United States Patent
Guo et al.

(10) Patent No.: US 9,012,723 B2
(45) Date of Patent: Apr. 21, 2015

(54) ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS

(75) Inventors: Liang Guo, St. Louis, MO (US); David K. Kovalic, Clayton, MO (US); Bo-Xing Qiu, Chesterfield, MO (US); Jack E. Tabaska, O'Fallon, MO (US); Wei Wu, Chesterfield, MO (US)

(73) Assignee: Monsanto Technology LLC, St. Louis, MO (US)

( * ) Notice: Subject to any disclaimer, the term of this patent is extended or adjusted under 35 U.S.C. 154(b) by 729 days.

(21) Appl. No.: 13/138,181

(22) PCT Filed: Jan. 13, 2010

(86) PCT No.: PCT/US2010/020834
§ 371 (c)(1),
(2), (4) Date: Sep. 30, 2011

(87) PCT Pub. No.: WO2010/083179
PCT Pub. Date: Jul. 22, 2010

(65) Prior Publication Data
US 2012/0246748 A1    Sep. 27, 2012

Related U.S. Application Data

(60) Provisional application No. 61/205,230, filed on Jan. 16, 2009.

(51) Int. Cl.
*C12N 15/82* (2006.01)
*A01H 5/00* (2006.01)
*C12N 5/10* (2006.01)
*C12N 15/00* (2006.01)
*C07H 21/04* (2006.01)
*C07K 14/415* (2006.01)

(52) U.S. Cl.
CPC .......... *C07K 14/415* (2013.01); *C12N 15/8247* (2013.01); *C12N 15/8261* (2013.01)

(58) Field of Classification Search
None
See application file for complete search history.

(56) References Cited

U.S. PATENT DOCUMENTS

2007/0067865 A1*  3/2007  Kovalic et al. ................. 800/278

OTHER PUBLICATIONS

Guo Proc Natl Acad Sci 101 9205 2004.*
Whisstock_Q Rev Biophys_36_307_2003.*
International Search Report for PCT/US2010/020834 (forms 210 and 237); pp. 1-25.

* cited by examiner

*Primary Examiner* — Medina A Ibrahim
*Assistant Examiner* — Russell Boggs
(74) *Attorney, Agent, or Firm* — Lawrence M. Lavin, Jr.; David R. Marsh; Arnold & Porter LLP

(57) ABSTRACT

This disclosure provides purified nucleic acids and polypeptides. Also provided are transgenic plants, seeds, and plant cells containing DNA for expression of the proteins that are useful for imparting enhanced agronomic trait(s) to transgenic crop plants, methods of making such plants and methods of making agricultural commodity including seeds and hybrid seeds from such plants.

23 Claims, No Drawings

ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS

CROSS REFERENCE TO RELATED APPLICATIONS

This application is a national phase under 35 U.S.C. §371 of International Application No. PCT/US10/20834, filed on Jan. 13, 2010, which application claims benefit under 35 USC §119(e) of United States provisional application Ser. No. 61/205,230, filed on Jan. 16, 2009, which is incorporated herein by reference in its entirety.

INCORPORATION-BY-REFERENCE OF MATERIALS FILED ON COMPACT DISC

A sequence listing having the file name "38-21(56220)A-PCT_SeqListing.txt" was created on Jan. 7, 2010 and has 183,370 sequences and is herein incorporated by reference in its entirety. Per Box No. IX(g) of the PCT Request, form PCT/RO/101, the sequence listing will be filed separately on a physical data carrier, on the same day (Jan. 13, 2010), and in the form of an Annex C/ST.25 text file. The sequence listing will be sent to the Untied States Patent and Trademark Office by Express Mail No. EV736977070US.

TECHNICAL FIELD OF THE INVENTION

Disclosed herein are inventions in the field of plant genetics and developmental biology. More specifically, this invention provides novel compositions of corn DNA and peptide molecules. Also disclosed are plants comprising recombinant DNA providing one or more enhanced traits in a transgenic plant, including cells, seed, and pollen derived from such a plant, as well as methods of making and using such plant.

SUMMARY OF THE INVENTION

Certain embodiments of the disclosed invention provide recombinant DNA constructs having polynucleotides characterized by reference to SEQ ID NO: 1-91967 and the cognate proteins with amino acid sequences having reference to SEQ ID NO:91968-183370. The recombinant DNA constructs are used in aspects of the various embodiments of the invention to provide enhanced traits when stably integrated into the chromosomes and expressed in the nuclei of transgenic plants cells. In many aspects of these embodiments, the recombinant DNA constructs, when expressed in a plant cell, provide for expression of cognate proteins. In particular aspects of the invention the recombinant DNA constructs for expressing cognate proteins are characterized by cognate amino acid sequence that have at least 95% identity over at least 95% of the length of a reference sequence selected from the group consisting of SEQ ID NOs: 91968-183370 when the amino acid sequence is aligned to the reference sequence. In some aspects of the invention, the recombinant DNA constructs are characterized as being constructed with sense-oriented and/or anti-sense-oriented polynucleotides from the group consisting of SEQ ID NOs: 1-91967 which, when expressed in a plant cell, provide for the suppression of cognate proteins having amino acid sequences that have at least 95% identity over at least 95% of the length of a reference sequence selected from the group consisting of SEQ ID NOs: 91968-183370.

In certain aspects of this invention the recombinant DNA constructs of the invention are stably integrated into the chromosome of a plant cell nucleus.

Certain aspects of this embodiment of the invention provide transgenic plant cells having stably integrated recombinant DNA constructs, transgenic plants and seeds comprising a plurality of such transgenic plant cells and transgenic pollen of such plants. Such transgenic plants can be selected from a population of transgenic plants regenerated from plant cells transformed with recombinant DNA constructs by screening transgenic plants for an enhanced trait as compared to control plants. The enhanced trait provided may include, but is not limited to, enhanced water use efficiency, enhanced cold tolerance, increased yield, enhanced nitrogen use efficiency, altered seed protein composition, altered seed oil composition, or any combinations thereof.

Other embodiments of the invention provide for plant cells, plants, seeds, and pollen that can further comprise DNA expressing a protein that provides tolerance from exposure to an herbicide applied at levels that are lethal to a wild type plant cell.

Embodiments of the invention also provide methods for manufacturing non-natural, transgenic seed that can be used to produce a crop of transgenic plants with an enhanced trait resulting from expression of a stably-integrated recombinant DNA construct. The methods may comprise one or more of the following steps: (a) screening a population of plants for an enhanced trait and a recombinant DNA construct, where individual plants in the population can exhibit the trait at a level less than, essentially the same as or greater than the level that the trait is exhibited in control plants, (b) selecting from the population one or more plants that exhibit the trait at a level greater than the level that said trait is exhibited in control plants, (c) collecting seed from a selected plant, (d) verifying that the recombinant DNA is stably integrated in said selected plants, (e) analyzing tissue of a selected plant to determine the production or suppression of a protein having the function of a protein encoded by nucleotides in at least one sequence selected from SEQ ID NOs: 1-91967 or their complete complement thereof. In certain embodiments of the invention, the plants in the population further include DNA expressing a protein that provides tolerance to exposure to a herbicide applied at levels that are lethal to wild type plant cells and the selecting is affected by treating the population with the herbicide, e.g. a glyphosate, dicamba, or glufosinate compound. In another embodiment of the invention, the plants are selected by identifying plants with the enhanced trait. The methods can be used for the manufacturing corn, soybean, cotton, canola, alfalfa, wheat, rice, sugarcane or sugar beet seed. In other embodiments of the present invention, the methods can also be used for manufacture transgenic plants including, but are not limited to, millet, barley, peanut, pigeon pea, sorghum, vegetables (including but not limited to Broccoli, Cauliflower, Cabbage, Radish, Chinese cabbage, Melons, Watermelons, Cucumber, Gourds, Pumpkin, Squash, Pepper, Tomato, Eggplant, Onion, Carrot, Garden Bean, Sweet Corn, Pea, Dry Bean, Okra, Spinach, Leek, Lettuce, and Fennel), grape, berries (including blue, black, raspberry, mullberry, boisenberry, etc), cherry and related fruit trees (including but not limited to plum, peach, apricot, kiwi, pomegranate, mango, fig), fruit trees (including but not limited to orange, lemon, lime, blood orange, grapefruit, and the like), and nut trees (including but not limited to coconut, walnut (English and black), pecan, almond, hazelnut, brazil nut, hickory nut, acorn, and the like) and sunflower, other oilseed producing plants or any combinations thereof.

Other embodiments of the invention provide a methods for producing hybrid corn seed by acquiring hybrid corn seed from a herbicide tolerant corn plant which also has stably-integrated, recombinant DNA construct having a promoter that is (a) functional in plant cells and (b) is operably linked to DNA that encodes or suppresses a protein having the function of a protein encoded by nucleotides in at least one sequence selected from the group consisting of SEQ ID NOs: 1-91967. The methods of these embodiments may further include producing corn plants from said hybrid corn seed, wherein a fraction of the plants produced from said hybrid corn seed is homozygous for said recombinant DNA, a fraction of the plants produced from said hybrid corn seed is hemizygous for said recombinant DNA, and a fraction of the plants produced from said hybrid corn seed has none of said recombinant DNA; selecting corn plants which are homozygous and hemizygous for said recombinant DNA by treating with an herbicide; collecting seed from herbicide-treated-surviving corn plants and planting said seed to produce further progeny corn plants; repeating the selecting and collecting steps at least once to produce an inbred corn line; and crossing the inbred corn line with a second corn line to produce hybrid seed.

Other embodiments of the invention provide methods for selecting a plant comprising plant cells of the invention by using an immunoreactive antibody to detect the presence or absence of protein expressed or suppressed by recombinant DNA in seed or plant tissue. Another embodiment of the invention provides anti-counterfeit milled seed having, as an indication of origin, plant cells of this invention.

Still other embodiments of this invention provide for transgenic plants with enhanced water use efficiency or enhanced nitrogen use efficiency. For example, this invention provides methods of growing a corn, cotton, soybean, or canola crop without irrigation water by planting seed having plant cells of the invention which are selected for enhanced water use efficiency. Alternatively embodiments of these methods include applying reduced irrigation water, e.g. providing up to 300 millimeters of ground water during the production of a corn crop. This invention also provides methods of growing a corn, cotton, soybean or canola crop without added nitrogen fertilizer by planting seed having plant cells of the invention which are selected for enhanced nitrogen use efficiency.

Other embodiments of the invention provide mixtures comprising plants cells and an antibody to a protein produced in the cells where the protein has an amino acid sequence that has at least 90% identity over at least 90% of the length of a reference sequence selected from the group consisting of SEQ ID NO: 91968-183370 when the sequence is aligned to the reference sequence.

In another aspect, the present invention includes a mixture having plant cells, and an antibody to a protein produced in said cells wherein said protein has an amino acid sequence that has at least 95% identity over at least 95% of the length of a reference sequence selected from the group consisting of SEQ ID NO: 91968-183370 when said amino acid sequence is aligned to said reference sequence.

In another aspect, the present invention includes a mixture having plant cells, and an antibody to a protein produced in said cells wherein said protein has an amino acid sequence that has at least 98% identity over at least 98% of the length of a reference sequence selected from the group consisting of SEQ ID NO: 91968-183370 when said amino acid sequence is aligned to said reference sequence.

In another aspect, the present invention includes a mixture having plant cells, and an antibody to a protein produced in said cells wherein said protein has an amino acid sequence that has at least 99% identity over at least 99% of the length of a reference sequence selected from the group consisting of SEQ ID NO: 91968-183370 when said amino acid sequence is aligned to said reference sequence.

In another aspect, the present invention includes a mixture having plant cells, and an antibody to a protein produced in said cells wherein said protein has an amino acid sequence that has at least 99.5% identity over at least 99.5% of the length of a reference sequence selected from the group consisting of SEQ ID NO: 91968-183370 when said amino acid sequence is aligned to said reference sequence.

Yet another aspect of the present invention includes a transgenic plant cell with stably integrated, recombinant DNA comprising a promoter that is functional in plant cells and that is operably linked to DNA from a plant, bacteria or yeast that encodes a protein having at least 90% sequence identity selected from the group consisting of SEQ ID NO: 91968-183370; wherein said plant cell is selected from a population of plant with said recombinant DNA by screening plants that are regenerated from plant cells in said population and that express said protein for an enhanced trait as compared to control plants that do not have said recombinant DNA; and wherein said enhanced trait includes, but are not limited to, enhanced water use efficiency, enhanced cold tolerance, increased yield, enhanced nitrogen use efficiency, enhanced seed protein or enhanced seed oil.

ILLUSTRATIVE EMBODIMENTS OF THE INVENTION

While the making and using of various embodiments of the present invention are discussed in detail below, it should be appreciated that the present invention provides many applicable inventive concepts that can be embodied in a wide variety of specific contexts. The specific embodiments discussed herein are merely illustrative of specific ways to make and use the invention and do not delimit the scope of the invention.

To facilitate the understanding of this invention, a number of terms are defined below. Terms defined herein have meanings as commonly understood by a person of ordinary skill in the areas relevant to the present invention. Terms such as "a", "an" and "the" are not intended to refer to only a singular entity, but include the general class of which a specific example may be used for illustration. The terminology herein is used to describe specific embodiments of the invention, but their usage does not delimit the invention, except as outlined in the claims.

In the Attached Sequence Listing:

SEQ ID NO:1-91967 are nucleotide sequences of the coding strand of DNA for "genes" used in the recombinant DNA imparting an enhanced trait in plant cells, e.g. each comprises a coding sequence for a protein;

SEQ ID NO: 91968-183370 are amino acid sequences of the cognate protein of the "genes" with nucleotide coding sequences provided by SEQ ID NO: 1-91967;

As used herein, a "plant cell" means a plant cell that is transformed with stably-integrated, non-natural, recombinant DNA, e.g. by *Agrobacterium*-mediated transformation or by bombardment using microparticles coated with recombinant DNA or other means. A plant cell of this invention can be an originally-transformed plant cell that exists as a microorganism or as a progeny plant cell that is duplicated by regeneration into differentiated tissue, e.g. into a transgenic plant with stably-integrated, non-natural recombinant DNA, or seed or pollen derived from a progeny transgenic plant.

As used herein, a "transgenic plant" means a plant whose genome has been altered by the stable integration of recombinant DNA. A transgenic plant includes a plant regenerated from an originally-transformed plant cell and progeny transgenic plants from later generations or crosses of a transformed plant.

A "consensus amino acid sequence" means an artificial, amino acid sequence indicating conserved amino acids in the sequence of homologous proteins as determined by statistical analysis of an optimal alignment, e.g. CLUSTALW, of amino acid sequence of homolog proteins. The consensus sequences listed in the sequence listing were created by identifying the most frequent amino acid at each position in a set of aligned protein sequences. When there was 100% identity in an alignment the amino acid is indicated by a capital letter. When the occurrence of an amino acid is at least about 70% in an alignment, the amino acid is indicated by a lower case letter. When there is no amino acid occurrence of at least about 70%, e.g. due to diversity or gaps, the amino acid is indicated by an "x". When used to defined embodiments of the invention, a consensus amino acid sequence will be aligned with a query protein amino acid sequence in an optimal alignment, e.g. CLUSTALW. An embodiment of the invention will have identity to the conserved amino acids indicated in the consensus amino acid sequence.

As used herein, "control plant" means a plant that does not contain the recombinant DNA that expressed a protein which imparts an enhanced trait. A control plant is to identify and select a transgenic plant that has an enhance trait. A suitable control plant can be a non-transgenic plant of the parental line used to generate a transgenic plant, e.g., devoid of recombinant DNA. A suitable control plant can in some cases be a progeny of a hemizygous transgenic plant line that is does not contain the recombinant DNA, known as a negative segregant.

As used herein, an "enhanced trait" means a characteristic of a transgenic plant that includes, but is not limited to, an enhance agronomic trait characterized by enhanced plant morphology, physiology, growth and development, yield, nutritional enhancement, disease or pest resistance, or environmental or chemical tolerance. In more specific aspects of this invention enhanced trait is selected from group of enhanced traits consisting of enhanced water use efficiency, enhanced cold tolerance, increased yield, enhanced nitrogen use efficiency, enhanced seed protein and enhanced seed oil. In an important aspect of the invention the enhanced trait is enhanced yield including increased yield under non-stress conditions and increased yield under environmental stress conditions. Stress conditions can include, for example, drought, shade, fungal disease, viral disease, bacterial disease, insect infestation, nematode infestation, cold temperature exposure, heat exposure, osmotic stress, reduced nitrogen nutrient availability, reduced phosphorus nutrient availability and high plant density. "Yield" can be affected by many properties including without limitation, plant height, pod number, pod position on the plant, number of internodes, incidence of pod shatter, grain size, efficiency of nodulation and nitrogen fixation, efficiency of nutrient assimilation, resistance to biotic and abiotic stress, carbon assimilation, plant architecture, resistance to lodging, percent seed germination, seedling vigor, and juvenile traits. Yield can also be affected by efficiency of germination (including germination in stressed conditions), growth rate (including growth rate in stressed conditions), ear number, seed number per ear, seed size, composition of seed (starch, oil, protein) and characteristics of seed fill.

Increased yield of a transgenic plant of the present invention can be measured in a number of ways, including test weight, seed number per plant, seed weight, seed number per unit area (e.g., seeds, or weight of seeds, per acre), bushels per acre, tonnes per acre, tons per acre, kilo per hectare. For example, maize yield can be measured as production of shelled corn kernels per unit of production area in bushels per acre or metric tons per hectare, often reported on a moisture adjusted basis at about 15.5 percent moisture. Increased yield can result from improved utilization of key biochemical compounds such as nitrogen, phosphorous and carbohydrate, or from improved responses to environmental stresses, such as cold, heat, drought, salt, and attack by pests or pathogens. Recombinant DNA used in this invention can also be used to provide plants having improved growth and development, and ultimately increased yield, as the result of modified expression of plant growth regulators or modification of cell cycle or photosynthesis pathways. Also of interest is the generation of transgenic plants that demonstrate enhanced yield with respect to a seed component that can correspond to an increase in overall plant yield. Such properties include enhancements in seed oil, seed molecules such as tocopherol, protein and starch, or oil, particular oil components as can be manifest by alterations in the ratios of seed components.

Seed according to the present invention may be planted, grown and harvested to produce a crop or terminal crop. As used herein, a "crop" is a plant or plant product that is grown and harvested, such plant or plant product including but not limited to plants or plant parts such as leaf, root, shoot, fruit, seed, grain, or the like. A "terminal crop" is a crop grown for uses other than for use as planting seed to produce subsequent generations of plants. In some crop plants, such as grain produced from hybrid corn, the crop is not very suitable for planting because it does not breed true and the crop can then be conveniently referred to as "hybrid grain." In other crop plants, where the crop does breed true, such as soybean, whether a crop is planting seed or a terminal crop will depend on the uses and marketing channels of the crop. If used or marketed for planting, it will be a crop of planting seed; if used or marketed for other purposes it will be a terminal crop.

As used herein, "exogenous promoter region" refers to a sequence, capable of promoting mRNA transcription, that does not naturally occur in the plant at the same site and/or linked to the nucleic acids. The promoter can be from a different plant species or it can be from the same plant species, but naturally found in a different location in a non-genetically modified plant. Moreover, the promoter region can be found in the same genetic locus as is present a native plant, but linked to different sequence(s), than are native.

As used herein, "promoter" means regulatory DNA for initializing transcription. A "plant promoter" is a promoter capable of initiating transcription in plant cells whether or not its origin is a plant cell, e.g. is it well known that *Agrobacterium* promoters are functional in plant cells. Thus, plant promoters include promoter DNA obtained from plants, plant viruses and bacteria such as *Agrobacterium* and *Bradyrhizobium* bacteria. Examples of promoters under developmental control include promoters that preferentially initiate transcription in certain tissues, such as leaves, roots, or seeds. Such promoters are referred to as "tissue preferred". Promoters that initiate transcription only in certain tissues are referred to as "tissue specific". A "cell type" specific promoter primarily drives expression in certain cell types in one or more organs, for example, vascular cells in roots or leaves. An "inducible" or "repressible" promoter is a promoter which is under environmental control. Examples of environmental conditions that can effect transcription by inducible promoters include anaerobic conditions, or certain chemicals, or the presence of light. Tissue specific, tissue preferred, cell-type specific, and inducible promoters constitute the class of "nonconstitutive" promoters. A "constitutive" promoter is a promoter which is active under most conditions.

As used herein, a "functional fragment" refers to a portion of a polypeptide provided herein which retains full or partial molecular, physiological or biochemical function of the full length polypeptide. A functional fragment often contains the domain(s), such as Pfam domain, identified in the polypeptide provided in the sequence listing. In some embodiment, a function fragment includes at least 1, 2, 3, 4, 5 or more starting coding codons and at least 1, 2, 3, 4, 5 or more stop codons.

Embodiments of the invention provide molecules of that include "fragments" of the disclosed recombinant DNA molecules; including oligonucleotides of at least 15, at least 16 or 17, at least 18 or 19, and at least 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more, consecutive nucleotides of any of the sequences provided. Such oligonucleotides are fragments of the larger molecules having a sequence selected from the group consisting of SEQ ID NO: 1 through SEQ ID NO: 91967, and find use, for example as probes and primers for detection of the polynucleotides of the present invention. Alternatively, these fragments can be used as RNAi for gene suppression purposes. In some embodiments, a fragment can contain one or more coding region. In another embodiment, a fragment can include non-coding regions only.

Aspects of the various embodiments of the invention also provide for nucleic acid fragments of SEQ ID NO: 1 through SEQ ID NO: 91967 that are at least about 125, 150, 175, 200, 225, 250, 300, 325, 350, 375, 400, 425, 450, 475, 500, 525, 550, 575, 600, 625, 650, 675, 700, 725, 750, 775, 800, 825, 850, 875, 900, 925, 950, 975, 1000, 1050, 1100, 1150, 1200, 1250, 1300, 1350, 1400, 1450, 1500, 1550, 1600, 1650, 1700, 1750, 1800, 1850, 1900, 1950, 2000, 2050, 2100, 2150, 2200, 2250, 2300, 2350, 2400, 2450, 2500, 2550, 2600, 2650, 2700, 2750, 2800, 2850, 2900, 2950, 3000 or more nucleotides in length. Some aspects of these embodiments provide for nucleic acid fragment molecules that encode functional fragment of any of the polypeptide sequences provided in SEQ ID NO: 91968 to SEQ ID NO: 183370.

Other embodiments of the present invention provide for one or more polypeptides having at least about 10 contiguous peptide residues of one or more of the peptide sequences provided in SEQ ID NO: 91968 to SEQ ID NO: 183370. In other aspects of these embodiment, the polypeptide(s) comprises at least 15, 20, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 205, 210, 215, 220, 225, 230, 235, 240, 245, 250, 255, 260, 265, 270, 275, 280, 285, 290, 295, 300, 305, 310, 315, 320, 325, 330, 335, 340, 345, 350, 355, 360, 365, 370, 375, 380, 385, 390, 395, 400, 405, 410, 415, 420, 425, 430, 435, 440, 445, 450, 455, 460, 465, 470, 475, 480, 485, 490, 495, 500, 525, 550, 575, 600, 625, 650, 675, 700, 750, 800, 850, 900, 950, 1000 or more contiguous peptide residues from one or more of the sequences provided in SEQ ID NO: 91968 to SEQ ID NO: 183370. In particularly aspects, these embodiments the poly peptide includes a functional fragment of one or more of the polypeptides provided in the Sequence Listing.

The present invention also provides substantial, credible, and specific utility of each nucleic acid and amino acid molecules disclosed in the sequence listing. For example, SEQ ID No. 163320 is annotated as nitric-oxide synthase in the sequence listing. This correlation indicates SEQ ID No. 163320 has substantial, credible, and specific utility.

As used herein, "expressed" means produced, e.g. a protein is expressed in a plant cell when its cognate DNA is transcribed to mRNA that is translated to the protein.

As used herein, an "expression cassette of a DNA construct" is capable of integrating in a plant genome, expressing a functional polypeptide and providing a transgenic plant expressing polypeptides of the invention.

As used herein, "suppressed" means decreased, e.g. a protein is suppressed in a plant cell when there is a decrease in the amount and/or activity of the protein in the plant cell. The presence or activity of the protein can be decreased by any amount up to and including a total loss of protein expression and/or activity.

As used herein, a "functional fragment" refers to a portion of a polypeptide provided herein which retains full or partial molecular, physiological or biochemical function of the full length polypeptide. A functional fragment often contains the domain(s), such as Pfam domain, identified in the polypeptide provided in the sequence listing.

As used herein, a "homolog" means a protein in a group of proteins that perform the same biological function, e.g. proteins that belong to the same Pfam protein family and that provide a common enhanced trait in transgenic plants of this invention. Homologs are expressed by homologous genes. With reference to homologous genes, homologs include orthologs, e.g., genes expressed in different species that evolved from a common ancestral genes by speciation and encode proteins retain the same function, but do not include paralogs, e.g., genes that are related by duplication but have evolved to encode proteins with different functions. Homologous genes include naturally occurring alleles and artificially-created variants. Degeneracy of the genetic code provides the possibility to substitute at least one base of the protein encoding sequence of a gene with a different base without causing the amino acid sequence of the polypeptide produced from the gene to be changed. When optimally aligned, homolog proteins have typically at least about 60% identity, in some instances at least about 70%, at least about 75%, at least about bout 80%, about 85%, at least about 90%, at least about bout 92%, at least about bout 94%, at least about bout 95%, at least about 96%, at least about 97%, at least about 98%, at least about 99%, and even at least about 99.5% identity over the full length of a protein identified as being associated with imparting an enhanced trait when expressed in plant cells. In one aspect of the invention homolog proteins have an amino acid sequence that has at least about 80%, at least about 85%, at least about 90%, at least about 92.5%, at least about 95%, at least about 96%, at least about 97%, at least about 98%, at least about 99%, and at least about 99.5% identity to a consensus amino acid sequence of proteins and homologs that can be build from sequences disclosed herein.

Homologs can be identified by comparison of amino acid sequence, e.g. manually or by use of a computer-based tool using known homology-based search algorithms such as those commonly known and referred to as BLAST, FASTA, and Smith-Waterman. A local sequence alignment program, e.g. BLAST, can be used to search a database of sequences to find similar sequences, and the summary Expectation value (E-value) used to measure the sequence base similarity. Because a protein hit with the best E-value for a particular organism may not necessarily be an ortholog, e.g., have the same function, or be the only ortholog, a reciprocal query is used to filter hit sequences with significant E-values for ortholog identification. The reciprocal query entails search of the significant hits against a database of amino acid sequences from the base organism that are similar to the sequence of the query protein. A hit can be identified as an ortholog, when the reciprocal query's best hit is the query protein itself or a protein encoded by a duplicated gene after speciation. A further aspect of the homologs encoded by DNA useful in the transgenic plants of the invention are those proteins that differ from a disclosed protein as the result of deletion or insertion of one or more amino acids in a native sequence.

Other functional homolog proteins differ in one or more amino acids from those of a trait-improving protein disclosed herein as the result of one or more of the well-known conservative amino acid substitutions, e.g., valine is a conservative substitute for alanine and threonine is a conservative substitute for serine. Conservative substitutions for an amino acid within the native sequence can be selected from other members of a class to which the naturally occurring amino acid belongs. Representative amino acids within these various classes include, but are not limited to: (1) acidic (negatively charged) amino acids such as aspartic acid and glutamic acid; (2) basic (positively charged) amino acids such as arginine, histidine, and lysine; (3) neutral polar amino acids such as glycine, serine, threonine, cysteine, tyrosine, asparagine, and glutamine; and (4) neutral nonpolar (hydrophobic) amino acids such as alanine, leucine, isoleucine, valine, proline, phenylalanine, tryptophan, and methionine. Conserved substitutes for an amino acid within a native amino acid sequence can be selected from other members of the group to which the naturally occurring amino acid belongs. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Naturally conservative amino acids substitution groups are: valine-leucine, valine-isoleucine, phenylalanine-tyrosine, lysine-arginine, alanine-valine, aspartic acid-glutamic acid, and asparagine-glutamine. A further aspect of the invention includes proteins that differ in one or more amino acids from those of a described protein sequence as the result of deletion or insertion of one or more amino acids in a native sequence.

Genes that are homologous to each other can be grouped into families and included in multiple sequence alignments. Then a consensus sequence for each group can be derived. This analysis enables the derivation of conserved and class—(family) specific residues or motifs that are functionally important. These conserved residues and motifs can be further validated with 3D protein structure if available. The consensus sequence can be used to define the full scope of the invention, e.g., to identify proteins with a homolog relationship. Thus, the present invention contemplates that protein homologs include proteins with an amino acid sequence that has at least 90% identity to such a consensus amino acid sequence sequences.

As used herein, "operably linked" refers to the association of two or more nucleic acid elements in a recombinant DNA construct, e.g. as when a promoter is operably linked with DNA that is transcribed to RNA whether for expressing or suppressing a protein. Recombinant DNA constructs can be designed to express a protein which can be an endogenous protein, an exogenous homologue of an endogenous protein or an exogenous protein with no native homologue. Alternatively, recombinant DNA constructs can be designed to suppress the level of an endogenous protein, e.g. by suppression of the native gene. Such gene suppression can be effectively employed through a native RNA interference (RNAi) mechanism in which recombinant DNA comprises both sense and anti-sense oriented DNA matched to the gene targeted for suppression where the recombinant DNA is transcribed into RNA that can form a double-strand to initiate an RNAi mechanism. Gene suppression can also be effected by recombinant DNA that comprises anti-sense oriented DNA matched to the gene targeted for suppression. Gene suppression can also be effected by recombinant DNA that comprises DNA that is transcribed to a microRNA matched to the gene targeted for suppression. In the examples illustrating the invention recombinant DNA for effecting gene suppression that imparts is identified by the term "antisense". It will be understood by a person of ordinary skill in the art that any of the ways of effecting gene suppression are contemplated and enabled by a showing of one approach to gene suppression.

As used herein, "percent identity" means the extent to which two optimally aligned DNA or protein segments are invariant throughout a window of alignment of components, for example nucleotide sequence or amino acid sequence. An "identity fraction" for aligned segments of a test sequence and a reference sequence is the number of identical components that are shared by sequences of the two aligned segments divided by the total number of sequence components in the reference segment over a window of alignment which is the smaller of the full test sequence or the full reference sequence. "Percent identity" ("% identity") is the identity fraction times 100. Such optimal alignment is understood to be deemed as local alignment of DNA sequences. For protein alignment, a local alignment of protein sequences should allow introduction of gaps to achieve optimal alignment. Percent identity is calculated over the aligned length not including the gaps introduced by the alignment per se.

As used herein, a "plant by-product" includes any product that is made from a plant or plant product, for example, by dehulling, crushing, milling, extraction, hydrogenation, and other processes. A plant by-products in accordance with the invention, therefore, will include such as, for example, dehulled soybeans, crushed corn, soybean meal, soy milk, paper made from corn stalks, and a wide range of other useful products of processing based on plant vitamins, minerals, lipids, proteins and carbohydrates and their constituents that can be characterized as being produced from crops or terminal crops in accordance with the invention.

As used herein, a "plant cell" means a plant cell that is transformed with stably-integrated, recombinant DNA, e.g. by *Agrobacterium*-mediated transformation or by bombardment using microparticles coated with recombinant DNA or other means. A plant cell of this invention can be an originally-transformed plant cell that exists as a microorganism or as a progeny plant cell that is regenerated into differentiated tissue, e.g.

into a transgenic plant with stably-integrated, non-natural recombinant DNA, or seed or pollen derived from a progeny transgenic plant.

As used herein, the term "polypeptide" or "polypeptide molecule" means a chain of amino acids. Polypeptide is also commonly referred as "protein".

As used herein, "polyadenylated ribonucleotides" refers to the series of adenosines at the 3' end of a polyribonucleotide commonly referred to as a "poly-A tail".

As used herein, "recombinant DNA" means DNA which has been genetically engineered and constructed outside of a cell including DNA containing naturally occurring DNA or cDNA or synthetic DNA.

As used herein, the term "structural nucleic acid molecule" refers to a molecule having sequence that encodes a protein, functional peptide fragment, or any other molecule that has biological activity (including, but not limited to, mRNA and bioactive RNA molecules, including antisense RNA).

As used herein, the term "substantially purified nucleic acid" or polypeptide means nucleic acid or protein separated from substantially all other molecules normally associated with it in its native state. A substantially purified nucleic acid can be greater than about 60% free from the other molecules (exclusive of solvent) present in the natural mixture. The term "substantially purified" is not intended to encompass molecules present in their native state.

"Pfam" database is a large collection of multiple sequence alignments and hidden Markov models covering many common protein families, e.g. Pfam version 19.0 (December 2005) contains alignments and models for 8183 protein families and is based on the Swissprot 47.0 and SP-TrEMBL 30.0 protein sequence databases. See S. R. Eddy, "Profile Hidden Markov Models", *Bioinformatics* 14:755-763, 1998. The Pfam database is currently maintained and updated by the Pfam Consortium. The alignments represent some evolutionary conserved structure that has implications for the protein's function. Profile hidden Markov models (profile HMMs) built from the protein family alignments are useful for automatically recognizing that a new protein belongs to an existing protein family even if the homology by alignment appears to be low.

The modulation of protein in transgenic plant cells (hereafter generally referred to as the "target protein") can be achieved by a variety of approaches involving the use of recombinant DNA constructs. Examples of such recombinant DNA constructs include recombinant DNA constructs that produce messenger RNA for the target protein where native miRNA recognition sites in the mRNA for the target protein are modified or deleted, recombinant DNA constructs that produce an RNA gene suppression element such as a miRNA or a dsRNA comprising sense and anti-sense sequences from the gene encoding the target protein, recombinant DNA constructs that produce a transacting short interfering RNA (ta-siRNA) and recombinant DNA constructs that produce a miRNA element such as a decoy miRNA that is a target for native miRNA or RNA that sequesters target messenger RNA away from native miRNA.

Small RNAs that regulate protein expression include miRNAs and ta-siRNAs. A miRNA is a small (typically about 21 nucleotide) RNA that has the ability to modulate the expression of a target gene by binding to messenger RNA for the target protein leading to destabilization of the target protein messenger RNA or translational inhibition of the target protein messenger RNA, ultimately resulting in reduction of the target protein. The design and construction of ta-siRNA constructs and their use in the modulation of protein in transgenic plant cells is disclosed by Allen and Carrington in US Patent Application Publication US 2006/0174380 A1 which is incorporated herein by reference. The expression or suppression of such small RNAs are aspects of the invention that are conveniently illustrated by reference to use of miRNAs.

Recombinant DNA constructs can be used to modify the activity of native miRNAs by a variety of means. By increasing the expression of a miRNA, e.g. temporally or spatially, the modulation of expression of a native target gene can be enhanced. An alternative gene suppression approach for suppressing the expression of a target protein can include the use of a recombinant DNA construct that produces a synthetic miRNA that is designed to bind to a native or synthetic miRNA recognition site on messenger RNA for the target protein.

By reducing the expression of a miRNA, the modulation of a native target gene can be diminished resulting in enhanced expression of the target protein. More specifically, the expression of a target protein can be enhanced by suppression of the activity of the miRNA that binds to a recognition site in the messenger RNA that is transcribed from the native gene for the target protein. Several types of recombinant DNA constructs can be designed to suppress the activity of a miRNA.

For example, a recombinant DNA construct that produces an abundance of RNA with the miRNA recognition site can be used as a decoy for the native miRNA allowing endogenous messenger RNA with the miRNA recognition site to be translated to the target protein without interference from native miRNA. A recombinant DNA construct that produces RNA with a modified miRNA recognition site, e.g. with nucleotides at positions 10 and/or 11 in a 21mer miRNA recognition site which are unpaired with respect to the native miRNA, can be used to sequester natively expressed miRNA thereby reducing the cleavage that normally occurs when miRNA binds to a recognition site. The unpaired nucleotides can be produced e.g. through additional nucleotides between positions 10 and 11 or through substitutions of the nucleotides at positions 10 and 11.

Additionally, a recombinant DNA construct can be created that produces RNA that can be processed in plants into synthetic small RNA (miRNA-like) that can bind endogenous miRNA recognition sites but is unable to induce cleavage of mRNA because the small RNA is modified, for instance by having a modified nucleotide at positions 10 and/or 11 or a deletion that produces a bulge between positions 10 and 11 when the small RNA is paired with the miRNA recognition site. The resulting synthetic small RNA, a cleavage blocker, can reduce endogenous miRNA binding and thus block cleavage of a protected miRNA target site enhancing the expression of a target protein.

A recombinant DNA construct designed for producing a modified messenger RNA for the protein where the native miRNA recognition site is modified to be resistant to the binding of cognate miRNA which regulates the native gene can also be used to express protein from heterologous messenger RNA that is no longer modulated by the native miRNA.

The activity of a miRNA which down-regulates an endogenous protein is enhanced by enhancing the expression of the miRNA or by enhancing the ability of the miRNA to bind an RNA encoding the target protein. A recombinant DNA encoding an RNA encoding the miRNA or a miRNA-sensitive messenger RNA encoding the protein in which a miRNA binding site is added are designed to enhance miRNA activity resulting in enhanced suppression of the target mRNA and cognate protein. Recombinant DNA encoding an RNA encoding a miRNA, or a miRNA-sensitive RNA are designed using methods disclosed in U.S. Patent Application Publication U.S. 2009/0070898 A1.

Some, if not many, miRNAs modulate the expression of multiple proteins or biochemical pathways. Transgenic plants can be provided with enhanced traits not so much from the suppression or enhancement of the expression of a particular protein, as from change of enzyme activity in a pathway by modulating the level of a miRNA. Thus, aspects of this invention are achieved by enhanced miRNA activity resulting from use in transgenic plant cells of recombinant DNA constructs that produce an enhanced level of a miRNA. Other aspects of this invention are achieved by reduced miRNA activity resulting from use in transgenic plant cells of recombinant DNA constructs that produce a reduced level or activity of a miRNA.

Recombinant DNA Constructs

Recombinant DNA constructs are assembled using methods well known to persons of ordinary skill in the art and typically comprise a promoter operably linked to DNA, the expression of which provides the enhanced agronomic trait. Other construct components can include additional regulatory elements, such as 5' leaders and introns for enhancing transcription, 3' untranslated regions (such as polyadenylation signals and sites), DNA for transit or signal peptides.

Numerous promoters that are active in plant cells have been described in the literature. These include promoters present in plant genomes as well as promoters from other sources, including nopaline synthase (NOS) promoter and octopine synthase (OCS) promoters carried on tumor-inducing plasmids of *Agrobacterium tumefaciens* and the CaMV35S promoters from the cauliflower mosaic virus as disclosed in U.S. Pat. Nos. 5,164, 316 and 5,322,938. Useful promoters derived from plant genes are found in U.S. Pat. No. 5,641,876 which discloses a rice actin promoter, U.S. Pat. No. 7,151,204 which discloses a maize chloroplast aldolase promoter and a maize aldolase (FDA) promoter, and U.S. Patent Application Publication 2003/0131377 A1 which discloses a maize nicotianamine synthase promoter. These and numerous other promoters that function in plant cells are known to those skilled in the art and available for use in recombinant polynucleotides of the present invention to provide for expression of desired genes in transgenic plant cells.

Furthermore, the promoters can be altered to contain multiple "enhancer sequences" to assist in elevating gene expression. Such enhancers are known in the art. By including an enhancer sequence with such constructs, the expression of the selected protein can be enhanced. These enhancers often are found 5' to the start of transcription in a promoter that functions in eukaryotic cells, but can often be inserted upstream (5') or downstream (3') to the coding sequence. In some instances, these 5' enhancing elements are introns. Particularly useful as enhancers are the 5' introns of the rice actin 1 (see U.S. Pat. No. 5,641,876) and rice actin 2 genes, the maize alcohol dehydrogenase gene intron, the maize heat shock protein 70 gene intron (U.S. Pat. No. 5,593,874) and the maize shrunken 1 gene. See also U.S. Patent Application Publication 2002/0192813A1 which discloses 5', 3' and intron elements useful in the design of effective plant expression vectors.

In other aspects of the invention, sufficient expression in plant seed tissues is desired to affect improvements in seed composition. Exemplary promoters for use for seed composition modification include promoters from seed genes such as napin as disclosed in U.S. Pat. No. 5,420,034, maize L3 oleosin as disclosed in U.S. Pat. No. 6,433,252), zein Z27 as disclosed by Russell et al. (1997) *Transgenic Res.* 6(2):157-166), globulin 1 as disclosed by Belanger et al (1991) *Genetics* 129:863-872), glutelin 1 as disclosed by Russell (1997) supra), and peroxiredoxin antioxidant (Per1) as disclosed by Stacy et al. (1996) *Plant Mol Biol.* 31(6):1205-1216.

Recombinant DNA constructs in this invention will generally include a 3' element that typically contains a polyadenylation signal and site. Well-known 3' elements include those from *Agrobacterium tumefaciens* genes such as nos 3', tml 3', tmr 3', tms 3', ocs 3', tr7 3', for example disclosed in U.S. Pat. No. 6,090,627; 3' elements from plant genes such as wheat (*Triticum aesevitum*) heat shock protein 17 (Hsp17 3'), a wheat ubiquitin gene, a wheat fructose-1,6-biphosphatase gene, a rice glutelin gene, a rice lactate dehydrogenase gene and a rice beta-tubulin gene, all of which are disclosed in U.S. Patent Application Publication No. 2002/0192813 A1; and the pea (*Pisum sativum*) ribulose biphosphate carboxylase gene (rbs 3'), and 3' elements from the genes within the host plant.

Constructs and vectors can also include a transit peptide for targeting of a gene to a plant organelle, particularly to a chloroplast, leucoplast or other plastid organelle. For descriptions of the use of chloroplast transit peptides see U.S. Pat. No. 5, 188,642 and U.S. Pat. No. 5,728,925. For description of the transit peptide region of an Arabidopsis EPSPS gene useful in the present invention, see Klee, H. J. et al (MGG (1987) 210:437-442).

Recombinant DNA constructs for gene suppression can be designed for any of a number the well-known methods for suppressing transcription of a gene, the accumulation of the mRNA corresponding to that gene or preventing translation of the transcript into protein. Posttranscriptional gene suppression can be practically effected by transcription of RNA that forms double-stranded RNA (dsRNA) having homology to mRNA produced from a gene targeted for suppression.

Gene suppression can also be achieved by insertion mutations created by transposable elements can also prevent gene function. For example, in many dicot plants, transformation with the T-DNA of *Agrobacterium* can be readily achieved and large numbers of transformants can be rapidly obtained. Also, some species have lines with active transposable elements that can efficiently be used for the generation of large numbers of insertion mutations, while some other species lack such options. Mutant plants produced by *Agrobacterium* or transposon mutagenesis and having altered expression of a polypeptide of interest can be identified using the polynucleotides of the present invention. For example, a large population of mutated plants can be screened with polynucleotides encoding the polypeptide of interest to detect mutated plants having an insertion in the gene encoding the polypeptide of interest.

Transgenic plants comprising or derived from plant cells of this invention transformed with recombinant DNA can be further enhanced with stacked traits, e.g. a crop plant having an enhanced trait resulting from expression of DNA disclosed herein in combination with other enhanced traits with various degree or amount of enhancement including, but not limited to enhanced water use efficiency, enhanced cold tolerance, increased yield, enhanced nitrogen use efficiency, enhanced seed protein and enhanced seed oil herbicide pest resistance traits, or any combinations thereof. For example, genes of the current invention can be stacked with other traits of agronomic interest, such as a trait providing herbicide resistance, or insect resistance, such as using a gene from *Bacillus thuringensis* to provide resistance against lepidopteran, coliopteran, homopteran, hemiopteran, and other insects. Herbicides for which transgenic plant tolerance has been demonstrated and the method of the present invention can be applied include, but are not limited to, glyphosate, dicamba, glufosinate, sulfonylurea, bromoxynil and norflurazon herbicides. Polynucleotide molecules encoding proteins involved in herbicide tolerance are well-known in the art and include, but are not limited to, a polynucleotide molecule encoding 5-enolpyruvylshikimate-3-phosphate synthase (EPSPS) disclosed in U.S. Pat. Nos. 5,094,945; 5,627,061; 5,633,435 and 6,040,497 for imparting glyphosate tolerance; polynucleotide molecules encoding a glyphosate oxidoreductase (GOX) disclosed in U.S. Pat. No. 5,463,175 and a glyphosate-N-acetyl transferase (GAT) disclosed in U.S. Patent Application Publication No. 2003/0083480 A1 also for imparting glyphosate tolerance; dicamba monooxygenase disclosed in U.S. Patent Application Publication No. 2003/0135879 A1 for imparting dicamba tolerance; a polynucleotide molecule encoding bromoxynil nitrilase (Bxn) disclosed in U.S. Pat. No. 4,810,648 for imparting bromoxynil tolerance; a polynucleotide molecule encoding phytoene desaturase (crtI) described in Misawa et al, (1993) *Plant J.* 4:833-840 and in Misawa et al, (1994) *Plant J.* 6:481-489 for norflurazon tolerance; a polynucleotide molecule encoding acetohydroxyacid synthase (AHAS, aka ALS) described in Sathasiivan et al. (1990) *Nucl. Acids Res.* 18:2188-2193 for imparting tolerance to sulfonylurea herbicides; polynucleotide molecules known as bar genes disclosed in DeBlock, et al. (1987) *EMBO J.* 6:2513-2519 for imparting glufosinate and bialaphos tolerance; polynucleotide molecules disclosed in U.S. Patent Application Publication No. 2003/010609 A1 for imparting N-amino methyl phosphonic acid tolerance; polynucleotide molecules disclosed in U.S. Pat. No. 6,107,549 for imparting pyridine herbicide resistance; molecules and methods for imparting tolerance to multiple herbicides such as glyphosate, atrazine, ALS inhibitors, isoxoflutole and glufosinate herbicides are disclosed in U.S. Pat. No. 6,376,754 and U.S. Patent Application Publication No. 2002/0112260. Molecules and methods for imparting insect/nematode/virus resistance are disclosed in U.S. Pat. Nos. 5,250,515; 5,880,275; 6,506,599; 5,986,175 and U.S. Patent Application Publication No. 2003/0150017 A1, each are herein incorporated by reference.

Another embodiment of the present invention provides methods for delivering transgenic crop plants comprising two or more genetic factors giving enhanced traits using haploid breeding approaches. One goal of transgenic trait integration is to deliver one or more transgenic traits to a inbred and the typical backcross process involved multiple generations with selection at each generation for the one or more transgenic traits coupled with selection for the elite inbred, referred to as the recurrent parent. As product concepts move to transgenic trait stacks, comprising two or more transgenic traits, the trait integration process becomes exponentially more complicated because an increasing number of progeny must be screened in order to recover progeny with both the transgenic traits and, as relevant, desired percent of the recurrent parent genome (i.e., 95% recurrent parent) and minimized percent of the donor parent genome (i.e., reduce linkage drag). The methods included herein provide an advantage over the art by reducing the time required to deliver a stacked transgenic trait hybrid to market as well as providing the potential for reducing the number of plots needed to generate an elite crop plant comprising two or more transgenic traits. These methods can be applied at any point in a breeding program, wherein the "recurrent" parent can be segregating. In other aspects, the recurrent parent comprises one or more genetic factors. Further, depending on the degree of segregating in the starting material, sister line generation can occur in parallel to trait integration. Examples of stacking two or more genetic factors using a haploid approach can be seen in U.S. Patent Application Publication No. 20090070891 and is herein incorporated by reference in its entirety.

Other aspects of the various embodiments of the invention includes, transgenic plants, transgenic plant seeds, transgenic crops, plant products and byproducts having any of the nucleic acid or protein fragments described above. The invention also provides for various methods that use such fragments.

Embodiments of the present invention also contemplate that the trait-improving recombinant DNA provided herein can be used in combination with other recombinant DNA to create plants with multiple desired traits or a further enhanced trait. The combinations generated can include multiple copies of any one or more of the recombinant DNA constructs. These stacked combinations can be created by any method, including but not limited to cross breeding of transgenic plants, or multiple genetic transformations.

DNA vectors containing gene(s) of interest or fragments of genes disclosed in the sequence listing can be delivered into plant cells via one of the several methods known to those skilled in the art, including but not limited to protoplast transformation, biolistic bombardment and *Agrobacterium*-mediated transformation. The delivered DNA can be integrated randomly into a plant genome or can also be present as part of the independently segregating genetic units such as artificial chromosome or mini-chromosome. One aspect of this embodiment, the construct further comprises regulatory sequences, including, for example, a promoter, operably linked to the sequence.

Plant Cell Transformation Methods

Numerous methods for transforming chromosomes in a plant cell nucleus with recombinant DNA are known in the art and are used in methods of preparing a transgenic plant cell nucleus cell, and plant. Two effective methods for such transformation are *Agrobacterium*-mediated transformation and microprojectile bombardment. Microprojectile bombardment methods are illustrated in U.S. Pat. Nos. 5,015,580 (soybean); 5,550,318 (corn); 5,538,880 (corn); 5,914,451 (soybean); 6,160,208 (corn); 6,399,861 (corn); 6,153,812 (wheat) and 6,365,807 (rice) and *Agrobacterium*-mediated transformation is described in U.S. Pat. Nos. 5,159,135 (cotton); 5,824,877 (soybean); 5,463,174 (canola); 5,591,616 (corn); 5,846,797 (cotton); 6,384,301 (soybean), 7,026,528 (wheat) and 6,329,571 (rice), U.S. Patent Application Publication 2004/0087030 A1 (cotton), and U.S. Patent Application Publication 2001/0042257 A1 (sugar beet), all of which are incorporated herein by reference for enabling the production of transgenic plants. Transformation of plant material is practiced in tissue culture on a nutrient media, e.g., a mixture of nutrients that will allow cells to grow in vitro. Recipient cell targets include, but are not limited to, meristem cells, hypocotyls, calli, immature embryos and gametic cells such as microspores, pollen, sperm and egg cells. Callus can be initiated from tissue sources including, but not limited to, immature embryos, hypocotyls, seedling apical meristems, microspores and the like. Cells containing a transgenic nucleus are grown into transgenic plants.

In addition to direct transformation of a plant material with a recombinant DNA, a transgenic plant cell nucleus can be prepared by crossing a first plant having cells with a transgenic nucleus with recombinant DNA with a second plant lacking the transgenic nucleus. For example, recombinant DNA can be introduced into a nucleus from a first plant line that is amenable to transformation to transgenic nucleus in cells that are grown into a transgenic plant which can be crossed with a second plant line to introgress the recombinant DNA into the second plant line. A transgenic plant with recombinant DNA providing an enhanced trait, e.g. enhanced yield, can be crossed with transgenic plant line having other recombinant DNA that confers another trait, for example herbicide resistance or pest resistance, to produce progeny plants having recombinant DNA that confers both traits. Typically, in such breeding for combining traits the transgenic plant donating the additional trait is a male line and the transgenic plant carrying the base traits is the female line. The progeny of this cross will segregate such that some of the plants will carry the DNA for both parental traits and some will carry DNA for one parental trait; such plants can be identified by markers associated with parental recombinant DNA, e.g. marker identification by analysis for recombinant DNA or, in the case where a selectable marker is linked to the recombinant, by application of the selecting agent such as a herbicide for use with a herbicide tolerance marker, or by selection for the enhanced trait. Progeny plants carrying DNA for both parental traits can be crossed back into the female parent line multiple times, for example usually 6 to 8 generations, to produce a progeny plant with substantially the same genotype as one original transgenic parental line but for the recombinant DNA of the other transgenic parental line.

In certain embodiments of the invention the recombinant DNA insertion is "targeted" in order to achieve site-specific integration, for example to replace an existing gene in the genome, to use an existing promoter in the plant genome, or to insert a recombinant polynucleotide at a predetermined site known to be active for gene expression. Several site specific recombination systems exist which are known to function implants include cre-lox as disclosed in U.S. Pat. No. 4,959,317 and FLP-FRT as disclosed in U.S. Pat. No. 5,527,695, both incorporated herein by reference.

Transformation methods of this invention can be practiced in tissue culture on media and in a controlled environment. "Media" refers to the numerous nutrient mixtures that are used to grow cells in vitro, that is, outside of the intact living organism. Recipient cell targets include, but are not limited to, meristem cells, callus, immature embryos and gametic cells such as microspores, pollen, sperm and egg cells. It is contemplated that any cell from which a fertile plant can be regenerated is useful as a recipient cell. Callus can be initiated from tissue sources including, but not limited to, immature embryos, seedling apical meristems, microspores and the like. Cells capable of proliferating as callus are also recipient cells for genetic transformation. Practical transformation methods and materials for making transgenic plants of this invention, for example, various media and recipient target cells, transformation of immature embryo cells and subsequent regeneration of fertile transgenic plants are disclosed in U.S. Pat. Nos. 6,194,636 and 6,232,526, which are incorporated herein by reference.

The seeds of transgenic plants can be harvested from fertile transgenic plants and be used to grow progeny generations of transformed plants of this invention including hybrid plants line for selection of plants having an enhanced trait. In addition to direct transformation of a plant with a recombinant DNA, transgenic plants can be prepared by crossing a first plant having a recombinant DNA with a second plant lacking the DNA. For example, recombinant DNA can be introduced into first plant line that is amenable to transformation to produce a transgenic plant which can be crossed with a second plant line to introgress the recombinant DNA into the second plant line. A transgenic plant with recombinant DNA providing an enhanced trait, e.g. enhanced yield, can be crossed with transgenic plant line having other recombinant DNA that confers another trait, for example herbicide resistance or pest resistance, to produce progeny plants having recombinant DNA that confers both traits. Typically, in such breeding for combining traits the transgenic plant donating the additional trait is a male line and the transgenic plant carrying the base traits is the female line. The progeny of this cross will segregate such that some of the plants will carry the DNA for both parental traits and some will carry DNA for one parental trait; such plants can be identified by markers associated with parental recombinant DNA, e.g. marker identification by analysis for recombinant DNA or, in the case where a selectable marker is linked to the recombinant, by application of the selecting agent such as a herbicide for use with a herbicide tolerance marker, or by selection for the enhanced trait. Progeny plants carrying DNA for both parental traits can be crossed back into the female parent line multiple times, for example usually 6 to 8 generations, to produce a progeny plant with substantially the same genotype as one original transgenic parental line but for the recombinant DNA of the other transgenic parental line.

Descriptions of commonly used breeding terms such as "crossing", "hybrids" and methods for crossing and producing hybrid that are used to describe present invention can be found in one of several reference books (Allard, "Principles of Plant Breeding," John Wiley & Sons, NY, U. of CA, Davis, C A, 50-98, 1960; *Simmonds*, "Principles of crop improvement," Longman, Inc., NY, 369-399, 1979; Sneep and Hendriksen, "Plant breeding perspectives," Wageningen (ed), *Center for Agricultural Publishing and Documentation*, 1979; Fehr, In: Soybeans: Improvement, Production and Uses, 2nd Edition, Monograph., 16:249, 1987; Fehr, "Principles of variety development," *Theory and Technique*, (Vol. 1) and *Crop Species Soybean* (Vol. 2), Iowa State Univ., Macmillan Pub. Co., NY, 360-376, 1987).

In some embodiments of the invention, during transformation, DNA is introduced into only a small percentage of target plant cells in any one transformation. Marker genes are used to provide an efficient system for identification of those cells that are stably transformed by receiving and integrating a transgenic DNA construct into their genomes. Marker genes provide selective markers which confer resistance to a selective agent, such as an antibiotic or herbicide. Any of the herbicides to which plants of this invention can be resistant are useful agents for selective markers. Potentially transformed cells are exposed to the selective agent. In the population of surviving cells will be those cells where, generally, the resistance-conferring gene is integrated and expressed at sufficient levels to permit cell survival. Cells can be tested further to confirm stable integration of the exogenous DNA. Commonly used selective marker genes include those conferring resistance to antibiotics such as kanamycin and paromomycin (nptII), hygromycin B (aph IV) and gentamycin (aac3 and aacC4) or resistance to herbicides such as glufosinate (bar or pat) and glyphosate (aroA or EPSPS). Examples of such selectable are illustrated in U.S. Pat. Nos. 5,550,318; 5,633,435; 5,780,708 and 6,118,047, all of which are incorporated herein by reference. Selectable markers which provide an ability to visually identify transformants can also be employed, for example, a gene expressing a colored or fluorescent protein such as a luciferase or green fluorescent protein (GFP) or a gene expressing a beta glucuronidase or uidA gene (GUS) for which various chromogenic substrates are known.

Plant cells that survive exposure to the selective agent, or plant cells that have been scored positive in a screening assay, can be cultured in regeneration media and allowed to mature into plants. Developing plantlets regenerated from transformed plant cells can be transferred to plant growth mix, and hardened off, for example, in an environmentally controlled chamber at about 85% relative humidity, 600 ppm $CO_2$, and 25-250 microeinsteins $m^{-2}s^{-1}$ of light, prior to transfer to a greenhouse or growth chamber for maturation. Plants are regenerated from about 6 weeks to 10 months after a transformant is identified, depending on the initial tissue. Plants can be pollinated using conventional plant breeding methods known to those of skill in the art and seed produced. The regenerated transformed plant or its progeny seed or plants can be tested for expression of the recombinant DNA and selected for the presence of enhanced agronomic trait.

Progeny can be recovered from transformed plants and tested for expression of the exogenous recombinant polynucleotide. Useful assays include, for example, "molecular biological" assays, such as Southern and Northern blotting and PCR; "biochemical" assays, such as detecting the presence of RNA, e.g., double stranded RNA, or a protein product, e.g., by immunological means (ELISAs and Western blots) or by enzymatic function; plant part assays, such as leaf or root assays; and also, by analyzing the phenotype of the whole regenerated plant.

Transgenic Plants and Seeds

Transgenic plants derived from the plant cells of this invention are grown to generate transgenic plants having an enhanced trait as compared to a control plant and produce transgenic seed and haploid pollen of this invention. Such plants with enhanced traits are identified by selection of transformed plants or progeny seed for the enhanced trait. For efficiency a selection method is designed to evaluate multiple transgenic plants (events) including the recombinant DNA, for example multiple plants from 2 to 20 or more transgenic events. Transgenic plants grown from transgenic seed provided herein demonstrate improved agronomic traits that contribute to increased yield or other trait that provides increased plant value, including, for example, improved seed quality. Of particular interest are plants having enhanced water use efficiency, enhanced cold tolerance, increased yield, enhanced nitrogen use efficiency, enhanced seed protein and enhanced seed oil. Transgenic plants of the present invention include, but are not limited to, corn, soybean, cotton, canola, alfalfa, wheat, rice, sugarcane, sugar beet seed, millet, barley, peanut, pigeon pea, sorghum, vegetables (including but not limited to Broccoli, Cauliflower, Cabbage, Radish, Chinese cabbage, Melons, Watermelons, Cucumber, Gourds, Pumpkin, Squash, Pepper, Tomato, Eggplant, Onion, Carrot, Garden Bean, Sweet Corn, Pea, Dry Bean, Okra, Spinach, Leek, Lettuce, and Fennel), grape, berries (including blue, black, raspberry, mullberry, boysenberry. . . etc), cherry and related fruit trees (including but not limited to plum, peach, apricot, kiwi, pomegranate, mango, fig), fruit trees (including but not limited to orange, lemon, lime, blood orange, grapefruit, and the like), nut trees (including but not limited to coconut, walnut (English and black), pecan, almond, hazelnut, brazil nut, hickory nut, acorn, and the like), sunflower, other oilseed producing plants or any combinations thereof.

Selection Methods for Transgenic Plants with Enhanced Agronomic Trait

Within a population of transgenic plants each regenerated from a plant cell having a nucleus with recombinant DNA many plants that survive to fertile transgenic plants that produce seeds and progeny plants may not exhibit an enhanced agronomic trait. Selection from such population is necessary to identify one or more transgenic plant cells having a transgenic nucleus that can provide plants with the enhanced trait. Transgenic plants having enhanced traits are selected from populations of plants regenerated or derived from plant cells transformed as described herein by evaluating the plants in a variety of assays to detect an enhanced trait. These assays also can take many forms including, but not limited to, direct screening for the trait in a greenhouse or field trial or by screening for a surrogate trait. Such analyses can be directed to detecting changes in the chemical composition, biomass, physiological properties, morphology of the plant. Changes in chemical compositions such as nutritional composition of grain can be detected by analysis of the seed composition and content of protein, free amino acids, oil, free fatty acids, starch or tocopherols. Changes in biomass characteristics can be made on greenhouse or field grown plants and can include plant height, stem diameter, root and shoot dry weights; and, for corn plants, ear length and diameter. Changes in physiological properties can be identified by evaluating responses to stress conditions, for example assays using imposed stress conditions such as water deficit, nitrogen deficiency, cold growing conditions, pathogen or insect attack or light deficiency, or increased plant density. Changes in morphology can be measured by visual observation of tendency of a transformed plant with an enhanced agronomic trait to also appear to be a normal plant as compared to changes toward bushy, taller, thicker, narrower leaves, striped leaves, knotted trait, chlorosis, albino, anthocyanin production, or altered tassels, ears or roots. Other selection properties include days to pollen shed, days to silking, leaf extension rate, chlorophyll content, leaf temperature, stand, seedling vigor, internode length, plant height, leaf number, leaf area, tittering, brace roots, stay green, stalk lodging, root lodging, plant health, barreness/prolificacy, green snap, and pest resistance. In addition, phenotypic characteristics of harvested grain can be evaluated, including number of kernels per row on the ear, number of rows of kernels on the ear, kernel abortion, kernel weight, kernel size, kernel density and physical grain quality.

Assays for screening for a desired trait are readily designed by those practicing in the art. The following illustrates screening assays for corn traits using hybrid corn plants. The assays can be readily adapted for screening other plants such as canola, cotton and soybean either as hybrids or inbreds.

In certain embodiments of the invention transgenic corn plants having nitrogen use efficiency can be identified by screening in fields with three levels of nitrogen (N) fertilizer being applied, e.g. low level (0 N), medium level (80 lb/ac) and high level (180 lb/ac). Plants with enhanced nitrogen use efficiency provide higher yield as compared to control plants.

In some embodiments, the present invention discloses transgenic plant exhibiting increased yield under various stress conditions (e.g., drought, heat, limited nitrogen, or any combinations thereof disclosed herein, compare to control plant. For example, transgenic plants of the present invention can exhibit averaged, or similar yield received in the past, but higher yield as compared the control plants under similar stress conditions. The present invention is capable of maintaining yield under stress conditions as compared with plants that do not comprise the genes or miRNA disclosed herein.

In other embodiments, transgenic corn plants having enhanced yield can be identified by screening using progeny of the transgenic plants over multiple locations with plants grown under optimal production management practices and maximum weed and pest control. A useful target for improved yield is a 5% to 10% increase in yield as compared to yield produced by plants grown from seed for a control plant. Selection methods can be applied in multiple and diverse geographic locations, for example up to 16 or more locations, over one or more planting seasons, for example at least two planting seasons, to statistically distinguish yield improvement from natural environmental effects.

In other embodiments, transgenic corn plants having enhanced water use efficiency can be identified by screening plants in an assay where water is withheld for a period to induce stress followed by watering to revive the plants. For example, a useful selection process imposes 3 drought/rewater cycles on plants over a total period of 15 days after an initial stress free growth period of 11 days. Each cycle consists of 5 days, with no water being applied for the first four days and a water quenching on the 5th day of the cycle. The primary phenotypes analyzed by the selection method are the changes in plant growth rate as determined by height and biomass during a vegetative drought treatment.

In other embodiments, transgenic corn plants having enhanced cold tolerance can be identified by screening plants in a cold germination assay and/or a cold tolerance field trial. In a cold germination assay trays of transgenic and control seeds are placed in a growth chamber at 9.7° C. for 24 days (no light). For example, seeds having higher germination rates as compared to the control can be identified as having enhanced cold tolerance. In a cold tolerance field trial plants with enhanced cold tolerance can be identified from field planting at an earlier date than conventional Spring planting for the field location. For example, seeds are planted into the ground around two weeks before local farmers begin to plant corn so that a significant cold stress is exerted onto the crop, named as cold treatment. Seeds can be planted under local optimal planting conditions such that the crop has little or no exposure to cold condition, named as normal treatment. At each location, seeds may be can be planted under both cold and normal conditions preferably with multiple repetitions per treatment.

In other embodiments, transgenic corn plants having seeds with increased protein and/or oil levels can be identified by analyzing progeny seed for protein and/or oil. Near-infrared transmittance spectrometry is a non-destructive, high-throughput method that is useful to determine the composition of a bulk seed sample for properties listed in table 1.

TABLE 1

| Typical sample(s): | Whole grain corn and soybean seeds |
|---|---|
| Typical analytical range: | Corn - moisture 5-15%, oil 5-20%, protein 5-30%, starch 50-75%, and density 1.0-1.3%. Soybean - moisture 5-15%, oil 15-25%, and protein 35-50%. |

Although the plant cells and methods of this invention can be applied to any plant cell, plant, seed or pollen, e.g. any fruit, vegetable, grass, tree or ornamental plant, the various aspects of the invention are preferably applied to corn, soybean, cotton, canola, alfalfa, wheat, rice, sugarcane, and sugar beet plants. In many cases the invention is applied to corn plants that are inherently resistant to disease from the Mal de Rio Cuarto virus or the *Puccina sorghi* fungus or both.

Homolog Identification

In certain embodiment, the present invention also includes identification of homologs of proteins encoded by the DNA identified in the sequence listing which is used to provide transgenic seed and plants having enhanced agronomic traits. From the sequence of the homologs, homologous DNA sequence are identified for preparing additional transgenic seeds and plants of this invention with enhanced agronomic traits.

An "All Protein Database" are constructed of known protein sequences using a proprietary sequence database and the National Center for Biotechnology Information (NCBI) non-redundant amino acid database (nr.aa). For each organism from which a polynucleotide sequence provided herein can be obtained, an "Organism Protein Database" are constructed of known protein sequences of the organism; it is a subset of the All Protein Database based on the NCBI taxonomy ID for the organism.

The All Protein Database are queried using amino acid sequences provided herein as SEQ ID NO: 91968 through SEQ ID NO: 183370 using NCBI "blastp" program with E-value cutoff of $1e^{-8}$. Up to 1000 top hits are kept, and separated by organism names. For each organism other than that of the query sequence, a list is kept for hits from the query organism itself with a more significant E-value than the best hit of the organism. The list contain likely duplicated genes of the polynucleotides provided herein, and is referred to as the Core List. Another list is kept for all the hits from each organism, sorted by E-value, and referred to as the Hit List.

The Organism Protein Database are queried using polypeptide sequences provided herein as SEQ ID NO: 91968 through SEQ ID NO: 183370 using NCBI "blastp" program with E-value cutoff of $1e^{-4}$. Up to 1000 top hits are kept. A BLAST searchable database is constructed based on these hits, and are referred to as "SubDB". SubDB are queried with each sequence in the Hit List using NCBI "blastp" program with E-value cutoff of $1e^{-8}$. The hit with the best E-value are compared with the Core List from the corresponding organism. The hit is deemed a likely ortholog if it belongs to the Core List, otherwise it is deemed not a likely ortholog and there is no further search of sequences in the Hit List for the same organism. Homologs from a large number of distinct organisms are identified and reported.

Recombinant DNA constructs can be prepared using the DNA encoding each of the identified homologs and the constructs can be used to prepare multiple events of transgenic corn, soybean, canola, cotton and other transgenic plants mentioned. Plants can be regenerated from the transformed plant cells and used to produce progeny plants and seed that are screened for enhanced water use efficiency, enhanced cold tolerance, increased yield, enhanced nitrogen use efficiency, enhanced seed protein and enhanced seed oil. From each group of multiple events of transgenic plants with a specific recombinant DNA for a homolog the event that produces the greatest enhancement in yield, water use efficiency, nitrogen use efficiency, enhanced cold tolerance, enhanced seed protein and enhanced seed oil is identified and progeny seed can be selected for commercial development.

Pfam Module Annotation

The amino acid sequence of the expressed proteins shown to be associated with an enhanced trait are analyzed for Pfam protein family against the current Pfam collection of multiple sequence alignments and hidden Markov models using the HMMER software in the appended computer listing. The Pfam domain modules and individual protein domain for the proteins shown in the sequence listing. The Hidden Markov model databases for the identified patent families are known to a skilled artisan allowing identification of other homologous proteins and their cognate encoding DNA to enable the full breadth of the invention for a person of ordinary skill in the art. Certain proteins are identified by a single Pfam domain and others by multiple Pfam domains.

Selectable Markers

The present invention includes transgenic plants with and without selectable markers. As used herein the term "marker" refers to any transcribable polynucleotide molecule whose expression, or lack thereof, can be screened for or scored in some way. Marker genes for use in the practice of the present invention include, but are not limited to transcribable polynucleotide molecules encoding B-glucuronidase (GUS described in U.S. Pat. No. 5,599,670, which is incorporated herein by reference), green fluorescent protein and variants thereof (GFP described in U.S. Pat. Nos. 5,491,084 and 6,146,826, RFP and the like), proteins that confer antibiotic resistance, or proteins that confer herbicide tolerance. Marker genes in genetically modified plants are generally of two types: genes conferring antibiotic resistance or genes conferring herbicide tolerance. Examples include, but are not limited to antibiotic resistance markers, including those encoding proteins conferring resistance to kanamycin (nptII), hygromycin B (aph IV), streptomycin or spectinomycin (aad, spec/strep) and gentamycin (aac3 and aacC4) are known in the art.

Included within the term "selectable markers" are also genes which encode a secretable marker whose secretion can be detected as a means of identifying or selecting for transformed cells. Examples include markers that encode a secretable antigen that can be identified by antibody interaction, or even secretable enzymes which can be detected catalytically. Selectable secreted marker proteins fall into a number of classes, including small, diffusible proteins which are detectable, (e.g., by ELISA), small active enzymes which are detectable in extracellular solution (e.g., alpha.-amylase, beta.-lactamase, phosphinothricin transferase), or proteins which are inserted or trapped in the cell wall (such as proteins which include a leader sequence such as that found in the expression unit of extension or tobacco PR-S). Other possible selectable marker genes will be apparent to those of skill in the art.

The selectable marker is preferably GUS, green fluorescent protein (GFP) or variants thereof, neomycin phosphotransferase II (nptII), luciferase (LUX), an antibiotic resistance protein, or a herbicide (e.g., glyphosate, bromoxynil, and the like) resistance or tolerance protein. The selectable marker is most preferably a kanamycin, hygromycin, or herbicide resistance marker.

In one aspect, the present invention includes recombinant DNA constructs having a polynucleotide encoding a protein that has an amino acid sequence having at least 95% identity over at least 95% of the length of a reference sequence selected from the group consisting of SEQ ID NO: 91968-183370 when said amino acid sequence is aligned with said reference sequence.

In another aspect, the present invention includes a mixture having plant cells, and an antibody to a protein produced in said cells wherein said protein has an amino acid sequence that has at least 95% identity over at least 95% of the length of a reference sequence selected from the group consisting of SEQ ID NO: 91968-183370 when said amino acid sequence is aligned to said reference sequence.

Yet another aspect of the present invention includes recombinant DNA constructs having a promoter that is functional in a plant cell and that is operably linked to a polynucleotide that: (a) encodes a protein having an amino acid sequence having at least 95% identity over at least 95% of the length of a reference sequence selected from the group consisting of SEQ ID NO: 91968-183370, when said amino acid sequence is aligned to said reference sequence; or is transcribed into an RNA molecule that suppresses the level of an endogenous protein that has an amino acid sequence that is at least 95% identical over at least 95% of the length of a reference sequence of SEQ ID NO: 91968-183370, when said amino acid sequence is aligned to said reference sequence; and wherein said construct is stably integrated into a chromosome in a plant cell nucleus. In some aspect, this invention includes a transgenic plant cell having the recombinant DNA construct wherein said DNA construct provides for an enhanced trait as compared to control plants; and wherein said enhanced trait is enhanced water use efficiency, enhanced cold tolerance, increased yield, enhanced nitrogen use efficiency, enhanced seed protein or enhanced seed oil. The DNA construct further can express a protein that provides tolerance from exposure to an herbicide (e.g., a glyphosate, dicamba, or glufosinate compound) having an agent applied at levels that are lethal to a wild type of said plant cell nucleus.

In some aspects, this invention provides transgenic plants (e.g., corn, soybean, cotton, canola, alfalfa, wheat, rice, sugarcane, or sugar beet plant), that is homozygous for said recombinant DNA and have a plurality of plant cells.

Yet in another aspect, this inventions includes transgenic pollen grains having a haploid derivative of a plant cell nucleus having a chromosome comprising the recombinant DNA construct.

In one aspect, this inventions provides a method for manufacturing non-natural, transgenic seed (e.g., corn, soybean, cotton, canola, alfalfa, wheat, rice, sugarcane, or sugar beet seed) that can be used to produce a crop of transgenic plants with an enhanced trait resulting from expression of a stably-integrated, recombinant DNA construct, said method includes (a) screening a population of plants for said enhanced trait and said recombinant DNA, wherein individual plants in said population exhibit said trait at a level less than, essentially the same as or greater than the level that said trait is exhibited in control plants which do not contain said recombinant DNA, wherein said enhanced trait is selected from the group of enhanced traits consisting of enhanced water use efficiency, enhanced cold tolerance, increased yield, enhanced nitrogen use efficiency, enhanced seed protein and enhanced seed oil; (b) selecting from said population one or more plants that exhibit said trait at a level greater than the level that said trait is exhibited in control plants, and (c) collecting seed from selected plant from step b.

Yet in another aspect, the method of this invention further includes: (a) verifying that said recombinant DNA is stably integrated in said selected plants, and (b) analyzing tissue of said selected plant to determine the expression or suppression of a protein having the function of a protein having an amino acid sequence selected from the group consisting of one of SEQ ID NOs: 91968-183370.

In one aspect, this invention provides a method of producing hybrid corn seed including: (a) acquiring hybrid corn seed from an herbicide tolerant corn plant which also has a stably-integrated, recombinant DNA construct; (b) producing corn plants from said hybrid corn seed, wherein a fraction of the plants produced from said hybrid corn seed is homozygous for said recombinant DNA, a fraction of the plants produced from said hybrid corn seed is hemizygous for said recombinant DNA, and a fraction of the plants produced from said hybrid corn seed has none of said recombinant DNA; (c) selecting corn plants which are homozygous and hemizygous for said recombinant DNA by treating with an herbicide; (d) collecting seed from herbicide-treated-surviving corn plants and planting said seed to produce further progeny corn plants; (e) repeating steps (c) and (d) at least once to produce an inbred corn line; and (f) crossing said inbred corn line with a second corn line to produce hybrid seed.

In some aspect, this invention provides substantially purified nucleic acid molecule having a nucleic acid sequence wherein said nucleic acid sequence exhibits 95% or greater identity to a nucleic acid sequence selected from the group consisting of SEQ ID NO: 1 through SEQ ID NO: 91967 and sequences complementary to SEQ ID NO: 1 through SEQ ID NO: 91967.

It is contemplated that any embodiment discussed in this specification can be implemented with respect to any method, kit, reagent, or composition of the invention, and vice versa. Furthermore, compositions of the invention can be used to achieve methods of the invention.

It will be understood that particular embodiments described herein are shown by way of illustration and not as limitations of the invention. The principal features of this invention can be employed in various embodiments without departing from the scope of the invention. Those skilled in the art will recognize, or be able to ascertain using no more than routine experimentation, numerous equivalents to the specific procedures described herein. Such equivalents are considered to be within the scope of this invention and are covered by the claims.

All publications and patent applications mentioned in the specification are indicative of the level of skill of those skilled in the art to which this invention pertains. All publications and patent applications are herein incorporated by reference to the same extent as if each individual publication or patent application was specifically and individually indicated to be incorporated by reference.

The use of the word "a" or "an" when used in conjunction with the term "comprising" in the claims and/or the specification may mean "one," but it is also consistent with the meaning of "one or more," "at least one," and "one or more than one." The use of the term "or" in the claims is used to mean "and/or" unless explicitly indicated to refer to alternatives only or the alternatives are mutually exclusive, although the disclosure supports a definition that refers to only alternatives and "and/or." Throughout this application, the term "about" is used to indicate that a value includes the inherent variation of error for the device, the method being employed to determine the value, or the variation that exists among the study subjects.

As used in this specification and claim(s), the words "comprising" (and any form of comprising, such as "comprise" and "comprises"), "having" (and any form of having, such as "have" and "has"), "including" (and any form of including, such as "includes" and "include") or "containing" (and any form of containing, such as "contains" and "contain") are inclusive or open-ended and do not exclude additional, unrecited elements or method steps.

The term "or combinations thereof" as used herein refers to all permutations and combinations of the listed items preceding the term. For example, "A, B, C, or combinations thereof" is intended to include at least one of: A, B, C, AB, AC, BC, or ABC, and if order is important in a particular context, also BA, CA, CB, CBA, BCA, ACB, BAC, or CAB. Continuing with this example, expressly included are combinations that contain repeats of one or more item or term, such as BB, AAA, MB, BBC, AAABCCCC, CBBAAA, CABABB, and so forth. The skilled artisan will understand that typically there is no limit on the number of items or terms in any combination, unless otherwise apparent from the context.

All of the compositions and/or methods disclosed and claimed herein can be made and executed without undue experimentation in light of the present disclosure. While the compositions and methods of this invention have been described in terms of preferred embodiments, it will be apparent to those of skill in the art that variations may be applied to the compositions and/or methods and in the steps or in the sequence of steps of the method described herein without departing from the concept, spirit and scope of the invention. All such similar substitutes and modifications apparent to those skilled in the art are deemed to be within the spirit, scope and concept of the invention as defined by the appended claims.

SEQUENCE LISTING (183370 sequences)

SEQ ID NO: 1 - DNA, 406 bp, Glycine max
  Peptide Sequence Number=SeqID_91686
tgagcagacaaagggtcagaagttcccagtgaatgcttcggatcaggaaatgatggagatagtcatggatagggacttgggtattatggggtgcctatgtcccacatcgagtagtttggatgcttggtggagaagtgggctacctatggggatttcggctctcaagggcagtgctaagttagggacctgggaactcatgcatcctatccaaaaccttctcaatggagagctggttcgggctatacttattcaggttcagaagctcaagctggacactgagacggcaatgctagagctgaaccagattctacgggcaaatgaaatcaactttgcagttctgactgctttacctgcattttttctctctcttttactcatgatgttagtacgtggatggttcaaacag

SEQ ID NO: 2 - DNA, 426 bp, Glycine max
  Peptide Sequence Number=SeqID_91687
atgaaatgttgtagtcggtttcacctaggaattaagtcagaggctttggtgggaggtgggaggtgggagcagacattcatctctatggagcggtcatgggacaaggttgtattcaattcatggatactacctgggtcccttctcatggcagaagcaacatcatccagacaaattgcatctgggtcagcacagaatgaggtgctaaaggaatggcaagatgcatgggacgaaagggataaggattttgagaagcaaggaattaatcaacaagattcattttggagcaagctaaagtcagaggctgctaggaaggtgggtgcagaagaagcggagagattttgcaagtcattccaacaaatccataagaaactagtcaatgaagagttgagtttagatgctgctcgaagcttcttaaattcatcctag

SEQ ID NO: 3 - DNA, 468 bp, Glycine max
  Peptide Sequence Number=SeqID_91688
atgatagttatcgttgcagccggaagcgctcgtcgacggtgggttgcgccgacgagatctacaaatcctagatttgttcctcatcgacctttctctgttgtcccttccgctgggagagtctctgatcttggtacctctgagctcaataaacgagagaggcaaaggtttcgagcagggtgtggtggtcttcctggagagatggtgcatcgtctcaggcttcccaacacgcacgacgagatcggagacgagtgcctggaggctacagtagaggtcggagacgggcgcctagaggttgcggcagagtttgcgacagaagaagagacatggaagatttcgtttcggtgcgaccttccttcacccaaggcttccactactttggcgtttttgacggttgcgactatgtgcaaggagcggttacacgatatcttgaatgaagaaattgatcacgcacgcgagaatttggagtga

SEQ ID NO: 4 - DNA, 876 bp, Glycine max
  Peptide Sequence Number=SeqID_91689
atggggcatcccctcagtcaactaccaaactaccttaaagatggtgcagcctgcttcctagatgttggtacattaacaagcggatgtgatggtgcccctctgcttcctctgctgtttattattgtaaacataggtttcaatattgcattgcttcatctcctgaagatctcttcagctgttgtatcttgtcttgcttccacattttcaggaacagcaaacataacaccaggaagcaagggcattaaggagcagaagcaagatcaagaggtgcagaagcaggatcaacaggtacagatagcagagaagcccaaaagaaaggtactggccctcgaagccagcttcaattctgcacctaacatgttgcctcctctcttccaacaggctttatggctggggccatcatcctcattttgggcttactcatttatgcttgtaccccttcaaatggttcctcgggcaaatatcaatagcaatagcagcaatgtcaatgttgagatcagtttgtcagttaaggcttcgtatggcactggggctagtgctgctgctgaaggtgataggccaagggagatattggtgcagcatttgttggtcaaagaagatgaccagaagcttctgttagatattcagcaaagaatctcttcaggctctgtttttgtgcgttcaggtgaagatttgagtgatcttgctgtggaatattcactgtgcccatccaaagaagaaggagggatgcttgggtgggtcagaaagggacaaatggcggttttaccgctttcagatggaaaagacacagttactgtgaactttctttgggaagaggaagcagatgaggttcctgaatttgaggaggctgcatttactgcacctttaaacaaagtg

SEQ ID NO: 5 - DNA, 753 bp, Glycine max
  Peptide Sequence Number=SeqID_91690
atggagaatagtgtccatgaacccttcttttgcctaccttctcagaatggctccacgagcaacaattccactaattttaccaccctctttgaaagctcccatgttgttggtttcaacaaaagtcatttatcctttgataacatcaatagtagcaataactttctcgaacccatagtcctaattgttcctcctggaattgacattgttaatgccatcatcaactttagtcatgatcaagatgtggacatttcggtgcatcatgcttcaggtctcatatgtgaaataaacctttgcaaccctctctccacttccgatgatttgtgcttcttgggaacctttcacatgatttctctcacaggcttttacaccaacaacaacctttcagcttcttcaccccccaacaacattccctatccatccttcgcaattcaattcacgagaggaagccctcccaaactctttggaggccgtattggaggcaagctcattggtgtagaacctgtgcatgtaatggcttctatcgttaagaagcatgagtaccataagccaaatgttcagcctgtcatcaaaagtactcgtggtgctaatcactatgttgacatcaccaacaacactgacaataatcaccttggtttctctaatattggaccttcaagctcatctccgatcaatatccaaaccactactactccttatgctcctacagatgctaacatgcatgctctatctgaacaaccccaccaatcaggataa

SEQ ID NO: 6 - DNA, 228 bp, Glycine max
  Peptide Sequence Number=SeqID_91691
atggagtttgttgttgagaggagatcttgttgtgttgttagggtgaggtggggtgaggagggggagttgagtggagtggacttggatttttctctctctgaaaaggaagggaaaacgaacaacttctctgcttcttcttctgtttctgcttcttctgctgctattgtggctactactactgtcactttggcttttttccacaggaagaaaaagttttggtttgagtga

SEQ ID NO: 7 - DNA, 1450 bp, Glycine max
  Peptide Sequence Number=SeqID_91692
tgaattgcaatcagaagaaaataaagtctccaatgagaaaaataagaaaagaaagctgaaaacaccggcgcagcttaaagccttggaggatttttataatgagcacaaataccccacggaggaaatgaaattagtacttgctgaggagttaggattgacagaaaagcaaatatctggatggttttgccacagaaggttaaaagataaaagattgatgaaagatgaagccgttgctaatgggagacaagatcgttcaagtggtgtcatccaagatcgtggcagtggacttgggcaagattcatgcggaagcagtaagcatgctgatcacaggtatctggatccgaaggaggttgagagccatggcctctacaatcacgaattgtcagttgcagatatgacccacagacgtaggaaccattatcctgaaaatgttagtggggtggatgacacatcatctgagagcagctcatttttgcaagaaaggttttctcaaggtcaggatccgtatgatatggagccttctagacatcttacacctaatggagctcttccacccctaaatcccaaaggtgcagttaagatggggcacaaaccatcaggatatttgaaagtgaagggcgagatagagcatgctgctataactgctgttagaaagcaattaggaaggcattatctggaagatggtccactacttggtatagaattcgatccacttcctccaggggcatttgaatgccaaactgcagatacagctaatgattcgcatatggaaggagctgactttggttccttgcatgaatctgatttccaggataaacaagataagaaagcatgtcagaacataaaacaaaggcaatctttatacggttataccaataattttcctggaaggaacactttcccagatttgtatgaagactctactggagaagcatctgcttataatagcaataagagtcatagaatgagcactaaacatggtgttgaggggatgcgatctgattctgcttctaaccatagtgatcactatgaagagaagcttacagttaagcagaaaaccttgatgctgcatggttatgataacatcaatccaaagaatatacaaaggagtgaacatgtaaaatctaaaccttctagttcaatccataattcccgtgttcctatggatactgaagaacgggggttatctgctaggatggcaaaggaagagatgtttaaggggaacaggaaagcaaaaaatacatactgcgatgtagagggagcagggatgctttcaaatgaaatcatggttgcaaaacgagctaaagttgacatgcttcaacaatacaatgtgaaaaaatcacctgttgctgagatggaactaaagaaaattcagagatctgttgcagagatgccttctagctttagcgaggatgaaactgctgacaccagttcctcactggattattaa

SEQ ID NO: 8 - DNA, 528 bp, Glycine max
  Peptide Sequence Number=SeqID_91693
atggcgaaacttgaagcgaagctaggaatgatcgtggactcggtggggcagttcttctccggcaaagaccatcttccttattgtgactctgacgtcgtcgctggatgtgaaagagaggtattggaggctgaaaaacaatcatctgaagagcatatgcaggactgtctcctgcgtttatcatgggctcttgttcactccaaacacccacaagatgtgcaccgtgggatagccatgcttgaaggtctctctctctctctcatcttgcaattcaattatgacccactgcagcaaagggagaagctttatcttctggctgttggatactatagaaacgctgattattcaaggagtagggatctcgtcgacaggtgcctcgcgcttgcacccgactggaggcaggcagtgacactcaagaagacgatcgaggataagatcactaaagatggtgtcattggcctgggcattgccgctactgctgtaggacttatagcaggtgggattgcagcagctgtgtctagaaaaaagtga

SEQ ID NO: 9 - DNA, 2910 bp, Glycine max
  Peptide Sequence Number=SeqID_91694
atggcttcggatcttagcagaaccggtcctgtggaaagagacattgaacaggccattactgctttaaagaaaggggcctgcttgctcaagtatggaagaaggggaaggcccaagatttgccccttccgtctttccaatatagtggtggaaatatttcttttaagagattgtagggtaggggaccttgaagttgaatggcatagtgacgaatctgttttgatatggttctccgggaaagaagagaagcaccttaaactgagtcaggtctctagaattatatctgggcaacgcacatttgtgtcacctttctctatatgcacttgtgatcctatctttcaaagatatccacgacctgagaaagaataccagtcattttctcttatctacaatgataggtcactggacttgatatgcaaggataaagatgaagctgaagtttggttcagtggtttgaaagcattaatttctcgtagccatcaccggaagtggagaacagagtcaagaagtgatggtattccatctgaagctaatagtcctcgaacatacaccagaagaagttctcccatgaattctccctttggcagtaatgaaagcctgcaaaaggacagtggggatcaccttcgccttcatagtccatacgagagcccccctaagaatggtttggataaagcattagatgtggttttgtatgctgtccctcagaagggtttcttccctccagattctgccagtgcttcagtacattctgtgtcatctggaggatcagacagtatgcatggtcagatgaagacaatgggtatggatgcttttagagttagtctatccagtgctgttagcacatctagccaaggttctggtcatgatgatggtgatgctctaggggatgttttcatttggggggaaggcactggtgatggtgttttgggtggtgggaatcaccgagttgggagttgtttgggtgtaaaaatggattctctatttcccaaatctttggaatctgcagtagttcttgatgtacagaatattgcttgtggtggacgacatgcggccctagtgaccaaacaaggcgaaattttttcctggggggaagaagcaggcggcagacttgggcacggtgttgactctgatgttctccatcctaagcttatagaagctctaagtaatacaaatattgaacttgtagcttgtggggaatatcatacatgtgctgttacactttctggtgatctttatacatggggtaatggcacatacaattgtggccttctaggacatggaaatcaagtgagccactgggtaccaaaaagagtaaacggccccttggaaggcatacatgtttcatatatttcttgtggaccgtggcacactgctgttgtaacatctgctggtcaattatttacttttggtgatggtacatttggtgctttgggtcatggagacaggaaaagtgtttcattaccaagggaagtagagtctctcaagggtcttcgaacagtgcgggctgcatgtggtgtttggcatactgctgcagttgtggaagtcatggttggaaattcaagttccagcaactgctcttcggggaagctgtttacttggggtgatggagacaaaggtcgacttgggcatggtgataaggaagcaaaacttgttccaacccgtgttgcccttgttaatgttaaacccaatttttgtcaagttgcttgtggtcatagtctcactgttgcacttaccactaagggccatgtctatacaatgggtagtccagtctatggccagttaggaattcctcaagctgatgggaagctaccaatctgtgttgaatggaaattgtcagagagttttgtggaggagatagcttgtggggcatatcatgttgccgtcttaacttcaaggactgaagtttacacttgggggaagggtgcaaatggccgtttaggccatggcgatacagatgatagaaataccccaacattagtagaagctctgaaagacaaagatgtcaaaagtattgcttgtggaactaatttcactgcagctatttgtttgcataagtgggtatctggtgttgaccagtctatgtgttcgggctgtcgtatgccatttaatttcaaaagaaaacgccacaattgttataattgtggacttgttttttgtcattcatgtagcagtaagaagtctctcaaggcttcgatggcaccaaaccccaacaaaccttatcgtgtctgtgataattgttttaataaacttaggaaaacggtagaaactgattcttcatctcattcttctgtgagcagaagaggagttgccaatcaggggcctctggagttaattgataaggatgataaattggattccagatctcgtaatcaacttgccaggttttcttcaatggaatccttcaaacaggtggaaagcagatcttcgaagaaaaacaagaaattggaattcaacagcagccgtgtctcgcccattccaaatgggggttcacaatggggagcatcgaatatttctaaatcttttaatcctgtttttggatcatcaaagaaatttttctctgcttctgttcctggatctagaattgtttcccgagcaacatccccaatatctagacggcctagtccacctcgttcgactacaccaaccccaacactgggaggtcttacatccccaaatatagttgtggatgatgctaagaggactaatgatagtctcagtcaggaggttattaaattaagatcacaggtggaaaacctgactcggaaggctcaacttcaagaagttgagttggaaagaacaactaaacagctaaaagatgcaatagcaattgctggggaagaaactgccaaatgtaaagcagcaaaggaagtaataaagtcacttacagcccaggtagaaactttaatcccttaa

SEQ ID NO: 10 - DNA, 879 bp, Glycine max
  Peptide Sequence Number=SeqID_91695
atgggtctgtccaaggagaatctgaaaggtctcatactagctttggtgtcaagtgggttcattggggcaagttttatcattaagaagcaaggccttagaagagctgcagcagtttctggtgtcagggctggtgttggtggttattattatctcttggagccactatggtgggtgggaatgatcacaagagaggttgcaaacttcgttgcatatgcatttgctccagcagtcctagttactcctcttggtgcattaagtattattgtgagtgctgttttggctgacattattctgaaagagaagctacacaatcttgggatattgggctgtataatgtgcattgctggtagtatcattattgttattcatgctcctaaggaacaacctattacatctgttctggaaatatggaatatggccactcaaccagtaatagtgttggttttcattctggtcttccattttgcaccaagatgtgggcatacgaatgtgctagtttttactggaatttgttcattgatgggttccctctctgctcttgacaccttcaacacagcaattgtatctcctatatactatgtcatgttcacaacacttacaatactagccagtgtaataatgtttaaggattgggatggacaaagtggtggaactattgtgtcagaaatatgtggcttcatcattgtgctctctggaacaataatgttgcatgcgactaaggacttcgagagaagctcttcttttagaggtagtgatcctttatcgcctacgctatctgcccgactttttaccggaaatggtgactcattacttaagcaagatgaggaaaatggatctcccgagagtaatatgcgctcaagaaggcaagaattgtattag

SEQ ID NO: 11 - DNA, 1104 bp, Glycine max
  Peptide Sequence Number=SeqID_91696
atgttaaccgcagtcctcagaagaaccagttccaccctctcaaggcgcggtttccccgccgccttaatctctgcctccaccgccaccgccaccgccaccgccggcaaccacttccggctactctccgctgccgtcaattccagaaccttccactccaaccctggccccttgaatttccgcgcctcttcatgtcaccgcgcggaatacgccgtggacgatttcccttacgaagaagggtccaaaggaaacgccgacgaaggcctcgagatcgcgaagctcggaatttcgcaggatattgtctccgctttggccaagaaaggcatcaccaagctcttccccattcagagggctgtgttggaacctgctatgcaaggtcgtgatatgattggtcgagctagaactggaactgggaagactcttgcttttgggatacccatcatggataaggtcattcagtttaatgctaagcatgggcgggggagggatcctttggctttggtgttggctccgaccagagagcttgcgcgacaggttgaatcagagttctgtgagtcggcacctaatttggatacaatttgtgtttatgggggtacacccatttctcagcagatgaggcagcttgattatggggttgatattgctgtggggacgcctggtcggattattgaccttctcaacagaggtgcgctaaatttgaaggatgttcagtttgttgttcttgatgaagctgatcagatgcttcaggtgggctttcaggaagacgtggagaagatcttggagaggttgcccccaaaacgtcagactcttatgttctctgcaacaatgccatcttggataaagcagatttcgcgcaattacttgaataatcccctaaccattgatcttgttggagattctgatcagaaattggcagatggaatttcactgtactccattgcaactgatttgtatgttaaagcgggaattcttgcacctctaataacaagggtgagccttggcccaatggtagggttggtgccttatgacttggaggtcactggtacaaattctagaaacagcctttccgcttgtggtggtaaggctgtgcgcatctacgctccttag

SEQ ID NO: 12 - DNA, 837 bp, Glycine max
  Peptide Sequence Number=SeqID_91697
atgaattcatcaccaggattcgtcaaattggcctttgattgcaccattgccatcttatggaagaggaagggaacggcctgcaggaaggtatatgagttttatccatggagatggagtttaggatgtggtgaaaatgggacaatagatgggcaaggagatgagtggtggaacaagtggaagcagagaactcttcagtttaccagaccaaaccttgttgaatttgtgaattctagagatattatcatttcaaatgtaatcttcaagagttctcccttctggaatatacacccgtatagcaatgttgttgttcgatatgtcacgattttggctcctcgtgactctccaaatactgatggcattgatccacattcaagttcaaatgtgtgcatagaggattcatatatatccactggagatgatcttgtggctgagaagagtggatgggatgaatatgggattgtttatggccgtcctagctcagacataactatccggcgcgtaactggatcatctccatttgctgggattgctattggcagtgaaacctctggtggggtggagaatgtactttctgagcacatcaacctttacaacatgggaattggtatccacattaagaccaacactggcagggctggatatataaagaacataaccatgtctcatgtgtacatggaggaagcaaggaagggaataaggatctcaggtgatgttggggaccaccctgatgacaaatatgaccctaatgctcttccacttgtgaagggtgtcacaattaagaatgtttggggtgtgaaggttttgcaggctggcttgatacaagggttgagtagttaa

SEQ ID NO: 13 - DNA, 4299 bp, Glycine max
  Peptide Sequence Number=SeqID_91698
atggcattctcaacgaatcgagatcagactcccaaatctgactccacgaacccctgctgtgaactctggaagaagaagtactcgaagacccaagaatcgcggaatgctctgcgacaagccgtcaaggttcttgaacaaaaaattaacgaaatccagtcccgctacaacaaagtatgtggggccaaagtggaaagagaggaaaaattgggagaatttgttgctgctagggtgcatttagagagtgaaactttcagcttggagtctcagattgttactcccataacaaaccagggacgtggcggggatggaaatgagaataggaccttacaatctgattgggaaaaggaaattggtagattgaaggagcttatagaagtggagaagggaagggctgattctgagaggaagaatgctactgaagcttgcaagttactagagaatgagaagaataaggttgttgaaaaggaaaaggaaattggtggattgaagaggcttatagaggcagagaagagaagggctgattctgagagcaagaaagctgctgaagcttgcaagatggtaggggatgagaagaataaggttgttgaaaaggaaaaggaaattgttggattgaagaggcttatagaggcagagaagagaagggctgattctgagagcaagaaagcttctgaagcttgcaagttggtaggggatgagaagaataaggctgctgaaaaggaggagggaatccgtagattgaaggggattatggaggtggagaagagaaagaatgattctgagaggaaggaagacactgaagcatgcaagttacttggagaagagaagaaaaaggttgctgaaaaggaaaaggaaattggtagattgaaggggtgtatagaggagaagaagagaagggttgattctgagaggaagaaagctactgaagcttgcaagttactagaagaagagaagaataaggctgccgtaaagggggagattgccagaattgaagcagagaaggcagtgaagtatagttttcagattggtcaattagagaaacaggttaatgaagcaaaaacaaagttggtgtctgagatttctacgtttagagaggcaaccaaaaagtttgaagctgaaaaccacaaactattagcagagaaaagaaatgctgagtcggggatggcaaaagcgaatgaaaggttagaggttgaaaaacaaaaggtcaatgaggaaaaaaggcgtgcagatgcagagatggttaaattagagaagcagaaggcgcttgctaaggataactggaacaagttcatgaaagagaaatgtcttgctgatcagatgtctcagcagttagaagaggataagaagacgattgaggatttgaaacggaagatccatgaactctcatccttgacaaaacctgttgaaatggctgctgacagcaaggtcaatgctgatagtacagaagtgaagcttttgaaaaacaaacttaagcttgaaaagctaagagcaaaacataccaggcaaaaatataagttagaaacaagtcgttacagtattttacggcatgatttaggtcgtctaaagatggatttcattcaatttctacaacgccttgatatactggatgcatccttttcacctgtcgctggaagtatgcatggccaaacaaagtttgagaatatactagatatgcagaattcaaatgtcacgagacaaatttgcaatctaaatttgtctgagacatgtcgccaatttgagaatgagcttctggaaccctgctgcacaacaatttatgcaagtgacccattgaggaaaaacatacagaacactcaactcctcactccaggtggaaattactctgaaaaatccatcacaggtattggttctaaattggagcctcttgttagaggatcagacagaacaaagttacagagttctgcagtaaattccagtacagaatctttttctgatggacagttgatgggctcacaggatgcagccattttcccagttactgcatcagcaaaattaactcaggactgcaagccacctgacaaatctgttgatgtgcaccacaggaagaggaaaagaatgcaggacacaattgaatataatgcaaatttatctcctgagaaactctctgatttgcatggtttgatttatagaaaagttggcaaatgcttagaaggaggaaaagaggtgcttcataatctgaataatttacaggaagagaataaaagggcccacaaaaagagaaagaaatctcgtagagaaaaagtggacatgatacctttggttaacagggatgagcaaaagggcgcagaagaggccgagactgaggtctatgacgatgcaaatgtctgtagacatacttcctgccttgctccacatactttagaaacctctgaagcatgtggggataggatatgtgatgctgcgaataatttcgattcgatggttaattttgataccgtgcctgatggaaattatatgaaattattagaattagaagatgctaccagtgaggaatgctatagaaaagcaatggattttcccatttctccatctcttcctgaaattgaattttgtgacacatttgaagagggtaatttgacgaatacgtctctagagaaagcactccaagatgacatgttgagttcaagaacagacctgtttacttcaccttacctcaatgtaattaatgttgaaatcaattctaacgaacaaaaatgtgatgattgcggagtttcttgtaatttacatatgcgcattacagaaaagccaaggacagctttttcggtggaggatgtaattggatcattaaacaatcaacttcctgaattttgtgttgtcttttcaaatattgaggacaatagtatcatatctaggatacttgttgctacaaaaaattgtatagctcggtgcaatttggcttctcaaacaggctggggggttgctaacattctgactgcacttaaaatggaagaaaagctctcacagaaggagaaggtttcagtactgttaacacttatgatgttcaactttgccatgactgcaacaaagacatttggaaaactctgggatgggaatttattccactgcttgcaatcttattctgaacatatttgcacagagacaagagtcctgtttgtagagaattattctttgcatgagctgcttagcctcattgaagattttcttattgagggaaaagtaatagtaaacaatagagtatatgctgaaactttgtcttgtgatttgagagttaatgattttctggattgtgttaatcaagtatcatccgatgtagcttcaagtgaacaattggcggcagcaagtattatattagcatcagtatgtgctgcaactgattatgttggatttatttgtgatgcttcatatcatattcttcagtcatgcaagtgggattctctgatggtgctgactattctccatatttttgcttatttgggcggagagaagttttttaacatggataattttggattaatggtgaccgttttgaagtctctagttatgtttcttgaggatgagagcccatctgttgcatctgcctgtcttccttcaataaatcagctgcatgctgagttgtgtatgaatgttaaatgcccattcttggaaggtgttgaatccattgatgcagttgcatgcttgctcttggaagagataaagcgaataaatttgtctgattccagattaatgtcagacaattatgatgctgaactatggtataatcaggatgcaattcaatgtaccattagcaagaactgtgatgtgccctgtttgagaaaattctcgatttttgctactcaaccagatgcccttaggaacgtcaatttttgtcgcctgaatgacgtcctgtcattggtggaactggtttcaaacaaaatgagctggcactgggctgatatcaaacttgttcctcagcttctgaatatactcgactcgtgtgtagaggagaactttgctgttcggataattgttcttcttggtcaacttgggaggactggagtagattttggtggatatgaagataaaggagttggaaacctgagatgttatttgtttacttatttttgccgcacctcttccatgaaagcaggtctttctcttcaagttgctgctgccactgctctgtttggccttcttcctcttgattttgaaaccctttttcatactaaaatcaatctttcagcatattctaaatcggtttctgacaatgctgaaagtttgaggaagtggttctctgggctggataaagatcaacagaaattgctatctgatgtatttaacatgtaa

SEQ ID NO: 14 - DNA, 1701 bp, Glycine max
  Peptide Sequence Number=SeqID_91699
atgaacaacagtattcctggttgggattttgagagtgatacatgtctcaccaaccaaagaaagctcatagggccggaccaagaacttgtagagctcctatggaaaaatgggcaagtagttatgcacaaccaaacacataggaagacacttgggaattcatctaacttgagacaggtgcagaaaagtgatcaatcagtattaaggtctagcggtccctatggaaactcaagcaacttggatcaagaagatgccgccccatgggtccaattcccacttgaggacccattggaacaagatttttgttcaaaccttttatctgaactaccaacttgtgaatttgaatcttacaagccaatcaggcaattggaagaggaaaagtttgccaaattttttgcttccggtaccccccatcatcctacaacttcaagttcacaaccactaccacctaacatgaaaccctcatgtattcagggactccaagggaatcctattcctatgccagctccaagatttcatggtcctgattcatctcagaaaatccatgactttggagcatcacgaaaggttctaaattttcctcagttttcaacaccccgtaataatgttccatcagcacctggtattacacagtttagagagaaaactactgctaacatgtcacaaagtgaggctagagagtactcagtgatcacagttggttcaagtcactgtggcagcaatcacatccctcaggagcaagatgtaagcaggatttcaagcactggtgtttgggccactactaataataatactactttatctgctgagcctgaagctgtcagagattatgtccaaagaccgatttgtcctaagagtggccaaggaaaatcagagatgattgaactaactgtgacttcatcttccggtggctcgggaagtactggtatcggaagaacctgttccctatcaacaagagatcatggccaaaagagaaaagggacagaagaagaagcgttagaggaacaaagtgaggacacagaacttaaatcagctgatggaaacaaggcttctcagcggacgaggtcttccagaaggaaccgtgcagcagaagtgcataatcaatcagaaaggagaagaagagataggatcaacgagaagatgaggacattgcagcaactgatacctaatagtaacaagattcggatggatgtcacagacaaagcatcaatgttagaagaggcaatcgaatacttgaaatcacttcagtttcagcttcaggttatgtggatggggggtggcatgacaccagtgatgttcccaggaattcagcactatatgtcacaaatgggtatgggaatgggtgcaccttctttgccttccattcacaacccgatgcaattgccaaaagtgccacatgatcaagccatgtctgtgcttcagataccaaaccagaatttaatgtgtcaaaatccagttttgggtgcctttaactaccaaaaccagatgcagaacccgtgccttccagaacaatatgcacgttacatgggttaccatcttatgcaaaatgcctctcagcctatgaatgtgttcagatatggttcccaagcagtgcaacacagtcaaacgatgattgcaccaggcaataatagcagcggacccatgagtggaacagctaatattgatgatgctgacagtggcaaagcggtcaatgacttcacataa

SEQ ID NO: 15 - DNA, 1458 bp, Glycine max
  Peptide Sequence Number=SeqID_91700
atgacgccggagaatgggaaagagaagaaggattttgatgcagaagcagcagggatgaagagatacaggaatggtgaaatctgggagtttgaggatgacatgggtgtctcagatggtgatggtactggtgtcttgttgggcttggatggtggaaccacctccactgtctgcatttgcatgcccatgattcccttttctcactctcagctccaatctctccctatccttgcaagggctgttgctggatgctccaatcacaatagtgttggagatgtttcattaatcacttcttctacagaaattgctgcaagggaaacgatagagcaggttatggcagatgccctttcaaagtgtggttcaaaacgatctttagtccaagctgtttgtttggctgtatctggtgttaaccatccaacagatcaacaaagaattctcggttggcttagggatatattcccaagccatgtgagactatatgttcggaatgatgctgtggctgctctagcaagtggaacaatgggtaaacttcatggatgtgtattaattgctggcacagggagcattgcatatggatttaccgaggatggaaaagaagcaagggctgcaggtgctggacctgtcttaggtgactggggcagtggatatggaatagccgcgcaggcactaactgcagttgtaagagcgcatgatggccgtggtccaagtacaatgcttacgagtagtattttacaaacgcttggtctttcttctgcagaagaattaatcgggtggacctatgcagatccctcttgggcccggatcgctgcccttgttccagttgtagtgacctgtgcagaggctggggatgaggttgcaaataagatcttgctagattctgtacaagagctagcttcaagtgtcaaagctgttgtagagagacttggattgtgtggtcaagtgatccctctccactctctgcttcatcttgccaattatgtcaaactcaatggaaacaaacatgtagcagtctttcctttcccctttggcacccacgttgtgcctctcttaaaccttgtcctcaaactatctcaagccgctccaaactgttcattctcattcattggcacagagaaatccaacgcagtccgtttcctaaaaccccatatccccaccaacatcaagccctattgcatcagcgatggaatcccagagggtcaccctctagccaaccacccaattgaaaagctcagtttttccctcaaaatgggttctgggaacttgcacaagggtatacaaatggcggaagaagagaccaaggtgaaagtcacatgcgtcattgctgttgcttttgtaacctcttctctcctcatggcaaagaacctcaacgttccttggatcgcgttttgtccccccatggctcgtcctaggagttggtgttgtgggagcgcgacgaggattccacggagtcggagtagctga

SEQ ID NO: 16 - DNA, 2097 bp, Glycine max
  Peptide Sequence Number=SeqID_91701
atggaaacgacgacgaagaacaaaagagagaagaagaaaggagagccacttttccgtcaaaaccccaacgttgatgaagtcaccaggattcgcatttcccagattctagaacacttccgagcttccaatgatgaagtctacaagtttgatgctgatttgtccaaccaagagcgtgctttggtgcatcaaatggccctcaaaatggggtttagatctaaaagttacgggctagggaaggaaaggagagtgtgtgttcaaaaaatgaaaaagaaggttgacacggataacgggtttggaagtcttcctcaattcacattttctggagaggcaaagtgggtgctgggtgatttgtttgctcattatccgcctggcgatggaaactcatgggagatggtcggagaaaatagtgacactgctactgacagaacaaaacagaggccggatgatattttcagcaggccctctatgaccaaagctgaaattgctaggagattggaagctcttacttctagaatgaacaatgtctctaacttgaaacagatcattgaagggagatctaagcttccaattgtgtcttacaaggattcaattacatcaactgttgaatctcaccaggttgttctaatatctggtgagactggttgtggaaagaccacgcaggtcccacaatttattttggatcatatgtggggtaagggagaggtattttccgagagaattgctagtgagagaggagagactattggagaaaatgtgggatataagatacggttagaaagcagaggtggaaggcaatcatcaattgtgctatgtactactggagtgctattaagggtgctggtttccaaaggttctcattcgtcaaagattgggcgtgtgaaggatgagatttctggcatcactcacataattatggatgaaattcatgaaagggatcgatactcagacttcatgttggcaatcatcagagacatgctccctttatatcctcacctatgtctgatattaatgagtgctaccattgatgctgctagattttctcaatattttgggggctgcccaatcatccatgttccgggcttcacatatccggtcaaaactttctatttggaggatgtactttctattgtaaaatccaggcctgataatcatcttgatagtaccacatgtagtattccaaaaaccacttgtgagctaagtgaagaagagaagctttccattgatgaagctattaatttggcttggtctaatgatgagtgggacctgctgttagaattggtttcttcggaaggaaccccagatctatttcattaccaacattctttaactggccttactccattaatggtgtttgctggaaaaggtagagtgggtgatatgtgcatgctcttatcttgtggggcagattgccatttaagggccaaagatggaatgactgcattggagattgctgaaagggaaaaccaaccagaagcagccgaaatattgaagaagcacatggataatgatttttccaactccatagaagagaagaaattacttgataaatacctggcaacagtcaacccagaacttgttgatgatgttttgatagagcagctgataagaaaaatatgtattgattcaacagatggagggatccttgtttttcttccgggctgggatgatataaatagaacacgtgagagattgcttgcatcaccttttttcaagaattcctcaatgtttatgctcatatctctgcattcaatggttccaagcatggaacaaaagaaggtttttaggcacccacctcatggttgtcgcaaaattgtactatctaccaatattgctgaaacagctatcaccattgatgatatagtgtatgtcatagacaccggacgaatgaaggaaaaaagttatgatccttataacaatgtgtcaactcttcagtcatcttggatttcaaaagcaagtgctaagcagcgagagggacgtgctggccgttgtcaacctggtatatgctatcatctatattcaaggactcgagcagcttccttgccagattttcagattccggaaattaggagaatgcctattgaggagctttgtctgcag

SEQ ID NO: 17 - DNA, 1074 bp, Glycine max
  Peptide Sequence Number=SeqID_91702
atggctaagtttcttaaagcttgtgggaccttaacaggaacacccgttgaaattcgtaaagcatctgagaaattgaaagcatcacccgctcctgataaagattcagaacattcaagatttcattgttggcttcctaacacgtctgtggagaaactgcagctggatgtacaaccatttgatccaccaactcccataaatctttgccaaaaattgggaaatagtatggattcatttgagcacacgccaatcagctttatctccaaagcgcaagatactgaagaagactctgttgactatatggaaaaaagttggtcagggaaccttcatacggcagataggtctgaaaggaatgcagctttggtttcagctttgctagccacaaatactcagagaaagaacaagtctgttcgttttgaaagtgaaactgacttggcaacctatggaagctcatcagataatcggcatatgaaggaaaacaagtcaccaaataaccaaagtgcatataaaccgtctccttatcctaccccgttgaagttatttgatgagatgcaaacaccaggaactgtgtatcctgcatcattagaagagttacatacaggtagggctcaagttcggtcccagtttgtctatccaactaacaaaccaggtgataatgtcctccggtgcaaaatactcaaggagagagattttaaccctgaagaagattcaagtgagctgagtgatttggttgagaaagctcaaaatggaactcctaccccagaaaaagggtccaagagattttcaaatgaaaatgatgagatcaaatcaaatttgtcttctagaataagtcctgtatcaaccatcgaggagcattcgcctatgtcatttaagtggtggtatgacaatggcatcccgaattcaacaactaagtacaaagaggaccagaaagtaaaatggcatgcaaccccatttgaagagaggctggataaggcactgtctgaggagaattttatatctcaaaggaagcttgtttgtgggaaaccagtggaatttgatgagattgaagaaagtgatactgcatcatctcagctatag

SEQ ID NO: 18 - DNA, 285 bp, Glycine max
  Peptide Sequence Number=SeqID_91703
atgtcaattggtggattcaaacctgcaacctctcccccttgtcttcttccttctccaatcactggaccaaccttatatcttctacctaaagtgttgatgactgaaggcagaagggaagatataccttcaagcgagatcgcgttgggatttggcagcgacggagccgcagagggattggatctgagtgatgtcgtttttcacggccaacgagagatcggaggaggactgctccgaccgttccacgcgctcgaggtcgtcgcgtgtcgcttcttcgcgctttggtaa

SEQ ID NO: 19 - DNA, 165 bp, Glycine max
  Peptide Sequence Number=SeqID_91704
atgaagtcattgcattgtgaggaaggtgttgagaaaaggaggtggaacgggacaaggagaagccaccgtgggaaagcagaagctgtcacagatacaagatacgcaaatgagaatacaggattcaaatccctactacatcccatggggctcgagaagctcggttga

SEQ ID NO: 20 - DNA, 1560 bp, Glycine max
  Peptide Sequence Number=SeqID_91705
atgggtcaggtcgggtcgaaccgcaccagaacccaggtgctacacaagccgttgatctgtatccacggccacaaatgcaaccatgcaaaccaaaatagggaagctagcggtgaagccactgcactgagtggtggaagacaagttcatatccctcatgcgcgcgcctgggtggaattcgacaaaacggcgcaaccaaacggcgccacgtggaacgccatgttccgagggtacgcccaagccaagtgccacctcgacgtcgtcgttttgttcgcgcgaatgcaccgcgctggcgcttccctcaactgcttcacgttccccatggtagtgaagtcttgtgccactgcgaacgctgcgaaagaaggacgacaggtgtttgctgaaatgcgcgacaagaatgtgttcgcttggacagctgttgttgcagcacacgtggcgtgtcacgacatggtttccgcccggagactcttcgacctcgcgccgcagtgtgacgtggtgctgtggaacgtgatcgtttcggggtatatcgagttgggggacatggtggctgcgagggagctgtttgatagaatgccggactgcgacgtgatgtcgtggaacaccgtgttgagcggttacgcgaataatggcgaggttgaattgttcgtgaaggtgttcgaggaaatgcctgcgaggaatgtttattcttggaatgggttgattggagggtacgttcggaatggactatttaaggaggctttggagtgttttaaacggatgttggtgttggttgaaggtgaaggtaaagaaggtagtgatggtgtggttgttcctaatgattacaccgttgtggcggttttgtccgcgtgttcgagattgggggaccttgagataggtaagtgggtgcatgtttatgcggatagtattgggtataaggggaacttgtttgttggaaatgctttgattgacatgtatgcgaaatgtggggttatagagaaagctcttgatgtgtttgatggcttggatagggcgggagagaggccggacggtgttacttttgttgggattttgtcggcctgcacacatatggggttggtgagaaacgggtttttgcatttccaatcaatggttgatgattacttgattgtgcctcagattgagcattatggatgcatggtggatttgttgggaagagctggtcttataaaccaggctgtggatatcgtgaggaagatgcctatggagccagatgtgaatgtggaaatggcagagctggcacttcagcggctcattgaacttgaacccaataaccccggaaactttgtcatgctctcgaacatttacaaggatcttggaagatcacaagatgttgcccggttgaaggtcgcgatgagagataccgggttcaggaaagtgccgggatgtagtgttattgggtgcaatgatagtgtggtggagttctactccttggatgagagacatcctgagacagatagtatatatagggcattgcagggattgactattttgttaagatcgcatggatacgttccaaatcttgtggatgttgctcatgcaaactga

SEQ ID NO: 21 - DNA, 1146 bp, Glycine max
  Peptide Sequence Number=SeqID_91706
atgcaggagtccctcctgagatcttgctctaggaaagcagactcaccaaacagatcatcacctggggaactatctatccatgatcttgctcttgcccttgccccatccctgttccaatctagttctcatcatgtcaccaatgaagccaagacttctatgcacctcatagccaacttggccttcaagaaaggaaagtttatccatcgctctcgctctgcaccatctttattattcactgacatgggattagattttcaagaaccatctgaaccacacaagtcatcaacttcaatagtgaggctatcttttcttggtgttttcttgtatgtggcaattggggtgacagtgtacatgactagtgggagtttcaggggcactaccactttcaggcctgtagatgctgtgtactttacaatggtaactctgtgcactattggatatggagatattgttcctgactccacgtttaccaagatctttacatgtggtttcattttggtgggttttggatttcttggttttctgctcaatggattggttgcatacatttgtgatacacaagaggcattcttgttgagcatgatggatgagaatagatataagaaaattctcaggacttatatggttgatgaagagaaaggaagaatgagaataagaaccaaagtttgtctggctttggctgttgtgattggctgcattgctataggaacagtcacagtgcacttagttgaggacctgaattgggatgacagtatttatctctccattacttcggttacaacggttggttatggggatttttctctcagaacagtaaccggaagatgctttgcaattatatggcttttggtaagcacactggcagttgccagggcctttatataccttactgaatatagtattcacaagagaaatcgtaagatggcacaatgggttcttcagaagaagataaccttatcagatttagcagctgcagaccttgataatgatggatcaatcagcaagtctgactttgtcatatacaagcttaagcaaatggggaagattactgagatagacattctgcaaataagcaaacaatttgattccttggaacatggcatgtatggcaagattactcttgctgacctcatggatactgtctaa

SEQ ID NO: 22 - DNA, 678 bp, Glycine max
  Peptide Sequence Number=SeqID_91707
acgggtctccttcatcactctccacctgcacctcacttgctttcactcattcctctccacccacacgctttcccctgtgaccctaatcgacttcaacgacttcaaatcaaacacgacatcgatatccgacatcaaattcgtcaaggcgtcatgcaaatccagaatcttgaacaacttctccgacgaccaacagcttatgctaattgcctcagtgaagttgaagagctgaatcgcggaacctttcaccatctccatgaagcaagcctcgtcgatggaagttctgacgctgtcgaagatttgctcgcagagcttcttctcactcgcaaagagagttctgacgcagaccttggcagcttttatcccgcgtctgcttttgttctcgagctgctcccactcaaggcgctaaacgtctatgatgctgagcttttcaatgtggagcttgtggaagctcacgtccacggaggattttcgcacgctgacatagacctggatgcactcgcagaagtagccgaaggagaacatgcactcatcgatgcaacggaggtcgtagatggcatcggaggggatcaaatcaatatcgcggatgctactagtggaacagtaactgttgttgttaacaaagttgacagaaataatataagaattaaaaatataagaaatctaaattggtttatctaa

SEQ ID NO: 23 - DNA, 240 bp, Glycine max
  Peptide Sequence Number=SeqID_91708
atgaagttctatgtatctgccaaagacgcccgaaaaggatccgtcaagacaactgttcctgccgacaccgtcgccgctcgccggatttccagccggacggtgctggtcctcggaatcgtcttcctgctcagctttgtgagagtggcggttttggtgctggaatcttctgcggtgtgctccacctttgtagacagttcggtaaggaaaacagttgagtgtgagacaagtacatatgaatga

SEQ ID NO: 24 - DNA, 159 bp, Glycine max
  Peptide Sequence Number=SeqID_91709
atgacacctgatatatatttcccctcactttggagatcggagattcctatgagaatgagaggacaagacagctcggtcaaaactcaatcgtcgaaattcaatgggaacattttggtatctaacctcaacttcaatactggagatcggaaattccactaa

SEQ ID NO: 25 - DNA, 630 bp, Glycine max
  Peptide Sequence Number=SeqID_91710
atggaaatcaagaagctccagcctcgcttctctctcggccgccaatcctccctcgcgccggagcgcggcggctgcggcggcgacgcgtcggaggcgctggacccggcggtccggttgatgtatctggccaacgaaggcgactcggacggtattaaggagctcttggacgccgggagtgacgtcaatttcaccgacattgacggccgcaccgcgctccacgtcgccgcctgccagggccgcaccgacgtagttggcttgctgctccgacgaggcgccgacgtcgatcctcaagaccgctggggcagcacccctctagttgatgcaatgtactacaaaaatcacgacgttgtcaagcttttggagaaacacggtgcaagacccccgatggctcccatgcatgtgcaaaatgctcgtgaagtcccggagtatgagattgatccttctgaacttgattttactaatagcgtttgcataacaaagggaacttttcggattgcattatggcgtggaactcaggttgctgtcaagacacttggggaggaattgttcactgatgatgataaagtgtgggttggtctacttatgcaagctgtcgtttcattcatgtcaattggattattcaattcttaa

SEQ ID NO: 26 - DNA, 1317 bp, Glycine max
  Peptide Sequence Number=SeqID_91711
atggggaggcgggacgggtttgagccggacgagatgagtctggtgagtttgctcggggcttgcggggagttgggggacttggagttggggaggtgggtggaggggtttgttgtggaacgtggcatgactcttaactcctatataggttctgctttgattagtatgtatgctaaatgtggggaattggagtctgctagaaggatctttgatggcatggctgcaagagatgttatcacgtggaatgctgttatatcaggatatgctcagaacgggatggcggatgaagcaatcttgttattccatggtatgaaggaggactgtgttactgcaaataaaattaccttgactgcagtgctctctgcatgtgccaccattggcgctctggatttggggaaacagattgatgaatatgcatcacaaagaggatttcagcatgatatttttgtggctactgcattaattgatatgtatgctaagtctgggagtttggacaatgcacagagagttttcaaagatatgccccaaaaaaatgaagcttcttggaatgcaatgatatcagcacttgctgctcatggaaaagccaaggaggcactatcactatttcagcacatgtcagatgagggtggaggtgcccgccctaatgatataacatttgtagggttgctttctgcttgtgtgcatgcaggcctcgttgatgaaggatatagattgttcgatatgatgagcacattgttcggattggtacctaaaattgagcactactcttgtatggttgatcttttggctcgtgctggtcatttatacgaggcatgggatctaattcggaaaatgcccgaaaaaccagacaaggttacattaggtgctttgcttggtgcctgtcgaagtaaaaaaaatgtagatataggtgagcgggttatgcggatgattctggaggtggatccttcaaattctggtaactatattatctcatcaaaaatatatgctaatctgaacatgtgggaagattcagcaaggatgagattgttgatgagacaaaagggtattactaaaactcctggttgtagctggattgaggttgagaatcacttgcatgaatttcatgctggtgatggtttatgccttgactctatagatctaagtaacataattgatttgctctatgaggaactcaaaagggaagggaaaatcggatcaaggggaactcagttgtctcagctcaactatttcatattaatgttaataggattggttttatcggattcagtggagaatgctgataaagagttgatgaggtactgggaggtgatacaagtgtaa

SEQ ID NO: 27 - DNA, 342 bp, Glycine max
  Peptide Sequence Number=SeqID_91712
atgaaagtgttttcacttttcggagagtggaactctttttggttgttcaagcaggatgaaaatgatagggagtccagcccaaaatgcgcgcgttacgcgctaagcgtgcaaggcagcacaagcgctaagcgaggcgttaagcacgaagatgcaggatttgttacgtgcgctaagcgcgaggcacgcgccaagcacacgatccaacagaagcacatactaagcctacagcacgcgctgagcgcacgatctgaacgcgctaagcgcacctatgaaggcccaaagctcatttctgcatctataaatagagatccaagccaagggaaacacacatcttgcctcaaa

SEQ ID NO: 28 - DNA, 408 bp, Glycine max
  Peptide Sequence Number=SeqID_91713
atggacagaacaaagcaaggcagcaaaggtcacatttggctagaaacagtgaaaggtttgcagaaacttgccacagaattctcagggatgatcataaactatggagagcagaggctgcatatgttggggatggccaactgtcacaactggccagaaaatgctgagaaatactggctatgttcccagaaaaggaaattaggattccagcaatccaccattgataacactaactgcatgctcattcaatttttccaaaatgctccagctgctccactttgtgagcacaagatagcaacactattcggcactattgacaactatgctaaagcaatgctcatttacaaaggtaaagggaacggacagaattacacatttgccttaccaccatttgaaccagttaacatttaa

SEQ ID NO: 29 - DNA, 1401 bp, Glycine max
  Peptide Sequence Number=SeqID_91714
atggcagtgagctctgactgcttctgtttgttaccaatcgaagtggttttaaccatcctttcactccttcccttcaaggaagttgtgagaacttgtgtactctccaaggactggttggacatatgcaagtccactccaaacatagagttcaatgaactctttttcgtgaaacccgatcaatcaaatgaaacaagagaagcccagagaagggcttttcttgagttcataaaatcttggattgaaaaccacaaaggagctactatagacaagttctctttaagtttatcaatgcctgcaaatgttggcgagatcattaatgaatccgttgcttttgctacacaacgtggggtgaaagagttggatcttgactttgttgataggagtaagaatgagaatggtgattgttcatacgatagtgacgaggcattgtttgaattaccatcacgggtttatgagcacataagccttgagtctttaaagttgtattcatgcagttttattgagactaaagtgcttaactttcatgcactcaaagaagtttctttgggttggatggaagtgaggcttactgctatcaaagcttttcttttcaactgtaaaaagcttgagtgtttgagttttacaaggtgttggaactcagataagtttgacctaggtgaagaagaacacatgggtctaacaaagctcttcctggacaagtgcaattttgattttgattatttcagagtgaaagcaccaaatcttaaaattttcaagtattgcgggtggataaactttgccgtcgtagaaattgattcactcgcaatggaagaggtagatcttgacttctctctagaatcatcatttgaagaatttggtcatcctatctacaatctggtgaaagatgtttgtactgctagagtgctgacagtatgtagttttgtgcttcaggtaattcctactggtcctgaacagctacgtatggaagttgacatggatgcacgacatttgataatgaagacggccttggatgacgatgagtttattggaatctcattcttccttaacagttgtcccctcttagagcgtctcaccattgaaataggtccaaaaagtgagctgtctgattatgaaccagcgtttgaatttaccagcttacttttctggattgaatatttgaatgtttgcgaatgcttgatttcaagtcttgaagtggtggagattaatggctttagaggaactctgaatgaatatcgcttcctcgagtatttgatctttagtgggtatgtcttgaaaaagattatcataaacatgttgaaggatgattctggtaggactgtggagtattattgccgtcatatggcagaacttctgttgacatgtccatgcacttcaagaaacttagagatatcaatcttttga

SEQ ID NO: 30 - DNA, 3126 bp, Glycine max
  Peptide Sequence Number=SeqID_91715
atgcagtcattccaaatttcgtacaatggcctccgtaacagcactgttcttagaaattttgtacaatctagagcagatttctcatgctgtctgaagggcacatctgtggggttaaataaatacaatggcgcgaggtataagcgtaattttctgtgcaagagtccagtttgcatttcatctatgaaaatttcaaatgcatcaactggcacgttggaggaaatgacggaggaggaagagctgaactctttgcgtccgtgtgaaatgcaagttaggacagtgggcatggctgcttgcaacaatgaattttccacaaccactttaggaaaaaaattgtccggtggtgattatagaggctggactatggcaaaagataagttaactgaaaataaaaaggaaatgaatggctcaaataaatttgagagggaaaatggcagtttttctgcatctaatggaattgcttccattgctcagaaccaggctgttcctaggaacggggatagcattattgtactgcaggatcctggtacacatgccccatcttctgttaactattctgtattaaacaattcaaaggtgttaacagattctgaaaaggtgattcaccagtataacggatcttctttggggattggtaaagagaaagtcattgtagtcaatggtgatcatggtttggatgaaactgcaaaggattcaactaatgcaacacttactaaacaggcatgtggtaccgaccaatcaaagctccgggataggctttgtagtatatatgatgatattctggttgttgataatattcctcttgcagaggaagtttctaagatgcttacaacaaagtaccggcatcttatttatgcatgtgataccgaggtggccaagatagatgtcaaacaagaaactcctgtagatcatggggagataacatgcttcagcatttattgtggtccagaagctgattttggaggtggaaagtcttgtatctgggtagatgttcttgatggtggaggcaaagagattttagaaaaatttgctgaattttttagtgactcttccatcaagaaggtctggcataattatagctttgactgtcatgttatagagaattatggattcaaagtttctggatttcatgctgatacaatgcacatggcacgattatgggattcttcaagacatttggatgggggttattctcttgaaggacttactggtgacagaagggtcatgtctagggctcagctgaaccatgaaaaggatttgactggtaaggtgtcaatgaaaactatatttagtaagaaaaaattgaaaaaggatggatctgagggtaaaacaagtatcattgctcctgttgaagagctacagagagaggagcgtataccttggatatgctattctgccttagatgctagcagcactttgaagctgtatgagagcctaaagagccatctttcagacatgccctggaaatttgatggcctgccagtttatgggaaaaccatgtatgatttctacaatgaatattggcgaccatttggtgagcttctagtcatgatggaatctgagggaatgctagttgatcgggcttatctcgaaagcatagaaaaggtggccaaagcagagcaagaggtagctgttaatagattccgcaaatgggccactaggtattgccctgatgcccaatatatgaatgtgggaagtgattcacagttgcgccagctgctttttggtggcatcgtgaacagaaaggactccagtcagacacttccaactgaacgaatattcaaaattcccaatgttgataatgtgattgaagaaggcaagaaggctccaaaaaaatttcgtgatataaagttgacgagcctaggttataacctggagactgagatgtacacagcaactggttggccgtcagttagtggtgatgctttaaaggccctggctggaagtatttccgctgattatgacttttttgatgaggattgtaacttggatgatcttgatgatgaagatgaaaatccttctcaaagtcaagttgcatctgtaaaaattgataaatctgcatatgggacagcctatgcagcttttccaacagaggaagaagggagagaagcctgccatgcaattgctgctttatgtcaagtctgttcaatcaactctttgatctccaacttcatccttcccctgcagggacataatatatcaggaaaagatctccgtgttcattgttccttaaatatcaacacagagactggacgcttgtcagcaagaaggccaaatctgcagaatcaacctgctctggaaaaggaccgatacaaaatccgtcaagcattcattgctgcacctgggaattctcttatagttgctgattatggacagctggaacttaggattctggcacacctcgcggactgtaagagcatgttggaagcttttgaagctggtggagatttccattcaaggactgcaatgaatatgtacccacatattcgtgaagcagttgagaaaaaggaagtgcttctggagtggcatcctcagcctggtgaagataaaccccctgttcctcttttgaaggatgcctttgcttctgaaagaagaaaagctaaaatgcttaacttctcaattgcatatgggaagactcctgtggggctttccaaggattggaaggtttctgtgaaagaagctaagaaaacagttgacctttggtacaatgatagaaaagaggttttgcaatggcaagaggagcgtaaaaaggaagctcgtgtgttacattgtgtttacacattgctagggcgagctcggcggttccctttgatggcccaagctaacacctatcaaaaaggtcatattgagcgagctgctattaatactccagtgcagggtagtgcagctgatgttgccatgtgtgctatgttgcaaatttccaagaataaacggttgaaggagcttgggtggaagttacttctacaggttcatgatgaagtcatattggaaggaccaacggaatcggctgaggttgcgaagtccatagttgttgagtgcatgtccaaaccctttaacggcaaaaatattcttaaagttgacctctctgttgatgccaagtgtgctcaaaactggtactctgggaaatag

SEQ ID NO: 31 - DNA, 4938 bp, Glycine max
  Peptide Sequence Number=SeqID_91716
atggcgtcctccatagcctcgcagttagaagctatcagatccttcgccaaaaccgattctgatcctctcaagaggccatacactcgcccttccatcttgtacgatcccaaaaaagccgctgacatcagcaccgaaactattttcaccgaagctcttcgaggcttagagattcttattggcatggatgagcggttcaggaactataagaacgatttgtttagccacagaagtatagagttggatagagagttaatgggaatagaacagaacaatcaacttaatgtctccattgcttcatacttgagactactttctggatactttcttcatacctctgctcttcaaacgctcgagtacttgatacgtagacacaagattcatgtatacaacaatgaggatttgattttgtgtactttgccgtaccacgacgagcccgaatttgttcgaatagtacagatactcgatacaaggaatactaaatggggatttcttgatggtgtgaaagcctctggtgcacggctacctagaatggtcatagtgcagcagtgcatccgtgataagggcatattagatgctctatgtaactatgcatctccatcaaaaaagtctcgaccttcaatgcctgcaattcgcttttgtactgctgttttcgttgaagttttgggtactgttgtgactgttgatgatgatctcgtaaagaggatacttccttttgtgagtcttcagcctggcattaagggggtttcagatcacaaggctggttctttgatgatcattggcttgcttggaaacaaaactgcattagctcctaaacttttgaatagtttgatacgtttggttgctgaggttgctcgtcaggaggctacagagttgacagatctccattggtttcgattgtcccttattaccttaattagtcttgttcagattctgtttgtcgtcaatacaaaatacccttctgaattacgaggtgcagctcatcatttccttcaggataacaaagcacgttctaagaaagatgattcattgtataaggttttatgtaagatgttggatgggaattcggattcgtcacttgatatttcagactcaaatgctgatgttcgacgtgctacactgcttgatttaaataattccgttatcctgaaagccaaggcagttggtttagagcttgaggataaagatctaacagttgttcaagcagctttacgtgttgatggcttgccgaatgtaatagattcttctaagcttcttgatgcactacaaaaagtgctaagaagatgcactgacaaactgctgtcagctgataactatagtctaaatggtgaagttgctgtcacttgtctaaagaatgccatctcctacttcagtgatcatactgattacttgaagaatgttgctgctatgatttttccgttactccttgttctaccacaggctgagtgggaaacatcagtgacagctggtgatgcctcattggatgagttcaagcctgaagtgttagactgggattgcagtgcattctttaatgagcttttgtatgtcaagctgagacatctaaatgtgaagcgtgatgatgataagtgggtcaacaagataagggatctgtttgtattttttgcttcctctaaattgaagcatacattcctcgaacacctccattacttagcagcacagtgcaaaatatcacctccccgcctcttatctaagtttttcacagatgaaggtgttactgctgcagttcaggttgaaagtcttcaatgctatgcatttctttgtagcctgtcgcaagataaatggaaaattgaacttttagctgaatttccttctgttcttgttccatttgcgagtgataatcagtctataagggttgctgccatgagctgtattgattcattgcgtacattgtggtgtcatgttgagcgttctggcaagaaaaatgttgtggagatagagatacagatcaagctaatgattttatctttattcaaaggaattgggaatgcccttatgcacattccagaagttgggccattgttgtcctcttttctggagcagtactatgatgagctcaataagtcttgtccaaaattgtcaaacactgaaactcagatagtgtgccttttgctggagagctgtgttatgtcatctccctctggtggaaatgatcttcaaaatcttttactgaaagctttgcggttgggtgccatgacttcggatgaccctgcctgtgtaaagccttgcatcactgtcttgaacaaacttaacagtcaattctatatggagttgaagaatgaagtaaaggagggtttattttgtgagctcgtgtttttgtggcataatgataatggtgatgtacaacgtgcaactaaagaggcattaatgcgcatcgatattagtttctcaactgttggccacatgcttgatcttatacttgcacagaagagttgtataagtagttcagcagaagaaaagatggtgaagaaacaaaaattcataggacatcaagaagcaggatatcctcctaatgacatatccagaagagataatccagtctacatccttagttcccttcttgatgttttgctactgaagaaggacataacaaacaggcatttacttttagggcccttatttaagcttcttagcaaggtgttttcaggtgaatgggtgaatggtgcctattccccggtgagaagagtctttccaggcgaagttttggagcatatgcttgatattctagaagttattggacaagcagctgtcacacaggatgtgctttttatagttgttaagatgaaatctaacacggtatcaaagcctactgccatttctgtcgtttccaagtttcctttgtgcatcacttggtcagccggcatccgtggagtgggagggggtgttgaaagtcctacatcaccaatagaaattgacagtcattcaaagcatgtttttgaggatcttatatctgcaattgttccgtgttggctggctaagacagatgatgtggagaaattactaatgattttcatggatatattgcctgaaatcgttgagcacagaaggctgtcatttgtgttatatctattaagaactttgggtgagggtaaaagcttagcctcattgcttatcctacttttgcgttcattaatttcaaggaaagctgcctgtttccttaatgtcaagacacgagatgatttaacattttatactggggaatgggaatataaatttgcagtgcaaatttgtgaacaatatacgagtatgatttggcttccttctttagtcatgctgcttgagcagaggggaaatagtgatgttgaccaggcactgtttctggaattgtttattgtaatgcaattttccttgcaaaagttgcaagatccagaatttgtgtttaagttggaatcaggagaagatactgcagtcattcaggctcttgggctgttatgtgaggttgcaagaaatcacaaaaatgtcagcttaaagcttaaaggcaataaaggttcaaggtcaactccaagttttcttttgcttcatatgaatgaaacttctcaagaatcacttaataaattgtgtttagaaattattcgagtacttgatgattcatcaaatacctccttgaaagtggcagcagtttcagcattagaagttctagctgaaagatttccttctaataattccatctttagtctgtgccttggatctgttacaagacatattgtgtctcataacttggctgtgacttctagctgcctcagaacaactgctgccctgatcaatgttctaggtccaaaatcactggcagaacttcccaagattatggacaatgtgatgaagtcatctcgtcgagtattggctagtttggataagaaacccgaaaccaccgatgttttatcagcctcaaatgaatcccatttttatgttctcatcactttggaggcagtcgtggacaagcttggtggatttttaaatccatatctcacaaatatcatggagcttctggtgctttatcctgaatatgtttcaggagtagatgcaaaagtggagtctagagctcatggagtacgaaagcttcttgctgaaaaaattcctgttcgacttgccctgccacctttgttaaaattatacccagctgccattgaggctggggataaaagcttaacaattgtatttgatatgttgggaaccataattggtacaatggacagatcatctattgtggcattccatggaaaggtatttgacctttgtttggttgctcttgatctgcgccgtcaaagtcctccttcagttcaaaacattgatgtagtggaaaaagctgtgcttaacacaatgactgttctgaccctaaaacttactgagagcatgttcaagcctcttctcataaagagtattgagtgggcagaatctgaagtggatgaaactgcctctagcggaagcattgatagggtcatatcgttctatggcatggtaaataagcttacagagagccatcggtcattgtttgttccttacttcaaacacttgcttggtagttgtgttcatcatcttagtgaaggtggagatgtgaaagtgtctagagtgaatcagaagaaaaaggccaggattctggatgatggcaatataaaagaaataggcagtgtgtctatcaatgcctggcatctcagggcactaatgttgttgagacctattgtttcacaacttgttgtagatccaccagcactgttggatgacagcattaatataccaagtgtgaaggaagttgatgacctactggttgtatgcattggtcaaatggcagtgactgctggatcagaccttttgtggaaacctttgaatcatgaggcagtagctgtagtgcagcagcaagccaactgggctcctagcaatggcagcaggtccaaatatggagtttccaacattagtcattcaaactag

SEQ ID NO: 32 - DNA, 867 bp, Glycine max
  Peptide Sequence Number=SeqID_91717
atggaggagtcttcgtacaccggtcttcccactagccacttgctcggttcagttcctgctgtcataactgaagaaaataatgccacgaaacatgtggccaccggtgcaaatatgcaaacattccctcccaacaatggaggagacagaggaccaggacatcaaactcttggcagtcctactgaagcttttgaacaacagccagcaaacaactggaggggaatctttagcatgtcatcatattcagagtatttcaatgtagacacagatgttgtcttaatcagattgataagttccttgaatccagttgctgcagactttttcagcaagatagatgctaaccctgatttatatgggcttatatggatctcaacaacattggtttttgtgcttgcctcacttggaaatctggccacgttccttatgcaaaaacatgcagataacagtacctcttggagctttgatgtcagctatgtgaatgtggctgcatgctctatctatggctatgcaattgtggttccattggcatactacttcttccttcagtatatgggttcaaatgctagccttataaggttttggtgcttgtgggggtattccctcaccattttcatcatgtcttctttcctgttgataattcctgttgagtttcttcggtgggttataatactccttacgggcgttgcctcggcaagctttgttgccttaaacctgagatcttatatagaaggcaatgaactttcagtggcgattattgcagcatttttcttgcaaatggctttggcaatcttcatcaagctgttttgcgtgaagccaaggcaatttcctatgctggtgaatcaaattttgctcttttcatctcctgtttga

SEQ ID NO: 33 - DNA, 1482 bp, Glycine max
  Peptide Sequence Number=SeqID_91718
atggccatgaataatggcgatggaaccgacggaggggcattgcagagggtgctttacatgtggggttaccttcccggagctctgccgcaaaggacgccgctcttgacgccggttgccgttagggttccgccgtgtgattattcttggaatgatgtttgcggcggtggctgtggattcgctattgctatatcagaatcagggaagctcatcacatggggctcaacagatgatctaggccaaagctatgtgacttctggcaagcatggggaaactccagagcctttccctcttccaaccgaaacctctattgtaaaagctgcagcaggatgggctcattgtgttgctgtaacagaacatggagaagtttatacatggggatggaaagaatgcattccctctgggaaggtatttggtgaatcatcaacaggggtaagtcttgaaaaagatgtgccaggaaggcatactccattgttcacagagcaagtgagccctcgttctcaaggctcaagatctactggaggtactgcctccagtaacagtggagaagaaagtacaaagcgaaggagagtgtcttcagcaaagcaaacagctgaaagctcgtcatccagtgatgatagtctgacagcattcccatgtcttgtcacactaaatccagggataaggatagctagtgttgcagctggtggacgtcatacactagcattgtcagatacaggactggtgtgggcttggggctatggaggtgaagggcagcttggtctgggttccagaatacgtatggtttccactcctcatcttgttccttgcattgattcctcttattatgttaaagatagatctgctacactggctcgaggaaacatgggttcagagggacagacttttagaattcctggaagttacataaagagaattgcttgtggaggtcgacatagtgcagtaattacagtaaattcatatgtactaatattggaatatctatctgttgagctgacagatgctggagccttgcttacttttggttggggactttatggacagtgtgggcaaggaattaccgatgatgaactaagcccaacttgtgtatcttccctattgggtatccacatagagggaattgctgcaggactgtggcatacagtctgtacatctgctgatggtgatgtgtatgcatttggtgggaatcagtttgggcagttgggaactggtgctgatcaagccgagactctaccaagactagtggattcaccgagtttgaaaaatttgcatgctaagaatatatcttgcggtgctcgccacactgctttagtaacagagggcggaaaagttttctgctggggatggaacaaatatggacagctgggccttggggacgtgattgaccgtaacattccttctgaagtcaccattgaaggttgtgtccctaaaaatgttgcttgtggttggtggcatactcttcttctggccgagtcccacacttga

SEQ ID NO: 34 - DNA, 420 bp, Glycine max
  Peptide Sequence Number=SeqID_91719
atgaccaaggcgcctgcacgcactcgcctcgcccacgcgtggggactagggagcgggggcagcgtgacgtccttgtgtggggaagcacgagatttgaacggcgtttttcttcaattctaccaggttccggtccggttggagggggattccgtcgcaggaaaggtagaggtggtcggcgccgagggtgcggttccagtacgggaggtcgttgcggatgcgtgtaaggacacgcgtggagaagtctggggagaaagggtcgaagaaaaggtgcgcttcctcgggatcttgggtgaggagatgatgaattgtaattgtgttgcgtttgtgtttgtgacatcacaaccgaagctgcatagtgacaataacagtaaccgaaacattctagtactacagattgaagcttcagtttgtgaaatttaa

SEQ ID NO: 35 - DNA, 588 bp, Glycine max
  Peptide Sequence Number=SeqID_91720
atggaagataagtatagtctaggcaggcagcatagtgggatatggaagtccttgagagatggagaatttgatgaagaagaagtttgggatgttttcaagaacagaagtgattatggttcttcttcttctggggttcgcaagttcaaagacaagggtaaatcctcttctgttcctgctaggcctagttcagccagaatgatcccaagatctagcaatagcagtaacaatagcagtgctagttcctccaatgaagccaaggttcttcagcaatcagcacctgtcaacattcctgactggtcaaagatatataggactaaaacccccaagaatagtgtttcaaggtttgatgatgattatgatggtgatggtgctgctaactatggtggggatagtgatgaggatggagaggaaaatgatgagagtgattccaagcttcctccacatgagtttattgccagaaggcttgcaaggagtcggatttcctcattttctgttttagaaggtgctgggagaaccctcaaaggtagggatcttagcaaagtaaggaatgatgtactctcaaaaactggtttccttgaatcactataa

SEQ ID NO: 36 - DNA, 786 bp, Glycine max
  Peptide Sequence Number=SeqID_91721
atgccttcggctcaagatccattctacgttgtcaagcaagaaattcaagaatctattgataagctaaaatccacttttcaccaatgggaaaacactgctgatgttggcgagcgatccagtctatcaaaggaagttcttgctagttgtgaaagcattgcatggcaggtggatgaattggacaaagcaatttctgtggctgctagagatccttcttggtatggcattgatgaagtggaggttgaaaaccggaggaagtggaccagtgatgctcgcacccaggtgaacaaagcaaagagaacagtggaagctggaaagggctcaaacaatgctagtctaagtgggatgcacagggaattaatgaggcttcctagttctcatcaaactacatctaaccaatatgctgcccaggataatgatgatttcatagagtcagaatcagacaggcagatgcttcttattaagagacaagatgaggagttggatgagcttagtttaagtgtacaaagaattggaggtgttggacttactatacatgaagagctccttgcgcaggtcactggttcaaatcccagaaacagcctcttcccttgcggggttaaggcttcgtatttctatcctcccctaaccccactaggtgggagccttgtgcactgggctgcccttgaaaagattattgatgaacttggcaatgagatggacggtacatctaatcgcctagattttgtccagcgtgtgtcattgtttatgatatcagaaaaaagtggcaatggtcatgaagaaggctag

SEQ ID NO: 37 - DNA, 2175 bp, Glycine max
  Peptide Sequence Number=SeqID_91722
atggaggagcagacttttgtttccaaagcgagaaccgcctttcattccgcggcggcgaaagcggagcgtgttctcttggatttcaaatccgatcgagcattgactcaatttgttgaccgtcgtgaagaagatcacgataagcaatcgtcgccaaacaccttcaccggccaacaaccagaagctgaatctcctcacaccaacgaaaacgattccaagcttcgtagtgaattgaagcatataaagtggaggcctccacatttaggaataaagcaggattggcaggatagaataaagaacatccgtagagggagaaaagaagttgaagatacagataaagttggggatgcaagcatggcagttccattttatgacgataatttgtacctcctgaacatgaagaatgatcttgaggccaaggcttcagaagcaattccctcagttgaaagcttaactgctgcaactaaagatcccattcctccatcatctgtgctaaagcaattggctatagctgttgaggctggaagtaaggcaaagtcaatgaaagatttaatagcttcatcaggagtttcttcacctgctagagagagggcaggcttaagtttctcggcagttaaggctttagtgctacgtgaaaaggaggacaaacttacatctgagtttactagcaatgagaaagttgtgcagttaattaattctctgtttgatccagaaggagatttccttagaagaaagatcaactctaatctagaggaaactgctatgacatctttgccaagagatattcatggtgcacctcccgagagccttgttgttaagctagctgaaatccttggaaactacaagactcttagaaaaatggctcttttctggtgcagggttgttgctgaactaagaaaactatggtctgaggaacaatacttaccaggagtcccccagaatgagattcctgatctgaagttccgtattattgccaccgaatctttagactctatgatgatgcaagctaattcagacataaaagaatcaactgattgttgcgctggagctcctgcaagccctgttctatatgctagattgaatagtggggagcttgttcttcgacttggtgcagatcatcctgctggagatatgacattgttggaaactggcgagcctgtgtattctccaatcactcaggaaggacctttgcttacagaagatctaatcagggaaacagaggagtttgtgctgcggacagggagtgttggtgctgggtgctctcaactgctctcagatatgcaagctttcaaggctgcaaatcctggatgtatcttggaggattttgtaagatggtactctcctcctgattggacagataatgaagcaagtacagaggatagtgatgtttttgatagtggggagccattgtctaccagaggtcagctaagtcagcgaatgcaaaaagaaggatttgcaattgccgaacctatgctgtctagtaacagtgacttctcgaagttattctatgactgcaaggagtacataattgttgcttgtcaaaacaacaaattgaatgagaaagttgatgatcttgttcaggtatatgaaacagtggagaaaatgttattggatcctgaagaagctctaaagatgattaggcagacagaggaatcaacaatggttaccggtgaaccaaggagcccgtttaggacgcttagccttatctttggaggcaaagataaattattgaggaagtctgtctcaaaagatcagacaaacgacgaagagaagtcaggtcggcagtcattctctagtttctttgacagcaagtcatctttgtttggaaagaagcctcccaagtctgggttcccatctccttctgctaaatcttcaatcgatactgacaagttttggccaagcaatgaaaaagggaaagaaaagagattggaccttattgggagaaaggtggataagtcaccggattgggctggggcaacaaccattgaatgtggaagtgccttggtagttaatggatcacttgctaaagggaaatgctgggcacttttgcatgcaagggaagcagtgaagattggagctggaggcacttcatggggggaagcttggcttgttcagttgctctttcaggaagatacttttggcttgggatattgggataagcttatttttggggagtga

SEQ ID NO: 38 - DNA, 852 bp, Glycine max
  Peptide Sequence Number=SeqID_91723
atgatacaacttttattcatacttttgatgatccaaatagcattcatcttgatattatcttttgcaaatccaatacgaaaattggtggtgatagggctcgaccttttgaagcaggggaggggccccttagtcacaaaaactgtggcagcaactatgtgtgtggtcttgagctccaccgtgtatactataaccaaaatccaaaaacgttcaaaggatgctagcatagttaatccaactgatgaggtgttgatggcacatcgtctcttggaagcagctttcttgggattctctctgttccttggattggttatcgacagacaacattattatattagagagattaatttactaaggaagaacctggaaacatggaaaaaacgaaatcacaatcatgactccttaaagagaagagtggaaactgagaagccaaatcccaaaggtcgagctcaagtaagcggaaatggctgcggtgactttgctggaggcaccggagggaacaccggagggaacaatggtgatggtgatactgatactggtggtcgcagtgacggtgacacaggccgtgatggcgacacgggcgacactggtggtggtgatggcactgcttgctcaaaggcacacgatccaaatacgcataacctcccaaaggggcatactcttccacacctaccacagttgaaaagctccatcaatgatgttgatgaagaagatgaggcatcagtggcattctcatgcccttcttttggtgttggatttccctctattttgatcagcaacagcacaaaaaccaatgtaacaagagctgaagatagtgctcctagactcatcttgaggaaatggcttgaagggtag

SEQ ID NO: 39 - DNA, 393 bp, Glycine max
  Peptide Sequence Number=SeqID_91724
atggtgttcatattagcgaccgacttgttggtcacaaacgcgattttcgagggtagagggctgcaagcattttctggtctccttggtgacgttgtatgtgtgtccattccccacgttccgtcgctgcgtttaatggctatgatggctttggttccaatcatctccgcccaccctatcaacattatttctagtacgattgattcattcgtcacactgtggaatgcttcactgcagggccgaggcccaaagagagaaaacacagcactgtcaaaatggttaatgctaagggacaagaaggaagaagaagaatgggagaagaaagcggcggatgaccggagagagggaggagaaaaattccaaaaggaaggaagaaaaactgattcgccaaaatga

SEQ ID NO: 40 - DNA, 537 bp, Glycine max
  Peptide Sequence Number=SeqID_91725
atggaagtatttagggttgtgttgagttgttggcgaaagcagaggaagcggttgaagaaagaaatgaaagaattgcaatttgacaaggatgaagagctctctgaaaaaattgcgaggtttggcacttcaatcacaaacatgcttcctccaagtcaatcattcagcctctggcctagcttgacgagcgagctcgggctacccagccatttatttcttgaaaatgatatcataccttaccgtacaagaaaacttaatgcaagtgaaaaactaagacagatgcgcccatctttatcacggaagttcagctcatatgtgctagccacaccagttgatgctaagagttcaacctcttcagggtcaaataatccaaagccttccaatatgcaggcaaatttaagagaacctacaaagaatttgtggcattcatccccattggaacaaaagaaacatgacaaagatatgggagatgagttttctggttcaattatcagaagtgcacaatcattactcaaggaaagtaactgcctccttcagtag

SEQ ID NO: 41 - DNA, 1218 bp, Glycine max
  Peptide Sequence Number=SeqID_91726
atgaaagattacaggggactagaaggaaatgcagaggagccgaacgcatcaaggaaggaaggaaggaagatgttgggtgttataaggcacaagagtattcgccctgccttctccgcaatcagacacttgtcttctgcagctaaagagattactgtcagggaggctctgaactccgcactcgatgaggaaatgtcagctgatcctaaagtgttcttgatgggtgaagaggttggggaatatcagggtgcatacaagatatccaaggggctgctcgacaagtatggccccgagagggttctcgatactccaatcactgaggctgggtttactgggattggagttggcgctgcttactatggtctaaggcctgttgtggagttcatgacttttaacttctccatgcagaatacctgggttacgaggtttcaacacatgatgattcatttcactaggaaaaatgttgacttccatgcaatagatcatattattaactctgccgcaaaatcaaactacatgtctgctgggcaaatatctgtgcctattgtctttagaggacccaatggtgccgctgctggagttggtgctcagcattctcaatgttatgcatcttggtatggttcatgccctgggttgaaagtcttgtcaccatattcatctgaagatgctcgtggtttgcttaaagctgctataagggaccctgatcctgttgttttccttgaaaatgaattgttatatggtgagtcattccctgtttcggccgaagttcttgattccagtttttgccttcccataggaaaagcaaagattgagagggaaggaaaagatgtgactattacagcctattcgaaaatggttggctttgctctcaaggctgctgagacactggcaaaggaaggaatcagtgctgaggtcattaatttgcgttcaatccggccacttgatcgatccacaatcaatacttctgtcaggaaaaccaacaggctggtgacagttgaagaagggtttcctcagcatggcgttggcgctgaaatctgcacatctgtcattgaggagagttttggttatcttgatgcaccggttgagagaattgccggggctgatgttcccatgccatatgcagcaaatctggaaagaatggctgtcccacaggttgaagatattgttcgtgctgcaaagagagcatgctacagatctgtgcctttggccgcatctgcttga

SEQ ID NO: 42 - DNA, 936 bp, Glycine max
  Peptide Sequence Number=SeqID_91727
atggagatgcttcttcgaccggtcctttttcctcttctattgtttcttttctgctcttcttgggttgaaggagccatggattgttgggggaacaaaatccaacacaccatcgtagttgatcaacatggcaaaggagaattcagaaccgttcaagctgcttttgattcgataaaggaaaacaatgatcgatgggtcaaagttcacataaatgctggcacatacacagagaaagttcaaatttccatttacaagccatgcatctttttagaaggttccggcaaagaggtcacgaccattacatcaagtggcttccacagtacttccaccattaatattaatgcatcaagtgatgacaacagccaaagtgacaacacgggtgctacatgtgtttcttttccatccaatgttattgttattggcattactttcgagaactcgtttaatctggtgggatcacaatccatcgcacctgcacccgcggcagccatatacggtgacaaatctgtgttctttaagtgtggtttcgcttgcaccattaatgctactcaggaaagatcttttccaggttttgtaacagcccaattccgagattcagaaattgacacaagtggttttgtatttagagctggttgcgtaatgggaattggtagagtgaatcttggaagagcatggggaccttattcaagagttatatttcacggaacatacttatctccaatagtatcaccagaaggatggaatgcttgggattacactggccaagagtgggggtctaacttaacttatgcggaggttgattgtaccggaccaggagcaaatactgcaaaacgcgttaaatgggaaaagaaccttactggttcacagttaaatgaattttctttatcatcttttatcaaccaagatgggtggctttcctacttaccaattacattttag

SEQ ID NO: 43 - DNA, 1413 bp, Glycine max
  Peptide Sequence Number=SeqID_91728
atggcaccctcaatttgttttcttcttctatcccttctgttcctttcatcctccacaagtggtactgatgaagagggtttcatctctgtgatcatatctgataagggccttgattttgccaaggatattctgatagaccaagctgttgcctctattgttcagtctcagctgccacagattgagaagactgtgcaagtccctcttgttggaaaagccaaagtggttctttctgacatcactatcaatcatatccaagttaattcttcatctgttaatactggagagacaggcattgctcttgtcgtttctggtgccactgccgacttgagtttgaactggaggtactctgttagcagttggttagtcccaattggaatttcggacagtggaaccgctactgtgaaggttaatgatttgcaagtgggacttactgtgaatttaagaaaccaagaaggaactcttaagttgaatctcctggattctggatgtcatactgtgggacctgaaactgggaggccagataagagtgtttccgttatcttctgcaacaaaaactattctggggaatataaagctatatttcaatttttttgcaggctagtagatgcttttgcaggaaatatagcatctgcagttgaagaggcaatttctaagaaaataaatgaggggatatcaactcttgaccttttattgcaatctcttccaaaaacaatcccattagacgaaactgctgctctaaatgtttctttcatggacaacccagtgctgagtgattctgctattgaattagaaattaatggtttattcacagggagaaatgaagttttggtacctcaagcttactacagaggatcaggcctttctctttctgcttcctgtggtggcagttcaccaaagatgataacaatttcattacatgaaagtgttttcaaatccggttccatgctttacttcactgcagatagtatgcaatggattgttgatgaacttcctgatcaggcccttctgaacactgctgaatggagattccttattccacaattatacaaaaaatatccaaatgacgacatgaatcttaatatctctgtatcttctccaccagatatacaagtgacaaacaaagatgtcagtgtcaacattttcatagatataacaattgatgttctggaagatggtgaagtcatacctgttgcatgcatctcggtggattttagtgcctcttttgctgtggaaatcttaggaaacaatcttgctggttggcttaaattgagaaagttttccacatccttgaaatggagtaaaatagggaaactgcacatgaatttgattcagcttgctgctttgtattttgatatgaaattggatgaaattgaacaacaaggcaacaacatgagtgttttctgtttcaattag

SEQ ID NO: 44 - DNA, 1857 bp, Glycine max
  Peptide Sequence Number=SeqID_91729
atggttttggagaaactgaatagtcaaaaacttcttgataaggaagtcaacgatttggctcaacctggacttacagttgttggaattgacagtgatatgatagatgaatctaatgaagaatcagaagaaagggatgatctggatgtttgtgcactttgtgacaatggtggtaatgttacttgttgtgacggagtgtgcatgagatcatttcatgctactgtggaggctggtagagaaaatagttgtgtttctcttggttttacccagaaggaagttgatgagatccaaagcttttattgtaagaattgtgaatattatcagcaccaatgctttgcatgtggcaagctggggtcatctgataaagttaagggtgccgaggttattaaatgtgtttctgcgacctgtgaccgtttttatcatccacattgtgttgcaaagttacttcctcagctagctaagcctgttgcagaggatcttgagagaaatattgctgatcgggcgttgtccaaagtcatatcatcgcaaatgtttgccaagagggttgattctcaaattgcttttatcagagaaattgctcctagcaacagaggtaacaaaaatattatacaaagggcttgggaaggtcttttaccaaataaccgcattctgatatattgcttaaatcacaagatcgatcgtgaacttgggactcctgtaagagatcatataaaattccccaatatggaacctactgttcaaaaaattaatactactattgagcagaaggaacctgcaactaaagagagggttatactgaagaagaaaaatgttgacttagataattcatctggcaaaagcattgctaaaggatctaaattgactggaaaactgtcttctcacaaagttggtagcaagaagactaaaaagattatttctggttcaaatatctcaagaaagccaaaatcaaaagaaacatcaaggtgtttgactgaaaataagaggtcaatctcaaagaaatctgaaatgtctgactctgagcaaaactataaccagcctacaataggtgagatatatgctctccaaaaagagggtttgaagcgaatcaagcatgacaataaggtcaataatgtgattactaatcccctgtctgtgaagcctatcgaatcactgagtgttgaattgcctccattggatgctgattcagaaaagagtttgttgactttatttaaagaagctagatcatcaattacattggagagtgtcttagaaaagcacacatttgcttctactcatactcacccgttgagaaatgttgtggagaagaccattacaatggggaagctggaatactcagttaatgctgttcaaacagctttaaggaaattagagagtggatgcagcattcaggatgtaaaagctttttgtgaccctgatgatctgaagcagttatttaagtggaaggatgagctgaaaatatatcttgctcccgttctatatggtaaccgctatacatcatatggtcgccattttacacttgtggaaaagctggaagggcttttatatcctccttcctcgttaaaccatattattgatttaggacttcccttgagcatgcaccataggtttctaggtgaggcagatatcatggataggagaaataatgatgaccctgcagatgctgggaatgaggggggtttctacactgtagagtctacagttatggtggcacagtggtttagtggcagtgatgatgtactattggggattatgcacacgctgcattttgtgttcaagaagattgttctaattgttgaggctaggttgattgtggattctgataaggaaaaggttcctgccatattggctctaattcgctga

SEQ ID NO: 45 - DNA, 237 bp, Glycine max
  Peptide Sequence Number=SeqID_91730
atgcccgtgatatttgtcaccgttgcatttgcgaagctcctcgtgatggtacagcactactcattatcatgtggaagtatgatgaatcaagatcccaatagctgttggagtgtaagaaaaagaatgctcctgctggtcaaaacaagtaatatgatccccaacagcaatttctctcaagttccaagacaagtgttacaagaatgcattgtagaagaacaaggatggatatgctgctga

SEQ ID NO: 46 - DNA, 969 bp, Glycine max
  Peptide Sequence Number=SeqID_91731
atgccggaccaagatatttgcagttacattaatgaacctcgtcttgtagccagaaagttcttggccagacctcagcatgagggtgttggggctgttgttagaagaagcatagggagatttgagctcaagtactttgatcctttcattgtcttggatgaattctcagtcaccgctcctgctgggtttcctgatcatccacatagaggatttgagacagtcacatacatgttgcagttgagccaatgcaagtatcagctcaatatggtgttaatctgtgtgctggtggtgtggcaacatggagctataacgcatgaagattttgaaggacataagggaacaattgaagctggtgacttgcaatggatgactgcagggagagggatagttcactcagaaatgcctgcagctcaaggaacccaaaagggtctccagctgtggatcaaccttgcttcaaaacataaaatgattgagccaaggtaccaggaaatgttgagcaaggacatagctgaaactatgatagatggtatcaaagttagagttatagcaggggaagctcttggaataaagtcaccaatctacacaaggacaccaaccatgtacttggattttactcttaaacctggtgctcacttgcaacaaattataccaaaatcttggaatgcttttgtgtacatattggaaggagagggtgtttttggaaaccaaaaatcccaacctgtgacctctcaccatatacttcttcttggttctggggatggcctggaggcatggaacaaatcttctaaggtccttaggttcattttggttggaggtgaaccattgggtgaatctgtggtgcaatttggaccttttgtgatgaatactcaagaagagattgaccaaacaattgatgattttgagaactataccaacggatttgagaaagctagacattggaggtctgaaagtgcaattagtcttgattattga

SEQ ID NO: 47 - DNA, 441 bp, Glycine max
  Peptide Sequence Number=SeqID_91732
atggcagagctgagtgttggagatccatcaagaaaaattgtggagatgatctttcaaaaagcttggttcaacacatcaaagccaatgaagaaggttagaacagtcctcaggtataaagaatatgtcaagaaggtggcctctgagcaaaatccaaggcatccgaggagcacagttgatgggaatgaactgttgcggttgtatggtactacaatgatatgttttcaaggaaaatcttctaagaaagttcacgatctgtgtaaagatccatcttgttatctttgccaaataattcaatttaatttcaacacacgatatgccgagattcacttgaatacaagtgacaaagagttgagaaaaagaacaactgccactgccagagtacataaacgcgaaaaaagcagcaataatttgcaggataattgctggaactgcagtaaatga

SEQ ID NO: 48 - DNA, 1224 bp, Glycine max
  Peptide Sequence Number=SeqID_91733
atgtgtaaggttcgtgagttggctgaaaaggagtctgaaaacggtgtcttcagactactccgaagtgatgttactcggttccttaccacaatacttattggcacaacggtggtcaatattggggcaactgctcttgtcactgaagcagcaactgctatgtttggtgaagctggtgtcagtgcagcaacaggagtgatgactgttgccattttgcttctcactgaaatcactccaaaaagcatagctgttcataacgccacagaggtggctcggtttgtggtcaggccagtggcatggctttccctggtgttgtatcctgtaggaagaattgttacttatctttcaatggggatgctgaaattgcttggcctaaaaggaagaagtgagccatatgtaactgaagatgagctaaaattgatgctaagaggtgcagaattaagtggggcaatagaggaggaagaacaggatatgattgaaaatgtgttagagataaaagacacacatgtcagagaggttatgacacctcttgttgatgttgttgcaattgatgcaagttcaagcctggtagactttcatcacttgtgggtcacacatcagtactcaaggtattttgaagatttccagggtgagttgctagaaagtactacggttggagatatggctcacaaacctgcttattttgtacctgattcaatgtctgtttggaatcttcttagagagttcagaatcaggaaggttcacatggcggttgttcttaacgagtatggtggaactgtggggattgtaacactcgaagatgttgttgaggaaattgttggtgaaatatttgatgaaaatgactcaaaggaggagatacagaaaaaaactggttacattgtaatgcgagctgagggtgtttttgatgtggatgcaaacacatccattgatcagctctctgaagatttgaacatcaagatgccagagggtcaccaatatgagacggtatcaggctttgtgtgtgaagcatttggatacattccaaggacaggtgagtgcatcaaagtagttcttgaaagggaagatgaagatgataacaatgagtccaatgctgaccagcaggatcagaaggagaagaaccagagtttcaaacttgagtactatttctcaagctacactaaagatgtcaatgcgattttcttcaaaaagcttgatcaacaagtttgtgctttgatttctggtttttga

SEQ ID NO: 49 - DNA, 183 bp, Glycine max
  Peptide Sequence Number=SeqID_91734
atgaagagtgtgtgcgcagagaagggaagtgcagtcaaaaaggagttccttgggaagatggtaacgtgcatatccgcaaccaatgtcatgcccgaatgtgttcaaccagatgttgctgaggtactttgtttgagattggccataatcaaacagattgcaagaaactgcatgcatgaagcatga

SEQ ID NO: 50 - DNA, 1158 bp, Glycine max
  Peptide Sequence Number=SeqID_91735
atggaatccccacaatctgttgtgtcaccattcaagaggtctgtcttgggtgatgcagagaagtataggtctgatgttctgtctaaggacattgaagtcaatggaaaggaaggtgccgtgtgtaatgtggaggaattcattggtgttgttgatgtttacattcatcaggccagggacattcataacatctgcatataccacaagcaagatgtttatgctaagatttgtttgactagtaatcctgagaatactgtctctaccaagaccatcaatggaggaggaaggaaccccgtgtttaatgagaatcttagtctaagcgttaggactgttgattctgtagtcaaatgtgaaatttggatgctgagcagggtgaagaattatcttgaagatcagttgcttggttttgctttggtgcctttgtctgaagtactggtgaagaaggatggcaaactagagaaagagttctctctttcttcaactgatctattccattctccagccggttatgttcaattgtctcttgcttacactggtgcttcgcctgatgttatggcaatttcttcaatgcctaccaccgagaaggactccgaatcatgcgagtcactggtcagagatttggacaaaatcgaattcccggatccaaaaattgtaaatgaagaccacttgatggtttcggaatacttcggcattccatgtgaggagagccagtgttctgatagcttgaccactactgatactgaaaatcttagttctgaagcaggtgttcagcttgtggagagcttctcagcatgcagtgttagcagtgtgtcaacaaatggggtttcatctccttcagtggctgcaagctcagactcgtctcccaatgaggaaaccaaagagaaaaatgtggatgtcaaagatggtgagactgattcctcgttccctaaacctcttgtgactgttaacatcgagccggagccgaatgtggtgcagcaggattttgtagacatgtacatgaaaagcatgcagcaattcaccgagtcattggcaaaaatgaagcttcctgtggactttgaaagtggaccaactagttcaggaaactctagctctgaacacaagctacagacaccaaagagcactaactcccgtgtgttttatggcagcagggctttcttctga

SEQ ID NO: 51 - DNA, 552 bp, Glycine max
  Peptide Sequence Number=SeqID_91736
atgctcaaaattccagcatatgagaaaggggtaactgagtccccacccttggtctcttttgactccaaggaatcagcattcaaaaagaggttcatgaatgccgttatcaacatgaacctcagaaacgcgtctcccagacataacaacaatgtccaccacgatgcaatagcaagaaacaaagaggtagaaagtgaaccaggctctgaagaagaacgagaaccttctttggccggaactgaagaaccccttttgcaagcagacgcaaacaaccccccaagcaagcccacttgtataccagtagaagtagttaatgaaacagaggaggaaattgaaagcggaaagagcaagagaagaaaaaacggtcgttttgaagagggagttgtggaggaaaccggacaagccatgaaggaaaatgggtttgagcagaacggcagtggaaagagaagagaagtcaaagaggggattccttgggaagatggtaacgtggtgagcaagagtggagttgtgttgacggagaagaccaaggtagaaattaggaaaagagacaaaagg

SEQ ID NO: 52 - DNA, 675 bp, Glycine max
  Peptide Sequence Number=SeqID_91737
atggcctatgacacgaaacatcttcgtgtcccagagatacaatggcttggagcttttccttctgattctgagagatattttgttccgaatcagtgtctccttccattgactgctgaagacaaaagaaaagttgaagccatgctacttagatgctaccttgaaagggaggtaccacaatggaggttggagctacagttgattctgcaaagaggagtaaagtttgagattgaagccttatctgtgcacgcactttcattcttgtcagagtcttacataccatctaaaattgaagtcagtgggggaatgggctcttttggcatggcggggtcgaaatgggtgtttagtttaggactactgctgcctgcatttttttcagttgctgcctgcattctctatcaagtgaaacatacattatgtaagagagaggattcagagtttaaaagtcagtttggactcaatgaaaaatgccccataactcagcttgtaaaactgaacaatccccgagttacaagagaaaccactccggaattccccttcattatctgtcttaaggccaccgtcttccctaaaggcggacaccaaatgaaagagtgggagggaccaacacacgctcccttcttgctaattctatcatcaacgttctcagctcaggtccagacttgttccatcttgtga

SEQ ID NO: 53 - DNA, 768 bp, Glycine max
  Peptide Sequence Number=SeqID_91738
atggatgagaatgtgggatgtaagcatgtttcttgccaccagctttggaggcatgctgattcttttgcatgtgacaccccagttcctgctaaagcagtagagctttatttggatgcaagaagggtaattgaagaacaagttaagagttatactgaaccatacacagacaagctccttcctgatttgcttcctcaggagcaacatgtgtttacacttgttcttgatctcaatgagacattgattcactatatatggacgcgagatacaggttggcagacttttaaaagacctggagttgatgccttcttggaacatttagctcagttctatgaaatagtggtttacacagatgaacaaaatatgtttgtagaccctgttatagaaaggctggatactaagcattgcattagatacaggctatcaaggccggctactaagtatcaggatgggaaacacttcagagacctctcaaaactaaacagaaatccaggaaaagttctttatttaagtggccatgctttggaaagttgcctacaacctgagaactgtctccctattaaggcttggcagcagcaagatatagatgacacagctcttttggattttataccatttcttgagtttgttgcccgtagtagtccacctgatataagaccagtgctagcctcttaccaaggatgtgatattccaagtgagttcatcaggcgttccaaagagcatcaaaggagaatgcaagaacaaaagaatcgtggtcgcttctggaaatga

SEQ ID NO: 54 - DNA, 675 bp, Glycine max
  Peptide Sequence Number=SeqID_91739
atggagacaattatgggtggtgatggttctagcagcagcagtgtcaatgtttactgtgatcaccctgctgcttgctttaatcaaaaagaatgtcataattcactcacagtacagacaggaacatactttctcgtgtttccaggggagggctcctccggcgacggcctcgccttcttcctcttcctctccctctccttcgtcgccgtcgagttcgatgcccgcctcgacctcaagagcggcaacaccatcactgcatggatcgactacaacaccgaacacacattgctcaacgttttcttgagctattcacgtactagttcttctaaatcaaaacccctcgaaccaccgaccttcaccaaatccaaacatgggcttcactctgaagggaaagtgattgaggcagctgataagaggttgaatggggagtttgaggaggaggagatgaggttgagctgtgttgctaatcctgatagtgctgagagaccctccatgagaagagtgctgcagattctcaacaatgtggctgcaccacttgttgtgctgaaagtgaagccaacactcaccttctcttctgacctgcctctgcttctcactattgaggacattgtttcagaggcggatgaagaagagttcggtaccagcagccagtctatgtgcgagatcaaaattcactaa

SEQ ID NO: 55 - DNA, 2181 bp, Glycine max
  Peptide Sequence Number=SeqID_91740
atggcttcggagactgagacgtttgcttttcaggccgagatcaaccagctcctcagtctaatcatcaacaccttctacagcaacaaggagatctttcttcgtgagctcatcagcaatgcctctgatccacataagtttcgacatgataccaaatattggagcatttattattccctgttcctgcgttgtccctgtttggctttggacaagattcgatttgagagtcttacagacaagagcaagcttgatgctcagccagagttgttcattcacattattcctgacaagaccaacaacacattgtctatcattgacagtggtattggcatgactaaggccgatttggtgaataacctcggtactattgcaaggtctgggaccaaggaattcatggaagccctggctgctggtgctgatgtgagcatgattggacagtttggtgttggtttctactcggcttatcttgtagctgacaaggttattgttaccacaaagcacaatgatgatgagcagtatgtctgggagtcccatgctggtggctcatttactgtgacaagggatacatctggtgagaaccttggtaggggaacaaagataactttgtttctcaaggaagatcaacttgagtatcttgaggaacgccgtctgaaggatttgataaagaagcattctgaattcattagctatccaatttctctttggattgagaagaccactgaaaaggagatttctgatgatgaggacgaggaagagaagaaggatgaggagggtaaagttgaagatgtggatgaagataaggagaaggaggagaagaaaaagaagaccattaaggaggtatctcatgagtggtcattggtgaacaagcagaagcctatttggatgaggaaacctgaagagatcacaaaagaagaatatgctgctttctacaagagtcttaccaatgattgggaagagcatttggctgttaagcacttttctgttgagggtcagctggagtttaaggctgtcctctttatccccaagagggcaccttttgatctttttgacactaagaagaagcctaacaacatcaaactgtatgtccgccgtgttttcatcatggacaactgtgaggagttgatgccagaatatcttagctttgttaagggtattgtggattctgaggatcttcctctcaacatttctagagaaatgctgcagcagaacaagatcctgaaagtcatcaggaagaacttggtcaagaagtgcattgagatgttctttgaaattgctgagaacaaggaagactataacaagttttatgaagccttctctaagaatctgaaacttggtattcatgaggattctcagaacaagacaaaacttgctgaattgctcaggtatcactccaccaagagtggtgatgagatgaccagcctcaaggactatgttaccaggatgaaggaagggcagaatgacatctactacattactggtgaaagcaagaaagctgttgagaattcccctttccttgaaaagcttaagaagaaggggttcgaggttctctacatggttgatgctattgacgagtatgctgttggtcagcttaaggaatttgagggaaagaagttggtctctgctactaaggaaggcctgaaacttgacgagagcgaagacgaaaagaaaaagaaggaagaattgaaggagaaatttgagggtctctgccatgtgatcaaggatgtgttgggtgacaaggtggagaaagttgtggtgtctgatcgtgttgtggattctccttgctgtctcgtgactggtgaatatgggtggacagccaacatggaaaggattatgaaagcacaggcattgagggacagcagcatggctggatacatgtcgagcaagaagaccatggagattaaccctgagaaccccatcatggatgaactgaggaagcgagctgatgctgacaagaatgacaaatctgtgaaggatctcgttctcctactctttgagactgctcttctaacttctgggttcagccttgatgatcccaacactttcggtaacaggattcacaggatgctgaagcttggactgagcattgatgaagatgctggtgaagcagatgctgacatgcctcctctcgaggacgccgatgctgatgccgatgctgagggtagcaagatggaagaagttgattaa

SEQ ID NO: 56 - DNA, 1950 bp, Glycine max
  Peptide Sequence Number=SeqID_91741
atggtagccaaaatcaggcaaagtgctgctaactctccaaatccaacaaaaccagtggttggagagattgacaccagtccaccttttcaatctgttaaagatgctgtttctctatttggtgaaggtgctttctctggtgaaacacctcccaatgctcccattaagaaggccaaatcttattttgctgagagtgtttgggcaaaggagagacaacttcacttagcccagaaagatctgaaaaaattaaaggaacaactaaagaatgcagaaactaccaaagctcaagtcctggtggagcttgaaaaggctaaaagagtggttgaggatctctcacaaaagcttaaagttctcagtgaatccagagaatcagcaattcaggcaacggaagcttcaaaaagtcaagcaaaacagcttaaagaagaaaaatgtggtgatcctgatggaaccaatcatgcttggaaagaagagttagaaactgccgttaataattttgcatctgtaattacagaacttgatgttgcaaagcaagaactgagtaaaattcgtcaggggtatgatttatccttggaagcaagagtttctgctctcaagcaaacagcagaagctgaagatgcaatgaaggcaaacatggaaagagcatgtgaggtatctaaagaaattttggttgtgcaggaatcagttgagaaaatgaatgctgaatctgtccaagcacatcaactgcaagaagagacattagccggacaaaaagttcttagacaatcatatgaagccatccttgaagaatcaaaaaagaagttgcttgatttaaagaaggaatttaatccagagcttataaaaaatcttgaagtgcagctcactgagacaatgattgaaattggggttttgcaaaagcaaattgaaaacaaaaagacatcagacttggactctttgagaagtgtcactcaggatcttggtgatgctaaggaatcactgcagagagtaacaggacaggaagacacccttagaagcatggtggaagctcttgggatggagctggagaatgtaaaaagagaacactctgaattgaaggagaaagaatccaaaactgaatccattgttgagaatctgcaggtagagctctggaaaagcgagtttgaacttgaagcctacttggcaggagaatctaaagctagaggcgcatcagaggaaatgatcttgacattgaaacagttgttttctgaaactgaaaatgcaaggagggaaatagaagatatgaaaaatgagactgcagaattgaagatggaagctgcagtcactaaacttgtgttagaagatgcagaaacaaagcttagagtagcggtggaagaagtggaagcagctaatgcagcagaggcaagtgctcttgatcagattaaggtcttatctatgagaactagtccttctcattcatcaccttctgaacctggtgcaagaattacaatctcaagagaggagtttgaatccttagttcataaggttgaggagtctgataaattagcagatatcaaagtggctgctgccacagcacaggttgaagctgcaaaggccagcgaaaatgaagttctaaagaggttagaggaaactcaaaaggaaattgaggatatgaagagtgaaacacaggcagcgttgaaaagggctgaaatggctgaagcagcaaagagggctgtggagggtgagctcagaaagtggcgcgaacgagagcagaagaaagcagcagaagctgcatctcaaatattggctgagacactgatatccccagaactatctcctcagcactataggattcaaattcagaattcacctccaaacagggtggagatgaagaagttagaaaaggggaaggtgtcagtttcaaagaaagttctcttgcataatatcagtggcatctttcacaggaaaaggaaccatgttgagggagaatcttcttcttag

SEQ ID NO: 57 - DNA, 273 bp, Glycine max
  Peptide Sequence Number=SeqID_91742
atgagggcggtttcaaggcccggctaccctgggcaattgcccaggctctggcccaaattcatatcagaaaacaccacttcttcgggagaaagagagagagagagagaaagtatggatctaagaacgaaggggtttgaaggaagtgagattcctgaaatggagccaaggcttctccagcacggtggcttggtaactggccgtggtggatccattcttgaccttgaggaccaggcggtagttggtgtcggccacgacctgagtctcgccctttga

SEQ ID NO: 58 - DNA, 327 bp, Glycine max
  Peptide Sequence Number=SeqID_91743
atgatgctcactcttatgcaaaacttcgaaacgattgcgtttaaggcagaggatgcggagctggatgagggtggtgagggggagaatggagccggtgaggttgaggtcttcgaggacgaggcgggagacgcggtggtggttgtggttgcggaagtaggagatgccgtgtcggggttgattgttggcttcttagttgtttccggtgctttttggtttgaagccaatgaagtagtgggtacaaaaattctggtgtggctttggttttatggcattgagtccatggcggtgttggggttggctaatggtactgtgttgtttgtgatttaa

SEQ ID NO: 59 - DNA, 1917 bp, Glycine max
  Peptide Sequence Number=SeqID_91744
atgccggcaacgcctccctcctccgatctgatcctccaccgactcacctcctccgactgcgaaatcaagctcaaagccattcgtgaggtcaagaaccagatcatcggcaaccgcaccaagaagctctcctacatcaagctcggcgccgtccccgccctcgccgccgctctagcccaagctgacgccgattccgcctccggctccaccctcatcgtccagtccgccgccgcactcggcagctttgcatgcggcgtcgacgccggtgtccgcgccgtcctcgacgccggagctttccctcatttaatcagactcctctctgccgctgacgacaaggttgtggatgccgctgcacgctctttacgaatgatttatcaatcaaatctagctccaaagtatgacttttttaaagaacaagacatgcaatttcttctttcactattaaaaagtgggaatgaaaatcttactggactaggtgcaagcattgttattcattcttgtgagaaaagagatgaacaaaatatgttatgctgtgctggtgctttagaaacacttattagccttcttgatggttctctaagccaacgagattctagtttagagtctcttgctgcaattcttaaaaacaatccagaagttgtctataaatttgtggaccttcaaaatggaagagttttgagttcggtaattgaattaaccaaggatagatattctcggactaggttattagcctgcttgtgcctgatttgtgtaaagaattcatcttcttgctatctgcaagacataggaatcaaagccaaattgatacatattttacttgagctccttgatgaatctggtcaagttggagacagtgcttcctttgccttttcaagtttagttgcagaaaaagaagatttgcagaagttagcatttgaggcaaatgctattgataagttcaacagtcacttgcaaaattgtgctttacatcccaaacgtcttgaagggatatttctagccttagctgatctttgctcaaaattggagtgctgcaggtctaagtttctttcattgcaggtcttgaatatattagttgattccctaactcatgatgatgccaatgtgcgcactgcagcttgcatttgcttaaaaagtgtctctcgctccatcaagaatttgagtgcaggttatttcatgaatgaaaggattattgctcctttggttcggcttctatctgatctttctacttctgtccaagttgctgcccttggtgctattagcaacatagtgatcgactttacaccacagaagtcaacattcatggaatgtggaggtgttaaggagcttatccaattgacaaagtctatggattcatctttacggttaaatgctgtattggccttgaggaacatggtatttcttgcggacaaaatgtgtaaggaaggaatttttaaggagttgacagtgtcttctgtagctagccttatctgcgatcccgagccttctgttcaagaacaagctctggcccttgtgtgcaattttgttgatggatgtatagattgtgttgaatatgcttttgctgaagatggtatcatactggatgctgttgcaaggcaattgaaaaaatcttcaaaaattgaaattgggatacaggggatgtacttactcagcaatattgcgagtggaaatgagtctcatagagaagctatcatgcagctactcttttcaaaagcagaaaatgtgtctcactctttcttctaccagtttctgcagagcaatgacagttgtttacgcacatctgctgtttgggtcatagtaaatctaacttttcctgcaagtcctggggtatttggtagggttgtaaaactgcgtaatgtaggcattgtttctcaaatcaagaagatggtcaacgatccttgcatggatgttaaggtcttttaa

SEQ ID NO: 60 - DNA, 978 bp, Glycine max
  Peptide Sequence Number=SeqID_91745
atgggtactaaatcggctgttgacttaatggagtctttatctgaggttcatttttctggatttcacattgatggcttagagcaaagaaaggctggcacagagcaaccaaccacttcaacaactgacatgtataaacaaccttttgtgataggtgttgctggtggagcagcatccggtaagacatcagtttgtgatatgattgttcagcagcttcatgatcaacgagtcgtacttgttaatcagaacaagttcataacattgaatgagtatcaactccatctttcttactctcagaatgctcaggaatatcaaggtgttaatgaaattccagagctagaaattctcgcatttagcctagagatgagtatggttggtgaaaccactgcaaattttacatgtcagagtgttactcaaattgtgttatatgcatatgagcattccaaagaagcttttgatactgagcaattgctacgtgtcatggacaagttgaagcgtggccaagcagtagatattccaaactatgactttaagggttacaagaatgatgtttttccagcaagacgggtaaacccagcggatgttattattttggaaggtatccttgtttttcatgatccacgagtgcgagcattgatgaatatgaagatatttgttgacacagatgctgatgttcgtctggctagaagaattaagcgtgatactgctgacaatgctcgtgatattggagctgtgcttgatcagccggcttttgatgactttattcttcccaccaagaagtatgctgatatcattataccccgtggaagagataatcatgtggctattgatttgattgtacaacatattcgcacgaagcttggtcagcatgacatgtgtaaaatatatcgtaacttatatgtcattcagtctacttttcagttgaatcatcacgataattgcttcgatgtagatacggggtatgcataccctgatacgtga

SEQ ID NO: 61 - DNA, 441 bp, Glycine max
  Peptide Sequence Number=SeqID_91746
atgaagctagattctaatggtggtgttgagtcaataaggagatccattattgctctgaaaacagatcccctcaagcctcgtttggagcagattcgcaagcaagctgatgatcatggctctttggctcgtgtatgcttcctatgcacgcaagctcaagctggagagctcaaagcttgtaaggattttcgcggagctatgtggcaacttggtggatcttatgaacaaacctcaatacaggcctcttttcagcaatcagtgcttcgccaggtggtcggggacgcaaaggagtcctttgataaccagctcaagactcagaagttgaaagatacaatttttgcagtgaatgaacagttaaccaaggcaaagaagcagggagctaattccaaagagcttgcattgtctctccatgaggttgatggaagagaggattgcccatcctga

SEQ ID NO: 62 - DNA, 1275 bp, Glycine max
  Peptide Sequence Number=SeqID_91747
atgtcagtgcaagattacctggataagcacatgctttcccgaaaactcgaagatgccgtcaatgccgccgttagggccaaaacctccgatcccgttctcttcatctcgaatcacatgcgaaaagcagtgcaatcggtgataacaaaaatcaaggcgaggcagatcctagatagcagaggaattccaaccgtcgaagtcgacttgcacactaacaaaggcgtgttccgcgcttccgttcccagcggcaactccaccagcatgtatgaagctgttgagttacgcgacggtgacaaaggagtgtatctcggaaatggcgtggccaaagctgttaaaaatatcaatgacaagatatctgaggcgttgattggtatggatcctacgcttcagtcgcagattgatcaggccatgattgacctcgacaaaactgagaagaagggggaacttggagccaatgctatattagctgtgtccattgctgcctgtaaagctggtgctgcagaaaaggaggcatggctctttgttccactttacaagcacattgctgacctgtctggaaaaaccagcccaacacttcctgttcctgcctttactgtcataagtggtggaaaacatgctgggagtaatctggccattcaggaaatcatgattctcccaattggagcaagcaaatttgaggaagcattgcgaatgggcactgagacctatcatcacttaaaggaggccattagcagagctggttatgatgagaaaataaagatagctcttgatgttgctgctacagatttttgcataggtaaaagatatgatctggactttcaatctcctcaaaagtctggacagaattttaagtcagcagaggatatgatagacttgtacaaggaactatgctctgaataccctattgtgtcaatagaagatccatttgacaaggaagattgggaacatatcaagcatatctcaagtctggggatttgtcaggtagttggggatgatctcttgatgtcaaatgcaaaacgcattgagagagcaataactgagtctgcttgtaatgcccttcttctgaaggtcaaccaagttggaactattacagaggtcattgaagtggtgaagctggcaaaagaagcacattggggggtggtaacgtctcatagatgtggagaaactatagactctttcattgctgatttatctgttggccttgcttctggtgtaattaaagcaggagctccttgcagaggagagcggctagaaaagtacaaccaggtctctttctga

SEQ ID NO: 63 - DNA, 1404 bp, Glycine max
  Peptide Sequence Number=SeqID_91748
atgtcttctacttcttcttcgtcgtcgtcatcatcatcatctacttcttcttcaactccatatgacgctgttgcccctgatatccctggccctagtacgaggagaaccggtggtagtggtcaatttgaagcttcttcctcctctcaacgtcaacgtgctatgaacgaggtcttgcctgaacctttacttgaagctttggccacccaacttgcccttgatgctgccaactacaatggtcgtctttctgctgcttctgcccttgccattttatttcaggtgtcgcggtcggatctgctgtggcagcggctcacgagacgcatctggagacgcacctatcaactgagggccacgtggcagctggagtacatgtattggcatcggacggccaggaacttctcgacagggagacacaggtttttcgaccaagcagtgttcgacccttcggatcatcaccaccatctgctctgtcgctgcctcgccctgtccgacactcacctggcgtgcggcttcgtcgacggctccgtgcgtctcttcgacctcgaaacccgagcccacgtcaccaccttcttgtctctacacggccacctctttgggcccttctcgcgctccgtctcgggcatcgttataatcaactccagcatcaccttcgccaggctggatggggatatttacgtggataatgtggacgggcctgggcccattcaggctcgccgggccgtggaaggtgacgtggtcaacaacggggtgttggttgggttcgcgggaacggggcggtggtgggttggcctctacgcgggaatagcgggccgggcttttcagatatgggacgcgcgcagtgaagagcgcgtgttcgttggtgggtctttgacggatccagaaacggttatggggtggcacatgctgacggagctagttgaagccgtgggtcgcgtgcgcgtgacggagcgtgagtatgtggtggcgtgcacggcttcgaggatggtttgtttcagttttcggaacccggaggtgttgttgcgggacgtggggtccacgatggggttcgtggtgagttcgctggacgcgagtcaggaggcctatgtagtgttggagaggaacggcgtgggaacggttcggcgagcgagcacgtatgagcggttgagccggtttcggttaaaccggttatgggttcgggggttgtgggcctgcatgaaccttggctacgtcttaacctattcgcctgcgccttctccttcgccttccttgagggtttgggacattgagcaagccataggacgcttgtgtgtcactcttggggtcagagctggatacgttaatagcttggtggcaaatgacagacacgtctctatctcttccaatgacaataacattaacttattggattttggtgtacaggatccttag

SEQ ID NO: 64 - DNA, 1517 bp, Glycine max
  Peptide Sequence Number=SeqID_91749
atggaagcaaacaaggaggaagcacttaaagcgatagagattgctgaaaagcgatttgctctgagagactttgccggtgcaaaaaactatgctgtaaaggctaaaacactctgtccaggattggagggtatatctcaaatggtggccacatttgaagtttacgttgcttctgaggtcaaacataatggtgatctagattactattcgattcttggattaaaaccttttgcagataaggaggctgtgaagaaacagtacaagaagttggcagtgttgcttcacccagataagaacaaatgtgtgggagctgatgaggcatttaagcttgtttctgaggcttggacttggctatcagatagtgctatgcgcagttcttatgatctcaagagaaatgtgcagctgggtggggctaaccagacaaatttgtctcctgcccatgctacagggactgcaggttataccaaatgttccaatttgccaaccccttgtggtaggcttgacaccttttggacaatctgcacctcttgtaaggttcagtatgagtatctgcgcaagtatgtgaataaaagactctcttgtaagaactgtcgtggcacttttgttgctgttgaaactggggcggccccagcaaatggttcgtttccatattgtccttggtcatatgtggcaggaaatgggtatggaagtcattcatttgatggagttacatatgttccaactagtgccccctatttcaatgggaatggggtcacagggtaccattctggacatggttatgagtacgttccaaatgtttcatttcagtggggctctgctggagttgtcaaccaaaatggatcaactaccttacctgctgattctgttcatcgggccaatggaaatgtgaagaggggaaggccaaaagtcaagttgggagctgataagaggcatcacgtgatagagactatggtcaatacaaattcagatgtaccattctcctgtagtgaaccacaggaagataaactaagtagacctgacaagaaacagaaagttgttgtgggagccagtttcagaaatggctatgaagaaaagggttcaaaatgtgcttcagagttgatagtggctaacggaaatgatagcatgggacatggccaaaagccttcctgcacagtcgaagttcaaaccaaacagtgttccatggcaccagcatttgacgcaagaaaattattgattgagaaagccaggaaagaaatcaggaagaaactggaggagatgaagttgtcgtctgcagcagcagctgctgcagctctgaatgagaaagaaaaatcacaagctgaagttggtaaagtaaaaagagagacatgtagaaaagcagctccgaatgtttctggtctacaattagagaatgggaaaactggtccagtctcaattactgtcccagattctgactttcatgactttgacaaagataggtcagaggaatgcttcaggccaaagcaaatatgggccttgtatgatgaggaagatggaatgccacg

SEQ ID NO: 65 - DNA, 288 bp, Glycine max
  Peptide Sequence Number=SeqID_91750
atggctcaagttcaggttccgcctcagaatgcggttcccgaccccaacggtggtggtgctgctggaaatcagttcgtgacgacgtcgctttacgttggagatctcgacccgaacatcatggacgcccagctgtatgatttgttcaaccaattggaacaagtcatatccgttagggtttgtagggacttgaccactaggagatcgctcggttatggttatgtcaactttagcaacccgcaagatgctgtcgtccttctctcctgttacatattcatccggttgccttga

SEQ ID NO: 66 - DNA, 621 bp, Glycine max
  Peptide Sequence Number=SeqID_91751
atgcaaaagacgctgggcaaggccaaagcactttttttccaccccgctacgcgtttgagccctggaaacttggcagattcccattcatccataagtttatacgtaagattcctcatctctgtcaagaagccaacaaatacttccactggcaaccatccatcactactttcttcagtgcctcctgctagaaactcctcttccaaatcttctgttgcaattgatctagaagaagaagaagaagaagaagagaaagaagagcgcattaggagagatattgctagaattgtaaaggagaaggacttgaaatctctcgatgaccttggtggggttgactccgtttccgctgtcctttgtcgtcaacatcaacactcaaagaagggtactattgatgatgacaacaccactataccattaccagctattggaacaaacttgtccaagtttttattcaacagttgcaaattctaccgttgcacaattttggtgctgttgatctcagctgggttgtcattcgccatagaattcaagcaggaggaacctaaacatggttggcatgttggtgttgccatagtttttgccgttttactactggttgcaggaaattcggtagcaaacttttga

SEQ ID NO: 67 - DNA, 1527 bp, Glycine max
  Peptide Sequence Number=SeqID_91752
tttactcatgataaagggcatgtatttgtctctgttcatctggcgagtgaagtgaaaaacccacttcatattatggacgcagtgctgagagaaggcttaaacttaagccaggacataacaaacagaacatatgatacgttaagcgggtttcctgtatgcaacagatggaaaagttgggccaattttacgaagttaagtggcacaaatgagcctgaaattattcaacttctagtaatagttgaggacacaggtataggaattcctacagatgcacaaagccgcatattcacaccttttatgcaggctgacagttccacctcccgaacatatggtggaactggaataggactgagcattagtagatgtctagttgatctcatgggaggagaaattggatttgtaagtgagcctggaattggaagtactttttcctttactggaactttcagaaaaggagaaagcacgtctctggatgcaatgcggcagaataatcattttggttcagagttccaagaattgagaacattagtggtagatagaagaaaaatccgagctgaggtcacaaaatatcatctgcagagattgggaatgtccgtggatgtaacttacagtctgaattctgcatgctcttgtctatctaatgtgtgtaacatgagtatgttggccatgattcttattgacaaggatgcttgggataaagaatatcatatcttatacacaatcaagaaacgtagacagaatggcatcaaaggggatccattgaatttaccaaagatttttctcctagctacccaccttagctccaatgaacaggatgagctcaagtcagttggtgtcatagatgatatattaatgaagcctctatggtttagttctttgattcagtgttacagagaatcccttggcactgaaaacaagcgagtaaataggaaaaaagtatccaaactcgggaatttattaattgacaaacaaattttggtggttgatgataatgcagtgaacagaagagttgcaaaaggtgttctacagaaatatggggctaaagtgactgctgtggagagtggcagggctgctctaaagatgcttgagctgccgcataattttgatgcttgtttcatggatctccaaatgccagaaatggatggttttgaagcgacgaggaaaatccgttgtctggagagtgaggtaaatgagaaaattgcatgtgggcaagcatctgcagagatgtttggtaacatctcttattggcacattccgatactagcaatgacagcagattcaactcagtcttccaatgaagagtgcataaagtgtggaatgaatgactatgtgtcaaagccgtttgaagaagagcagctctacatggcaatggcacgtttcttcaaacaccctgctcacaagtgtggactgacctccaatattgtaatggttggacatgccccagctgatgtgttcctaattgagactgcttgccagcatcaaagctatcaattcagcatcatggatctcacctatggtcttgtttag

SEQ ID NO: 68 - DNA, 339 bp, Glycine max
  Peptide Sequence Number=SeqID_91753
atgtcctctaagttagtgggtcaagctgaaatagaaatgatatcaactccatcagcaattgcttcattaaatgctgcaagagcgtcaacctcaggacaacctattttgatccaacatgctttgtatataggaagacgtgctgatggaactcatcctccacgggctgtccctgaggcaaaccctagtagactcgctgacttaaccaaatttccagcaattgtggatgcagtgtgtgatccgtggccttctgcatctctaggagatattatatcatctttggaattggcaccttcgatattgaagtatttagcacctattattttgctgcataattcataa

SEQ ID NO: 69 - DNA, 1980 bp, Glycine max
  Peptide Sequence Number=SeqID_91754
atgtctagtttcgtgggtgtccttgtttctgatcaatggcttcagagccagttcactcaagtcgaacttcgaaccctcaaatccaagtatgtgtcggaaaggactcaatcgggacgtgttactgtcggaaatttgccacccatttttaagaaattgaaggctttctctgaactgttcaccgaggatgagattaaggatgccttggctgagtcatatcagaacatggatgaagagattgattttgagtccttcctaagggcacatttaaatctgcaatcccgagcaatagctaaagatggtggttcaaaaagttcttcttcatttctgaaggcagctacaacaactgttcatcatgcaattaatgaatctgagaaagcttcttatgttgcacatattaataactacttggctgaagataaattcatgagtcagtttcttccaattgatccatctacaaatgcgttgtttgatcttgcaaaagatggagtccttctttgcaagcttattaatattgctgttcctgggaccatagatgagcgagctatcaacacaaaacgggttcttaatccatgggaaaggaatgagaaccatacccttggcctcaattcggccaaggctattgggtgcacggtggttaatattggtacacaggatttaattgaaggaagagtagccccatctggtacttggtttgatttcgcaagtaatcaagctgatctcaatctgaagaaaactcctcaacttgtggaattagtggaagatgacaaggatgtggaggagcttatcagtttagctcctgataagctcttgttgaaatggatgaatttccacttgaagaaagctggatatgagaaacaagttacaaacttctcttctgacctaaaggatggagaggcttatgcttacttgcttaatgctcttgccccagaagtggcaggcccatctgccctaaacacaagtgatccaacagaaagggcaaacatggttcttgagcaggcagagagattagattgcaagagatacctcactccaaaggacatagtggaggggtcacctaatctcaatcttgcatttgttgctcaaattttccagcataggaatggccttacaacagttgacagccagaaaatgtcctttgctgagatgatgactgatgatgcagagacatctcgggaagaacgatgctttagactatggattaacagtcttggaatttccacttatgtcaataatgtttttgaggatgtcagaaatggatgggttctattagaagttcttgacaaggtttcagctggatctgtcaattggaagctggccacaaagcctcctataaagatgccgtttcggaaagttgagaactgcaaccaagtcataaagattgggaaggaactaaacttttcattagtgaatgttgctgcattcctgtggcagctgatgaggtttactatgcttcaacttctgagaaatttgagatcacactcacaaggtaaagagattactgatgctgatattctaaactgggcaaacaataaggtgaaaagagcaggaagaacttctcaaatggatagtttcaaggataagaatctttccagtggcattttcttccttgagcttttgagtgcagtggagccaagggttgtcaactggagtcttgttactaaaggagagactggtgaagataagaagttgaatgcaacatatataatcagtgtcgcccgaaaacttgggtgttccattttcctgttacctgaggacataatagaggtcaaccagaagatgattctcattttagctgctagtataatgtattggagcctcaagaaacctgaagaaaacatcacccctgaagcatcgcctaaagcttcagtagatggtgaaagcgaaacagatttagttgatgaggtatcccatttagccattgacgaggtatccaatttagccattgatgagacaacttcggagaatgctagctcttcttaa

SEQ ID NO: 70 - DNA, 1113 bp, Glycine max
  Peptide Sequence Number=SeqID_91755
atgaagaaagctcttttcaagccaaagcccaaaacaccagtggagctcgtgcgccacgcccgggaactcatcatctttctggactccaatgcatgcactcgtgaaagtaaacgcgaagagaagctatcagacctaagcaaaatgatactggagataaggactgttctttacggaaacggcgaatcagagccaaatgccgatgcgtgttctcagatcacgcgagagtttttcaaagatgacacatttcgccttttcattctctatctgtcaaatcttaaacttggggcacgccaagatgcaacccacgtgattgcaaacttgcaaaggcagcgggttaattcgcaactaattgcttctcagtacctggaaaaaaatctagatcttgtggacatgctcataggcggttccagtgtgctggataaatggttaatgaaagtttatttaattagttatgagaaagagggtgacattgctttgacgtatggtgcggttgcaagggagtgcatacgccaccagagcgttgcaaggcatgttttggaatcagagcacatgaagaagttttttgactatattcagctaccaaactttgaaatagcatcagatgctgttgcaacttttaaagagttgttgacaaggcacaaatctacagttgctgaatttctttctaaaaattatgactggatattatcagctaaaaggttttactgtggctgtcagttcttcaaagagtacaactctcagttgctggaatccaccagttatttcactagacggtacgctatcaagcggtgtattttaaacacagcactaagacgtactgtcctaatcatagtaatcaaatatgttacagttattgggggatatgctattggatcgctcgaatgctgcggtaatggtccactatttgttgcaaatcaaaataagcctcctgaggttgtcagcatccttgttaccaacaaacataagcttttgcaatttttggacaacttcaataatgacaaagcggacgagcattttcaagcagataaacaacaagtaattagcgagataataactcttgaacacaaggatcgtccatgcacagctttggacaattgtgaagttccatgttga

SEQ ID NO: 71 - DNA, 3531 bp, Glycine max
  Peptide Sequence Number=SeqID_91756
atggatcaagcaggtctcgtcagattcccttccttttctttctttattagcttcactttccaatttctacctacattacagggatcaaaaccaccacttgatgttgccgacaaactcaccgatccattcccaccgtctcctcttttcagcactgctaacactcttaattctccccttctgcctcccttcaagttccacccagctttattacaaccgcgcaacctcgcctttgccaccggcggctatggcgccggtcccgatgacagttacgaaagcatggatgatgccaatttctccgatgaggaactctctgctcccaacaaccttgacttctcggactctccaacaccacacaactatgacgaggaacaattgtttccgtgtaaagggcgcagagaaattctcaagacaggcttggccgatcaaagcctaaccattcaggttcccaacactgtcagaagattcacagatggagaaatgggtttcaataaatgtcttcaaaggaacctcactccagctggcactgccggtgttcagcttcaaaagcaatttcaccttcgcaatgacactcttggattgggtactccaagtgcccctcccatcattgattctgaatttccactggagagggattcagaatgctccataaggaacgaaccaactgaccctggatcttggccttcaagggaatctctggattttaatgatggcacaaaaagtgagacttcaattgaacaaaagcctaaggccaagactgttgctgaacccactgtcactgagcttgctgaaagactggacaagacttttacagatgacatagaaagacacacccctcatttacaatattacaacaccagcagttgcaatagtcaattcgcctggcaaacccttatcacttatgatgcctgcatacgtttatgcctacaagcatgggcaaaaggctgcactgaggccccagagtttttaaaagatgagtgcctagctctccgaagtgcttttggattgcatgagttcctgttgcaacctcgaggtgtaaagccaactgaaggcagaaataacaggaattcagaacaaacacttcccctgaagactaagaaggttgtagggaaaataagagtggaagtgaagaaactacgaattataccaagacaaaaacttaagattacaaagtcacagcgaggatcaatctacatgaaagctggggtggagtatgtccggcatgtttcatcacttgtgaaaaatggcataaattctatgaaggcagcctccttctcattggcagccgaagaaccgctacattgtttgatccaacttaagagtacaacggaagaaaatgaatcagagccatgttctgcaattcttttgcgccctggaagtggagattaccatgattttttcccattgagccaaggggatgctttaattgtagaagtccaagattcgaaaaaggtagtccatggtgaagccaggattccaatgtcatccctcagtgataatcctagtgacagaattcggtggtggccagtatatcatgatgaacgtgaatgtgttggcaagatccagctctctattggcagtacaatgacaagcgacgagaacaatcacataaagagtgcggctgttgtggaaactcaagcttatgatttattattggagggtgccatgcgcgcacaaaatttccactcccgaaacttgcgtttaaatgggccttggaaatggttgttagatgcatttgcagactactatggagtttctaattcatatgccaggctgagatatctattacatgtgatgaatgtggcaactccaaccaaggactgcctagggcttgtgagagagttgcttgaacccctcataaaggccagaagtgagaggagtctgaccaggcaggagagaagtatactttcagactgtgaaactcaaattgaaagtcttctagcgacagttttcgagaattacaaatcgctagatgaaaactcgccaacaggtttaacagatcattttggttcaggatttgattctgctgcaccagctttggatcctgctgttcaagtctacacaagtcttcatgacatactatctctagatgctcaaactattctaagaaactatcttcagactgcagcaagaaaaaggtgcagaaaacacatgatggagactgatgaatttgtgtcaagcacctctgaaggttacctaatggataccattaccatctcaacagcatacctgaagatgaagaatctttgtgtttcaataagaaatgaaattcaggcagacataaagatccacaaccagcatacgatccatggtcagcatatatttccaagttcaattgacctgacaaacatcacagcagcagtttacagcacagagttgggtaagagactgagagctttcctttctgcattgccaccatcgagtccacaggcacatgtaaatgagcttctagttgcaactgcagattttgaacgggatttggaatcatggaatataagtcttgtgcagggaggtgtagactccagaaatttgttccacaactatatcatggtgtggatacaggatatgcaacttagtttacttgatttatgtaaagcagaaaaggtgccatgggctggagtaaccacaaaccactccacctccccatttgccgaggaaatgtatgagaaaatcaaagacaaccttaccctttacgaagttgtaatcaatagatggcctcaatactcactttatttggaaaatgctgttgcaaacattgaaagggcaattgtgaaatcccttgagaaacaatacagtgatatattaactcctttgaaagatagcattcaaaagagacttcacttgcaagttcaaaagatagcaagaagacaatcagctactgttcatttggttcctaatcaattgggaatattcttgaacaccatcaagaggattcttgatgtcctgcattgtagagtggaagacatcctaaattcatgggcatcctgtctacccgtcattggagataaaaagacactgtttggggagcaaatgaatggaattactgttctcttgagaaccaaatacaaaacttatttgcaagcaataatagggaatcttgtcaacagtatacaagctaatcggaacacaaggctgaaaaagatccttgaggaaacaacagaaacagacggagaagcagaagtgcgtgaaagaatgcagttgctgaattcacaactcactgacttcatctccaatctgcacgaggtctttaccagccagatttttatagcaatatgtcgcggattatgggataggatgggacagattattttgaaatttctcgaagggaggaaagaaaacaggatatggtacaacggctcttcatatgctctcgggatattggatgatacctttgcttcccaaatgcaacgattacgaggaaattcgttgcaagagaaggatattgagcctcctcgctcagtgattgaagctcgatctattctttgtaaagacacggcaaatgcaaccgatacatctaattacttgtatatataa

SEQ ID NO: 72 - DNA, 933 bp, Glycine max
  Peptide Sequence Number=SeqID_91757
atgaagacgaagctggtgtttgttacctatgatgatgttttgaattgggctcgcgttattgtttatgaaattggttttatgacagtgattatgaggttagacacaaatactgctgtgtgggaaaccagtggttggaggataaagatggatggtgaaggtatcatgatcatgctgcaacacattgaaattaaggcatcttttgagacaagtacacatgtggttgaatatgtttttaaagttatcttatacaagaaattacttggcatgatatcaaagtatgctttaaatcaaattgttgctaagtatgagcgtgtgagttatgctggtattgatagttctcgttatggatgtgtaatgagaactattcatggtcttccttgtgcatgcaagctagctagatatgttgtcggtaacatacctctgggtgtaatccatatgttttggtggaggttaagttttccagaccaaaggttatctaggcctaaagtcagcatagtcgaagagatggaaaccacatccaagtggtttaaagaacttgattcaaacatagtgcatcatcatctgagtaagcaattccaagaaggactatgccgacattggatcaatttcatccatgcatttcatgattccattgaaaacattgttgatgtcaaagctgagcttgcaaaatggtctgacgagtatatcaacctgcttggtggcatatgcagatttgaggaattaaagcggtttctacttgttgatggattatccatgaacctcgaagctatggaaggcgcctgtgatgggcagatgaagcaacgatgccacatcatcgagggtgatagtcatctctcttacaggaagatggaaacaactagttttcttatgccacctttccacaaaagcttatataagtctctgatcgccaatgttcaaggaacatgcgattaa

SEQ ID NO: 73 - DNA, 669 bp, Glycine max
  Peptide Sequence Number=SeqID_91758
atgttggggaaatacccgagactctacagcatttcagaacagcaacatcatgaggtacaacaaatggggtcagctgcggaaggggtttgggaatggagtttcagacggagaaggaacctgttgaaaagtgaactagaaatggcatcaaacttcatgcaagtggggaatatacagccaaaagtgcatatggtttgccaagttgggagggtcaggtggaggaaaacaatgataaggaggttaccaaccaggaagaatctaaggagaaggaatgtagatttagaggacgatagatgtctgtcgtgcttaacacaacaggaggatgcgtcacacattttctttcagtgcccaaaggtgttgcctatgtggtgggaatgtctatcttgggtacaaatcaaatcttttttcccagcagatccagcacatcatttcttacaacatccagactgtcatctgcctgggctaattcagaataggtggcataccttgtgggcttctctcacctggtgtatatggtatcaaaggaacaaattgggcttttcaggcgaagcatttgatggacagagagtcttggaacaagctctatttttttgctggctgtggttaaaaaatttcgagagaaacttcaatatacctttccattactggtccagcaacattaagactggttga

SEQ ID NO: 74 - DNA, 1875 bp, Glycine max
  Peptide Sequence Number=SeqID_91759
atggaacaacctgttgcttttactgctcagagggagtttggcctagtttacatgctttgttctcccttaggcattcttcctcaagatactgctctcattttggaggatctccaacacacacacctcatgctggggactagacatctcaagcgtgaagtttgcaggattggacagttgcggatagttggtgttgataacatgtgtataatcgtagatgctgtgaaacggcaaccctcaggtttaccagtagaggaacaaataagcaatgcaatgggtgaagttggaccttcgataacactagccagcttatcagagattctagcatttgctgtaggatcatttgtttctatgccagcatgccgtgttttctccatgattgcagctttggcggttctactggacttccttctacagattactgcttttgtagctttggttacattagactttatgagggccaaggataataggattgactgctttccatgtgtgaagttgaatccgccctctgcggagcagaatgaaggtattaggctagaaagagatggattactgacacgatatatgaaggaggttcatgcaccatttcttggactatggggagttaaaatcttggtcattgccgtatttgctgcatttaccttagcaagcattgcattatgcacaagaattgaagctggtcttgagcagcagattgctcttccacgggattcctaccttcagggttatttcagtaacatatctgagtaccttagagttggaccacccttatattttgttgtaaaggattacaactacagtttggaatccaaacacacaaaccagctatgctccattagccactgtgattcaaattctcttttaaatgagggtttactagatgagagagagagagaaacagtgagagagagtgggggggtacaaaggcggaaaacaaattggagggatgcatttgatatccattccttcttcttcacaagattcccagaggagatgaatgaatcagatttatggtatgagtttaaaaaatggggggatgtccgagaggtttttattgcaagaaaccgcaataggtggggtaagagatacggattcgtaagattcaagggggtgaaagatgtaacaaagttggagagaaagctggatagcctggtagtagggggattaaaaatgcatgtcaatacaccaaagcatggaagagtgagggcgacactggaagaaggcatccggggaggacgagagcaaaagggacaggaagaagctaacaggaaaggtaagcacgggtacgaagacaaccatgtggatatgaagatgaaacaattccaacagaagaaagaggcaacctcgtatgcgaagatcctaatgacggaaggaagaaacacggcaccgggaagaattctcagaaggccgagcctaactggtggtgtatctcactcatcggtgcagttgaacataaatgtggaacaaaagacatggttaagaaacacatgggtgggaagactgaagaaccttgcgttatttgatagaatggaagacaatctcatgtgtaatggaggcgaagatgtcaagccaaaatatattggtgatgacatgatattgctaatgggacttacagagaccagagctacacaaatggctaaagaagcaaatgagcaaagatcatccttgttctactcactagaaaaatggacccctcagttgagaactggttatcgcctagtttggctgttatgctggggcatacctctgcatgcctgggacttggaggatactagacacattatgacagcagtaggagaagtggtggaggtggatgacgaaatggatgaactccataggctggacagggcgcggatattagtgaagacaccatga

SEQ ID NO: 75 - DNA, 1770 bp, Glycine max
  Peptide Sequence Number=SeqID_91760
atggatgctttatgcaacaagggtgaaaattttcaaaagaaaaaagatggggttccttcttcttctagtgattcaactcacgaatgttcttctccttctcttggctggcctattcggaaggctacactctccaaatgccgcaaatcagatgaaaaagaaaatgaacctgtttctcacttggaagattcaaaatttaccactgtcagttccaaaatgtcaggaattgatgcaatgaaggaaaggtttgcaaaattactgcttggggaagatatgtcaggatctgggaaaggagtgtgcagtgctttggccatctctaatgctatcactaatctctgtgcaactgtgtttgggcaattgtggagactagaacctataccttgtgaaaagaaagaaatgtggcggagagagatggaatggcttcttagtgttagtgatcacattgttgagttaattccttcttggcaaacatttccagatggaagtaagcttgaggtaatgacttgcaggccaaggtcagatcttttcatgaatcttccagctctgcacaaacttgacaatatgcttcttgaaattttagatggttgcaaggatatggagttttggtatgttgaccaagggattgtagcccaagatgcagatggatcagcttcattttgcaaaagaattcaacggcaagaggataaatggtggctcccagttcctcgtgtccccccttctggcctcagtgagaactcaagaaagcagttgaatcacacaagagaatgtgcaagccaaatactaaaagcttctatggctatcaacaacggtgctttagctgaaatggaagttcccgagtcatacttggaaacccttcctaagaatggaaggacttgcttgggggattttatttaccattacatcacatcagagaaattctctccagagtgcctgcttgattgcctagacctctcctctgagcatgttgcactagagattgcaaactgtgtggaagcctcgatatacgtgtggcgtagaagagctcactctaaacccccagctaatcctaatcgttcatctacaaagtcatcctgggaaattgtcaaggacttcatggctgatggagataagagagaactactagcagaaagagctgaaaatgttctactttcattgaagcaaagattcccaggtctcactcaaactaccttggataccagcaagatccagtgcaacaaggttccattccatgcttctgttaccttattttcatccaatttgcaatattttctctcaaagcctttaacattaacacatttcatttcaaacattcaggatattggaaaatccatactagagagctattcaagagtgttggagagcatggcatttaacatcgtggctcgcatagaagatttgctatatgtggatgacttaacaaaacattcagataggtttcctctggttccaatgacagtgtctgtctcaggcactcctcataaagcaattggcacaccaagaagcttttcacctgcaccaccactaattagtcctgcaaggggagagagatcccctttccttggcaacaaccacaacaacaataataatatcaaacctcaacgtcgtggcttcggggtgagaagagtattgtcaaattatctaggggcagaatctaaagaaacaaagattttaagcaattcaactgtggtgaatggttcaaacacaagcaacaataaggaagaacaaccagaacgtcaaaagaaatcacatgccatgcatggcaagacaaaatga

SEQ ID NO: 76 - DNA, 738 bp, Glycine max
  Peptide Sequence Number=SeqID_91761
atggtgtataaaaaagtcaacttcattggagagattaatgacacaagagacttggaagttgataataagaattataagtatttgattgtgcaaaagaacccttcaaatgaacacgtaggagaagagcagacaattacattgacaaccaatcaagcatgtagtctctctggatctactattgaatttgactcgcatttgcacaaaaacacctcaccaaggcgtcattggattcaattcaatgagagcagacaagtccaaagtccaagcataacaaaaaaaagagagaaagaaataatgagctccatgggtgagagccagcagcggagcttgtttgggagtacaaaggcatcgtctctgccagtgtcaacgtcgcgttcagactctgaaggaggccttcgcagacgtctttcttctctgtctctgaagatccaattagagagcccgaattcctcctcatggtcatttcccagatccaagtccctctcatccatgggtgactatgcaaggacatggtgggactggagctgggcctggatcctctccaggaagctcatcttcgctacagatctcgaaatgaacgaccaggaaaccaagctccttgcttctcataacaggggcacttggagacatgttttctataagctgcgctctgagatcagaaggttcatcaatacttctgatcacaccactcttcccaaaacctaccaccacaagtccactcctcaagtcttctcataa

SEQ ID NO: 77 - DNA, 825 bp, Glycine max
  Peptide Sequence Number=SeqID_91762
atggggatattttccttggaggttatagttgtcccccagccatttatccttccagaaactgatgttggacccccttcccaccctccatttaaggttatcaataaagcagttgttgtgctgctgctgaaagatgatcttcagatcctgccaccgttgagaagctggcaacctggtatccaagaaggagctgctgactgggatgaagattgggataagcttgaagataaagaatttgtttttgtcaaagaactcactcttgacgtgcaaaacattatagcgcctccaaagcaaaagttgctgtcagctgtgaacacgaaagctttgaacacagaagctttgaacacggaagctgtgaacactgacagtcctacatttgctgcttctcccaagagtgatgataagtcaaaaaagccccagactaccaatgaacagggagttggtaatggatctgtttataataaaagtgaagatgggtctgtaaaaagtgctcccaatagtccatttgctagcagtgctattggaagcccgcatggggattttgattctaacataagaaagacagctggtgaagatagctcaccccgtgatcaagataccatacaagaaacccaaaggaatgaagggaataatggtggacctagtggaacgatggaaccaaatgaatccttactcaatcatgaggtgggccctagagaatggaaggtatattctagaagggagaaaagagtcacaaagggagaagggagcttggattctagtgaattgatagaatggttaggcagcaatagctggcctataggagccactgctctgtgtcagatttag

SEQ ID NO: 78 - DNA, 1746 bp, Glycine max
  Peptide Sequence Number=SeqID_91763
atggcacaaatgatcttcgaaggtgctgctgtacataagaatatcgtcaaagaagatgatgatgaattgtcggagataagggccgaacaacggcgcttggttgttggtggcggaggatgtaacggaggaggaaagggtggagacagggtgttcgaatttggggtcaagggttgtggtgcggccgtgtgggacgggggcgagacgcgtgatgctgctcgaggaacttctcctcttgaatacgggcgagaccggcggcttgagctagagtcaggggttgcaggatctgcacctcgcggcgaatttccgcacccgtggggtcatcgtaaggggattgggcaaaacggagctgcaaagcttgtaagaacactggccacgatgtcagttgaccgttgctctgcatccactggaaccaggccagagctctaccttccatgtagaaggaggcgatggtcaagcgttcctggggaggagttgcggctgagggataatgggattgggagaaggaacaggggagacaggattgtggtgtgggttaatgtgagtgaggagggcatcaagtttctcgcccaaggaaagctgttggatggagaggcgggtgaggatttcttcaagtttcaggggaggttcaggcggggtggagttggccataacaatgaaagcaccagaatgttaggtgcagaaattaagctggcttcgagggctagtacctccagaagcttaaggaagaagaagagaattgcgcaaggaaggacaagatacaatcaagcagtgtatggtgagttctgggctgatgatgcttcccaatttacccttacgcatagtccttcaattagctatcgagacatggtctcacaaataaatggccacaatgcagttcaaggatgttgcatagatatattcctagctgccattaaattgcttccgtgtgcagttcaatacaagttcattctgtttggagatggacacaagaacccaagctactatgatcttgtcaacatgattacttattatgtttttgatgctgttgtaggtgacattgcgattgtcactgaccgaacaaagattgtggattttactcaaccatatatagagtttgtggttgcttcagtgaaaaaattgaacagtggagaaaacacagttagttcacttggtcgagttgagttgataatctggctttttgtggttctgataatcaattcaagctacactgcaagcttgacatctattctcactgtgcaacaactgtgctcacctataacaagaattgatagcttgatattcagcagtgaacgtatagggttccaagtaggctcatttgctgcaaactatctgactgagcaactcaacatccccaaacataggcttatccctcttggctcatcagaagaatatgctgttgcctttcaaagccgaactcttgcaactgtggtggatgaacgaccctatgcgttcccgagagactctcctcttgcaattgatatgacaaccgcgattctaaccctatctgagaatgctgaacttcagagaatccaagaaaagtggctttcagaaaaggcttgtggttttcacagtactgaggaagaacagcttcaattaaatagcttccggggccttaagaaatcccctcaaaaagttggtccttctaatcgttgcagctcacgttctgcacacatccagacatttctacattttgttgacgaaaaagaagacgtatcacccaagaagttaaaacgaaaactcgtttga

SEQ ID NO: 79 - DNA, 207 bp, Glycine max
  Peptide Sequence Number=SeqID_91764
atggaagtaccaatgtcgacacttggaccctctggacccaaggaattgccggtgcctagagtaacaaaagctgccatggcctttaagaaagggcgggaagcagacttaggtaggcaaatggagtttggaggaaaggatcttcttcttggacagcagagtcaaaacgttaacgaaggaggcgcttctctcagccatgaagcgccttga

SEQ ID NO: 80 - DNA, 2190 bp, Glycine max
  Peptide Sequence Number=SeqID_91765
atgtcaaggaaacactcatggaacagcccgaaaaggactgggctttgtgaacctcagtctggagagcctgaccttgcaaattgtgtgtttgaatacacaccggagaactttgcttatatggtgtacttggagcactgtctgcttccaagagaagcttataggattgtcaatggtcttctgaaaactgctttgggaccacccacagggtcaaccactgctttgtctccagcacaggatattactttccgacatgaatctgtgaaatgcttggtcagcattattaagtcaatgggagcatggatggaccagcagataaggataggagatttagatctagcgaagagccctgaaagcagtagtgcagcagagaatcatctaatactaaatgtagaagaaggaaatgcttctgatcacgagctacattctgatgtaaattctgaattttcagaagctgccacattagagcaacgtcgggcatataaaatcgaacttcagaaaggcatatcactttttaatcgaaaacctccaaagggtattgaatttttgaaaagcaacaaaaaaattggtagttctccagaacaagtggcactgttcctgaagaacactgctggccttgatgaaaccaagattggtgactatttgggagaaagggaggagttttctctaaaagttatgcatgcttatgtagattcctttaacttcaaagggatggattttggtgaagctattcgattttttcttcagggcttcaggttgcctggtgaggcacaaaaaattgatcgcatcatggagaagtttgctgagcgctattgtaaatgcaaccctagttcttttagcagtgcagatactgcctacgttctagcttactctgtgataatgcttaatacggatgctcataataacatggtgaaagataagatgacaaaggctgattttgttcgaaacaaccgaggaatagatgatgggaaggatttaccagaggaatatcttggggcaatttatgaccaaattgttaaaaatgaaattaaaatgaatgctgattcttctgcacctcaaaataaacaagcaaatagcttcaatagattgctgggattagaaggtatactcaatcttgtgaactggaagcagagtgaggaaaaagcagtgggtgcaaatgggcttctcattcggcacattcaggagcaatttaaatctaattcgcgaaaatcagacaaagcacgccctcaggtggaaggaggtgattccaatgtaacgctcaccagagatgcatcacgcatcgtgtcgttgatgcaaaccgataagagggtggcacactggttgccaaacaagcccaatagtgggcacgacggagtccaaaggaatcttggtagccatgaagggagagacgacggtggtcgtcggcgaaaggatgccgtgatggctgccaaacagcagcaaagggtggagaaaggtacaccggaatgtggaaacagtcatcggaagacatctgcgtatcatgttgtcacagatgtggctatactgaggtttatggtggaagtttgttgggggcctatgctggctgcattcagtgtaacacttgaccagagtgatgacagggtagctacttctcaatgcttacaaggatttcgacatgctgtgcatgttactgcagtgatgggtatgcagactcaaagggatgcttttgttacatctgttgccaaatttacttatctgcactgtgctggagatatgaaacagaaaaatgttgatgctgtcaaggcgataatatcaattgcgattgaagatggagatcatctgtatgaagcatgggaacacatattaacttgcctctcccgaattgagcatttgcaactgttaggtgagggtgccccaagtgatgcaaccttcttcacttcaactaattttgaaacggaggagaaagcactgaaaacattaggtttctcttcttttaagaaaggaacactccagaatccagccatggtggctgttgttcgtggtagttcatatgacagtacaagtattgggattgggaactttgaattgaaccatgtgtttgctcatagtcaacggttgaatggagaagcaatagtagcatttgtcaaagcactttgtaaagtttccatttcagagttacagtctccaacagacccccgtgtatttggcctcactaaaatagtagaaattgcgtaa

SEQ ID NO: 81 - DNA, 945 bp, Glycine max
  Peptide Sequence Number=SeqID_91766
atgaagcggaagaagtggtcggagctggaagagcaaaccctactctccaaatactccgagctcctccgttcaggaaccctcgccaagctcaaaacccgcgagaagaagttcaagcctgtggcggagcacgtgaatgcggtgcaccacctccgcaacccagcctccttccccttcaagtggtcgtggcgcgacgtctcgatcaaggtgcagaacatgcgccaccagtacctcggcgtcaagcagaagatccgcctctcccctcaccacttcaattggaaggacggtaacaatcattgggagaattttcttaaatacaaagaagtcttcggcgatgtgcaattgttggaatcccccaaacctatcaccaccgccaaattagggtttgatgttgattctgatgatgatgagaatgaggaggaagaagaagaagatgatgatgaggaggattgtgatgaagaggaggatgtgttgaagggaggcggtggtgaagcgcgaggagaggcggcgggagagggagtttcggcgggagaaggtggaggcggagcgggagaggaagcggagggagtcggagtttcggcgggagaggcgaagggagttgctggaagatcgggagatggagctggaggagcggcagttgagcgcgtggaggagaagatggaggaggaggagatggagtggaggcagaggatggtggcaatgcaggtcgagcacgagaagcagatgatgcagatgcacgtagaggcgtgccagaatcaaatgcaggttctagggatcatggctagactcctttgccagttcttcgggtccggaactgatggattgagtaatggtttgggggcattgcctcctcaggttttgcatcatggaggtggattggggaatgcgaaactttggggagggaaagaaggggaaacagttgagcatgcttgtttgacgtgtttctaa

SEQ ID NO: 82 - DNA, 1272 bp, Glycine max
  Peptide Sequence Number=SeqID_91767
atgaagaagctctgtcccaatcttactcgcgaggatgggctcgaaacggtgctggaggttcccatccctgaggagattttcaccatcaagagtggaaccagcagagcttggcataacatgaagtcatggatgaagccaaatgttgaatcttcaagatcatcatcactctttggaggccaaaacacagatatccaactattgcttggtgttgttggagcgccattgatccctctccctgtcacctctcacaaccaacctatcaccattaaatcccataacattgaggcttcgatggcgaaatacatagtgaaacaatacgtggcggccgtgggaggagagagtggtttgaattcggtggaaagcatgtatgcgatgggtgaggtgagagtagggtcagagttttcagaaggggaagaatgtgtgagtagcaagaagacgaagaaggtacagatgaaagaggaagtgggagggttcgttgtgtggcagaagaagccagaactgtggtgcttggaactagttgtttctgggtacaaaatcagtgccgggagtgacggcaaagtggcgtggaggcaaacaccttggcatcattctcatgcttctcgtggcccaccaagaccacttaggcgtttacttcagggtcttgatccaaggtctacggcaaatttgttcaacaactccatatgcgttggagagaagacagtgaataatgaagaatgtttcatattaaaacttgaagccgattccaattcacttcgaacaagaagtagtagcaacgtagagattattcgccacacggtgtggggctactttagccagagaacaggccttttggtccaattagaagattcccacttgatcaaactcaaatccaatgcaagtgaagccatattttgggaaaccaacatggagtccctaatacaagactatagaattgtggatggcattaacatagcacacgcggggaagacttgggtcacattgtcaaggttgggtgaatgccctgagagccattcgacgacaagaataaaagaggtttggcaaattgaagaagtggattttaacatcaaagggttgtccatggattgcttcctaccacctagtgatttgaagagagaggaagagaaaggggtggaagagtgtggggtggctgcaagcaatgcaaagttgccctataagattcaatctgcttcttttaagattagtgtctccaaagtagcagctattaatgtggaggattcaagtgctagtgaaagtgatgatgaaaacgtgtaa

SEQ ID NO: 83 - DNA, 1071 bp, Glycine max
  Peptide Sequence Number=SeqID_91768
atggtagtttggtcagtggacacagtttatctatataatgaccgtgccttttgccttgagctagcttgcaaattgctagatgttggctatatttttggattagccggtcattacaaatatcttgactgtcaattatcaatatctaacagtaatgagaattcaatttctgcagaggaagaggataacatcatagtttcagcccatgcaatccatggaaacaaatgggcaataattgctaagcttcttccaggtagaacagataatgcaatcaagaatcactggaattctacactgacgcgcaagcgtatggaaatgggaagatatgtcccagcacatgctgatgtgatcgaagatggtactggtaactttgaaaaaacaaaagcatcctctgaagaaaccatgtcaattggggatatcaattcattgaatcctgcagaagtcagaaatgtcatgatgaatgatgaaactaaacctccaacaaaagatgatgctaaagtggaggaacatgctactcttcatcgaccagtagcacgtgttagtgcatttagtttttataactctccaggcaggccaacaatggggtcatgttcaaagatgttcccaaggcagagccctttgatccaatcccccaaaccagacgtaggaccctgcaagttatttgataatattgattgtgagcccatggtttcatcaaaagatgatgctaaagtggaggaacatgctactcttcatcgaccagtagcacgtgttagtgcatttagtttttataactctccaggcaggccaacaatgggatcatgttcaaagatgttcccaaggcagagccctttgatccaatcccccaaaccagacgtaggatcctgcaagttatttgataatattgattgtgagcccatggttccatcacaatgtggtcatggctgctgttcaggagactcgagggaaagccatttgcatggttcacttctaggtcccgagtttgttgactatttggagtcacctttctctagtcatgcatttctttctatagctacggacttgaactgttgtccaaagtatcacagaaaatga

SEQ ID NO: 84 - DNA, 351 bp, Glycine max
  Peptide Sequence Number=SeqID_91769
atgtcttttattggtactcagcaaaagtgcaaggcttgtggcaaaacggtttatccggttgatcagttatctgcttaccacaaagcatgcttcaagtgctcccattgcgaaggaaccttgaagcttagcaactattcctccatggaaagtgttctttactgtaagcctcataatgagcaactcttcaaggagacaggatctttcaagaagaacttccagtcaccttctaagcaagctgacaaaacaactcctgagctgacaaggtcccctagtaaagctgctagcatgttttctgggaccaagaaaagtgtgctacatgtggcaaaactgcttatccgttggagaaggtag

SEQ ID NO: 85 - DNA, 1608 bp, Glycine max
  Peptide Sequence Number=SeqID_91770
atggagttcactgcactctctaacgctacccaacttgggagcttcaaccctcttagaaccaaccttcaaagttcaacacaacactttcttcctttttcgtatgcttctttcccttcttcctctcgcagaggttgctcctgcaaagccgtccttagcacccacacacccacctctacccacaacaacatgtttggaccccgttccatcgattttgagctctctgctttgacggctctgtccccattggatggtcgttattggagcaaagttaaggaacttgctccttttttgagtgaatatggcttaatctactttcgggttcttgttgagctgtctgtgattcctgaaatcgttgaggttcccagtttcagtgatggtgctaaatctttcttagaaggcctgattgataactttagtgttgaggatgccttggaggttaaaaacattgagagggtcacgaatcatgacgtgaaagcggtggagtacttcttgaaacataagtgtcaatccaatgctgaagtggctaaggtggttgagttttttcactttgcttgcacatctgaggatataaataatcttgcccatgccttgatgctgagggaaacaatgaattctatcatgtttcctgtcatggataaaataatcaaagctttgtgtgatatggctaaagataatgcacatgttcctatgctttcccgcactcatggacagccagcttcaccaactactttgggaaaggaaatggcgatctttgctgcaagattaagcagagaaaggaaggatctgtctcaggttgagatagtggggaaatttgctggtgcggttggaaattacaatgcacatattgttgcatatcctgatgttaactggcctcacattgcagaacagtttgtacactctcttggattaagttttaatccttatgttgctcagattgaaactcatgactacatggcaaagctttttcatttgctcatccagttcaataatatattaatcgattttgatagagatgtatggggctatatatctttgggttactttaagcagaccaccaaggctggagagattgggtcatcaactatgcctcacaaagtgaatcctattgattttgagaacagcgaaggtaatctaggtgtagctaatggaggtctgtcacatctaagcatgaagttgccgatttcacgttggcaggcaagacctcttgaggacttgactgattcaactgtcttaaggaacatgggtgtaggtataggtcattctcttcttgcctacaaaagcacacttcaaggaatagggaagcttcaggttaatgaagcttgcttgagtgaagacttgaaccactgctgggaggtgcttgctgaaccaattcagactgttatgcgaagatatggtgttcctgagccttatgagaagttaaaagaactaaccagaggaagagcagttaccaaagagagcataagagatttcattaaaggcctagatattccagaagaagcaaagagtaatatgttgaagttaacacctgatacttatgttggagcagctgttgaattggccagaacagtggaaaatgtggtgaatactgtgattggaataaagatctag

SEQ ID NO: 86 - DNA, 450 bp, Glycine max
  Peptide Sequence Number=SeqID_91771
atgaattcggttataacagtgctgtatttcaatggaagagtatatgaagataatgatggtgtaatatttgaaggcagtaaaaaagcgatacagattaaacgtggaattagtttcaatgctttgaagaaaaaaattggagataagacgatgttggaaagttttaaacaacaacaagaaatgtcagttctagaattgtacatagaaaaggatgtggctggaggttcaatgtttcattctgcaaattcccttacatcatgtggaaattatgtatctaacgatgacacacaaccgccaacaaatatgagcaatttaaatcttgacgaagatgatgatcatgatgatgatgattatcttgagtctaactcatacgttgaagagtctttagacgaagatgatagtgttgacggtatatctgatacagacgatgaagtcaccgacattcctcaacca

SEQ ID NO: 87 - DNA, 750 bp, Glycine max
  Peptide Sequence Number=SeqID_91772
atggtgtggtataggcgtaaaacaaagatgtttgtcgacccaaacaatgcaaacacagctgcattgggtgaagttgtggagactttacaatatatggtgtcaccacaagggaggaacacgtggacggttgatgatctcgtgccttacgtggataagttagcgattatatctgaagagcaagagagaatcactgagccagtgtcacatggtccagcatcagagcgtgaattcccagtcccagagtttcacattcttcagtcaagtgttgaaactcggggcataggcagacgaagggagcctgttgaagccgaacaatattcccaacaaatgatggagcgtggtcatggaatgtattacacgccagcaacattttccgaatatccttcacagatgtatcagtatccttttgtaggtcatgatactgatacttctgagacctcacattcgttcggtggtgttgcggaaacacaagctcatttttcatggcccactatgactccttcacagcagcacgatgcctccatggcaacacctaacgccccatttgctccgcaatggaatgtacccggagcaatacctgatatgggtgacttattaggtgttgatttgcgtcaggatttttctgcagaggctgagcaagcagaagcggggagacaacgcggcggaagaagaaatcctgatcgtcaagcgcgaagatgggatcgaccatgtggcacatcctcacgacatcacagacaccataatgattga

SEQ ID NO: 88 - DNA, 601 bp, Glycine max
  Peptide Sequence Number=SeqID_91773
atggtgttggatggagccaaattgtacacggtggttgtggaaaaaggaggcttgtctcgtgttgccatggaatgtgtgaaattcctcgctcatcgcgttccgaatcttcctctcttgttatccagcaaccgaattctagatctcttgaacgcaccgtttttggcggttatagaggatcgggacgcgaggcggatgacggcgaggaggttatcggatgtggtgctggactgcgtgatgccatacatacacgactccaaggaccgcgacgccgtgtcgcaggtgtgcaggcggtggtacgagctcgactcgctcactcgtaaacacgtcactattgcgctgtgttacaccaccacgccggaccggctaaggcggcggttcccgcacctggagtcgctgaagctgaagggaaagccgcgggcggcgatgttcaacctgatacctgaggattggggagtcgcttcactttcggcgcatgattgtgagggattcggatcttcaagttctagctcgttcgcgcggtcacgtacttcaagcactcaggctggaaaatttgctctggattctccactgatggcctctactatatcggtcgttattgccg

SEQ ID NO: 89 - DNA, 924 bp, Glycine max
  Peptide Sequence Number=SeqID_91774
atggatcccggaacagctttagagcttgtcaagcacggtgtcactcttctcttcctcgatgttcctcagtacaccctcgtcgccgtcggtactcagatgttctctgtggggcctacttttaagggtattaagatgattcctccaggcattcattttgtgtattatagttcatcaagcagggatgggaaggagttctcaccaattattggattttttattgatgctggcccttcggaggtaatagttcgtaaatgggatcaacaagatgaaaggttaatcaaattatccgaggaagaggaagaaagatatagtcaagctgttaaaaatttggaatttgacagacaacttgggccttacaatctcagccattatgaagactggaaacgattatctaattttatcacaaagagcgtcattgaacgacttgagcccattggaggtgaaattactgttgaatgtgaaaatgagatagttaggaacactactaaaatgccaatggaggaagcactagacaagcagctgaaggttggtaattctgcaacatctgttggcaagtcccgaaggaaaggatgttattatacctcaattccacatgttgtgaaatgcaaggggattagtgggcaggaacttacttctttgaatcttgacaagacacatttgttagaaactctactgacaaaagattatggagattctgaagacttgcttcttggagaactgcagtttgcatttattgcctttttgatggggcaatcactagaagcatttctccaatggaagtcattagttagccttttgtttggctgcaccgaagcacctttccgcacacgaactcatctattcacaaaggtacaaaacattgacattaatacttggaatgctgttaatttcatccctgattgtagtagttcttctgacttctga

SEQ ID NO: 90 - DNA, 363 bp, Glycine max
  Peptide Sequence Number=SeqID_91775
atggacgagggcttgtcaggcttttgcattagatcatcatcaggaagtgtccgtggcaaaagtggcaccaagtgtgggcgttggaatcccaccactgaacaggttaaacttctaactgaactcttcagatcagggctccgaaccccaagcactgaccagattcaaaagatctccactcagcttagcttttatggcaagatagagagcaagaatgtcttctattggtttcagaaccataaggctcgggaaagacagaagaaccgtaagctctcctttgatgatcacaaggatctcatttgtagacaaaatgcaccttctacacaaagtcttgctgagatgtaccaagtttcaaagccagatagg

SEQ ID NO: 91 - DNA, 228 bp, Glycine max
  Peptide Sequence Number=SeqID_91776
atggaactatgcttttattgtctatttccctcttcttctcccattgggttaatatttcacacagacccaaaatatgactcattcgggtcttcttttcttcatagtgccgcaccactgcctcctcagcgtcgccgaccaccaccgttcttcttcctcagcttcaataacattgttgttaactattgtgctgaattggataacagaacagatgattggagcaaggaatga

SEQ ID NO: 92 - DNA, 2283 bp, Glycine max
  Peptide Sequence Number=SeqID_91777
aacaagatgcaggatatcacgcgcatggatgctgccgtggacgcaatgcgtccacttggatttaggacacaactgattctacgaacggttaatgaacttcttgatgtgtatggtggaaatcaaggatggtgctttattgaagaggcctattacaagctcctaatggaggccctacttagcaaacaacaaggttctgcagaagataaggatggtgcaagaagggatgatgttgttaatgggacatcatcagttgggatttctgaagttggctcttctggcatggtgactcaggacactccaatttataccagtgattgtttgggctcttcatctcaagccaatgcatcacttggcaatctagaaactgatgttgggaatttggctgtgcaagccgatagtggaggaaatgaacaagacatgatgaataagcctgaaaatgagataaagactgcagataatgtcaaaggaagcaaggatagcaccattgccaacaacattgagagcacttctgtcaagactcctatgattcaatcttcagaagcatttgatcatcgtccatgccgttgccctcctgaaggttgccatggatggattgatgatgatgatgacgacgacgacgacgatgaccttatccactttccagtcccaccattatttagacaaattgagaagatgattgtgcaactccttcggcatttcgcgggaatctcctcgttcctctgtcgcgctgcacctcttgcttcaaacttgatctccgttttcagcattccgacggttttcgccattcgcgttgtcgtcggacggaatatgtttcgttttacgtttgttactgatttggcttcaaatgctgatgcggttttgaactggaatagatcgagcaggaggagagggattgcttgtagtgttaccgagccagataacggtagcgacgagaaggagaaagaagcagataaaaatggagaaacgctacgtgtggaagattcctctgagcaaagtatccctccacctgtagatgcagaacaactaaatgagtttagtgatgaaaataagggtcaaagtgatgtgcagcagaatatggatgatagcaatgaagttgccagtggatcacctctgccaggtgtgaagcctcagaaactggatgaagcaataaaaattcccaaggaaacaattgaaattcttaagaaccaagtttttggctttgatacttttttcgtaacaagccaagatccttatgagggtggagtgttgttcaaaggaaacttgcgagggcaagctgctaaaagttatgataaaatatctaagagattgaaagataaatttggagatgaatacaagcttttccttttagtaaatccagaggatgataagccagtggctgttgtggttccaagaacaaccttacaaccagagacaactgctgtacctgagtggtttgctgctggatcttttggactgattacagtttttaccttacttcttcgcaatgttcctgctttgcaatctgatttattatcaacttttgacaatctgaacttgttaaaggatggcctacctggtgcccttgttactgcacttattctgggggtacatgaacttggtcactttttagctgccaaagacactggagttaaacttggggtcccgtactttgttcctagttggcagataggctcttttggtgccattacaaggataagaaatatagtacccaatcgtgaagatctgctcaaggttgcagctgctggaccaatagctggctatgccttgggtcttttgcttctgcttctaggttttgtcttgcctcccagtgatggtattggtgttgttgttgatgcttctgtgtttcatgagtcgtttcttgctggcggtattgcaaagctgcttcttggtaacgttctcaaggaaggaactgcaatttctatcaaccctcttgtgatttgggcttgggcaggactcctcatcaatgccatcaacagcattcctgcaggagaacttgatggagggagaatttcttttgccctatggggaagaaaggcttcattacgcttcacaggggtttcaattgcattgctgggagtttcatcactgcttaatgatgtagctttctattgggtagttctcatattcttcttgcaaagaggtccaattgctcctctttctgaggaaataactgatcctggtgagaaatatgttgctattggagtaacagttttactcttaggcttgttggtatgcttgccatatcctttcccatttacagaagaaaccatcacaagtttctag

SEQ ID NO: 93 - DNA, 639 bp, Glycine max
  Peptide Sequence Number=SeqID_91778
atggttactttgagcattttattcttttctttcgctgtgcttaaatcgaatcccgtgagagaatggttaaagtggaagtccacagaaacagcaagtacctattttgcagaagcgaccaagaagacaatgctttgggctttttccaacggacatatgctgataaacattatgaaactgaggaaaatcctttcaaatacaacgacgaggatgattttctttctctttcgaagagacccttggtgtttctttgcacggccacttagagcatgcagggagctgcagttgagatggttaaaagacaagtttgtcaccgaagtcagattttctagttcacagtggattgtgctcgagaaattgttgctagagaggtatgggatttcaatggaacttaaagaacccaagaacagagcaaatgactgcatgatgcgagtgctgtattttagattaaatggaatgcttccttcgaatttattggtgtgcagcgcagctatgaagcatcaacacggacacgggacacaatacggacacagacacgtgaacacctgtaatgtccaaaatatagaacgtaatacgggtgtcgtgtcggtgtcggacattgacacggacgcatgtcggacaccggacacgacaagagactga

SEQ ID NO: 94 - DNA, 1158 bp, Glycine max
  Peptide Sequence Number=SeqID_91779
atggcatctttcatcttcacacctgtactctttcttcttatcatctccgccgtccttctcttcctccaccgccgatcccgctgccggcgcttccgcctaccgcctggtacactcgggctccccttcgtcggcgaaaccttacagctcatatcagcttacaagagtgacaacccggaacccttcatggaccagcgcgtgaaacggtacggtccaatcttcaccacccatgtgttcggcgaacccaccgtgttctcgaccgacccagaaacgaaccggttcattttgctcaacgaagggaagctcttcgaatgcagctaccccggttcgatatcgaacctccttgggaaacactctctgctcctcatgaaaggttctcttcacaagagaatgcactccctcactatgagcttcgccaactcctccatcatcaaggaccatttattggtcgacatagaccgcctcatccggctcaacttggattcctggtccgaccgggttcttctcatggaagaagccaagaagcatgtgagtgtgatttacgtgatggaaatggaactggagttggtgactcagattccatggtttagtatattgtgtccaatttccataacgtttgagttgacagtgaagcagctgatgagctttgatccaggtgaatggactgagacactaaggaaagagtacgtgcttgtgattgaaggatttttctcagttcccttgcctctcttctcaagtacctaccgtagagccatcaaggctaggacgaaggtggcagaggcattaacactggtagtgagggatagaagaaaagaaagcgtaacggaggagaaaaagaatgacatgctaggggcattgttggcctccggctaccacttttccgacgaggaaatagtcgattttatgttggctttgctcgtcgccggctatgaaaccacctctacaataatgactcttgccatcaagttcctcaccgagactcccttagcactggcacaactcaagctagctagggtagtgggccatatagatgtagctccttccttagaattaccccaccagcgtgtgcatgtccatgtccatgaccaccgttcatgtggtgtggtctcctttgaaatctcattttcgttatctctatactcaccacttcccccattctag

SEQ ID NO: 95 - DNA, 270 bp, Glycine max
  Peptide Sequence Number=SeqID_91780
atggcgtggtacgacattaacgttctaagcaatgcaaactacaagagtgtggagcacagggtgctagtaaattcaaacaaagagagagtttccctagctttcttctacaatcccaaaagtgacatacccatagagccagcaaaggagttggtaaagccagaccaacctgcactctacacgcccatgacctttgatgaatataggctcttcattagattgagaggaccatgcggaaaatctcacgtggaatcgttaaaatctccaagatga

SEQ ID NO: 96 - DNA, 1422 bp, Glycine max
  Peptide Sequence Number=SeqID_91781
atggcgtcttcagacctcttcggcggcgccacctcagctccgccgccaactccggcggcgcaccatgacaacatcatgtcctcatccgacgccgccgatgcgctctcgcgcctcctccagcgcctcccgcccacgctctccctccccacgcgcctcccctcgccttcctccgcagccgccacgtgtcctccctgcctctcccttaacgacgtcctctcctgcgtttccaaactcggttacgcgcaactcaccgatcactcagtcccctccgaactcgccaactcggccgagtcagaagcgctggcactattcgacctttcgcaagaccagaagcagtccttgttccccaaaaactggcctcttggctacggaaacgatgaagatgaagacgaagacggggtcgccgactcgttccgcttcgactcggcgtgctctaccgagtcgagcgagttggcactcttttccctgcgcaagttcgcgcgtgaactggagaagctgggtttaatgatcgttgatgagttaacaaaagacttggggtgtgagaacccgctgggtgatgacccgaccagggtatgttcggttatgtgggtttcggagtctctgcccggaaacaaatcgggtgggttttacccgtttgtaatcgggctgcagtaccagataaggaatcagaaatactcattgctgtcggattcgggatgggtttctgtgctgccacacgtggactccattttggtcacttttggtgacattgctcaggtgtggagcaatggcaagttaaagaaagtgagaggtagaccaatggctacagtgggagatgaaaatggttcgcgctgcataacaatgtcattgctgataactcttcctacagatagcagagtggctccactccttcccaaggtaacatgcaacaaggaccaaaaggaagaagaaattgaaggggaagaagaagaaaacaatgatggtggtgatgaagaactagagaagagggtgttcaactcttttgactttgaggactatgcttggagagtttaccatgaacgcatccttttcaaagatccattggataggggtggaagtggtggcctgccaggcgcaaccactaatggtggcctgccaggcgctaccagtagtggtggggtcccaggcgcgaccactagtggtagcctgtcaggcgcgtccactagtggaaagagggacgtgcctgggccaccactagtggacgtgcctgacaggctaccactagtggtcgcgcctagggccccaccactactggtagcgcctgacaggccaccgctagtggtcgcgtctggcaggccaccacttccacccctgtctcatcgtcctgtcaagtcacgccacgtgtcgcgttctgctggaacacgcctctcaggacccaatttggtgattttgtctacgaagtag

SEQ ID NO: 97 - DNA, 338 bp, Glycine max
  Peptide Sequence Number=SeqID_91782
atggagatcaaattcacaatgagagagagagagagagagacagagcgagacagtgagagagacagcgggtgggaaagagtgaggtcgagaagggagagaagagagaatgagaggacgagaggtatggagggtccatgtctgtttatcgccagggaagggaaaggaggtcaacaacgtcgcttgcgagtcaactggagagatcatcggaatatatcatcgttttatttcacacgttttcctgaagatacaacagaagatgagctatggaagatattcagaagagcgggtgatgtcagggaggtgtttattcccaacaagaggaataggaccggaagaag

SEQ ID NO: 98 - DNA, 327 bp, Glycine max
  Peptide Sequence Number=SeqID_91783
atggaatggatcccatggcatggcagcagaacccgaccccgtgagaaccgaatcgaacccgccccgactttgacggataaaaaccgcgttgaccgggttcggggtcgggttcgggttttccccgataacccaaaacgggggcgggggcgggtatgggattacagctactgcagctctcagcctctcagtcaaggagaagtggtggagaacgtgaggccgctcaagagaggaatcaacgaagaggaagtactattggagaatgtggagctgatacttgacgcatttgattatctccaacttccatttgcactaaagcaaggtatatag

SEQ ID NO: 99 - DNA, 495 bp, Glycine max
  Peptide Sequence Number=SeqID_91784
atgaaagccttcaacgtgaacctaggtgctgtgcttagacttttcagaactgaaacaaagctaacacgtgaaccatggtacatgaagcctatctcgcagtacccagtggcggcatccctctctcccctgtcccgcaaccgccactggcggtaccacctcctgcaacaccctctctctcctatcccgccagctccaagggcgggacaccctctctctctcctatcccctcccatcccgccagcagcaatggcggcacccctccccctctctcctaatcagctcctatctcgccattggcactggcggttcaagcttcccgccagtgtcaatggcgacactcacaaaccattgacacaagtgactgagagctcgtataacccctcaaaaggtacagacatccatgtcgtaatcatcatactcgaggaaagggcctccaacccattagaggtatacattacaccaatcctgggagcaggcgtcagggttaccaagtag

SEQ ID NO: 100 - DNA, 354 bp, Glycine max
  Peptide Sequence Number=SeqID_91785
atgaatcattatgaagaggaaactctcaagaatgagtgtcataagcaagaagaacataagatggtgaagaagacttcatcaccatatgaattgaattccaacgacgaccctgaaactgaacgaggaaaaggaggaacaatgcgtacaaatgttgtgcacagtggtgaaacaagtgtagacaccaggatctcagaaggagacaattcaagtttgactgggcttactacagagcagtggcagacactggattgtatttcgaggacgttgattggagcagcttacaaaactgatggtttgcattccatggacttgtggcataaacagttgggacatccgtccttgaagatcacctag

SEQ ID NO: 101 - DNA, 468 bp, Glycine max
  Peptide Sequence Number=SeqID_91786
atgaataccaagccctttttctccttgtgcttactctgcgcactgcttctcatctgtgttgtggcaactgagccatccaaagatgcgacacaaggtagtgtctattgcataactagctgcatcttcctttctcaaatcacgccaagaaccattgttcttccacttattctacatgctttctttcttgctactcctattccccactcaataagtatgcacgtaaatcagaagaaccaaagacacggccagatgcctggagaagtggtggaagtggaggacatggtggaagtgggggacatggtggaagcgggggacacggtggaggctggggacatggtggaggctggggacatggcggtggacatggcggaggatgcaaatgctgcggtcgaaagggctgcaaatgttgctgaagtaaaaaaacacaaacatgaactgaagacacacatacgtgtgtactccatgtaa

SEQ ID NO: 102 - DNA, 87 bp, Glycine max
  Peptide Sequence Number=SeqID_91787
atggacaacgcaacttgggttgggttgggtaatatcaataggcccattttgggggttcaaaccgcatatgcagttaaccgcatatga

SEQ ID NO: 103 - DNA, 867 bp, Glycine max
  Peptide Sequence Number=SeqID_91788
atgattactgagcagagatcaagttcactcaattatgaagtaattagtaaaggaagaaagacaagcaatagaagggcctctctaggttctgcattagatttccatagcctattttccacaccaagaaggtcaacagaatatgaagtgccgagaaggagcagtgggaagatagcaagagaataccctatgcatatagaagatgccattgagaaaccaaatgaactgttagaggaactgctcaagtgtctgatagatttaagtttcttgacctacaagcagaagttcgcattctggatcaacatctacaatgcctgcataatgaatgcatttttacaccttggccttccttctactcaggagaaactgttgtctctcatgaacaagctacgtattgacacaggctgcaatgaacgtaggagggatagtactgaatgcactggctatcgaacactttattcttcggcacccatttcacaaaagggtcctatggatgaaaaggaagtgctattgcggcatgcttatggcctggggtatccagagcccaatgtcacctttgccctttgtagaggcacctggtcctcaccagcattaagggtgtacacttcagatgatgttgtgaaccaattggggagggccaaagtggagtacttggaagcttcagtgggtatcacaagcaagagaaagatacttgtgcctaagcttttggagtggcataagcacgattttgcagatgagatggaatcactactggaatggatttattgccaattgccacgctcgggatcattgaaaagagccaccatggagtgcctcataaaagaaacaaaaatatccagtgtccaaaatggtggaaatccagccatatga

SEQ ID NO: 104 - DNA, 906 bp, Glycine max
  Peptide Sequence Number=SeqID_91789
atgggcgatcatttggccagggccgaggattttgagaacaaggcagagaagaaactcagcagttggggcttgtttggctccaaattcgaggacgctgctgatctcttcgacaaatccgccaattcctataagctcgctaaatcatgggacaaagcaggatccacctacatcaaattagcgagttgtcatttgaagttggaaagcaagcatgaagctgcacaagcttatgttgacgctgcgcgttgctataaaaaaactaatataaatgagtctgtatcttgcttagacaatgctgtaaatattttctgtgagattggaagactctctatggctgctagatatttgaaggaaattgctgagttgtacgagtctgaacagaatatctcgcaggccgttgcttactatgaaaaatcagcggatttttttgaaaatgaagaagtgaacacttcagcaaaccagtgcaagcaaaaagttgctcaattctctgcccagcttgaacaatatcagagatcaattgagatttatgaagatattgctcgccagtctctcagcaatactttgctgaagtatggagttaaagggcatcttcttaatgctggcatttgcgaactttgtaaaggggatgttattgctattaccaatgcattggagcgatatcaggtccaatatttttcaagaatttacatcttgagaccggacttggatccaacattttctggaacacgtgaatatagacttctggcagatattgctgctgcaattgatgaggaagatgttggaaagtttactgaagttatcaaggaatttgatagtttgactcctttggattcttggaagacaacacttcttttgagggtgaaagataaactcaaagccaaagaaatcgaggaggatgatcttacttga

SEQ ID NO: 105 - DNA, 393 bp, Glycine max
  Peptide Sequence Number=SeqID_91790
atgggaggagggaaaattgatgagaaacggaattttaggccaaggttgctagtattggcaggaatcaggattaactatagttcaaacctaagaaaccaccgttacagaaatatgaaagaggaagaggtgaatcattgccagattcaggaatggtatccaatgttcaaatctgtatccatcaagaccttaattcatcaacttcctgaatcatttattcagcaccttcttgatgactcagggcccttcctgttgcctgtttctgtcttaaatgaagatgcattacccaatagaattcataacccagatgaggaagaagattttcaggtgtcagagggatctggtgatgaagcagaagcatggaattttgatcctcccttcctgttgctctcctaa

SEQ ID NO: 106 - DNA, 939 bp, Glycine max
  Peptide Sequence Number=SeqID_91791
atgaagccaccattctcaccttcttcttcccttctcagaggcaaagcacgcctctctccctacctcttcaccctcatagttttcatcctctttgtcgctatcctctatggcgaagacttcatgtgcatcttcggtcaacagttccaaaactactctaattaccctcacaaactctcctccacaaccgagagggtgaagaggcagaagcttccgtttgcggtggggaaggcggaggaagggtgtgacgtgttcagcggaagctgggttcgggacgagttgactcggccgttgtacgaggaatcggaatgtccgtacattcagccacaattgacttgtcaagaacatggacgacccgacaaggattaccagcattggaggtggcaacctcacggttgcgatcttcccaaattcaatgctagtttggtgctcgaaacacttcgtgggaaaaggatgatgtttgttggtgattctcttaaccgcggtcaatatgtctctttcgtgtgccttctccataaactcattcccgaggatggcaaatcaatggaaacctttgattcactcacggtattctctataaaggaatacaatgctacaattgagttctactgggcaccttttcttcttgaatcaaactcagacaatgctgtcattcataggatatctgataggattgtgagaaaaggttcaatcaataagcatggcagaaattggaaaggtgttgacattttggtattcaacacctatctttggtggatgactggcttgaagatgaaaatcttacttggatctttcgatgatgaagtaaaagagattgttgagctctcaacagaggatgcttacggcatggctatgaaaagtatgcttagatgggttaggttgaatatggatccaaagaaaacaagagtgtttttcacaagcatgtcaccttcacatgggaaa

SEQ ID NO: 107 - DNA, 1200 bp, Glycine max
  Peptide Sequence Number=SeqID_91792
atgtgtcaaacaaatgctgctcttgatgtaataagaaaagatgatgtttctgctgcaatatttgctcctggatgggtctacgagactaagcaagcaccagattttgagactgctcagaatcgttggtggagtctcgtgggaaaatcttggggcataacgcgaaagtatcttggaacactaccattttacacaaattttgatcagggaagcggttatcatatttcagttgatggagaccaagtatcagatgctccttggtgcaatatttcttcccaaggtgttcagccactccttgagtttgccgattcaactgcaaattctattcaacttattgtaaacttgaaggaagcatcatataacggaggggggaatattacattcaaaggatctcttgaaaaggatacttacttcaagaggagaatctttcaaggagagttcattttaagcaagctgcctatccatttcttttattctgtgaaatctgatagcaattcttcattgggacttgtacttgagttcacttctaccatcaacaaaacaatgtctgtactactcacttcccatggaatggatcatctgtcaagcgaatttagcaaagtagtcctaacaagtgaacacaagggaaatgcccttggatgggttatacatgaaggtacaattgaaatgaatggatacattctcactggaatccatgctttgtgctataagccaaatgctccttctaaagaactgaaatccagaccatttggtcctggtcatactgcgccttcctcaacagattattctgcggttcttggtcatatcacagtcaaaacttctaattataaaccagattttccaatttctacttcctggctagttgatggtgaatacatacattggaaatctggtcctcaggattcaaggatcctcagtgttaaaatttcttggaatctgaaaggaaagaattttgcatttccacactacaatgtgtttgtggagaaaccaccaaagctagcagatggtaattcaggcacaacattagaacctgtgcaggagtatcttggagtagcacatgtaaactgtttctatgtttctgagctcaaagttcctgctagcacttctagtctcaaatttattatacaggtctgcgattttgatgggacaaatcggaatttagaagactgtccatattatcaattggagataaaaggtctctaa

SEQ ID NO: 108 - DNA, 561 bp, Glycine max
  Peptide Sequence Number=SeqID_91793
atgcttctccgaaccgccgcctccgccgcttctgcttcgtccctctccctcttcagccctacctccgaacctctccgttcggttcccgctcgtggattggtggttcgcgccgcgaaaggatccacgaaccaccgcgccctaaccggcgtgatctttgaaccgttcgaagaggtgaagaaggagctcgatctcgttcccaccgttccacaagcttctctcgcccgccaaaaatacgttgacgaatccgaagccgccgttaacgaacaaatcaagttgctcctctctctctctctctctctcgcacatcgtgtggagtataacgtttcctacgtttaccatgctatgtttgcgtactttgatagggacaacgttgcgctgagaggtcttgctaagttttttaaggaatcgagtgaagaagaaagagagcatgctgagaaattgatggagtatcagaacaaacgtggtggaagagtgaagttgcagtcaattgtgatgccgctttctgagtttgatcatgcagataagggagatgcgctgcacgtacatgaaggaatgttgtga

SEQ ID NO: 109 - DNA, 738 bp, Glycine max
  Peptide Sequence Number=SeqID_91794
atgaattctttaacgctatttctctccttttgcttgatcctcattaccaattctccttcgctgacaaatgctaatgaggccatcttgcagttgtccttatacaaggcaatagaaggacagaagtttcttaggacattgatgaagtcagaaaatgttccagccattgcacaatgtgcaaactctgactatgaaagtgtgattacagcgtataagagtgctctaagcaagttgaaagacgatcctaaaactgctaagcattatgccagagatgctgaggccatcttgcagttgtccttatacaaggcaatagaaggacagaagtttcttaggacattgatgaagtcagaaaatgttccagccattgcacaatgtgcaaactctgactatgaaagtgtgattacagcgtataagagtgctctaagcaagttgaaagacgatcctaaaactgctaagcattatgccagagatgctggtaatggtcctgtttcctggtggggttggaaccgggtcagggcgacccggcccaaaccgcatttaggcaacagggttggaaatgccctagatgagacaaatcccaaaacaatgcaagacttggggaaccaccacgaagggtggtgtgccttctctgaatgccactggccgacgatgcgagatcgcgataggggcagtggcaacagagctgaggcactaccagaggcatggtggcacaaccaaaacaagaagaaaggaaagtcgtaa

SEQ ID NO: 110 - DNA, 396 bp, Glycine max
  Peptide Sequence Number=SeqID_91795
atggcttcttctgtatccaccacaccacctatgtactttgatgagaagtggaagctgtcaaagaaagaaggatccaccagaagcaggtcctcaagcacaagcacccctttcatcaagaattcttcttcctcacagagaaggtgtgcttttgctagcaagtgtgcgaagcttgtgaaggagcaaagggcgcgtttctacatcatgaggcggagggttgtgagcacgattcagttagtccttgctcccgagataaaatacaatgtgtcgaaggagacaacactgaaggtcttgtgggagaagctcaagaatatctatgcactagtccctaaccaatcgcctttgtttgaagatgaagttgtatcaactcaaaatggagatgggaggagatctccatga

SEQ ID NO: 111 - DNA, 678 bp, Glycine max
  Peptide Sequence Number=SeqID_91796
atgtcgcttccgaaattttcctactgcatctctggggaggacgctctcggtgtcctcctccttggcgacgggacggacgccccgtcgccactgcagtacacccctttagtgacggcgacaacctcgtcgccgtatttcaaccgtgtcgcgtacacggtccagctcgaggggattaaggtttcggagaaactcctgcaacttccgaagtcggtgttcgtgcccgaccacaccggagcgggtcagacaatggtggattcgggcacccagttcacttttcttctcgggtcggtctacagttccctgaaagatgagtttttggagcagacgaaaggagtgctgacccgaatcgaggatccgaatttcgtgttcgagggggcgatggacttgtgctaccacgcgccggcgagttttgcggcggtgccggcggtgacgctggtgttctcgggggcggagatgagggtgtcaggggagaggctgttgtatagggtgagtaaagggagtgattgggtgtattgcttcacttttgggaactctgatttgttgggaattgaagcgtatgtgattgggcatcatcatcagcagaacgtgtggatggagttcgatttgctcaagtctagggtgggcttcactcaaaccacctgtgaccttgccactcaacggctaggactctctccttag

SEQ ID NO: 112 - DNA, 516 bp, Glycine max
  Peptide Sequence Number=SeqID_91797
gccatcttgcagttgtccttatacaaggcaatagaaggacagaagtttcttaggacattgatgaagtcagaaaatgttccagccattgcacaatgtgcaaactctgactatgaaagtgtgattacagcgtataagagtgctctaagcaagttgaaagacgatcctaaaactgctaagcattatgccagagatgctggtaatggtcctgtttcctgtgagacagccttggctgctacaactagcccttggttgaaactcccccaccataaaatgaattctttaacactgttcctcgttgctccctctttgcttgatcctcattactcagccattgcagaatgtgctaactctgactatgaatatgtggttatggcgtttaggagtgctctgagtgatttgaaatacgaccctctaacggctatctatgctaacttgatgccaaacatgctgctgatggatctgaatactgctgctcatatttttaaccctgcaattcctgctcttatcgttgcttag

SEQ ID NO: 113 - DNA, 3075 bp, Glycine max
  Peptide Sequence Number=SeqID_91798
atgaataatgttctatccgcgatgatggtctccccaggcttgttaccatcagggactttgctagattctctgattcatgtgtgcaatgaagttggctcaatggagaagtttcccttggtacacacaagaaacgtttcaaccatgataaggaggatcaaacttctctcttctttgtttgaagagattcaagaaacggatactccactccctccttcctcgatcctgtgtctcacagaactcttctctgtgataagaagagtcaaagttttgatccaagattgcaaggatggaagttctctttggagtctcatacagttagagttcatatccaaccaattttatgtgcttgttaaggagatgggaagggcccttgatatcctttccttgagtttgcttaatgtaacctcagatattaaggaacaagtggagcttcttcacaagcaagcaaagagggctgagttactcattgatcctagagagcttcaccgaagagaacagcttatacaagtaatggccaacaacagtttacaaaacaagaagaagaaggggctcgttgactttggcaaagtggaagagatattaagtagcattggtttgagaactccatcagattatgaagaggaaatatccaagttagaggctgaagctcagaaccaagctggcacaggaggattaattgttgtctccaatataaacaatctcatatctctgatgtgctattccaaatccatgatattcaaagaaggagagagtgatacaaaagaagattgtaagccactatcttcatttttgtataacaaagtatatgatagttcttcatcctctcagtccatgacacctaatgttcctgatgaatttcgttgtccaatttcacttgacttaatgagggacccggtgattgtgtcatcagggcactcttatgatagaatctcaattgcacaatggataaactctggtcatcacacatgccccaaaagtgggcaaaggctaattcacacggctctcataccaaactatgcattgaagagccttgttcagcaatggtgccatgacaacaatgttccagtggatgagcctaccaccgaaggaaacaagaacagcagcaagaagttgaaggaagatgctgtagaccatatttctgcaaacaaagccgctgcggatgctgtcaaaatgacagcagaatttctagttggaaaattggcaactggttctgctgacatccaaaggcaagctgcatatgagcttcggttactcacaaaaactggcatggttaaccgaagcgtcatagccgaggtaggggctattccctttcttgtaacactcctaggatctcaagattcaagaatccaagagcatgcagtgacagccttgttcaacctctccatattcgacaacaacaagattttgatcatggcagcaggagcagttgacagcatagtggaagtacttgaatcagggaagaccatggaggcaagggagaatgcagcagcatcaatatatagtttgtctatggtggatgagtgcaaagtgcaaattggaggaaggccaagggcaatacctgccttagtcgaactcttgaaagaaggaactccaatagggaaaagagatgctgcaagtgcactgttcaatcttgcagtttacaatcctaacaaggtaagtgttgttaaggctgaggcagttcctgtgctggttgagttgcttatggatgacaaggctggcataacagatgatgctcttgctgttcttgctttgctcctaggttgctctgaggggctagaagagataaggaacagtagagcattggtgccacttcttattgatcttctgagatttggatcagtgaaagggaaggaaaattcaataacccttttgctaggactgtgcaaacaagagggggaagtggtggcaaggaggctcttggcaaatccaaggagcattccttcactgcaaagcttggctgctgatgggtctttgagagctaggagaaaggcagatgcagtgcttaggtttctcaatagcttctccattctcctcttgctatgcatgctaaagtccaccactgcctcgagcaatttctcggccatctttgcctttggggactccacggtggaccccggcaacaacaaccacttgttcactctcttccgaggggaccacttcccctatggtcgcgactttcccactcacctggcaactgggaggttttcaaatgggaaaatcgcaaccgattaccttgcccaattcctaggccttaaggaccttttacccgcttactttgacccgctagtgactgttagtgatatggtcaccggcgttagttttgcctctgggggctctggcttggatcccaataccgtggcattggccagggttttggacttgtcctcacagcttgcttcctttgaacaagccttgcagaggataacaagagtcgttggaaatcaaaaggccaatgatatactagaaaatgccttgtttgttatcagtattgggaccaatgacatgctctacaatgcatatttgatgccagcaacatcaaggatgattcgctatggttctatttcgggctaccaagattatctccttcaaaatcttaatgattttgttcagacactttatggagcaggagcacgtaggattttggtggcaggtcttccaccaattgggtgtctcccagtgcaagtgactttaagcagcatcaaagacctacattggctccaacgtgtgtgtgacgcccaacagaacatggattctcaagcctacaacaacaagcttcaatcccatatccatttactccaatccacactcaatgatgctaagatcgcttatttcgatatctatacacccattctcgatatggtccaaaatccaaccaaatatggctttgcgcaaactcttcaaggatgctgtgggacagggctcttggagatgggtcctgtgtgcaatgcacttgacctaacttgccccgatccgtctaagtacttgttctgggatgctgtgcaccttactgaagcaggaaactacgttcttgctgagaatggtcagcaaaatgtgattccataccttagtaattag

SEQ ID NO: 114 - DNA, 1386 bp, Glycine max
  Peptide Sequence Number=SeqID_91799
atggcgacttctttgaccttcacttgtattacagttttcttttccttcttcttgtctttcaacaactatgttaaaggtgatctcattccaccatctacttgcaatcgtacttctattaaaggtctcaatagaaaaatatcattggagttggtgcatatggatggaccatgctcccatttgaagcgtaacaatgttgtcaacgacaatgattttctgagggaccatgaaagggtgaagtacattcagtcacgaatttttaagaataataatttgactgaattagattcatcagtgagcataccaacgattccaggtcttccactttcaactttaaactacattatcgttattcgtcttggaacgccagaaaatagttatcaaatggtatttgatacgggtagttccctcacatggacccaatgttatcaatgcaagacatgctatgaacaatctgatgcaagatttaatccattaaattcttcaacatataaaggttcagtttgctcagataagacatgtaaaggcctcatgaatactagacaaggtctcaaatgtagtaaggatatacgcctatgccactatagtatccgttatggagatggatcatatagcacaggcttctttggcaaggatcgtctagccctatacagcaacatatctcctaacagcggcataacagatgacttctactttggttgtggcataatcaataagggactttttcatcgtactgcaggcgttttcggcctaggccgaggagagctctcctttgtgtctcaaacctcgtcacagtacatggaaaccttctcctactgcatccccaacattgataaggttggttacatcacctttggccctgaccctgatgctgaccacgatgagagaattgaatacacccctttagtcatccctcaaggtggcctatcacattacggtctcaacatcactggcatcgccatcgatggtgatatactcatgggccttgacttcaacgaaatcgaccacggcggcttcatcatcgactccggctgcatcgtcacccgcttacccccgaccatctacgccaagctccgctcagtgtatcagcagcgtatgtccaactatccctccgcaccaacatacactccatttgacacgtgttacgatcttagtggatttcattatccaattcccgaaatgtcattcgtgtttcccggtgtcactgtggacttgccccgggcagggacattctatcagctcaatccaaaacaatattgtttggcatttattcccaataaagacgatagtcaaataagcatatttggcaacatccaacaaaaaacccttgagattgtgcatgataatctgggtaataaaataggatttcgtccaaatggttgtggttga

SEQ ID NO: 115 - DNA, 1446 bp, Glycine max
  Peptide Sequence Number=SeqID_91800
atgagtcatgcattccactcccacatgcagcatatgcgatatcagagaagagacttgcaaatgtcgacttcttttaccttcacttgtattaccgttttctttttcttcttattgtctttcgacaactatgctaaaggtgatctcattccatcacctacttgcaagcgtacctctattcaaggtctcaatagaaaagtatcactggatttggtgcatatagatggaccatgctcccatttgaagcgtgataatgttagcattgataacgatctttttagggaccatgaaagggttaagtacattcagtcccgaatttctaagaataatagttcgtatcaattggattcatccgttagcataccaactatcccaggaataccacttgggacattgaactactatatcgttattcgtcttgggacgccagagaataattatcaactgcaatttgatacgggcagtgatctcacatggacccaatgtgaacaatgcacgacatgctatgaacaatccggtccaagattttatccagcaaaatctacaacatatgtggcttcaaattgctttgatgagacgtgcaaagtcctcataaaaaacgaacatggtctcgattgtagtaaggatgtacatctatgccactaccgtatctattatggtgacggatcccttaccagaggctactttggaaaggatcgtctggccctttacaatgacctcgcccccaaccctggaatcaccgataacttctacttcggttgcggcataattaatgatggaacttttggcagaacttcaggcatttttggccttggccgcggagaactgtcttttttgtctcaaacctcgaaacagtacatggaaaccttctcctattgcatccccagcgttgacgacgtgggctacatcacctttggctacgaccctgacactgactttgataaaagaatcaaatacacccctttagtcatccctcaaggtggcctaaaccattacggtctcagcatcactggcatcgccatcgatggtgatatactccctggccttaacttcagccaaatcaaccatgccggcttcatcattgactccggcaccgtcttcacccgcctccccccgaccatttacgcaactctccgttcagtatttcagcaacgtttgtccaactatcccactgccccctcgcacaatgtatttgacacgtgttatgatcttactggatatcattatccaattcctgaaatgtcattcgtctttcctggcgtcacagtggacctacacccgccaggggtactctatgagttcgatgataaacagtcttgtttggcatttattcccaataaagatgatagtcaaataaccatatttgggaacgtccaacaaaaaacccttgagattgtgtatgataatccgggtaatagaatagggtttcgttctgatggttgcagttga

SEQ ID NO: 116 - DNA, 1020 bp, Glycine max
  Peptide Sequence Number=SeqID_91801
atggaggcactagtggaagtgtgtgaacccgcagaggttcgaattgagttcgcactgaactgcaaatgtcgagccacggttcggattcggtctctaacccaaaccacaccagttgccttcaagatccaaacctcatcaccaaacaaattcctagtcaacccgcccagtggactcattcaacctctatcctccgccaccttccaagtcattctaaagccacagtcccacctccctcactcctaccctcgctccccctcggatcgtttcctagtcaaaacagccgagttctgtgctaactcgtcctgctcaactcaccccgagtcaatcaactcgtggttcgcctcgcgcccctacgggttcaagactctggacatcaaactgaaggtggcattcgttggccccatcctcctcaacgacgccgtcacgcgcggagatttagacgcggttaggaacttgattaaacgacagcgttccatgctcgccgagttgtcacccacccaagccgagacgctcctcggagccgccaccaagctgctcaacccggacgacatggttcacctcctcctcgaagccggcttgagaataatccccaatcccaataatgcccctgatcaaggagaagaaatatttgaggcttcgaggaacggacacgtggcggaagtggaatcgctgttacggagatgtggtgggagtgtgaagtaccgtgaccagtatggtctgacggcggttcacgcggcggcttttaaagggcacaaggatgtgttgatggtgcttagtgaattatcggatttggatttggaatgtgaagaccgggaaggtcacgtgccgcttcacatggctgtggagagtggcgatgtagggaccgtgaaagtgttggttgagaagggagtgaaccttaatgctgtgaataagaggggtgctacccctttgtacatggctaaaatttgggggtatgatgatatatgtcaattgcttgttagcaggggtgccttgtattctctaacttcgacttcgggttga

SEQ ID NO: 117 - DNA, 873 bp, Glycine max
  Peptide Sequence Number=SeqID_91802
atggcagcatcacccaccacaccagacaacataatttcaaaggaacctcccacaaagatcattgtgtgctgtcagtacatacatgactccaacatgctatctggtgtggcgcgggagcacgaagaagcatgcagggcaacgaatcaagccgttggcattgcaagaagaacagcttctaaatccgtttttctctgtgaagactttgtggcttccgttgcactcatcgcacactacgaatctgaagcctccgcaagaatcgcaggcgttgttctggttggagcgcgggaggcgttcgatgagccggtggagctcgccgctctcgtggagctggcggacgtcgtcagctccgccaacgtagatgccaccgacgaatacgcgcggcagggcgaggttgctgcggcagccgaggacggcgtggagctcgtcgcggaagcggtcgtcgatggagacgtcgcgctcgtcgacggcgacgcggaggccgcgcaggatggatcggacggcgcggcagtcgtcgaatgtgcggcgaacaacacggagggaggtaaagcgcggagcacggcggtggagatccggacgcggcggaagagagacggagatttgggagcggcgggttcggattcggggttgtcttggaagaggctctggatatctttgaaggaggagcaggagaagctgaaggagcgagttcgagaatgcgatggcgatgacgacggagagggtgagggcggtggagtgttgcggaacccgctcggtgagttgagccacggtggccacatgagaagtggtaagaggaaaagggttttgagggtagtgaagagtggagaaggtgatgggcacgcaaagaaaacgaaacgaagggggtgggggttataa

SEQ ID NO: 118 - DNA, 225 bp, Glycine max
  Peptide Sequence Number=SeqID_91803
atgaaggggaaagcggagcgcaatgtcaatctgctggtcgtaggtggcggtgcaactgcgacggtggggcctagggcggtgatggcgcagtgtgcgcgccgatctgggagagagaacgacgcgcgatggtggaggaactgggaggggatgtcgctcgcagaggagagagaaagagagagaggtaggtggcggcacgcaacagtgacgggggttgtcggaggctaa

SEQ ID NO: 119 - DNA, 258 bp, Glycine max
  Peptide Sequence Number=SeqID_91804
atggagccacgcaactctgccacgtgcacgccaccctcgcgttgcgacccatcttgcgcgcaactcacccccgagtcgtgcaccccaaggtcctgtcctctggaaaggttctgtggaaagaccgcctcggctagggttcggaaacgaagaagggttctgttttcttttcgcgatgagggccaagtggaagaagaagcgtatgaggaggctgaagaggaagcgccgaaagatgagacagagatccaagtagtgcgttaa

SEQ ID NO: 120 - DNA, 531 bp, Glycine max
  Peptide Sequence Number=SeqID_91805
atgcggtacttgcaccgccgctccatctgcgggacacgctgcctgaactcaccaccaggaagactttcgatacaagggatcttcaaggctgagatccatcaccgccatcttactcgtcagagccgaaaggcttactcaaccttgaggatagaaacttcccaagctatttatcttctctctcaaagaggctctctacttggatcgactcactctatggtggctcactcaagcttgaggatagagacttcccaagttatttatcttctctctcagagaggcttactcaagcttgaggatagagacttcccaagctatttatcttctctctcagagaggctctctacttggattgactcattctacggtgactcactcaagcttgaggatagagacttcccaagcaatttatcttctctctcagagaggctctctacttggattgagtcatcctatggtggctcactcaagcttgaggatagagacttctcaagctatttatcttctctctcagagaggcttactcaagtttga

SEQ ID NO: 121 - DNA, 795 bp, Glycine max
  Peptide Sequence Number=SeqID_91806
atggagattcttccactatataaaaagatagtagggttacaaggatgtgtttacaaaattgactcactctatggtggctcactcaagcttaaggatagagattttccaagctatttattttctctctcagagaggctttctacttggattgactcattctacggtagctcactcaagcttgaggatagagacttcccaagcaatttatcttctctctcagagaggctctctacttggattgagtcaccctatggtggctcactcaagcttgaggatagagacttctcaagctatttaccttctctctcagataggcttactcaaagagactctatacttggattgactcactctacggtggctcactcaagcttgaggatagagacttcccaagcaatttatcttctctctcagagaggctctctacttggattgagtcattctatggtggctcactcaagcttgaggatagagacttctcaagctatttatcttctctctcagagaggctctctacttggattgagtcaccctatggtggctcactcaagcttgaggatagagacttctcaagctatttatcttctctctcagagagacttactcaagcttgaggatagaaacttttcaagctatttatcttctctctcagagaggctctctacttggattgactcactctacggtggctcactcaagcttgaggataaagacttcccaaactatttatcttctctctcagagaggctttttctcactctaagaagtggattcactcttgtcttggatggatag

SEQ ID NO: 122 - DNA, 207 bp, Glycine max
  Peptide Sequence Number=SeqID_91807
atgcagagtaagctaaaggatttagagctcgaggccaatgcattaattttcgtgggaggaaaagtttccgttgatatattaccgttgatgaagctgttaagctttgcggtgggtgttcttcctgatcatgttcccaagcacttcaaagaaggcaccaatgagaaaagcaaggaactctcaacggtgttgacgtcatcaccgatatag

SEQ ID NO: 123 - DNA, 861 bp, Glycine max
  Peptide Sequence Number=SeqID_91808
gtgaggcgcaatagtgctgaaaatagaagatggttatctgtgaggtcatacttgtgtggcgatgaattcaactcagtgcttgcagagaatgattcagcttcagttaagagctctgaagtcacggtttcacagtccgtaaatgaggacttgttgaatgataaaggagacaccagttgtgaagaaactgtggagaatgtaacacagaacagaacagattcaaactccaaaaaatcattgaatgaggaagaagcagctattcttattcaatcagcatttagaggcttcctggaagattgggatgacagcacagtaagtagctatgtttcaaaaatgaggatgcagaatagaatggaggcatcaaccagaagggaaagagcattggcttatgctttctcacaacagctaagaatctgttcaaagagaagatctccaaaatttgatagaatggagtcaaatatgagttggagctggcttgaacgatggatggcaacacgccttcctgagacctcatcagttgaaagccatgccatgaagcagtatgacccttctaatggtagtcacaaattcacaatcatgacaagatttttggatgctgctggggaagaaaaggagagctgcgggtcaaatgaagtgccccttcattttgataactattccatcaattcacgagaagaaaaatttagcttcaaaccacatacaccaaagaccaacttcaaagctaggagaactgtttcaaggaggaaaacagtgccaagttatcaattccatgaagagcagccaaaggtcagaactcagaatctcttcattagttcacatgccatccaagccaagcataacatattcatgatcatgtctcagtga

SEQ ID NO: 124 - DNA, 348 bp, Glycine max
  Peptide Sequence Number=SeqID_91809
atggccgaatataccaaaggaatgctcgtgtttggtcttggagttctcattgttagcatgtggtgcatgaagggcactgaggccagcggcgacgacgacgatggtccaaccattcatgccgtgaggcgcgaagagccgcctgaagggtgcggatcccaccactcggaaggaggagtggaagaatgcacagaggaagatgactctcttggattgtatggtgatattgatgacactttcaaggctgcagtgaggaaagttgcttctagtttccatcatcatgatgatgatggccatggtgatgactctccagatgttgcacacaacaatgtcaatgtcttgggacattga

SEQ ID NO: 125 - DNA, 3309 bp, Glycine max
  Peptide Sequence Number=SeqID_91810
atggaaaaagggcaaagaaaaacaacaccactactactatgctctcacattgtggttctccatttgctctccctagtggccgagactagtgccaaggtttccgcggtgatcgtcttcggtgactcctccgtcgacgccggcaacaacaacttcatccccaccattgcacggagcaatttccagccatatgggcgtgactttgaaggtggaaaagccactgggaggttctgcaatgggagaatacctacggattttatatcagagtcttttgggctgaaaccttatgtgccagcatacttggatcctaagtataatatttcagattttgcaagtggggtcacttttgcttctgcagcaactggttatgataatgcaacttcagatgtgctgtctgtgataccactatggaagcaattagagtactacaagggataccaaaagaatttaagtgcatatcttggtgaaagcaaggcaaaggataccatagctgaagcattacaccttatgagtcttggaacaaatgacttccttgagaactactacaccatgcctggtagagcatctcaattcacaccccaacagtaccaaaattttcttgctggcatagctgagaacttcataaggagcctctatggtcttggtgctaggaaggtttccctaggagggttacctcccatgggatgtttgcctctagaaaggaccacaagtattgctggtgggaatgattgtgttgcaagatacaataacatagcattggagttcaataataggctcaagaatttgaccattaagctcaaccaagagctccctggactcaaattggtgttttctaatccatattacattatgttgagtatcataaaaagacctcaactttatgggtttgaatcgacctcagtggcgtgttgtgctactggaatgtttgagatgggttatgcatgcagcaggggccaaatgttcagttgcacagatgcttccaaatacgtgttttgggactctttccatccaactgagatgacaaatagtatcgttgcaaagcccggttgggtcatactgagtcaggcacatcaaaagcaaaagtccaaacgctcccatctcgccaccgtgaacaccccgacacaaacacactccaagcgcacgttagcagtctccgccgtcttcgccaccgtgccatcgccgtcgatggagtctctcttcggctcgatcaacgttcgcgacctcctctcggcgcaggacctctcggaccctaactcccctctctcagcgccggatctccgtctcctgatccagcgcctggagtcgcagtccttccagatccgttctcaggtgcagtcctaccttgtctcgcaccacgaagacttcgcgcgcctcttctctctttgtaacgacaccgtttcgcagacgcgcgaggtctccgatgatgtttccgccatcctcggcctcctctccgaccacccgatcgatgccgaggtgcgcgagatcgtgtcggagacgaagtcgaagaaggaggagctgaagatgaagaaggagctgctgggattggtcggaaccgttgtggcgctgaaccagagattggagagtgtgagggaagcgttgaagagtggaagattcgaattcgcggcgcaagggttgaaggagttgaaggtggcgctgaggattggtgatgaggatgatagggagcctttggtgtatggcttgttgaggaaggagtggtctcagtgctttgaagagattcaagaggtcctcgtgaactttatggaaaaggcagtacgatttgatggggatttgaatcaagttgaaatcaagtatcacttagaagttgagaatgtgaatgggattcaattacaaacagttctggaggcaatggatgtagttggtattctagagtatgggcttgctaaagttgctgatttgatgatcaagtatgttattactccttttgtaaatcatggacgacctctttcatttctcgaggaactgcatcaagaattggctttactgaagatagttccatcaccagatagtaagtttgaatatttggatggagagtttctctattcagggattctgctgtttatcaaatttatttacagaagtatttgcttccagaaaagttcttggatgcgatgttttggacggttgacatggcctaggatatcagagctaataatatctagctttctttcgaaggttgtcccaacagatgcatcaaaacttcctgactttcagaagatcattgcttgtacatctaaatttgagatggctttaaaagagcttatgtacatttcagaatcagatgacaaagataacaggctgagcaattttgctgaaaatgttgaggttcactttgcatttaagaaaaagacagagatcttggctaacgctagaaatctgcttctagaatgtgacttttcaattcctcaagagtatacaagggatggttctgtttggaagagtgatgaaacttctgcccagtcatccagccatgtggtagatttgcttttcttatcacagaggtgtctagtatccaaagcagccaaacaattgatggagctagttcatcagacgctacaggatgtttgcctgtcatctacaagagttgcttttgaattttatcacacagctagagatgctgtactactttatgaagtagttgtccctgtcaagctagagaggcagctcaatggcatcaatcaagtagccattctgttgcataatgactgtctttatctctcccaggagattcttgggtttgcatttgagtatcgaacagactttccaagttccatgaaggagcatgctgtgtttgttgatttagctccaagatttcagctgttggcagaagaaatattgcagagacaagttcaccttgttatttataatttgaaggaggctatagatggtgctgatggatttcagaatactcatcagatgaaacagtttgagtcagctaaattcagcatagaccaggttgttttcattctggaaaaagtacatatcatatgggagccacttttgctgccttcaacttacaggagaagcatgtgtacagtcttagagtcagttttctcaagaattgctagagatatacttctgttagatgacatagctgcagaggaaactttacagctacaaagacttatttatttaatgctggaaaacttgtcatcattatttgagtctctggcccctggagaacagaatttacatgagttccctgcagagtctcttgaagatcttatcccatccttacgtaaaatccgtaaactatcaggcatgcaaaggcatcttcttaattatttcttttaa

SEQ ID NO: 126 - DNA, 264 bp, Glycine max
  Peptide Sequence Number=SeqID_91811
atgatggttcaggagcttgatacacccggtcatggtgggccagaagtgctgcagcctgttatccctccactgttaagagccggaggtgatcgctgctctgtgaagccagcctcacgctgtgccctccagttacatgctagcgttacccagctcggcaaactgactcatatgtcagagacttataaagaatggtttgtattaaaacctagtcgatgtggggcttgtctcagccacgaggtgggagttctttatggtggaacataa

SEQ ID NO: 127 - DNA, 255 bp, Glycine max
  Peptide Sequence Number=SeqID_91812
atggaaaacaacgatgttggtaagagtagaagagccacgtccacaatcgtaatggaaaactcagacaacgacgaacccgaaaagaagaggcctcatctcacgtttgtttcttcccgcacgcctcgaaactccatcaacactcctgccaccaacaaaaccgctgacccaggagtcttacagttccagaatcagcagcttgttcaacagatagacatccaaaaacatgctttgcatgatcttgaagaaaaaacttag

SEQ ID NO: 128 - DNA, 825 bp, Glycine max
  Peptide Sequence Number=SeqID_91813
atggagaacttccctgtgatcaacttgaagaatatcaatggtgaggagagaaagactatcttggagcaaattcaagatgcttgtcagaactggggattttttgagttggtgaatcatggaataccccttgaacttttggatgcggtggaaaggacatggattgggagagcacattcttcttgcgccaacatctctgaaatccctgatctcagccaagagtaccaggatgcaatgaaggaatttgcaaagaaattggagaagcttgcagaggagttgctagacttgttatgtgaaaatcttggattagagaaagggtacctgaagaatgcattttatggatcaaagggtccaaattttgggacaaaggtagcaaactaccctgcatgcccaaagccagagttggtgaagggtcttcgtgcacatacggatgcgggtgggattatccttctcttgcaagatgacaaggtcagtggccttcagcttctcaaagatggccaatgggtggatgtgcctcctatgcgccattccattgttgttaaccttggtgaccaaattgaggtcattaccaatgggagatacaagagtgtggagcatcgtgtgattgcccaaacgaatgggaccagaatgtccgtagcctcattctacaaccctgccagtgatgctgttatctaccctgcaccagcattgttggagaaagaggcacaggagacagagcaagtgtacccaaaatttgtatttgaggattacatgaagctctatgctacgctaaagttccatccaaaggagcccagattccaagccatgaaggcagtgaactcattttag

SEQ ID NO: 129 - DNA, 3741 bp, Glycine max
  Peptide Sequence Number=SeqID_91814
atggatcctcagttgtggcacaaagttgctgcgatttcaggagtggcagcacttggattgggaacctatggtgcccacgtcttcaagccccaaaaccctgcttacaatgatgtttggcacacagcttcgctttaccatttggttcacactgctgccttagttgccgccccaattacaaaacaccccaatgtttttggaggccttctgaccgctggtatcttggccttctctgggacggtgagccattgccacattgatgttgaggatgaagagtttatttcattgtcttggttgcacgtatacaagctaggttgggtatcacagatattgtctgaagtattaggttgtgaacgtgaaagcttcaacatgttacgtggagaatcttcctcaaactcttggcgatggacataccatgttttcttgagttttagaggagaagacacccgtttagattttacagatcacttgtacgctgcgttggtgcgaaagggaatcatagcttttcgagatgacaaacaactcgagaaaggagatgcgattgcagaagaactccctaaagcaattgaggagtcccttggtgccatagtcattctctctgagaactatgcttcttcctcttggtgtttggatgagctcaacaaaattcttgaatcaaatagagttctggggagggaagtttttcctgtcttctatggggttagtcctggtgaggttcaacaccagaagacccagagtttttatgaggcttttaagaaacatgaaagaagatctgggaaagacacagaaaaggtgcaaaaatggagagattccttgaaggaacttggccaaattcctggttgggagtccaaacattatcagcatcaaacagagctcattgaaaatattgttgaatcggtatggacaaaacttcgtcctaaaatgccatctttcaatgatgggctaattggaattggctctagagttaagaaaatggattcacttctaagcatagaatcggaggacgttcgctttatcggaatatggggcatgggtggcattggaaagacaacagtagcgagagttgtcttccagaaaatcaaggatcagtttgatgttagctgcttccttgacaacgttagagagatttctagagaaaccaatggcatgcttcgcttgcaaacaaaacttctgtctcatttggcaataaaaggcttagaaattatcgatttggacgaaggaaagaacacaataataaaccttttatccgagaagaaagttttacttgtccttgatgatgttgatgacactagccaactaggtaatttggctaagagggtagaatggtttggacgtgggagcagagttataatcacaacaagagacacacaagtattaatatcacatggagtagttgaaaattacaacattgagttcttaaattcggatgaatcccttcaactcttgagtcagaaagccttcaaaagagatgaacctctagagcattatttggagttgtcaaaagttgtagccaaacatgctggaggccttcctttggccttggagcttttaggttcatttctttgtggaagaagtgaattccaatggagagaagttgtggatatgataaaagaagtctctgccagtcatattgtgatgaaatcgcttagaataagctacaatgggttaccacgatgtcataaagctttgtttcttgatattgcatgcttcttcaaagggagggtaaaagagcttgcaacacaaactctagaaatttgtgaccgctatccagcagttggaattgaacttctagttgaaaaatcattggcaacttacgatggctttactatagggatgcatgacttgcttcaagaaacagcaagggaaattgttatagaagaatctcatgtagatgctggaaaacgtagtaggttatggtctctagaggacacaaatcaagtattaaaatacagtagggaaaatgaatcgattgaaggcatagctttgaactcacccgaaaaggacgaagcaaactgggatcctgaagcattctcaaggatgtataatcttcggctacttatcataagttttcctataaaacttgctcgtggcctcaaatgtctttgcagttcattgaaatttcttcagtggaatgacttttctttggaaactctgccgcttggtgtgcagctagatgaacttgcttttgcaaagctgaagttcattgatttgagctattctgaagatctaattcaaactccaatagtttctggggctccatgtcttgaaagaatgcttcttataggttgtataaaccttgttgaggttcacccttcagttggacagcacaagagacttgttgtattgtgcatgaagaactgcaaaaatcttcaaatcatgccaagaaaattggaaatggattctttggaggaattgattctttctggctgctcaaaggttaaaaaactcccagaatttggaaagaatatgaaatctttatcactgcttagtgtggagaattgcataaatcttctttgcctaccaaattctatttgcaatttgaaatctcttagaaaactcaacatttctggctgctcaagattgtcaacactgcctaatggtttgaatgaaaatgagtctttggaggagcttgatgtgagtggcacagctataagagaaattactttatcaaaagttcgtttagaaaaacttaaagagctctcctttggtggaaggaaagaactagcacccaactcacaaaacttgcttctatggatctcaaagtttatgaggcaaccaaatctgaaggagtcaaccatgcctcctctttccagcttacttgccttggtgtccttggatttaagttactgcgaccttaacgatgaatcatttcctagccaccttggttctctatcattgttgcaggatttagatctaagtggtaacaattttgttaacccacctgcccagtgcattattaatctttctatgttgcagaatttgtccttcaatgattgcccaagacttgaatccttgccagtgcttccaccaaatttacaaggcttgtatgcaaataattgtcctaaattgaaaccatttaatttggatgaagaaatgctatggaagatatatgagacacaatcacggcccgaggtttggttcatcataccagggaatgaaattccatgttggtttgacaatcaaaactgccttgcaattgattcatcacatcatccatatgacaagttgggttgtgattcagttacatcaataacagtggatgtacctaaggattgccagttaagtaaatggtggggaattgcagtatgcctagtattagaaccttcaaatatggaggaggaggactcatctcgatcttatgtgagaccaacttctacaggaaatgaggaaatgtgcatttattattgggtctgtaaagctcctgatcgagaccctgacccaaagtttcctatagcatccaagtttggacacttggtttacaaactcaatgacccttacatccatattatattcttgagtgctgatcatgcaacaataaagaagtgcgggtgccgtgtggtatgtaaggaaaaaattgaagaatggcgcaagcactcagatggtcttaatatatcaagattaacagaagtgaatgatgatgaggaatttcgtcgtgaattggtggtggaagagcctacttctccaaatacattctcttcaacggacaaaacagcagtaaacactgcccttggtaaaatgatctga

SEQ ID NO: 130 - DNA, 135 bp, Glycine max
  Peptide Sequence Number=SeqID_91815
atgacccgacccgacccagagcgaaacacttccgtcagtggtgtccgcatatccttcccgccgataacctttccggtgatcgttcttcgctcacgcacgcgttacggtaatcctttctctctttttggttcttaa

SEQ ID NO: 131 - DNA, 645 bp, Glycine max
  Peptide Sequence Number=SeqID_91816
atgatgcaggtggaaatttcgcttcgtttcaaccagggaactggtgagagtgttttagtgagtggagaagttggtggtgctggtggagcatactcatatgaagccttgaaaagattagaccggctatggtcaagcatatgctcctctcaagaaggttcatgtcattcaatggttcttatatcctttaggaaatcaaactattctatatgtctgttgtgcaagaacctctgcaagttgtctggctcatctgatcttattgacaaagaaaagggatcatatgatgtgttagctcctaacaatgaggatttagcctctcatttccgtgagagactttacaccttagaggctaacatggatggaagaacgagagagatggataaaggaagaggagataatggtagcttaaaattcactcgacctcatgttgagggcgcacgtacttctagacttgatgaggacatgaccaagaacaaggacaaagattcacttgaaggacttggaggacctatgacaagggctagagcaaggaaagcaaaggaaactcttcaacaagtgttgtccatactatttgaatacaaacctaagtttcaaggagaaaagtccaaggttgtgagttgtatcatgacccaaatggaggaggactaa

SEQ ID NO: 132 - DNA, 1305 bp, Glycine max
  Peptide Sequence Number=SeqID_91817
atggaaggagagaaagaaaatcccgatggtaacgccgctttggtgaactccttctgcgaaatcacttcctcttccaaggaagaagctcttttctttttggagagccacaatttcgacctagacgctgccgtttcgactttcctcgacaacgccaacaaccccctcatccctctcaacgacgaccttgccattcccaaccccaacgccgtttcccctccctcagattctcactctccggacttcaacccttctcgctcgccgtctccgtctccttcgcccacccgcaccccctacgagctccgatcccgtaggtctctcggcaagaaaccctccaccagtcgccaaggcaaaattcgcaccctcggcgatctcaaacgcccctcccgcgacgacgatgattccggttccgatcctgatttcgaacccgacgagtactacaccggcggcgaaaagagtgggatgcttgttcgagatcctaccagaggaaacaacaacaacaatttggatgatattttcgatcaagcaaggcaggttgctgttgatgcgcccccggagaatcctcgaagctcttcgaggtcgagaagttttagtggcacggcgaggttgctctccggagagactgtgccatctgctcctcagcgtgtagaggaggttactcacactgtcattttctggaggaatggattctctgtcaatgatggtcctctacggaggttggatgatccgcagaacgcaccgtttctggaggtagtttgccatgacttttgcttccaaaagctcttattgaaggagaaggaaaaattagaatttaaactttgcttatatagcattaagaagtctgaatgtcccaaagagcttgaaccagcagataggaggactgctgtccatgtcaacctcacaaggcgggatgaagactaccctgaaccagtgaagccacgccaacgtgcttttcagggcgttggaagaactttaggtagcaccagctccagcaatgatgaacctattcaaacaactggtgcttcaccaaatactgcaccaatgccaacaatgggtttagttgtagatgagtcgcagccagtgacatcaatccagctgaggttggctgatggcacgcgcatggtttctcgcttcaatcaccaccatacaatcagagatgttcgagcattcattgacgcatcaagacccgggggagtaagaagttaccaactgcagacaatgggttttcctcccaaacaactcactgatttggaccagtctatagaacaagctggtatagccaactcagttgtcatccaaaagttgtag

SEQ ID NO: 133 - DNA, 2499 bp, Glycine max
  Peptide Sequence Number=SeqID_91818
atgtggaaactgaacaagtcaatagcaaaagaacttttgcctactcaacctgtggattttccaattgaaccgtggtgggaagtttgtcttgtgaaccttaccttggaagaatttaagaaattgtcaaaggaggaaatggccacaatagacaaagtttgcatggaagaagcaaattcatttgtcatgtttgatcctgacattgtaaggggtctttgcaaacggggactggtctattttgatgttccaatttatcctcaagatcggtttaaagtttttgtagtttcaaatgaaaatgtaacagttagagacttggcaacaaccctacaagctgacttgtcacagttgcaagctgctgctgcttttgtgtgtcgattgggatgggcaacaaaagtagttgatccagaatctattattggagattcaactatactagcatcacctgtggcaagttcaactagtgatgaagatgcttttgttgctattcaaaattatgagaataccctttttgataatgactctattcaacaaggggatgcttcagcttcagggaaccatggacctcgttcttcctacactcgtgttgctttcatagttgatgctaatattacatcctatcttatgatgggatctgtttcaccaggcctgaaatctcatgctgttacactctatgaagcagggaagttgggttacggcagcattgctgatctatgcaaggatcttagtaccttggagggtgcaacatatgagggagaattacaggaatttgctaaccacttatttagtctacgttgtgtcttagagtgtctacaatctggtggaatagttaccaacataaaagaagagggaagttctgataaactgagtatgattacctcaagtaatgatgggccaagttctgagatagctgaaagttcttgggttgataaatcaggagattgtagtattttagaagctgtgataaataacgaggatttaataaattatgattcagagaagctcgtggaggcttctatttacaccgaacgtgtttctagtggaatagatgatgaaactcgttccattactttggaagatggcagtgatcacattcacgaagctgacaagtcaaacacaaaatttgatagtaatgagaaattagaagtatttgaaagtgcagatgttaagacagaaatgctaaaaaggacaaaaaaatatcgtgtagaccttcttcgctctgaaagcttggcttctcttgcaccggcaactcttgatcgtttgtttcttcgtgattatggtatagttgtgtccatagtgcctctttctcattcatcaattcttcctagaccaacaggtccagttcattttggtcctcccacatattcttctatgagtccttggatgaaattggttttatactcaactgcaggtagtggccctatatcagttgttctgatgaaaggacagtgtctgcgcttgcttcctgcaccattggctggttgtgagaaagcccttatatggtcttgggatgcttccacaacaggagggttaggaaggaagcttgaaggaaagttggtgaagggcagtatcctcttgcattacttaaactcacttcttaaacattcagctgtgttggtgctgcctcttagtaggtgtgatcttaatgaatatggaaaattgattactttggatatccctttgcccttgaagaatgctgatggatcaattccctctgtaggaaaagagttaggactaaatgaagaggaagattctaagttgaattctttattggccaatttggctaacaaaatgaaattgtggactgttggttatattagactattgaaattgtttaatggaggaacaaaatcagaccagttttcttcagaagagaaatatgaatgggtgccattgagtgtggaatttggaatgccactatttagtccaacgttgtgcaatagtatatgtagaaggatagtttcatcggagttgcttcaatgtggttcatttggtgaacactatgatgcaatgcaaaacttaaggaaaaaattgcatgatatttgtgatggctaccaatcaacaggtcccattacaaagcatctttaccaaaaagatcaagcttttggacagcctatggaccctgccagtggaagatggaattcacttatggatctttctcccttttcagacgtattaagtgtgcgccaaaggctaaaacttgctaatcgacaacattgccaaaatgaagttttgagatgtgatggcagttttcttagatcatacacattaactcctgctcatgaagctgctacagaaccaattaaagaatcccatgaagccaatacgataaaaactgaaccagaagaaaatgatagtaaagaagcaatccttcctggtgttaatcttatttttgatggttctaggttgcttccatttgatataggcacttgtctccaagctcggcaacctatatccttaataatagatgcagctgctgcctcaacatatgcaccattcaaatag

SEQ ID NO: 134 - DNA, 1158 bp, Glycine max
  Peptide Sequence Number=SeqID_91819
atggaactcaaaaaagggttacttgtgttctttttgctgctggagtgtgtttgttacaatgtggaatccaagtgtgtgaagggatgtgatgtagctttcgcttcctactatgtcagtccggatttaagcttagaaaatatagcgcggttgatggaatcaagcattgaagttataatcagcttcaatgaagacaatatatcgaatggttatccgctatccttttacagactcaatattccattcccctgtgactgtattggtggtgagtttctggggcatgtgtttgagtactcagcttctgcaggtgacacctatgattcgattgcgaaagtgacatacgccaatctcaccaccgttgagcttttgcggaggttcaatggctatgatcaaaatggtatacctgcaaatgccagggttaatgtcacggtcaattgttcttgtgggaacagccaggtttcaaaagattatgggatgtttattacctatccactcaggcctgggaataatttgcatgatattgccaatgaggctcgtcttgatgcacagttgctgcagcgttacaatcctggtgtcaatttcagcaaagagagtgggactgttttcattccaggaagagatcaacatggagactatgttcccttgtacccgagaaaaacaggtcttgctaggggtgctgcagttggaatatctatagcaggaatatgcagtcttctattattagtaatttgcttatatggcaagtacttccagaagaaggaaggagagaaaactaaattgccaacagaaaattctatggcgttttcaactcaagatggtacggtctctggaagtgcagaatatgaaacttcaggatccagtgggactgctagtgctactggcctcacaggcattatggtggcaaaatcaatggagttctcatatcaagaactagccaaggctacaaataactttagcttggagaataaaattggtcaaggtggatttggagctgtctattatgcagaactgagaggcgagaaaactgcaattaagaagatggatgtgcaagcatcgacagaatttctttgcgagttgaaggtcttaactcacgttcatcactttaatctggtacagcatccttcaaacaaccccaagcatgtatatatctgggaaggataa

SEQ ID NO: 135 - DNA, 658 bp, Glycine max
  Peptide Sequence Number=SeqID_91820
ctctgggtttctgcgggaaagaaaaagactacaatgcgaagggtttttctctcagttcagacatgatattgaaattcccaacggtgagaatgctcggaattgtgttgcgaacatgatactcaaatttcacgacgatccaacggtgaacgggccaatggaagagcacaagcaccgagctcttatccattttctaaagaggtgcaaaaagcctattgagctcatcttccattgcatggatcaagtggttgaagagttgagagactcgtacagtccactagatccaatttggatgcaggagacgcctagcctatatgatagtgttccggatgactgtgctcatcacaatgatcctgtctatggtaaacccgggaaactgtatttcatgccatatatcaaaagtgacatgcttatgcttgagaatcaattgcccatgagggttgttcttcacacattgattgaggttgagactgacacagcccagcgtctccacgtcggagccagcaacgagataacgtcgtacgtgttcttcataggcacggtcatcgatgacggcatggacatggcaatacttcaccgaaagagagatcctgatcaacgctcaccaaagatatcaccgtggatagtgatggagaacttgaaaaggtacagaggtacatga

SEQ ID NO: 136 - DNA, 2830 bp, Glycine max
  Peptide Sequence Number=SeqID_91821
atgaaggtggaaatcaagatagagatgaaaccattgaaagttaggatagaagatgctcgggccaaggtttctgacacatcagcaaggaagtataatgatgttcttgatgcacatgagaaatccaaagatttagagaatacattaaaagatgtaacgaaagaacttcaaaactttaacaaagagaaagaggttattgaaaagcgacgaacagtggcattaaagaagcacacagagcttgagcttgatgtcaaagacttgcaagagaagatctctggaaatacccgagccaaagaagatgctgcaagacaactggagatacttgagaaagaaattcaagattcaactgctgaactgggcaaaattgttcctttacatgaagatcaagttcagaaagaaaaagacattgtcaaacgtaaagcttctcgtgataagtggcttcaaaaggagattgatgatcttgaacgagtgcattcttcaaacaaggggcaggcaactcaatttggtcttgctgttgatttttggaagctgcttgtagaagctaaggagaagcctgttactacacaatctcagactcagctgaatggaactttttatgctgcttattttaaaatgaactgggagcaaaagcttttggatgaaattgatcggcttaaagaagaactacaggattgtgatgagaacataaacagacgtaaatcagaaattactactttggaatctctcattgctcagtcacgtgaagggcttaatcgttacaaagaagagagagacaagttacatggggagagaaatgaagaatgcatacacccaaagtataggatgaggtccctatggggcaaagagaatgaacttactgctgaaattgataagctgagagctgaagttgagaaggctgaaaagagtcttgatcatgcaattcctggtgatgtgagaagagggttgaattcagttaggaagatctgcagggagtataacatttctggagttcatggtccaattattgagttgctgaattgtgatgaaaagtttttcactgctgttgaagttactgcaggaaacagagtaaagggtccacgcatcacttatccacagagttcggatgtcatacctcttttaaagaaattgaactttaaacatgactatactcctgcattcagtcagacctcttttgcgttgcattttcgagttgtggttggagtggttgtgatcgcgcttctgattctgaagcccaaggacgattcattttcacacgggtggcatgagctaacaaagaacatggttagtgatgggttgggtcttaaggttatctgcaagaatttggatgtggcttcaagggttgctcgttctgatggtctggactgcataacactggatggtgatcaagtaagcaagaaaggtagtatgactggaggattttatgatcacagacgatcaagattgaggtttatgaatatcattaagcagaatgcagacactattcatattagagaggaggaattggagaaaatagaccaaaagattaatgaaattgttgctgagcagcagaagattgatgccaaatgtgctcatgacaaatctgtgattgaacagcttaagcaggatattgctaatgctaataagcagaagctgttgatttctaaagcacttacaaaaaaggagaagtctgttggggatgtccagaatcaaattgaacagcttaatgctagtatcgctatgaagaaagctgagatgggcactgagctcattgatcatttaacaccagaggagaaaaagcttttgtcagatttgaaccctgaaatcaaagaccttaaagagaagcttgttgcttgcaagactgatcgcattgagactgaagcacggagagcagagctggataccaatctaaccactaaccttaggagaaggaaacaagagctggaggctgtaatatcatctgcagatgctgactctttggttgctgatgctgaatcaaagtggcaggaacttagtgatgctaaaatattggttgatgatgcaatagggcagcttagaagtgttactgaaagtataaatgaccgaacacgacaaattaaaaagatcaaagatgaattgaataaattgaaggatgagtatgaaaggaaacttcaagaagatgcaaaagagttagagcaattgcagagtaaaaaaaacacatatgctgctaaagaagaggaatatgccaagaaaataagggaactgggaccattgacatcagatgcttttgaggcgtgcaatgagcaattgcagcagttcagtcatgtaaacaagaaagcccttgaccagtatataaattttacagaacaacgagaagaacttcagaaaagacaggctgaacttgatgcaggagatgagaaaattaaggagctaataacagtgctagatcaacggaaggacgagtcaatagagcgcactttcaaaggtgttgctaggcattttcgggaagtattttccgaacttgtgctggggggacatggtcatctggttatgatgaaaaagaaggatggtgatcatgatgacgacgaagatgaggatggtcctcgtgaagcaaatccagaggggagagtagaaaagtacattggagtgaaagtgaaggcaaggtttgttaacctcacccgttgggatgagtctattgttgtttgtatcagaatgcttgaaggggagacacagtccatgaagcagttgtctgggggtcaaaaaactgttgtcgcccttacacttatctttgccatacagcgatgtgatcctgctcccttttatctatttgatgagatcgatgcagcgctggatccacagtacagaactgctgttggaa

SEQ ID NO: 137 - DNA, 951 bp, Glycine max
  Peptide Sequence Number=SeqID_91822
atgtacatcaagcaggttgtgattgaaggttttaagagttatcgagagcaaattgctacagagcctttcagttctaaagttaattgtgttgttggtgctaatggatctgggaagacaaactttttccatgccatccgttttgtgttaagtgatctctttcaaaacctacgcggtgaagataggcaggcacttctccatgaaggagctggacaccaggttttatctgcgttcgtggagattgtgtttgataattcagacaatcgtatcccggttgacaaggaggaagtgcgcttgcgccggactataggtttcaaaaaggatgagtattttctagatggaaagcacataacaaaaactgaagtgatgaatttgctggagagtgctgggttctcccgatcaaatccttattatgttgtacaacaaggaaagatagcatcactaaccttgatgaaagactctgaacgactggacttgctgaaggaaataggtggtactagagtttatgaggagaggcgtcgcgaaagtaataaaagaaagcaaataatccaagttgtacagtatttagatgaaaggttgaaagaactagatgaggagaaggaggaacttagaaaatatcagcagcttgacaagcaaagaaaatccttggaatatgctatttatagcaaagaagttcaagatgctcagcaaaaacttacagagccaagtccaaagattaaatactgcatcttcgaacaacttgttggcattgaaagtttcattagagaacaatatgctgttcctatgttgaaaccttcacttatatattttaacttggccttatctttatccaatgtgggatttgggtttttcccaacacctcccctcatgcccaacacttttgagcttggtgtgtggataatatggtgggtgatccttttgatggatctaggatatgctctgataccatcctag

SEQ ID NO: 138 - DNA, 1785 bp, Glycine max
  Peptide Sequence Number=SeqID_91823
atgggaacaactacaacaccccttgtgttggttcttctattttgctgccttgtttctgttttacaagcagaatacttgaagtacaaagacccgaaacagccactgaatgttagaatcaagaacttgctgaagcgaatgaccctggaggagaagataggccaaatggtgcagattgaacgaagtgttgccaccccacaagtgatgaagaagtacttcattgggagtgtgctgagtgggggagagagtgttccagccacaaatgcatctgctgagacttggatccaaatggtgaatggaatccaaaatggatctttgtctacgcgcctcgggattccaatgatttatggcatagatgcagttcatggcaacaataatgtctacaaggcaaccatctttcctcacaatgttgggctaggagttaccaggcaagtaaacatggatccagtactgataaagaagattggagatgcaactgccctagaagttagagctactggaattcaatatgtttttgctccgtgcattgcggtctgcagagatcctagatgggggcgttgctttgaaagttacagcgaggaccctaagattgctcaagcaatgactgaaattattcctggtttgcaaggagacatcagtagcaattcaagaaagggggttccctatgtttctggaaagaacaaggttgcggcttgtgctaaacattatgtaggagatggtggcacaaccaagggcattaatgagaacaatactgtgatcagttatagtgaattgcttcgaattcacatgcctccgtattatgactccattgtcaagggggtttcaacagtaatggtctcctactctagctggaatggccaaaagatgcatgctaatcattttcttgtcactaattacctcaagaacaaactgaagttcaggggttttgtcatatcagattggctaggcattgacaagattacttctcctcctcattctaactattcatactctattcaagttggtgttggtgctggaattgatatgatcatggttccctttaatttcactgaattcattgatgtcctgacttatcaagtaaagaacaatattatcccagagcatagacagatagcaagggaagccgtaaggaaatcacttgtgttgctaaagaatggtaaatctgctgagaaacctctgcttccccttcccaagaaagctgcaaagatactggtggcaggaagtcatgctgacaatttgggttatcaatgtggaggatggacaattacctggcaggggcttggtggcaataatctcactgttggtacaacaatccttgaggctgtaaaacaaacgattgatcctgctactaaagttgtcttcaatgaaaatcccgactccaactttgtcaagtccaacaacttctcttgtgccatagtcgttgtaggtgaacacccttatgcaacaacatttggtgatagtttgaatctgactattccagagcctggtccaagcaccatcaccaatgtatgtgggtctatacaatgtgtggtagttctcatcaccggccgaccagttgtgattcagccatatctatcaaaagtagacgcacttgtggctgcatggcttccagggactgaaggccaaggtgtagctgatcttctctttggtgactatggattcactggcaagttggcaagaacatggttcaagacagttgaccagctaccaatgaatgttggcgataaatattatgatcctctatttccatttggatttgggttatctacaaaccccaccaagtattaa

SEQ ID NO: 139 - DNA, 1959 bp, Glycine max
  Peptide Sequence Number=SeqID_91824
atgatctccgtcattgacgctctccaaacggtccttaacgcctctaaacgtcttcccccactcactgttccccttcacgatgccctaggcaaggtcttggcccaagatgttcgcgcccccgatcctctccctccctacccggcctccgtcaaggacggttacgccgtcgtctccgccgatggccccggcgagtatcccgtcgttgccgaatcgagagctggagatgacgctctcggcctcactctctcccctggaactgtcgcttacgtcacaaccggaggaccgatacctgatggtgctgatgcagttgttcaggttgagaatactgaaatagtgaacaatgcctccgatggtactaagagggtcagaatattgctacaaaccaccaaaggcaatgatatacgcccagtgggagttgatattaagaaagatgcagtagtcttgacatctggagaaaggttaggtgcttcagaaattggtttgcttgctacagttggtgttacaatggttaaggtgtatcctactccaacagttgctgttctttctactggagacgagcttgtggagccaactactgggcatctgaatcgtggtcagattagggactctaatcgtgccatgctgctggcagctgcggtacagcatcagtgcaaagttctggactttggtattgctaaggatgacaaagaatatcaaggaaggatcttggataaagcatttgcgtctggaattcatattcttctaacttcaggaggtgtttcaatgggagacaaagattttatcaagcctttgcttgaaaagcgaggaaaagtacatttcgataaggtgtgtattaaaccaggcaagccatttacatttgcagagattgactttcaatctacagagagcaaaattctagcttttgggctacctggaaatcctgtcagctctttagtttgcttccatctctttgtggtccctgcaatacgctaccttgcagggtggacaaatcctcatcattttagggtacaagctcggcttcgtcaaccaataaagacagatccaattaggccagaatatcatcgtgcttctgttatatggactgacaatgatggatcaggcaatccaggttttgttgctgtgagcactggtcatcaggtaagcagtcgactacttagtatgaagtcagctaatgccttgttggagtttccagcaacaggcagtgtagtttctgcagggactgctgtgtcagctatcataatttctgacctaagacctatggcatgtgatgagaatcataagtcatcagactcagcctttgctttgccaggaattaaatcaaataaaataactactgattcttcaggggatgctgaagtcaaagtggctattcttacagttagtgatacagttgctatgggtgctggcccagatcgaagtggtcccagggcagtttctgttattaattcttcttcagaaagactaggaggagcaagagttgtagccactgctgtggttccagatgatgtggcaaaaattcaggacattctaagaagatggagtgatattgaacaaatggatctcataattactcttggggggactggctttacctctcgagatttaacgccagaagctacaaaaccattgattgagaaagaaacacctggccttctgcatgtaatgatgcaagagagtttaaaggtgaccaaatctgcaatgctttcacgctctgcagctggaatcagaggatcaaccttgatcattaacatgcctggaaaccctaatgctgttgccgagtgtatggaagctttattgccggcacttaagcatggtctgaaacagctcaggggagacaagaaagaaaaacatcctcgtcacgttcctcatgccgaagcagttcctgcagatgtgtgggaacagagttatatgctagccactggtgctggctctgatgtctcttgttcctgttgcacgtaa

SEQ ID NO: 140 - DNA, 165 bp, Glycine max
  Peptide Sequence Number=SeqID_91825
atgaaagggttatgtcaaacaagagagaaaaacatcatcaatgagtcttcaggcaaatattgcagctcttgcaccatgtgtgggaaggttttatcaaacttgggtagcaattctagaagaataaaggaaaagaggaagagcaatgtaaaaaatgtgaaaaaataa

SEQ ID NO: 141 - DNA, 450 bp, Glycine max
  Peptide Sequence Number=SeqID_91826
atgattcactttgtgcttctcatcagtcggcaaggaaaagtaagactcgcaaaatggtattcaccatactctcaaaaggagagatccaaggtaattcgtgagttaactgggctaattatctctcgagcccctaagctgtgcaactttgtggagtggaggggattcaaagttgtttataaaagatatgctagcctatacttttgcatctgcaatgatcacgaagacaatgaattggagaccttggccattattcatcactatgtcgagacattggatcgctattttggcagtgcatattttatattggatgaaattttgttggctggagccatgcaggagactagcaagagaactactctgagactgataggtgcacaggaggatttagtagaagctgccaaagaggaagccagctcattgagtaatataatcgcacaggccaccaagtaa

SEQ ID NO: 142 - DNA, 486 bp, Glycine max
  Peptide Sequence Number=SeqID_91827
atggagaaactcgcaaattcattttcagtgttagaactcgacgccgatgatagccacgttcccaccactgccggtagtagtgacaagagagttaatgctgacattgacattgtaccaggaaaaagcgagaaacaaaatctagaaaatccagtgacttcttcatgtgaatacaagttacctcttgtgtggattgacttggaaatgactggtttaaatatcgaagtggacagaatattggagattgcttgtataattacagatggaaatttaaccaaaacagtggagaatttagaatgtgagtttgagcctaactcaaccccaaaagctagctcaaggggtgagggttacccctcacttatatactttaacttggctttatttatagacgatatgggacttgagttttttccaatacaccccctcaagtccagagcacttcttggacttggtgcgtggataacaatggtgggtgatcctttggattaa

SEQ ID NO: 143 - DNA, 330 bp, Glycine max
  Peptide Sequence Number=SeqID_91828
atgtggcgtgttctagctgcagtgacaagaaaccttcagagcacaagaaagagttccaaggtggcagatgagagcatgtttgaatcaggaaacggtgtagagctatttggacatgagaggggaagaagatcacaacatggttgggggcttgtgtgtagcattcttcaagcccccatatcaatactctcatgtgtttctcaccctcaggttaataataatggctctgatgggatttgggtaactactggggaattctcatcacaggtgtctgaaatgaaccatctcatgggaatacttgtgaatgccaattgtgttgctcttggtttctaa

SEQ ID NO: 144 - DNA, 1074 bp, Glycine max
  Peptide Sequence Number=SeqID_91829
atgggttttgggacactgagtttatccgtggtggtccgatttgaggccactaatttcaatggtttgcccccatctcggtcgtccaattcgttgcctcatctctcgttcacaaagccatcttgggttgtgagaacggagtctaatgttcggaagaaaagaagaaagaagccagatccgcattgcgtggtatgtgaggggagtggaagagttgattgtcaccagtgtcatggaaaggggaggacaaaccaggttcatttggaaatgctcccgaaaggtgaatggccaaaatggtgtaggacttgtggtggaagcggtcttagttactgctcccgctgccttgggactggagagtatagggatgatggtatttggttcaaggtattagagaatgtcttggtacagcagctttactttcagtggcagttgcttgattctcttttacctacgggtggatttgctcattcttttggccttgaagcagcagttcagtgccacttagtgtctgattccaatgaccttaagacatttgttatccatatattggagaatacaggaagcttactccttccttttgtgtactcagcttccatgttgcccaatttagaaacttggcataagcttgacaaaatattggatgctaccctaactaatgaagtgggtcgaaaggcatcaatctcgcaaggatctgcattaatgagggtggcctcagctgtgttttctgaggtcccctccctcaaaaccatgagagatacttctctgggtttagggactgtatcttttcatcatgctcctgtatttggacttatatgtggagcactaggatttgataaaactagttctcagagagcttacatgttcatcacaatgagagacgtgatttctgctgctacaaggctaaatttgataggaccccttggtgcagcattgttgcagcatcaggttgcccctaatgctgaagttatattagaaaaatggatgaatcgagctgttgacgaagcatgccaaactatgcctctgttagatactgtgcagggctgccatggttacttgttttcaagattgttttcatcttag

SEQ ID NO: 145 - DNA, 261 bp, Glycine max
  Peptide Sequence Number=SeqID_91830
atggcagttcacggtgacgatgaccctgtggtgatggtggttcccaacctctccccgcccaacacctacgaagctgtcgtcaacggtggcaccttcgaccgattgcacaatggccaccgcctcttcctcactgcttcagcggagttggctaggcgccggattgtaattggagtttgtgacggacctatgctggcaaaaaaacagaattccatttttatgtacgcacctaccataattattgtactccagctacagttttag

SEQ ID NO: 146 - DNA, 1893 bp, Glycine max
  Peptide Sequence Number=SeqID_91831
atgtcttgtttagcgctttctctgcaacccgcaaatggatccgacattctcctccagacgcgcgagtggttccctccctcacgcgccctcggcgccctctccgccttccgccacacgcgccgcgccttcgcctccaacaagcactcggcccctgacgacgcctacgccgcggaatccatcggcgacgaccccctcgctgcgtccagcggccaggtcatcgtcggcgtcgagagccgctaccgcgtcgtgtaccgcctcgtgaacggcatctacgtcctcggcatcaccgtcgccgaccacgacaactccgtgaacgtgttcgagtgcatccacatcgtcaaccaggccgtgagcgttgtcgtcacggcgtgccgcggcgtcgacgtcacgccggagaagctcagccgcaagtacgcagagatctacatggccctcgacatcgtcctccgcggcgttagcaacatccgcctcgccgccatgctcgccaccatgcacggcgagagcatcgccaagatggtccactctgccatcgacaccgagaacaagatccgcggcgccgaaacatggccctccgcggaggtgcattccctcgaacaccaggccggcatcgacgccttcaccaccgcgaccttcgaattgccgccggagacgctcaaggccggggacgaggtcgccgccagcctcgcccccgctgcgccggagcctcaggaggagccgcagcagaagcaggatgaatctcaggtggaaaaggatccttttgccgcgagtgatgcaattaacaaaccacaagagcttgttgaagggttcaagaaaacaaaggatccttctagtactgatttaacctcagctttggaggggcttgatgtgaccacattgccccctcctgaggctactcaatccacgcaaataaatgtggagggttttgaagggaactacggcggagttgagtttgggcatgaacaagcttctattggagaagcttttgaaggtttcaatgatgcttggggtggtggacttgatccttctgagtttgtgggtccaaccaagcctaataagccgcaaggacttggtggggttgaattgttgcagactgggcctgatgctgctcctaaagcagcggctgaaagtggtgccggaactccgctggagaatttgttggtgaagaaaactgagatgaggggtcctgagatgtatatctcggaggagattagtgccgagtttagagaatcgttgcttaccagggtgggattgatgggtgttgtttacctcagaactttgccacccaaaactgctggtgataaggaaactgaattttcgttccgaattgagggaacagaagctgttaaaagatttgttatacaaagttcgcgtgttagtagccttggtaatgggatgtttcatgtgaggactgcagcctctgaggagccgatacccattatgaagtatagtttggttcctagtctgacgcctttgcctttgagggttcgacttacaaaacgacatactgggagtttgctttctgtgatgatacaatatgcttcaaaccctgatttgctagttcccctgcatgatattacattcactctgaaactgcctgttgaccctacactgttgaaggtttctccaaaagctgtgttaaataggactgaaagagaaattaaatgggttgtgccagagattccattgaagggctctcctggcaggttgagagtacggatgccggtagattctaacgaagatgatgaagaaattgaggtggttggttatgtgaaattttctgagcgagtaactcagtcattgtctggagtttctatacgacctgcttcagatggtaagacagacttctacgaggttagtcacagacttgagagtggggtatacatgtgcgattga

SEQ ID NO: 147 - DNA, 1029 bp, Glycine max
  Peptide Sequence Number=SeqID_91832
atgtcatatgttcaccaaaccattatgttcttcataactgataagtgcttttatccaatacagtatggtgtcttaaaagagattgatggcatatcatctgagacaatattgctattatggagtatgaaagaaaagtacaactgtgattcaaaattcaaaatttactttgacacactcccagaaaaatttaatacagctgcttacctatttaacctcttcaaaaccccatcggagtccagctctacaggtttgagtttcagcattcaagcaattacaatgttagatggaaccttgctgttggaagagataatgcaagcaagacagcacttgcatgctcaatatgatgagttgttccctgctctgtgcaataattttcctgatatatttccaccagagctgtacacatgggagaaatttttatgggcttgtgaactttggtactctaatagcatgaagatcatgtattctgatggaaagctaagaacatgcttgatccctcttgctggctttctcaatcattcactatgcccacatgttatgcactatggcaaagtggatcccgcaacaaattccctgaaattttgtctatcaagaccatgcagatctggagaagaatgctgcttaagctacgggaacttctccagctctcatctaattaccttttatggtttcttaccacaaggagacaactcgtatgatgttattccgttagacattgacggttctgacgttgattctaatgaggatatacctgtgtccaactggacgactcacatgttgcaaggaagcttggaaaatgagctggaagttcttgaaaatctcaaagatatctttgatgatatgatggaaaatatgggcaagatcgatcttgacgacagagaaaactgcagttgggatgaaaaattggctatggattttaaagatctacaaagacgaattgcctgttctgtttccacttcgtgtcacacaggcatggacatgttgaagaacgaactatgcaagtgcatggctgaggacatcctaggctaa

SEQ ID NO: 148 - DNA, 783 bp, Glycine max
  Peptide Sequence Number=SeqID_91833
atggaagaagagcaagcacacataatgaaagaatcagatgatgtggaatcccaagaagaagaagaagaacgagaggaggcactctcgctttgcgatcttccacttaaccgcaattcgagaactccaagcttggacgacacgtcgtttaagaaaattctccgaccgtcctcattacccgatcacgcctgcgagattttcaacggcttcagcagcagcagcagctccgacatgtgccccgccgacgacatcattttctgcggcaaactcgttcccttcaaggccgaagagccgctgaaaaatttcatcgtcgaggaggaaaaatctccctcgcgccgccgcagatcggagtcactctcctccgtgacgcgatcgaacagtgtgagcacgtgcaccggttctcgccaactcatgatgaggaacagcaagagcttggatcatagcaggttgcgagagtcttcggcgccagaggttgatcggaattcctccaccaggagcttcgtgccggcggaggcagcggcgaagaaggcgacgaagccgcgctggtactctctgatgttcgggacgatgaagattccgccggagatggagctcagcgacatgaagaaccggcaggttcgccggaatccatccgcaacgatgtttgtcgcgacggaatccggcgggaaggttgccgtcaatcgcagccccgggaaggtgtcgtggagaatactgaaggcactgagttgcaaggatcacagcagcgtcgccgtaacgacgtcgttttcgttgccgcaagcatcgtag

SEQ ID NO: 149 - DNA, 3125 bp, Glycine max
  Peptide Sequence Number=SeqID_91834
ttaaagcaactggtccagctccactaacaagtttagctcaagctgtagttgtggctataaagaaaagaagactgaatctatcagaatatccactggattcttcgctctttgcctatgtttctccccagtctattaactccaagcttcttcacacgtctcagttcaggttcctagacaaagctgcaattataaccccacaagacggcataaacccagacgggtctgcatcagatccttggagtctttgcagcatgcaacaagtggaagagctaaaatgcttgctgagagtgatccccatttggttcgcaggaattttcttctacattgcaatagtccaacagaacacaatgctggtcttccaagcccttcaatccgacagacgcattctcagcaccaacttcaagatcctagcagcctcctacaccatcttccagatgctgagcctaaccatatggctacccatctacgaccgaatcctcgtgccgtcgctccaaagggtcaccaaaaaagagggtggcatcacagttcttcaaagaataggctttggcatgttcctctctatactatgcacaatggtgtctggtgtagtggaagaaagaagaaggacattggctttgaccaatcctattggattagagccaagaaaaggtgccatttcttcaatgtcaggtctatggttggttcctcagctaacactggcagggttatctgatgcattcgcgattgtgggacaagttgagtttttctacaaacagtttccagagaacatgaaaagccttgcagcgtctctatttttctgtggcctcgcgggatcaagttatttgagtagtttgctgatttctattatccatagggcgacagctaaatcttcaactgggaattggttacctcaggatctcaataaggggagattggattatttttattacattataactgctctagaagtcgttaatttcggttactttatattgtgtgccaagtggtataaatacaaagggactggttctagcagcagtggtgaccttcaactcgatcaacacttggaacgtatcatcatgaacacagttggagaaagaatgacaaagagagagacttcggagaatgatgaggaggaaagtttattgaagaatgagaatagcggaacagataatgaatctaagattaactacagagggtggaaggtcatgcccttcattataggaaatgagatttttgagaagctaggagccattggcactttatccaatctcttggtctatctcactactgtattcaacttggaaaacatcacggctacaaatattatcaacatctttaatggcagcaccaactttgctacattgctaggcgcttttctctctgatgcctttttcggtcgctacaagatactggcattctgcacagtggcttcctttgtgaatcgtacgattccacaaagcctcaacgagttaaaacgggagcagaatcgaaatcggagtggactcggccgagtcagtgcagactcgggcgagttaagggttcatgcttcgtgctgcctgcagttgcttaatcgtgtttcttcctcctcgcgtcgcattcgttgtcagagtgcgacggtaaagtccgatggtgaagggatcctccgcgagaccacgacggtgaagttcgagtgccactgtgccgtctgtgcgagttcaagactagcggcaattgagaagctgcatccacctcactgtgaagagtctgccatatgccagggaccaacagaggggcagatgacatttctaaagaccggtttaggtttattgatggtaggagctgcagggatccgcccatgtaacttagcatttggtgctgatcagtttaatcctaacacagattctggaaaaaaggggatcactagcttcttcaattggtactttttcactttcactgttgctcagatgatatccttaacaattattgtctatatacagtcaaatgtaagttgggcagtgggtctgggaattccttctgctttgatgtttgtatcttctataatcttcttcatgggctccaaactgtatgtgaaagttaaaccaagtggtagccctataactagtatagtgcaagttatagtggttgcaacaaagaaaaggaggctgaagcttcctgaatatcaatatccttccctcttcaactatgtagctcccaatgttcaccagatggtttatcttaacaggttccttgacaaagcagcaatcgtgactccccaagatcaaataaatcccaatggatctgttactgatccctggaatctttgcagtatgcagcaagtggaagaggttaaatgcttgttgagagtgttacccatatgggtttcaggcattttgtactttgttgttatcgtccaacaacacaccattttagtgttccaagcccttctatctgacaggcgtattgggcaaagcgagttcttgatcccaggagcatcctactacgtctttctcatgattagtgtggcaatttggttacccatgtacgaccgaaaagtcatgcctttactccaaaggctcaccggaaaagagggtggcatcacactccttcagaggatgggtattggcatatttttctctatactcagcatgctagtctctgctaaggttgaaaaacaccgtagaactctggctctgattaatcctctaggagtggaaaccagaaaaggtgcaatctcatcaatgtcaggcctgtggctgattcctcagctgtcattagctggacttgccgaagcattcatgtctgttgcccaagttgagttttactacaaacaatttcctgagaacatgagaagcattgcaggttctctttactactgtggccatgcagggtcaagttatttgagtagtgtgcttatttcagttatccaccaaatcactgccaaatctgaaactggaaattggttaccggaggatctgaacaaggggagattggataacttctattccctcattgctgctctagaaattattaatttaggctactttgtgttatgtgcaaggtggtttaggtacaaaggcacgggcagcagttccattgaactcgaaaaagctacaaaacaatcggaaagaagtgctactaattgtgttaatgattcaaatctatag

SEQ ID NO: 150 - DNA, 951 bp, Glycine max
  Peptide Sequence Number=SeqID_91835
atgactttactagaagtaattaaggatgcttcagtcaattcaaaaccacttgattcacctattgactacccaattgttctgaacccagatggtatcttgcctaatttaaagcctgaagttgaagatgaatcttcctcatccctcataaaaccccttattgggtggcaactttcacaaactgatgctgagattattgacattagcaaaaagttctttatacaactgaaggctaagctcaagaacaataatgacttgaataagggtgagtttattggtagtttgaattcctatctagaaaacatcagggacaaattaggggttgtaattgagtttgatccatcctgtagtggttataacagggctttgattgataagcttggagttttcatgggtaaagatgttgctggcctggttttggatgggagtgtttctttggagatttgggaagtggtcaaggctttgattgttaatggtattactgagcattcttgttattcaaacctgattacaaagttagtggaaaaaaagaggtctgatttgctctgtttatgcattacgcatggtttcgatcttggttcatcagaaatacttaccattttgaggtactttctttctccgtccaaagatgcttataacagtatggtaactgtgaagaaggattgggagtgccaagtgctgttggccattgagaaagcaaatgatagcaatctgaagaagtacttgcttacggcgaaggaggcttctattttgcttatgatggcatatgatggtttctctgcgtctgagatttgtttgcattatctgtttgcatcatccaacatcaatgatgtggtgttatccccttcattcaccaagtggttgaagaaatatgagaggtttcctcaagcaggaccgtgtccaaaagcctcatcagtttcagaggcttgtgaatgggttcctaaactcgaagat

SEQ ID NO: 151 - DNA, 1803 bp, Glycine max
  Peptide Sequence Number=SeqID_91836
atggagattgcttcggagagatctggtgatggatctagcggactcaaggaagaaaatagtgttggtgatgatgatggtcgtcataaacaagagattattgtcgaggaaccactcgtggctaataccgaaagatccatactagaggctggacctagcacatccccaaacaaaaaggaagacgaggttgatgatcagcttgagactgctaaagctgaaatgggtgtggtgagagaagaaaatcaacggctaaagatgtgtttgaacaaaataatgaatgaatatcggacactagagatgcaatttcaagatatactaaagcaacaagggacaaaaaagaacgttgataaaggaaaggctgatagccatgaagaaatattagaggaatcggatcttgtttccctctgccttggaagagttcctaccattaatgcaagaagtgatgagaaaatcaaagtttctaataagccattgaaggatgatgaagggtttaataacgaagagttgactcttggactagagtgcaaatttgaaacatcaaagtcaggaagcacgactgaagctttgcctaataatattccaagcccagaaaatagttgtgaagtaccaaaggaagaaggtggggagagtaaggaggcactcaagactatgagagacagtacagaggatgaagttgctcagcaaaatcctacaaagaaacctcgagtttgtgttagagcaagatgtgacactccaacaatgaatgacggatgccaatggaggaaatatggacaaaagatttcaaaggggaatccttgccctcgagcttactatcgttgcacaattgcaccgtcatgcccagttagaaaacaggtgcaaagatgtgctgatgacaagtcgattttaatcaccacctacgaagggacccacaaccactctcttccaccaacagccactgccatggcatccacaacttccgcagctgcctccatgctcttgtctggttcatcaacctctaactctaactccgcctcaataccttcagcaacccccacaaatctccacggcctcaacttctatctctctgaaggttcaaagccaagacaactatacctatccaaccctgcactatcgtcttcaccttcacatccaaccataactctagacctcactacttcacaccctgcagcatcttcctcctcatcatcaccctttttcagattcaattcaaactacaacaacaacaaccaacccagatacccttcttcctcatcaagcctaagcttcagtagtaataattcctcccaaattgccaatgctatatcttggagcaacggcttcttaaaccacaataatagggacatccttagtagtgtgaactttggaagacaacaacaaatggagaacgtgtaccaatcctacatgcaaaagaacaacagcaacaacaacaacaacaacacaagccttgttcctcaagctgatactatctctgcagcaacgaaagtgatcacagcggaccccacttttcagtcagctttggcagcagcactttcttcgtttattggtggcggtggtgttggaaacacgcgaggaagtcaaggttgtaatttcggagaaagtttgagtttgggtcagaaaatgaaatggggtgaggtgtttccagtgtcggagaaaggttgtgcatcgagcttcgtgaacaaaacgccggtagcgaatacacagacggaaagtttgatgtttctgccgccgtcgtctttgccgttttcttctaccaccaaaagtgcatctgcatctcctgctgataatagcaacaccaccatcaattga

SEQ ID NO: 152 - DNA, 1722 bp, Glycine max
  Peptide Sequence Number=SeqID_91837
atgggagtgtctttcatgaaggctcggagagcatttagggccctaaaaggcattataaggttgcaagcactcatccgtgggcacttggttaggagacaagctgttgcaacattatgctctatgtatggtattgtcaagtttcaagcacttgttcgtggaggaatagttagacattctaacgttggatctgaaatccaagagaagtgcaacatattgaaccctctggatggcaagcttgtcaagccaattgctatatccatgaaaattaccaagctgtctgcaaatgctttcattcgtaagcttcttacttcgtcaactagaataatggtgctgcggttgcaatatcttcctggtgatcttaactcactaaaatttatgggtggatatagccaccaccccccaaattactgtgtcaataatctagggcatcttctcacttcatcaaccagaataatggtgctgcagctgcaatatgttcctggtgatccaaattctgtcctaagttggttggagcgctggtcagcatctcatttttggaaaccagttccccagcctaagaaaattcgggatactaagtctcatagaaagcatggcaatatttcagttggagatactcatatgagcaagtcaaaacgaaccaacaggaagcttcctactgcaagttttgactcagtcccagtgcaagcacatcctgaatttgaaaaaccaaaacggaacatgaggaaaattccaagccaatcctcagatcctcctgtgcaggaaaatccacaaagtgagcttgaaaagattaaacgtaacctgaggaaagttcataacccagttgttgagaatgctgttccgtcagaagttgaatcggagacgccaaaggatcatttggaaaaggcaacagttacctcatgccttgctgtttcagaacaagaggtcattagttctaatgagaagatcaagaaggaagcaacattaattgtttctagtgtgccagatatagaaactactccaagactttcagttagtaaggaggtgttagactcaccaagcagttatcaagtgactgtggaatcaaaaccattgactgagattacaactaaagataaaaacattcatgtttctgatgaagtaaaaaacgagcccatagatttaccagagcctatttgtaaagatgaaaattctcacttaacaaatggagatttgagtcacaaggaagatcaaataggcagtgaaaaccagaaaccaaacggaaaagcctcaattgtagcaaagcaggaacgtgcagagaatggtatacagaatagtccagcactaccaagttacatggcagcaactgaatctgcaaaggcaaagttgaaggcacaaggatccccgagatttggacaagatggaagtgaaaaaaacaaccatactcggcgacattctctgccatcctcaactaactgcaaaattagttcgcattcacctaggacactgagacaagttcaatcaggaggcaaaggtggccacagaagtgacagaactgtatcatcttctagagatgggaatggaaaggtaattcaagcagagtggaggcgcacgtaccttggtaggcaaattgatcttagagggtttcttttagaaactaatccccaaccagggtctgatttgaaacattttgcgatgagtgttttgttgaggggaatggcgaaagacatatttcgccaagaggaacagcgaaatagaggtgtatga

SEQ ID NO: 153 - DNA, 1923 bp, Glycine max
  Peptide Sequence Number=SeqID_91838
atggaagaagcatgggtttcactgctgagcaagtgcagcagcctgaaacccacgaagcaaatccacgcccaaatctgcaaaaccggtcttcacacagaccctttggtcttcggcaagctccttctccactgcgccatcaccatctccgacgctctccactacgctctccgtctcttccaccacttccccaaccccgacaccttcatgcacaacaccctcattcgctccctctccctctcccaaacccctctttcctccctccaccccttcatccaactccgccgccaacccaccctctcccctgacagtttcactttcgccttcgccctcaaagcggtcgccaactcccgccacctcagacccggcattcagctgcattctcaagccttccgccacggcttcgatgcccatatctttgtcgggacaacgttgatcagcatgtatgcagaatgtggtgactccggttctgcgcgacgggtgttcgatgaaatgtctgaaccaaatgtggtcacgtggaatgctgttcttaccgcagctttcaggtgtggcgacgtggaaggcgcgcaggatgtgtttgggtgcatgcccgttcggaatttgacctcgtggaatggcatgcttgctggttatgccaaggcaggtgagcttggattggcaaggagagttttttatgaaatgcctctgagagatgaggtttcttggagcactatgattgttgggtttgctcataatggttgttttgacgaggcttttgggtttttcagggagttgctgcgcgaggaaattcggacaaatgaggtgagcctcaccggggtgctgtctgcttgtgcacaggctggggcgtttgagtttgggaagattttacatgggtttgtggagaaagctgggtttctttatgttggttctgtgaataatgctctcatagatacctactccaagtgtgggaatgtggctatggctaggttggtctttcagaatatgccagtggcgagaagcattgtttcttggacatcaataatagcgggacttgcgatgcatggttgtggagaagaggcaatacagctttttcatgagatggaagagtctggagttaggcctgatggtattacttttatatcactactgtatgcttgtagccatagtggcttggttgaggaagggtgtggtttattttctaagatgaagaatttgtatggtattgaacctgccattgagcattatggttgcatggttgatctgtatggtcgagctgctaggttgcagaaggcctatgagtttatatgtgaaatgccagtttctcctaatgcaatcatttggaggactctcctcggggcttgtagcattcatggtaatattgaaatggcagagcttgtgaaagcaaggcttgctgaaatggatccagacaactctggtgatcatgtactgctctcaaatgtttatgccgttgcagggaaatggaaggatgtttccagcataagaagaacgatgactgaacatagcatgaaaaaaactcctggttggagcatgattgaaattgacaaggtcatttatggttttgttgctggtgaaaagcctaatgaggttacggaggaggctcatgaaaaactgagggaaataatgttgagactcagaacagaagcaggttatgcaccacagctaaggagtgtcctgcatgatattgaagaggaagaaaaagaagattcagtttctaagcacagtgagaagcttgctgctgcttttggaatagcaaaacttcccaagggaaggattttaagaattgtgaagaacctgagggtttgtggggactgccatactgtgatgaagctgatttctaaagtttatcaagtagaaatcattgtgagagatagaagccgcttccactcgttcaaagatggattttgttcttgcagagattactggtga

SEQ ID NO: 154 - DNA, 585 bp, Glycine max
  Peptide Sequence Number=SeqID_91839
atggttaaaaccagaagtttgggtcaggctttagacaggattatagaaagagccttaggaagaaaagtcaaaggagatgtggatgaacaacggaaaattgcacatgttgctgggaatgttgagcatgtggatcattcatatgacgagatccatgaacaacctgaagaagcggctactgatgatgtagtcgctgatgtcgaggaacgtactgaactgaagttatcctcccatgaaagaaaagttgagaaatttgacaggaaatgtgactataaccctcgacgatgtgacatcgttgctacatctgctgattacaagggccttccaaagcttcgaggtttttcatgtgacgaaatcgtcttgttgttagttgaattgcttgaagttagttcagaagaaaacttacctccaccgttaatggccaaaccaaccactaccacaaccatcacttgccgacgaaccactgaaaataatgcacctcctccaaagaggacacaagaacgaacgacaaaatttcacggaacacctctcacgagaacgaaggtgaagaaaaacaatacaaggtcgcgtgcagaaggaaagcactga

SEQ ID NO: 155 - DNA, 627 bp, Glycine max
  Peptide Sequence Number=SeqID_91840
atggcggaagccactgcatcggaaccggaaatcgtcgagcccaccaccatggccgccgcagacacggctttcgacggcgttgactcaaatcagaagcgcactagagtggacagcgatgacgaagaagacggtgtttcgaagaagcggaaggtggatgaagaagaaaaggaaccttcaggtcccgtgaaattgggtttcaaaagcttcgcctcttccctggaaatgttcgattacttctacaatctccttcatgcttggcccccttttcaaaatcttaaccagtatgagcatatgatgctgctggaattgcttaagaacggccatacggaacctgatactaagattggaggaggaatctgtgtttttcaagtccgcaagcatcctatgtggaaaagtaggtgcttcttcctcgtcagggagggtgaatctgttgatgattttagcttccataaatgtgtggatcatattcttcccttgccagaagagatgcaagtgaaacctgatgctaacatggcattaggaggaggaaaaaaacattatagaggaaagagtggtggtggtggaacaagtgggcatggccatgggaaaaaaggaggatccaaacattttatgtgttttatgatctaa

SEQ ID NO: 156 - DNA, 516 bp, Glycine max
  Peptide Sequence Number=SeqID_91841
atgaaccaaatgagaggtatttctggttctggttcgagtagcagagaagcaaggagaagaaaggcgaggtcgacgtcaccagtgaaggaccgatccaaaacctcttcatctaagttaacctcttcttcttcttcatccaaacgaagcacctcaccctctgccactctcctcgacgtcgatgatgacgtcacctcactctttcacgattaccctagccctaaccctaaccctaatcctaaccctcggagcttccctcacagcgttaagcagaaatgctgggaaaaggccgacaaagtcaaaggacgcgaccccgatcgctggcgcagggacgccctcggcaacactctctttcgcaagctcgtaggttgccccggttgtctctgccatgactacgaccacattattccttactctaaggagaagaacatactctgcactttcatctgcagtgcatactttatatactacatatctccagattggtgcagaaacaactccgatagttgtccttgttga

SEQ ID NO: 157 - DNA, 153 bp, Glycine max
  Peptide Sequence Number=SeqID_91842
atggctgtttatggcgatgtgaagcggccaggaaaccagtgtcgttgcagaactattgctgaaaagcttggcaaattcaaaccaaaggatgacacagatgcattggatgaatttgaacttgcaactcccctcctctcctccctttatcactaa

SEQ ID NO: 158 - DNA, 642 bp, Glycine max
  Peptide Sequence Number=SeqID_91843
atgcctcgtcccaaaagaaaagctgccccaccaatcacttcctctgatgttgattcttctcttcgcaccgaaccaaagaaatcaactacaaagcaatttgatcgaatagataacttatttgagtcatatgcaaataagtcattgggtttaattgacccagacgggattgaagcactttgtaaagatgtgcatgtggaccacacagatgttagaatgctcatacttgcttggaaattgaaagctgaaaaacaaggttatttttccaaggatgagtggcgaaaagggctcaaatgtttaggggctgacactcttccaaaattaagaaaggctattaatggactgaagaaagagggaataatactttcagaagaaaagcaaaggagtatagatattgagaccatctgtgagctgttgaatgtcgttcttagatctgaatttcctactcaagtcaatttattaactgagtatctaaagatccagaacgattacagggcactaaacatagatcactggagaaatttttatcggttttttaaggaggtaagccttattgatcttcgaagttatgactccagtcaggcatggccagtgatcctcgacaattttgttgattggttaaaagaaaaagaagagaaaatatag

SEQ ID NO: 159 - DNA, 1020 bp, Glycine max
  Peptide Sequence Number=SeqID_91844
atgcactttgcatacaaggtaaatataaggaatgcagaagagtttataacagtgttttactcggccgagaagtcgacaatcaggggtgttacagatggtattagagcagatatctcttccggtacggactacatagttaaggatgatttaaaagaattaattgatactacctataccatcaagatgcatctacttttccgtagctcatcacttaagaactccacagttaagcttccgaaacagattgtcaaggtctcggaaagagctacctacggagggggccctacatggggtcgcacgcggcgctgttttgagttggttgcgcacgtggacagtgtggcgggagagaagatcaatgtgccgctagccaaagatgcgtcacacgtcgtgtgtgtgaacttcacatgccagggccatgcgaagggtcgctgcggcggtgttttgagttggttgcggatgtggatgactagggcagtctcgaagggaaccaaactggaaaaagaaatatacatgtatgaagaccctatagctctatccttatctaacagcaaaagcctctataagatcccatttgagaatataatgttatttctcatctgccacacagaccattggaaaaacagtggagatgttcacccaggacgtggtttcccaccaaagagggcgaccacaacaccggaagcatggcctaatcagagctccgacgcaccaaaaacagaacttgtttggttgcgcaaagaactggcatgtcggcagggtgtcggttttctaatggaggcacggtgggtggtgttggatagatcgacaatgggcgttccaaatcgtgggttcgccagtcaaaaaggtggccagatggcagcggccgacagctgtgacaggagaagttgccagaaattcaaaaacatatcatcaaagaaggagagaagtttcgtcagagcactggaatgcagaaacaaggtcgctagaagacgggcaaagcagagagatccaccagggatagtggatctctgtcaagaataa

SEQ ID NO: 160 - DNA, 2214 bp, Glycine max
  Peptide Sequence Number=SeqID_91845
atgaaaacagtgagagggaaggaagcatataaatttgcagtccccggtttcaacgccctcgttccaccgtttcgcgtttattttcctttctttcttaccataataaattctagattcccattgctcgaagaaatcgtttcatgccctcaaacacattttccacaccgatcttcttccctctgtcctcggcatttcccctatctgggtctttcagatctgatgcaaaaccgtcctaaaatggagtcttttcatcgatttagattgtgggttttcgtttttctgtgcttaatgttccaatcgggaaatgggttttacctccccggtagttaccctcacaagtacggcattggggatgagttatcggtgaaggtgaattctctgacttcaattgagacagaaatgcccttcagttattatagtttacccttctgcaagcctgagggtggtgtcaaggacagtgctgagaatctcggtgaactcctcatgggggatcggatcgagaactcgccttacaagtttaagatgtacaccaatgagtctgagatattcctgtgtcaagtggaaaagctctctgatgatgagttcaagatcttgaagaagaggattgatgagatgtatcaggttaatctcatacttgataatttgcctgccattagatttaccaagaaggtggagtactttctgaggtggaccgggtacccggttggtatcaagattcaggatgtgtattatatgtttaaccatctgaggtttaatgtccttgtccataagtatgaggagaccaatgtggcacgtgttatggggaccggtgatgcgaccgagatgatcccaacaattggtaaggagggatctgacaagcctggttacatggttgttgggtttgaggtgataccttgtagtattatgcataatgctgattctgttaaagggttgaaaatgtataacaaatacccgtcgccgatcagatgcgatccatccacggtggcgatgcctatcaaggaagggcagccacttacatttacttatgagatcacctttgaggagagtgatatcaagtggccatctagatgggatgcctacttgaagatggagggagccaaagttcattggttctctatcctcaattcgcttatggtgatcacttttcttgctggcattgttcttgttatcttcctgaggactgttaggagggatctgacccggtacgaggagcttgataaggaggcccaagcgcagatgaatgaggagttatctggttggaagcttgttgtgggggatgttttccgtgccccatcaaatcctgccttgttgtgtataatggttggtgatggagttcaaattctggggatggctgttgtgacaattttgtttgctgcacttggattcatgtcaccggcctcacgtggaacacttatcacaggtatgctgtttttctacatgatacttggtgttgctgctggttatgttgcagttcggctatggaggacaatcggctgcggtgatcagaagggatggagttccgttgcatggaaggctgcttgtttcttccctggtatcgcctttttgatcctcacaaccttgaacttcctattgtggggaagtcacagcacaggagccattccattttcactctttgttatactgattttgctttggttttgcatctctgtgccccttacccttatcggtgggctctttggagcaagggcacctcacgttgagtatccagtccggacgaatcaaatccctcgagaaattccccagcagaggtacccatcatggcttttggttctcggtgctggcaccctcccattcggtaccttgttcatcgagctcttctttattatgtctagtatttggatgggccgtgtttactatgtatttggatttctcttagttgttatgattcttcttgtggtggtctgtgctgaggtatctctagttctaacctacatgcacctctgtgtggaggactggagatggtggtggaaatcgttctttgcctctggttctgttgccatatacatctttttgtactccataaactatcttgtatttgatctcaagaatctgagtgggccagtttctgcaactctctacttggggtattccctcttcatggttctagcaatcatgttggctacaggcacagttgggttcctttcctcattctggttcgtgtattacttgttttcttcggtcaaattggattga

SEQ ID NO: 161 - DNA, 126 bp, Glycine max
  Peptide Sequence Number=SeqID_91846
atggagaaagaggaaatgacgagaaaggacacagaggttgcggtgggtggtcacagaaaagaacggtttattggaaagggtagcgcgttttcggaaggatgctggataaaattagttattcaataa

SEQ ID NO: 162 - DNA, 1423 bp, Glycine max
  Peptide Sequence Number=SeqID_91847
atgggatgcgccagttctgttggcgacttcgtgcatggcagacacgtgtcgaacggggacatgtcattgctgtcggcgctttctgccagttctgctgtgaagtcccgtcagccagtgcaagtgcagaggctacgtgcagcagctagcaccaccgattacaaagttaaatcaatcggaggtatgtgcatcttaatccaaatgtgggcatgggaacgatgcacgactttagctccaaagaggacgcctcccatcatagataataaaccactcggacacaggtggctgcgacgaggaaatcagcatattggcaatgatgatcttagagttttccgtcgcaaattggatctgatgaaacaacatgagtttgtctgggagccatacacagcaactgtgatggcagcgttgcctccaatttgtgtggttggaagtgtagcctggtttgcggtggtgccactgatttgttttcatgttttaagtggcaccaacccgatagagttttacgacaatttagattgcaacaacctattcccggctgagtttagggtcgacgtttatcctcgacaggagggcctattgggttttaactcggactacatggtgtggtataggcgtaaaacaaagatgtttgtcgacccaaaaaatgcaaacacagctgcattgggtgaagttgtggagactttacaatatatggtgtcaccacaagggaggaacacatggacagttgataatctcgtgccttacgtggataagttagcgattatatctgaagagcaagagagaatcattgagccagtgtcacatggtccagcatcagagcgtgaattcccagcacaagagtttcacattcttcagtcaagtgttgaaactcggggcattggcagacgaagggagcctatgtatcagtatccttttgcaagtcatcatactgatacttttgagacctcacattcgttcggtggtgttgcggaaacacagcctcatttttcatggtctactatgactccttcacagagttttctgcagagactgagcaagcaaaagcggggagacaacgcggcgacagaagaaatcctgatcgtcaagcgcgaagatgggatcgaccatgtggcacatcctcacgacatcacggacaccataatgactgattttcatgtatttgtgttaaggttaggtttaggggttaggttttatggaatagggttaggttttatggaatatggggttaggttatatgtattagggttaggtttaggggttaggttatatggattagggttaggtttaggggttaggttatatggattagggttaggttttatggagtatggtaaggttttagggttaggttggatgggattaggggttgagattatgggattaggatttgggttagggttagagattaggggtttagggattaggg

SEQ ID NO: 163 - DNA, 162 bp, Glycine max
  Peptide Sequence Number=SeqID_91848
atggaagttgaagctgcatgcaacacagcattggtttcgatagaaggggcaagaatcgctaaagaaaggttcttggaggtgttcttgaaggagttctttgatggctgcagtatctgggtcaattcctgcaaatctaccagttctcacaggaaagaactatga

SEQ ID NO: 164 - DNA, 531 bp, Glycine max
  Peptide Sequence Number=SeqID_91849
atgaagtcccaaccatcacgcacgtgcatgtgctcacccacgaatcaccctggctcgttccggtgtagcatgcacaagaagccacccctagcggcggcggtaccctccaaatgggaatcatcacctatggctgccaaagccaattcattgaaggccactctcttgcaaatgattaagccctctagccatgatcatcacaagagaaagactttccaaccaaagcctacccgcttttctttgatgaacaacggtaacgctgctgttgttgccgcggaaaacgccattgccactggcggcaaggctcaacccgccattgccagtggcggcaaagcaggagagaggggtgcttgccgccagaagggctggcgggattggcagtgcagtgggtctcgcccagggtgctggcgagacagccatgtcagtgcaggactcgcccaaggtgctggcgagacagccatgtcacgtgaacttttcaggcttgcagggcttgtttctgctctccattgtatagggatgcagcatagggtttag

SEQ ID NO: 165 - DNA, 930 bp, Glycine max
  Peptide Sequence Number=SeqID_91850
atgaccaaggagaaagagaataaggatgtgtggcttgagacaaaggatgaagggagcaaccttcacgggtggattgggaaaagtggtgttaattcattaaggataataaggctcgccgccgcaacgcctccaccactgccaccaccaccaccgcccccgctggcaccgctgctctcctccgtcagctggatcgcggcggcgaagatccctcttccaaggcccatcgcatcggcctctcctcgtaaaaccctaaccgcactctccctcctctcttccccaatggaggtcgaagtcaagctgcgtctcgccgacgccaacgcccaccgccacgtcaccactctactctccccctttcacgtcatcacccaccgccagcagaacctcttcttcgacggcgccgcctccgagctctccgcgcgccgcgccgtcctccgcctccgcttctacggcgacgacgagcgctgcgtcgcttcgctgaaggcgcgggcggtgctggtggacggcgtgagccgcgtggaggaggacgaggaggatctggacccaagcatcgggcgcgaatgcgtggcggagccggcgaagttggggtcggtggagtctagggttttgaagagggtgcaagaggaatttggaactgaaaaaggattggtggggttgggagggtttgggaatttgaggagtgtgtatgattggaagggtttgaaattggaggtggatgaaaccagttttgattttggaacactctatgagatcgaatgcgagagttctgatcctgaaagagctaaacgcctccttgaggagttcttgaaggagaatgaaatcaattattcttactccactgcctccaaattcgccatctttcgatctgggaaactgccttaccattgtagacaggttcccaccgtcttcgcatcacttcactacgagttgtga

SEQ ID NO: 166 - DNA, 117 bp, Glycine max
  Peptide Sequence Number=SeqID_91851
atggaggaggaaccttttgatggtgttttactgtcctcgatggagtttctcaagatacagtggtgcaacgttgctactgctagagcaaaagtgatgagagagataaatcttatttaa

SEQ ID NO: 167 - DNA, 1173 bp, Glycine max
  Peptide Sequence Number=SeqID_91852
atggaagaagaagagagtgaaaaatccccacaattggtgcgagtccttgaagctctgaaagaagccacccacgacatccaacgacaccactcctcggattccccagccataaaggcactcctggaactccactccattctctcctcctcggacccctacctctccgctctctccgaccacctcatccgcctcaaaaccctcgtccactctctcaaccactccaatggccttctatccttcctcactcgccccctctccactctctccctctcacgcctcgcctcccaaatcgagtccgaaatccaatcctggatcgaccgcgaaactctccacaccctctcctcttctctacgaaaccctaacaataaccacgaatttgtctccttgttgactcagtccatttaccgtgtctcgcagggcttcaatcgcgagttgcaggacctggttctcaaactaaagctcttctcatcgctggagtcggttctgttcgacgataagtgttcgatcccggttcgggaacaggccggtctggctgtctccgcgttaatccggttcaataaagacgtgttcgtgggccaggttctgatgggccccaccgtccgggctttggtctcgatgggctctgttctgtcccttgaggtgctgtgttcactcatcaggtccattaggtctcctctggtggacgagatcgagagcaacggtgagattccgaatattatcgcgatgttgaattcggaggatctggaactgcgtgttgttgcgttggggtgcgcgctggagatagggtacttcgggcggaaggaagcggtggaggcgatgatgaaggaggggttggtggagaagctggtggagttgcagaggtcggagaaaggtggggatttgattgagattggaagggaaaaggttagtggggttttggagagaaaaccttttgcgagctgcgtggcgaggtttgcggtgcagttggaagttggggaagggttgcggcagagagaaaagagggcttttaaacctgagattttgatcagagttagagacgcctctgtttctgaagccgaagctgccaccattgctgctgagatactactagatagagggaatagagattatgaggaaaattatatggatgcggaatatgctgaggagaagtcggctgaggaatcaagattctga

SEQ ID NO: 168 - DNA, 774 bp, Glycine max
  Peptide Sequence Number=SeqID_91853
atggtgaaaagattcaaggtgtgggtttaccaagaaggggaacaaccattagtacatgatggtccagtaaacaacatatatgcgattgaaggtcaatttatggacgaaatagacaataatgataagtggagccaattcagggcaagacatcctgaggaggcacatgtgtttttccttccattcagcattgccaatgtggttcactatgtctacaagcctatcctaaagcaatctgactacgaacctgtccgtttgcaactcttggttgaagactatattagtgttattgaagataaatatccttactggaatagaagcaaaggtgcagaccattttttgctttcgtgtcatgattgggctccaaaagtttccaatggcaatcctgaactttttcaaagtttcattagggcactttgcaatgctaacacttcagaagggtttcatccaaatagagatgtgtccatccctgaagtgtacttgcctgttggaaagctaggtccgccgagcctaggccagcacccaaacagccgcactatattggcttttttcgcaggaggggtccatggagaaattagaaaaatacttttaaaacattggaaggacaaagataatgaagtgcgagttcatgaatatcttccaaaaagtcaaaattacacaaaattaatgggacaaagcaagttttgcttgtgccctagtgggcatgaagttgcaagtcccagagtggttgaagcaattcatgctggtaattatctaaccagaacagaaataccttga

SEQ ID NO: 169 - DNA, 465 bp, Glycine max
  Peptide Sequence Number=SeqID_91854
atggggatattgtatggaatggtggcaaggggccaggtgattctggctgagttcagcgccacccagagtaatgctagtgtcgtagccaagcagatactcagcaagatcaatcaagggagtgatgataccaataacgatagcaatgtttccttttcccatgatcgctatgtttttcatgtcaagaggacagatggcctcacggttctttgcatggctgatgatgcatttggaagaatgatcccttttgcatttcttgaagatattcataaaaaatttgtgaagacgtatggccgtgctattctttcagctcctgcttatgccatgaatgatgagttctcaagggtcttgaaccaacagatggagtattactccaatgacccaaatgctgacagattaaaccgtctcaaaggtgaaatgactcaggcaagttcaaaatatacacatttagatttgtctacactctga

SEQ ID NO: 170 - DNA, 927 bp, Glycine max
  Peptide Sequence Number=SeqID_91855
atgtcagatgcacaacgcaacaacgatccaatcatgtttgacacacagcccagcagtgagatagtcatgcctgagacacagcccagcaatgaaactctcgtacatgaagcacagaacatcaatgatgtggtcatgtctgaagcattgcctgaaaatgagttggtaaattctacagcagatcccaacaatcatctctctcatccagaatctttttctcatgatcatcagtatactaatttacacatgattcctgaacttgaatcgctgcccaactctgatccattgcctagttctgaaccaatgcaagacattcatctcacagacatcaaaccgttacctcataatcatctggcccagtatgatacacttcccaacaatcatcatatggaccattctgaggcggtgtccaaccatcaactaactcactttgagacactatccaatgaacagctagccaattctcatttgttgcctgactacgacgggctacaaaatagtgaaacactacacgaccatccgatagttaattctcaaccactctatgagatagtcaatgctagcaacatacccaactatgggataggtcaggttcggataagacatgccttgcattggggcaaggtatgtgcattgaatcacgagttatcgaaagaacagcttggcaaactggaaagtaccccatttagtttaatgctgactaggatggacaataaaaacatccgtgtcagcaatttattgttgttcgagcttctggaagccagaaagtcagtcgtttcaaattcaagacacgttgatcattttctgttaaagaaatcacacttatacttggcttgccaagtacaggccagagacaatgaaattcctccgggtgttgcaatggttggaaaagacctactttacggacaaggacttgaagtcaaaatttaa

SEQ ID NO: 171 - DNA, 3750 bp, Glycine max
  Peptide Sequence Number=SeqID_91856
atgattccatctcatctcgtgctatttaaactgtctgatgataccattatttcgtcgctcacaacaattcttctcttctctctctatctccgttttctctttctccttcttgttcttcttcttcaaatccctagcccccttttgttgtataaatactcagccagaagagctctaacacaagaaaaagctagagagagaaagtggagcgagaaaaatactgaaaccctccctcgccattcttgttctgctccgtccctctcgatctgcgtcagggattctctggcaggtattgttgatctgttcggttctagatcttttcgtgcggcttttgttgacggcaccgtcatgtcttccctcagcagagagcttgtttttctcatacttcagtttctcgatgaagagaaatttaaggagactgttcacaagttggagcaagaatcgggatttttctttaacatgaggtattttgaggatatggtgacgaatggggagtgggatgaggtggagaagtacttgtctggttttacgaaggtggatgacaatagatactccatgaagatcttctttgagatacgcaagcagaagtacttagaagcattggacaagcaagatcgagcaaaagcggtggatattttagtgaaggatttgaaagtatttgctgcatttaatgaagaactttttaaggaaatcacacagttgttgactttggacaactttagacataatgaacagctatccaagtatggagatacaaaatctgcacgaggcataatgctggctgaactgaagaaattgatagaagctaaccctctgtttcgcgacaagcttcaatttcctactttaaagaactccagattgcggactctaattaatcagagtttaaattggcaacatcaactttgtaagaacccaaggcccaaccctgacataaagaccctttttgtggaccatagttgtgggcaagtgcaaccaaatggtgcacgagccccttctcccgttaccaatcccttaatgggtgctgtcccaaaggctggaggtttcccaccacttggtgctcatggtccatttcagcccacaccagctgctcttccgacatcccttgctggatggatggctaacccatctcctgttccacacccttcggcttctgccggacccataggtttggcagcagctaataatgcagctattttaaagcgccccagaacccctccttccaataacccagctatggactatcaaactgctgattcagatcatgtattgaagagaacaagaccttttggattatcagatgaagtcagtaatctaccagtaaatttgcttcccgttgcttactctggccagagccatggtcagagctcctattcctctgatgacttgcccaagactgttgtgatgactctcaaccaaggttcaattgtcaaaagcatggatttccatccactgcagcaaattctacttcttgttggaacaaacatgggcgatgtcatggtgtgggatataggcagccgtgaaaggattgcacaaagaaattttaaagtctgggaacttggagcatgctctgtggcgttacaagcatctctttccaatgattactcagcatcaatcaatcgggtggtgtggagtcctgatggaacactttgcagtgttgcttattctaaacatattgttcacatatattcctatcatggtggggatgatcttagaaaccacctagagattgaagctcatgctgggagtgtcaatgatcttgccttttcatatccaaacaaacagctttgtgttgtgacctgtggagaggatagggtcatcaaggtatgggatgcagttactggtgcaaagcagtatacttttgagggtcatgaagcacctgtatattctgtatgccctcatcacaaagaaagtattcagttcatcttctcaaccgcaactgatggaaaaataaaagcatggttgtatgataacatgggttctagggttgactatgatgcacctggtcattcttctactacaatggcatatagtgctgatggaacaagattgttctcgtgtggaacgaataaagaaggggaatcatttctagtagaatggaatgaaagtgaaggagctgtgaagcgtacttatcatggtcttgggaagagatctgtaggtgttgttcaatttgataccaccaaaaataggttcttagctgctggtgacgagtttacaatcaaattctgggacatggataacacaaacatgctgacaagtgttgaggcagaaggtggattactggcttcaccctgtattagatttaacaaggatggaatactgttggctgtctccacaaatgacaatggagttaaaattctagctaacgcagaaggaattaggctgcttcgaacggtggaaaatcgtacatttgatgcttctagagttgcttctgcagctgttgtgaaggcacctactattggagcttttccttctaccaatgtaactgttggaacaagccttgctgatagagctcctccagtagcagccatggttgggattaataatgatactcggaatttagctgatgtgaaacccagaattgttgatgaatctgtggaaaaatctaggatatggaagctgacagaaattaatgaaccatcacaatgccgctccctgaaacttcctgatagtttatcatctatgagggtttctaggttaatttatacaaatcagggggttgcgattttggctttggcagcaaatgctgttcacaagctttggaaatggcagagaaatgagcggaacactactgggaaggccactgcaagtattcaaccacaactatggcaaccatctagtggaatactgatgactaatgatataagtgatactaacccagaggatgctgtgtcatgttttgcactgtcaaagaatgactcatatgttatgtctgcttcaggggggaaaatttctctattcaatatgatgacatttaagacaatgacaactttcatgccacctccaccagctgcgacatttcttgcatttcatcctcaagacaataatattattgctattggcatggaggactcttccatacaaatctataatgttagagtggacgaggtcaaaaccaagctaaaaggtcatcagaagagaattactggtcttgccttttctcatgttctaaatgtgcttgtctcatctggagctgactctcagttgtgtgtttggagcacagatggatgggaaaagcaagcaagtaaattcctacaaatgcccagtggacgaccgcctgcacctcttgcagatactcgggtccaatttcatctagaccagacacatttactggctgttcatgaaactcaaatagccttatatgaggcaccaaagttggaatgtataaagcagttttcacctcgggaagccaatccaatcacacatgctacatactcatgtgatagtcagtcaatatatgtaagctttgaagatggaagtattggcattcttactgtccctgcgctcagattaagatgtagaataaatcaatctgcttatctccatcccaacccaagcttgagagtgcatcctcttgtgattgctgcacatccctccgaacccaatcaatttgcattaggactcaccgatggtggagtacatgtacttgaaccactagaggcagaaggaaaatggggtactccacctccgaacgagaatggtgccgggcctagcactgcttcaggtgctgctgtttcagagcaaccccaaagatga

SEQ ID NO: 172 - DNA, 1182 bp, Glycine max
  Peptide Sequence Number=SeqID_91857
atggcatgtctgaggaggaagaagcactgcgtccaaggccaacaacgcgtttcattttcaaattttgatcatcctcgccagtcaaatatgtacttgattcttcgcttcttctgccccttctctatactcttcttcactccaatagcttctgtgcaagcgttcaccggaacatatggtataaattatggtaggattgcaaataatattccttcacccgatgaagttgttactcttctcagagcagaaaaaataaggaacgttagaatctacgatgctgatcacagtgttctcaaggcatttagtggaactgggcttgaaattgtagtggggctccccaacgggcagctgcaagacatgagttcgaatccagaccatgctttgaactgggtaaaagaaaatgtacagtcatttcttcctgatacacgcattcgtggaattgctgtaggcaatgaagttttgggtggcggtgactattctttgtggggagttcttctgggcgctgttaaaaatatttacaatgctaccgtgaaacttcatctagatcaactggttcagatttctactgcaaactcgtttgcagttttttcgcagtcctaccctccctcctctggtaaatttgatgataatgttaatcagtttatgaagccactactggagttcttccagcagattggctctcctttctgtgtgaatgcttaccctttcctagtctatgcgagtgatcctgaacatattgatataaattatgcactttttgaacctacaaagggaatttatgatccaacgtatcgtctgcattatgataacatgctcgatgctcagattgatgctgcctatgctgctttggaggatgctggatttgacaaaatggaagtcataattactgagactggctgggcctctaatggagatcaaactgaagctggagcaaatgcaactaatgcaaggacatataattataacctgcgtagaaggcttgcgaagaggaaaggaaccccacatagacctaaaaatgttgtgaaggcatacatttttgcattattcaacgagaacgagaagcctgggcattcatctgagaagaactatggactgttcaaggctgatggaagtatatcatatgacattggttttcatggacttaatgctggacattcatctctgttatctcttaaggtaccataa

SEQ ID NO: 173 - DNA, 543 bp, Glycine max
  Peptide Sequence Number=SeqID_91858
atgaacagtggttgttttggatgctgtgtgaaacccacaccaattattgccgtggatgagccagcaaagggactaagaattcaggggcagacagtaagaaaaccacacatatcagatggtttctggagttcaagcacttgtgatctggataacagcaacattcaatctcagagaagtatctcgtctgtcagtacatcaaatcaaattctctatcatagcggtggaacttctaccccaggggccaatcctgaatttgtaaacccaggcaagttctatattggccttcttctctggaatgagagcaggcttcagtgggttggaagtggcaaatctaggaagcatggccaacaaaaaagagaacccagactaaattggaatgcaacttatgaaagtttgcttggaactagacaacctttccccaagcccatacctttatctaagttgttactttttaaggctgtaactatgcatttatatgagtcaggtccttgtctggactgtcacttcctcggatctctccatgatgtggctggaggtagttag

SEQ ID NO: 174 - DNA, 402 bp, Glycine max
  Peptide Sequence Number=SeqID_91859
atggcgagcagtcttctgtccgtacaccactttcttccctcccaaacttggaaggaaggtgagatttacaaatttcctaatggctcaaaattgtactatcagaccactagagtgacatttgtctttgatgatgaggctctggaggtaaagataggtgaacagctccaggaatcgggtgagaatgcttttgtgggaggaaaaaaatgctggaagtactcaacatttgttaattgggaattctggtggccaaacttccctatcttggtttacttcaaggagacacaaacaaagcctgagggacaaattcattgctttcccataatatttaatgggaagcagctttatgacgttatggtggaaagagctggcccttcaaaaactagtggaccaaaagaatcctga

SEQ ID NO: 175 - DNA, 456 bp, Glycine max
  Peptide Sequence Number=SeqID_91860
atggatatcattgatataactatcaccttcctgttgcttatgtctgcaggcacaagagttgaaacgcagccaccaaagcagcagcagatacaagccggtgcttcacttctcccaaatattactcctgcatggtggccttcccattctggacaaattgcattggggtcttatacgcacggggcaaggcaatggcgagatgatcctccggtcacctcaaatgcaaagctacaaccaaccatggatgataaactggtactaatagatggccaaggagaaaagaaggttattgctcgtaatgctagtgcaaaagcttcctttgcatccatgcatgattctggaaactttgtcctgtacaacaataattcaagcatcatatggcagagttttgattacccaactgatactttgttagggagtcaatctcttcctaatggaaatcaactggcctctagttga

SEQ ID NO: 176 - DNA, 582 bp, Glycine max
  Peptide Sequence Number=SeqID_91861
atggtattgagcgcagcaccagtgaaaaaaatcgctaaagtgtataaaaagtcatcagttcatgtctcggctacatgcacatatagtccttatctggttgcaccgagaattgatggaaccaaaaattcttataattcaaaaattcaagtgtggatattgatcaggaaaatgagctggtctggaggagattggatgtgtggtgtttgcgagcatataaatttcaagaagagggaagcatgccagagttgtggataccccaagtatgggggtcctgacccttcaacctacagatacaacaggactgaagctttagcaggggactggttttgcaactgtggagctcacaacttcgcaagtcgatcaaactgcttcagatgtggctcaatgaaagatgattactcttcaggatatggcaacaactctggaggatatggatctgacactttccccccaggatggaagactggagactggctttgcccaaggtctttttcacattatcatcatattttcagtactcataatagtgtctctattttatcctacattatcatcacattttcagctgcttcagttcaataa

SEQ ID NO: 177 - DNA, 837 bp, Glycine max
  Peptide Sequence Number=SeqID_91862
atgatatcagagctagctatgaatggacatgcagagagggctcttggccttttcaaagaaatgatcaatgaggggttccagcccgacgatatcacgtttgttggagtattgtctgcttgtactcaagctggtttggtggatcttggacacagatatttcagttcaatgaacaaggattacgggatatcaccaaaattgcaacactatggttgcatgatagatcttctggctagaagtggaaagtttgatgaagcaaaggttttgatgggaaatatggaaatggagccggatggagctatttggggttctctgcttaatgctcgtagggttcatggacaggttgaattcggtgaatatgttgcagaacgtctctttgaattggagccagaaaattccggggctttcgtgcttttgtcaaacatatatgcaggagctggcagatgggatgatattgatggtattgtgcatgagttccttgttggtgataagttccacccgcagagtgaaaatatttttagattgctggatgaggtagataggcttttggaggagactgggtttgtgcctgatacttctgaggtactctatgatatggatgaggagtggaaggaaggggctttgaatcaacacagcgagaagttggctattgctttcggtttgataagcacaaagccggggactacaattaggatcgtgaagaatcttcgtgtttgtccaaattgccattcggctactaagttaatatccaagatcttcaatagggaaataattgcaagagatagaaaccgttttcaccatttcaaagacgggttttgctcatgcaatgactgctggtga

SEQ ID NO: 178 - DNA, 1215 bp, Glycine max
  Peptide Sequence Number=SeqID_91863
atgaaattcaagaaagggaataaggtggaagtgttaagcaaagttgaggtgccttgtggctcctggctatgtgcagagatcatttgcagtaatggccaccactatactgtgaaatatgatggatatgaaagtgacgctggtgaggcaattgttgagcgggtgtccaggaaagacttaaggccatgtccacctgcacttgaactcacagataattggagtccaggtgatgtggtagagatcttccagaacttctcatggaagatggctacagttttgaagatattggggaaaaaccacattttggtcaggctacttggatcttctttggaatttcaagtgagcaaatttgacattcgggtgagacagtcttggcaagatgacaagtggattatagttggaaagggttcttccagctgtgagaacagaaaacgttctagcacccaacttcagaagacatctacaaagacaaaactatcaggttctgcttactatcgtcctgaaaagaaaaaactgagtattctggaatcagaactcatttattttaaaacattgaaacgaggaagcaattcacaagttgaggcatatgctgagcctcccccaaagtttagagcacttgaaaatgaaggcagatgtcacagagcaagagttagaaatccacccacaccactcaaacaggtacagggtgtcagttttccaagagatgtgattgctgaagaatgtatacctgcttctgtaaacaacagaaaaactgggatttctaatatgattgacatggagaggaggaaagagactggcactgtgggttgttcatttggagaaaacagagaatcaaatcatgctgatagtattacatgctcagttggtagttgtagtatcactagcaggaattcctgtaaactgcaatttcctgtatctgcaggtccttttgatgatgtagacagttcatttagtgatgctgagtctgtctgccagaggagtgatgaggaaggggattgttcccctcctacacaagaggaattggcagcagaaattcataggttagagttgcatgcctatcgttgtacaattgaggcattgcatgcatcaggccccttaagttgggaacaggaagcattaatgacaaacctccgtctttcgctccacatatcaaacgatgaacacttaatggagctaagaaatttgatttcttctgaaaacagcattcctttaagatga

SEQ ID NO: 179 - DNA, 332 bp, Glycine max
  Peptide Sequence Number=SeqID_91864
ttcgatccccatccgagtcgccggaatccaaccgtgcgccacctccggccaccgcaggaccgatcccgatcgccggagagcctcctccaccagctgccggaaccggttacggcggcgacggagtcgaaagcgccgagaccgcgcttcgccggttgcttcacggaggagaaggcgaagcagctccggatgatgaccagcaagtcttttcacgacaccatgtatcactccgcgatcgcttctcgactggcctcagacttcaaggctcgctccgatccgtaacacttgaacagtttactaattcttctttggtgtattttgcggattgtttgtag

SEQ ID NO: 180 - DNA, 69 bp, Glycine max
  Peptide Sequence Number=SeqID_91865
atggaggaaagactttgggatcgaacatcattgggatggaatgaagttgaagcaattcgcaaacaatag

SEQ ID NO: 181 - DNA, 1419 bp, Glycine max
  Peptide Sequence Number=SeqID_91866
atggccgcttcttcttcctctcccgacgagccttctcgctccgtcttcctcggcgtcgacgtcggcaccggcagcgctcgtgcaggtctatttgacgaggaaggaaagcttcttggttcatctagcagctcaatacaaatatggaaagacggtgcctgtgttgagcaatcctctacagatatatggcttgcagtttgtgcagctgtaaaagcagcttgctctaaagctgaagttgcaccaacagaagtaaagggtatgggatttgctgctacttgttctcttgttgctgtggattccgacagctcacctgtttcagtttcttggagtggtgattcaagaagaaatgtgattgtatggatggatcatagagctgtagaacaagccgaaaggatcaattcctctaaatcacctgtattggagtactgtggtggagctgtttcacctgaaatggagccaccaaagcttctatgggttaaagaaaatttgcaagaatcttggtcaatggttttcaggtggatggacttaagcgattggttgtcatacagggcaaccggtgatgatactcgcagtctatgcaccacagtttgtaaatggacatatctgggtcatgcacacatgcagcatgtcaatgataaagagtctcgagacatggaagcttgtggatgggatgatgatttttgggaggaaattggtttgggtgatcttattgaaggacatcatgcgaagataggtattcatcttattaacattggccttgaactgggtctggtaccaggaattcctgttgggacatcattaattgatgctcatgctggtggcgtgggggtaattgaaagtgtgccaccatcagaagctgaagaacatgacatggaagcaatttgcaaccgtatggtgttagtttgtggaacttctacatgccatatggctgtatcgcggagcaaattgttcatacctggggtttggggtccattttggtcagcaatggtaccagaatattggctaacggaaggtgggcagagtgctactggtgcattattggatcatataattgaaaaccatgctgcttctgcacgccttgcaaatcaagctgctacccaaaagatttcattgtttgagcttctgaacaagatgttggaaacaatgatagttgagctgaacctatcctttattgctgccttgactgaagatgtacatgttcttcctgacttccatgggaataggtcacccattgcagatccaaaagcaaaaggagtcatctatggtttgacacttgacacaagtgacaaacagttggctcttctttacctggctactgtgcagggcattgcatatggcacacgtcacattgtagagcattgcaatgctcatggtcacaaagtaaggatctgccagaagtatgttgcacactggttgtactga

SEQ ID NO: 182 - DNA, 162 bp, Glycine max
  Peptide Sequence Number=SeqID_91867
atgagggggtttaacctctcattgtcatgggagactttgcacttgctaggattgatcgggagagaagaagaacaatacagatggagatggaggaaagaaatgtctccaaaaggtgaaatcagcttaaaatttacacatgtgaccattgactcactcacttag

SEQ ID NO: 183 - DNA, 207 bp, Glycine max
  Peptide Sequence Number=SeqID_91868
atgctcgtcaggggggcggagctatggaaaaacgccagcaacgcggcctttttacggttcctggccttttgctggccttttgctcacatgttctttcctgcgttatcccctgattctgtggataaccgtattaccgcctttgactggcacgacaggtttcccgactggaaagcgggcagtgagcgcaacgcaattaatgtgagttag

SEQ ID NO: 184 - DNA, 291 bp, Glycine max
  Peptide Sequence Number=SeqID_91869
atgtggtggagtggattcatgaaacgctcatatgataaaggaattacctggacagaaagagaacaacttcctcctggtatattaggacctatcaagaataagcctctcttgctggaaaatggtgacatactttgtggatcttctgttgaaagctggaaatcctggggagcatgggcagaggttacaacagattttagcgggacatggagaaagtatggcccaatttacattgagaataggccccttggtgtgattcaaccagtaccataccacactgcgtgttttgcttag

SEQ ID NO: 185 - DNA, 1059 bp, Glycine max
  Peptide Sequence Number=SeqID_91870
atggctagcaattgttcaatagaaggaccactagtggaggagttcacttaccaagcaggatcagctcccttcaagagttgtcatgcttctaccattgttgaggttgataaggatcattttttggttgcctattttgggggtacattcgagggggcacctgatgtgaaaatatgggtgcagacttacaagaatggaagatggcaagcacctgtaattgctgatgaagaaccaaatgttcctatgtggaaccctgcactgttcaaacttccatcagatgagctacttctgttctataaaataggccaagaagttcaaaagtggagtggattcatgaaacgctcatatgataaaggcaaaacttggacaggaagagaacagcttcctcctggtatattaggacctataaagaataagcccattttgctagaaaatggtaatttactatgtggatcatccgttgaaagctggaactcttggggtgcctgggtggaggtaacaacagattttggtaggtcatggagcaagtatggcccaatttacattgaaaataaacctctgagtgtgattcaaccagtaccttatcagactgcagatgggaaactacgtgttttgctacgatcctttgatggcattggtagagtatgtatgtcagaatcatctgatggtggcaagacctggggatatgcaaaacctactcagctccctaacccaaattcaggtattgatggggttaagcttagagatggccggttattgcttgcttataatactgtatcaaggagtgtgcttaaagtggcactctctaaggatgatggtgattcctggtgtgaggttctcacattagaggatacatcgggaatggaattctcatatcctgctgtaatccaggatagtgatgggcgaatacatatcacctatacatataataggacacaaattaagtctcttcattgcaacactgcttattctgatttccagcttattatgtctagatgtagattgtatctcagctatattccaaactcattatttggcaagagcgtccagatcgtatactaa

SEQ ID NO: 186 - DNA, 777 bp, Glycine max
  Peptide Sequence Number=SeqID_91871
atggttgacacgtacgtattaaagagaaaatggaatcatctgaactccaaaattgaggagcttgaggcatctctcaagtctttctcagacaattgcgcctccgaaagacaaggccgaattagagctcaacaggccttgagaaaagaagtaacacagtcgcaacctaattctcaaaagcttaacctcacttcttatcccatgatgccaattggtgtcgtccactcgtgcttctccaccaggaacgggacgccgaggcaaccgttactcgtcccacttgctagggcgtgtttggttttcaacacaactcgcgttccaccggcgtctctggagggtttggaggaatattctcattgctggattctctatgtgtttcatttaaatacggatctcgataagctctggaagcacccgtctaaatcagggttcaaggccaaggtgagggttccaagactgaagggtggaagaaagggagtgtttgccacacgatccccacatcgtccatgccccattggcctcacagttgcaaaggtagaggctgtacagggaaatatgattttgctctctggtgtggatctggttgatggaactcctgtgctcgatatcaagccttacctaccatattgtgacaacatccaagaagctacagtaccaaattggttgatggaggataacttgctttctgtagcttctgttagcttttcggagcacttcacttcagcactcaaaaatatctggataatggtgaatggatgcaccccatcagtcctcactgtataa

SEQ ID NO: 187 - DNA, 156 bp, Glycine max
  Peptide Sequence Number=SeqID_91872
atggaagagcgtggggtggcgtttttgtctgcgagaaaactaaactatgacactggcgtggataagaacccaacccaaccgataactgtggttgaatgctccactggaaaagtggatagaaatcacggatatcatggacaggtggtggagggataa

SEQ ID NO: 188 - DNA, 1542 bp, Glycine max
  Peptide Sequence Number=SeqID_91873
atgggtcataggccaccagaacagccaccatattttctctcagagccaaacccaccattcccacccactactactgttcgatctgatagtttcagtttgaacgatagggccttgaaggttagtccaagcatccttctgatcatcataattctggctattgttttcttcatttctggtttgctgcaccttcttgttagattcctgtggagaccccaaactagagagcctgatgaattggacaatgtcaccgctctccaaggccaattgcagcaactctttcacctccatgatgctggggttgaccagtccttcattgacacactccctgtgttcctctacaaggccatcatagggctcaagaagtacccttttgactgtgccgtttgtttgtgtgagtttgagcctgaggacaagctaaggttgctaccaaaatgtagccacgcttttcacatggagtgtattgacacctggctcttgtctcactctacttgtcctctttgtagagccagcttgctccctgatcaattctctgcaaccaacgcatgttctcctattgttcttgtccttgaatctgggagtagtgagagctccagggaaatcgttcccgaaagagtgggtgcttctgctgctgttggaaggactagttcggttatgaccacagattctcgccttggttgccgtggagatagtgaatttggatcgacccgtgtggatttgatgaaatcaggtgagttgttaagtgaaattcctgatccaacagtgcctaatggtgtggaaaaagttgttactgtgaagctggggaagtttagaagtgtggatggtggaggtgaaggtggggaagggagtagtagtagtactagtaccaacaacgtggatgctagaaggtgtttctctatggggtcttttgcttatgtcatggatgagagttcttcattgcaagtacctataagaactccaatcaagaagcaatcaagtaagaagaagtctggtttgcctttgacaccagggcacaggcctgcaatgtcagaatgtgactgtgaatccagaagggatttcaagtttgcagggtttgatgcaacaactattatagttgaggatgatgctgctactagtactggggctacaacttcaagcacaacttgtaatgggaacagtgctgctgccattggaaggagcagaaaggagagcttttctatatcaaagatttggcttagggggaagaaggataagccaaattctgtggcggattcgtctagaagggctgtttcgtttcgattcccggcgaagtcgagtgttgttactgctgcttctggtagtgctcatgatgatgatgatgatgacttgaagggcaagaattgcaagtttgatacaaggagtactatttctgagatggatattgggaagtgggaaaatggaggagggagtgagttcgattatgatgacgaaaaccagagttgttatagtctagattcttctcaagctagggcgccatcttttgctagaaggactttgctttggctcacaggaggaagacagaataag

SEQ ID NO: 189 - DNA, 777 bp, Glycine max
  Peptide Sequence Number=SeqID_91874
atggcggaactgaacactctggtggtgcgaaagccatgttttggccttccaaccgatcaaattccttactttgaggttggtgactctgtggcttataataatgagaaggaggggatcattgagtgcttgaagaaagatgttggggttgttgatttggatagtggggtttcttcactccctgagtggatttcaaccaaagcaattctcaccacttggcttgctgatgcacttgcctatgaactctggctggggtgtgaaggttcctctgcttatagcatctattactctgatcttccttggccattggggaagattctgtcttggaagaaagctatttgggtaaagctgaaacatgggataactaatgacaatgctgaagtgaaaaaagaagagatttatgagagagcaaagtctgcatatgaggcgctgtcaagttgcttaggtgaacagaattacttatttgagaacaggccatcaagcttggatgctatttttcttgcacatggactagttgttcttcatgctttacctgaatcttcaatgttgcggatcaagttttcagagcatgctaatttagttagatatgtgcaacaatgtaagacagaacttatagatgcagctccatctccttcctctgccccacaatttcatactgatgcaacatcatctgcttctaaaagtcattcaattgttgtgttcctcacacttatgacttcatttgatgatgctgaagtggagttagatgatgatgatggtagttatgattacgatgaatga

SEQ ID NO: 190 - DNA, 939 bp, Glycine max
  Peptide Sequence Number=SeqID_91875
atggcgtcgagaccagaggtgattgcgccgcctgagattttctacgacgatgccgaagctcgcaagtacacctcttcttcccgtattgttcaaattcaggcgacgctgtcagagagagctcttgaactacttgctttgcctgatgacggcgttcctaaattactccttgatatcggttgtggatcgggacttagcggtgagacaatctcggagaatggacaccattggattgggcttgatatttcagcatcaatgcttaatgttgcggtggagcgagaggttgagggtgaccttttacttggtgacatgggccagggtataggaattcgtcctggagttatggatggggccatcagtatatctgctgttcagtggttatgcaatgctgataaatcctctcacaaccctcgattaagattgaaggccttttttacatctctatataaatgcttatcaaatggagctagagcagtatttcaagtgtatcctgaaaatatagaccaacgtgaattgattttgaatgctgcaatgcatgctggatttgctggtggtatagtggtggattttccacacagcatcattttgcctagccttcttgagcatggtgtttcactaaccggagaacaattgtcttatgatagttctaagaagaggaaggagttccttgttctcacttgtggtcaatgctcagtaaatgcgtccatttccaaaggtaaaaatgaagatggggagagttgctctgatgacgacagtgaagatgaagaaaatcagacagtatgtatatcagacaggcatagaccgcggaagaaacagaaaaataataaggttggtaaaggaaaggaatggttactaaggaagaaggagcagatgagaagaagaggaaatgttgttcctccaaataccaagtacacgggtaggaaacggaaggatcgtttttga

SEQ ID NO: 191 - DNA, 273 bp, Glycine max
  Peptide Sequence Number=SeqID_91876
atggcgaacattcgtaaatgggaaaggacgaattattccagcggtgacagcatgcatagcgatataataataacagctagggatactgatgggacaacacatagtcaattcatcagtgtttctcagagtcgtcctttctttttctccttcaatcgttgcagccgcctacgtaagacaaagcatatgaacatggcagccctttccaacgccggccccaaaccccttcttctttcatctatcaatagacctactgtcgctgcttctttacactaa

SEQ ID NO: 192 - DNA, 138 bp, Glycine max
  Peptide Sequence Number=SeqID_91877
atggaaaaaccattgcttgtcatcgttatgggtaaggatggatggtctggaagtccctttgttcggaagggaggccatcaacggtgtggcagcgagcgagagagcatgatgtgggaaagagagaaagggaaagaatga

SEQ ID NO: 193 - DNA, 1311 bp, Glycine max
  Peptide Sequence Number=SeqID_91878
atggcctcccttcgtattcgtaaccttctccgtttctccatacacgggacgctgctttcatcttctccacttcgaccagggttttcgggaagctctcgaagctacagcgtcgttgaatcttcgaaacattttctattgaagtccgacgatgaggagatattcgctctccgtcgcaaattcgaagctgccaaacagagttttctcagtattcccgatgcgctccgggaaatgcccaaaatgaatcctaaaggcatatatgtgaataagaacgtgagattggaccaattgcaagtttatgggttcgactatgattacacattggcgcattactcgtctgatttacagactttgatatatgaccttgccaaggagtacttggttaatgaggttagctctgacaacacagtcctgctttatgactatggttcctttccttactcatcttgttgctcctttcagcttaggtatccggaggtttgcacgagttttaaatatgatccaactttccccattagaggcctatactatgataagtcaaaagggtgcctcatgaagctggatttctttggttcaattgagccggatggatgcttctttggaagacgcaggctaagccatacagaaatacgtgacatatatggcacgcggcatattggtcgtgatcatgctcgatcacttgttggtttgatggatttcttctgcttcagtgaggcatgccttcttgcagatatagttcagtactttgttgatgctaagctagaatttgatgcttcctacatttatgaagatgttattcgtgcaattgaccatgtccatcgaagtggcctggttcatagaggaattctatctgacccacacagatacttagtgaaaaatggaaagatattacgttatcttaagatgctaagggagcgggggaagaagcttttcctgttgactaattctccttattattttgtggatggagggatgcgttttatgttggaggattctctggattgtagagactcttggacggaactgtttgatgttgtgattgctaaggccaataaaccacagttttatacatctgagcatccattccgttgttatgacacaaagaatgacacattaacttttaccaaggttgatgaatttctaccagataaaatttattatcatggatgcctcaaatcctttctccaaataaccaagtggaatggcccagaggtgatatattttggagatcacctatttagtgacttaagaggcccctcaaaggcaggctggcgtacagcagcaatcatccatgaactagaggcacgtctgtaa

SEQ ID NO: 194 - DNA, 150 bp, Glycine max
  Peptide Sequence Number=SeqID_91879
atggcaccactgatgggagggtgcttttggctttggtggcagctgaagcagcagtgccaacagcaacagcaacatcagcggcaccagaatatggccacagattatgggatccaacaatggcctgggaaagcaaagcaagtaaggaagtag

SEQ ID NO: 195 - DNA, 3471 bp, Glycine max
  Peptide Sequence Number=SeqID_91880
atgagttccagcgtgactggaagtatagtccatcagggccagttgcttgttcatattgctgagaatggacactcttttgagttggattgcaatgagaacacacttgttgagtcagttatgcggtctattcaatctgttactgggattaatttcggtgatcagcttgttctttgtttggatatgaagcttgagtcgcagcggccgctatctgcatacaagcttccatctgatgagagggaagtgttcatattcaataaagcaaggcttcagaacaactcgcctgttccaccgccggagcaagttgatatccccagtcatttggagcctccaccgccagcctcttcccatgatccacaccctcttgatgatgcttcggatcctgctttaaaggctttaccttcttacgagcggcaattcagataccattatcatcgggggcatgtgatttatactggtaccatgatgaaatatgagcattgtgagaggcttttgagagaacagatggtccaagaaagagcggtggaggttgcaaggggtaatttggatcagtactatcgaatgattaaccaaaactatggggacttcatgaaacgttatatgcaacaatgcaggatgcattctgatcttttggtgaatttcgggaaggatattgagaaactaaggtccatcaaacttcatcctgctttacaaactgctaatcgcaagtgcttactggatttggtcaaggaagaaaacttgaggaagtcggtggagaattgcaccagctcccacaagcagtttgagaataaagtttcacaatttaagcagacttttggggaagtgaagcgtcgggctgaggaattgttgtccagcagggatttcttgcccatcaagaatttagaacaagcaattaaagaacaccagagatatataaatgaacaaaagagtatcatgcaatctctgagcaaggatgttaacactgtaaagaaactggtagatgattgtctatcctcccaattgtcctcctcactccgtcctcatgatgcagtttcagccttgggtcctatgtatgatgttcatgacaaaaatcacttgcctaaaatgcaggcttgtgatcgtgctatttcaaagctacttgagttttgcaaggagaacaagaatgaaatgaatctttttgttcataattacatgcaaaacataacttatgtttcttatctcatcaaagatcagaagctacaattccctgtttttaaagaggcaatggctcgtcaggatggcttatttatggatttaaagttgttccatggtattggtcctgcatacagagcttgccttgctgaaatagtgagacgaaaggcttctatgaagttgtacatgggcatggctgggcaaatggctgaaaggcttgctataaaacgggaggctgagctcaggagacgggaggagtttttgagacttcatagttcatgcattcctaaagaagttttagcatctatgggattgtttgacactccaaaccaatgtgatgtcaatatagctccatttgatggtggtttgcttaatattgacatatcagatgtggaacgttatgctcctgaatatctaacgggagtaacttccaagctggataagcaaggaagctctaaaagttcatctgctttgagtagtgatagctctcacttggctgaggctgtagatattactggtgactcaattgagagagatgattccgaggacttgcttgatggcagtgagttgcttgaaattgctggaacctgcaagatggaagttgagaatgcaaaactgaaagctgaacttgctggtagaatagctttaatatgttctctctgtcctgagttagagtacgagtcattggatgatgaaagggtgaataatatattgaggaatgccgcagagaagacacaagaagccttgcatttgaaagatgaatatattaaacatgttcaatccatgcttaagatgaagcagatgctatgcgtgtcctatgagaaacgtattcaagaattggagcagaaattgtcagatcagtatgtgcaggggcagaagatgtccagtgtaaatgatgcagctgaccttccccttgtggctgggaagacagataattacaagtcagaatctatcagtggtgaagccaacatgccttgcatatctacttctgagcccatggatgaggtttcatgcatctcaagttccttggatgcaaaacttggtttgttcatgttcacagagcatactggtaaagcattagatggggtggatgaaaacatgttggattcctctggagttcagaacccacagttggattcatctatgatggagcctcatcgcgaagaagcacagagtggtgataaagataaaaaaggcaagataatagtacaattgggcatgtcactgacaaacagttctactggtgagaacatgcctgtgtcacatgatcttgtaccctgtgactcggcagtttgtcaagacttggaatccaaagtaaatgatgaaaaggtgttggaactacaaagtgcacttgcagataagtcaaatcaattgaatgaaactgaaaccaagcttaaaactgttatggagaaggttgctgtgctcagaagggagttggaagcaagtcaaaaactacttgatgaatctcagatgaattgtgctcacctggaaaattgtttgcatgaggcaagagaggaagctcagacacaaaaaagttctgctgacaggagggcctcggaatatagtttactgcgtgcatccgttattaaaacgcgcagcttttttgaaagactcaagacctgtgtttattctcctggtggtgtggctggttttgcagattccctacgtaatttggcgcaatctttggccaattctgctaatgacagagatgatgatgatattgctgaattccggaaatgcattcgtgtattagctgatagagttggtttcttatctaagcaccgggaagagctgcatgagaagaacacaagaacagaagctgctaacgaacagctgcggaaagaattggaggagaaaatagaccaggtcaaaacttattacaataagcatcaacttgaaaagcaggcaaataaagagaagatttgttttggttgcctggaagttcacgagatagctgcctttgtgctcacttcagctgggcattatgaggcaattactaggaactgctctaactactacttatctgatgaatctgtagccctgtttgcagaccatcttcctaccagacctaactacatcgttggacaaattgtgcatattgaacgccaaattgtgaagacgctgccgcctcggcctgagcatggtagggctgataaatttacccctgacaagggggctgactggttgaccttgaattcaggatcaactccgaacccttacggtctccctgttggctgtgaatatttcctagtgacagtagccatgttacctgatacccccattcattcatcctctccttcctga

SEQ ID NO: 196 - DNA, 1629 bp, Glycine max
  Peptide Sequence Number=SeqID_91881
atggaggaaccgctacaagaagagcatgctcctcccaacaagcgcttcaaatcttcatccgcttcacaagatgagcaatggaatgcttcaaacggtgcatcatcttccagttctccctcccagtacaatatacttgatgagcctagccctctgggcttacgtctgaggaagagcccttcgcttttagatttgatacaaatgaagctttctcaagggaatgtgattattgcaaatacacaagatgaaaattttataagctctggattgaaaaaggagagtcggggtgctgctgcatcaggttctgtggagaagcttaaggcttcaaatttcccagcttcacttttaagaattggttcatgggagtataaatcaaaacatgagggtgacttagtggcaaaatgttacttcgctaaacagaagcttgtttgggaagttattgaaggtgaactaaagagcaaaatggaaatccaatggccagatatcatggcacttaaggcaaattgtcctgatactggacctagctcgttgactgtagtgctcgctagacaacctcttttcttcaaggagactaatcctcagcctagaaagcatacactatggcaagcaacatcagattttactgatggagcggcttgcaaacacaggcagcatttcttggaatttccacaagggttgttggccaagcattttgaaaagcttatccaatgtgacgcacgtcttaatttcttaagccaacaaccggagataatcttggattcacctcattttgatacacagcctgctgcttttgagaaccttgacaatccagaagatcgtgatttgcatctagtcaacggtaaaggatctaccacatcttgtttgcaggtcatagaatcacctcattcatcccagtcaccatcatttaaggttgagcataatggtcgtctaggcattaactttgatttccctccggacattgggacttttcattcattcgtcaatctcccaaacatccaccccctaagcatcattgtcagtttgtcacatatatactgggatcagggtagagattgtagtagaagttctgaaactgatttcaagggaccaagaaacttggatcagataaaattgcctggactccagccctctatgtcagtgagtgattttattggccacattgaacattgcctttccgaacaaataacttccggaaatccatccttttgtggtggaagatcagagttacaggaaatgctggaggaaattgcacagcatcttcttaatgacaatcaggttataacaacttctgatgaaatatcactcatgacaagggtcaattctctctgctgtcttctacagaaggaccctgcaggattgcagagttcacatgacaaggaaagtgctgttgctgaaggacctgatgatgaaaaacgtattcaacttagccatgatcttgaatcaatgcagaacaacaaaattaaaatggatgtcaagcctgctgaagaggacttcagagatgcttctgggagcaagcaaacactaggcatgtccaggaaagactcttttgcagagttgcttcatcaacttcctcgaattgcatcactttcgaagttcttgtttgacatatcagaagaagatagcgacagctaa

SEQ ID NO: 197 - DNA, 2562 bp, Glycine max
  Peptide Sequence Number=SeqID_91882
atgtggaatgctgtgatcaaagcaggaaatggaaaatgggatgaagccaaagaggatagaatggatgactggaagttgcaacaaggcaatttggggcctgaacctgatgaagatccagatgcagccatgttagatgaagcaaggcaaccattgtcaaggaaggtaccaatagcatccagcaaagtgaatccatataggatggtgatcgtggcacggcttgttatccttgccttcttccttcgatatagacttatgaatcctgtacatgatgcactgggactgtggctaacttctattatatgtgaaatctggtttgctttttcatggatccttgatcagtttcccaaatggtatcccattgatcgagaaacataccttgatcgtctttcaatcaggtatgagcgtgaaggtgaacccaacatgcttgctccagtggatgtctttgttagtactgtggatcccatgaaggaacctcctttggttacagccaacactgttctttcaatcttggccatggattacccagttgctaagatatcgtgttacatttctgatgatggagcttcaatgtgtacatttgaagccctgtcagaaactgcggagtttgctaggaagtgggtaccattctgcaagaaattttctatagaacctagagcaccagagatgtacttcagtgagaaaattgattacctcaaggacaaggtgcagcccacctttgttaaggagcgtcgagctatgaagagagaatatgaagagtttaaggttaggatcaatgcacttgtggcaaaagctcagaaggttcctcaaggaggatggattatgcaggatgggacaccatggccaggaaacaatactaaggatcatcctggtatgattcaagtctttcttggtcacagtggaggtcatgatactgaaggaaatgagcttcctcgtcttgtttatgtttcccgagagaaaaggcctggattccaacaccacaagaaagctggtgctatgaatgctttgattcgggtctccgctgtgctcacaaatgctcctttcatgctgaacttggattgtgatcattatgttaataacagcaaggctgctcgagaggccatgtgcttcttaatggacccccaaactgggaagaaggtctgctatgtccaatttcctcaaagatttgatggcatcgataggcatgatcgttatgccaatagaaacacggttttctttgatattaacatgaagggtctagatggtattcagggtcctgcatatgttggcacagggtgtgtatttaggaggcaagctttatatggctacaatcctcccaagggtcccaagcgtccaaaaatggtaagctgtgactgctgcccatgtttcggaaagcgcaagaaggttaagtatgaagggaatgatgcaaatggagaggcagcaagccttagaggagtggatgatgacaaagaggtgctgatgtcccagatgaattttgaaaagaaatttgggcagtcatcaatttttgtgacttcaaccttgatggaagagggtggcgtgcctccttcagccagttcagcaagccaacttaaagaagctattcatgtaatcagctgcggatatgaagataaaactgaatggggaattgagctaggttggatttacgggtctattacagaggatattctaacaggttttaagatgcattgccgtggttggaggtccatttattgcatgccaaagagagcagcattcaagggtactgctcccattaacttgtcagataggcttaaccaggtgcttcgttgggcacttggctccattgagatcttcttcagtcgtcattgccctttatggtatggctataaggaagggaagctgaagtggcttgagcgatttgcctacgcaaacacaactgtctaccccttcacctccatacctctagtcgcctactgtgttcttccagctgtctgtttactcactgataaattcatcatgccaccgataagcacttttgctggtttgtacttcgttgctctattctcttcaatcattgcaactggtcttcttgagttgaaatggagtggagtgagcattgaggaatggtggagaaatgagcaattttgggtcattggtggtgtgtcagcacacctctttgcagtcatacaaggtcttctgaaggttttggctggaattgacaccaacttcactgttacatccaaggcagcagatgatgaagaatttggagaattatacacctttaagtggactactctcttgattcctccaaccactatcttaataatcaacattgttggggttgttgctggaatctcagatgccataaacaatgggtaccaatcctggggacctctatttggaaaactattcttttcattttgggtgattgtccatctgtatccattccttaaaggtttgatgggtcgccaaaaccgcacacccaccatagttgttatatggtcagtactattggcttccattttttccttgctttgggtaagaattgacccatttgtattaaaaactaagggacctgataccaagctatgtggaatcaactgctga

SEQ ID NO: 198 - DNA, 771 bp, Glycine max
  Peptide Sequence Number=SeqID_91883
atggaattccaataccgtgatggccaaaaccaaaggacaccattagcaatgcctttttccggtgtcgcctacttttctggaaacccattagaagggtatgagtttatgccaggtggttttcccgacaatgttccaacgcccaacgttttcccaacaacaatgttgatcaatgctgaggaagcattccgacaagagttggtgaaaaaacagatacgacgggagcgggaggaggaggaaatcaggaaaaagataatttcccgtgagacgacattggcacatcgtcgagaactggaggaggaggtgaagagagaaatgatgtcagagagaatggggggaatccccatgcaaagaacagaggggttcttgtttccagatcgagtttatgtcaatttggagtcttcatatcaaagaatgatgaatcatgttaatcacattaacatatttggtaggccacaaccccaactacctggccaagttgataccaggcaaccttatacactgaccaatactgaaaaggacaaagttatcatattggctaagccaaatgttgacgattatggtgcaaagcgcaaagcaatggcacctcttgcagttgatgaaagtgagaatttgggaaagaaatcaaagccggagtggagttgcactttatgtggaattactgtcacaagcgagaaacagttgaatgctcatcaccaggggaaaaaacacaaggctaaagaaacatttctgagaactcaaaagatagggtttgattcaagaccaaatcattag

SEQ ID NO: 199 - DNA, 1008 bp, Glycine max
  Peptide Sequence Number=SeqID_91884
atggagttcaaatatcgtgatggtcaaatccgaaggacaccatcaccattgcggagccctcttccttccaactcctatgtctccaatcgcccattacatgggtgtgactttgcatcaggtggctttcctagcaatgtttcagcgcctagagttttcccaatggtcatgtcgatcaatgtcaacgaagtattccaacgagagttggagaaggagaaaatatggcgagagctagagaaggaaaaaatcaggagagaaatcattgctagtgagatggcttttgcacaacgacgagagttggaagacgaagtgagaaaggaaatggaattagagagaacattcagaatcccgatgcaaagatcagaggggattgcatttcgagaaccaatttcagagtctattaatcagagtcggttgaataacattaccatgtttggtgggctaccattccatttattgtcccaagcttctaagcaaattcacacggataatatccaatttgataacaaagaagcttctaatagcaaggataaagtgattatattgaataagccagatgatcattgtggagaaaagcgcaaagcagtaacacttccaattgatgacaatgagagtctacagaagaaagccaagaaggagtggacttgcgagttgtgtcaaatttctacaacaagtgagaaaggcttgaatgatcatattcaagggaaaaaacataaggctaacaaagaatccactagaactcaaaaaatagggctggattcaagaccagaaagagaaacacttcatccttgtttaacacccgcggatgatcaaaatgaaacaactactattaaacaagcacaggaaacaagcgcaccgtcaaaagggaagaaatttgaattttggtgtgagctttgtcaagttcaaactcattcagaaattgtcatgcaaagtcataagaatggaaaaaaacatttgagaaatatgaagaaattgaatcacaacaatgatggtgttgcaaatcttggataa

SEQ ID NO: 200 - DNA, 330 bp, Glycine max
  Peptide Sequence Number=SeqID_91885
atgaatgtcatgggaaaagtcttcatagtcctgcaagagactctggtgcctcagcctggccctctgatcctgatatacctcataaggagggtccaaggagacaacccctttcatcttcttcatgagatcaaagagaaacaagagaacccaaaagggaagaacaaacgaagactaaagggaaaaggggagaaagagagaaagaagaagaccagtgatgaagatgggattttttgggggcttgcagaagggcaattcggggaacatagttttgatgagagagagagaaatgtaagagagagaaagaagggtagtagtattgaagatagatag

SEQ ID NO: 201 - DNA, 327 bp, Glycine max
  Peptide Sequence Number=SeqID_91886
atgacattccaaagcaaggcaggtatcttcttcctgtgcttgttaatcattgcattttcatccattaatcttgctgttgctgtgccaaaagagcaagagcaagatcgaatcttggcgctcccggggcagccacgtgtggcattctctcagttctccggttatgtcactgtgaacgagcaacatggccgagcactcttctactggctcactgaatcccccacttccccgcagaataaaccacttgttctctggctcaatggagctagagagagcttaaactcatcatcttctaccttctatactagcttcattccattacctttgtga

SEQ ID NO: 202 - DNA, 2454 bp, Glycine max
  Peptide Sequence Number=SeqID_91887
atgtttgactgtggtcccaagtcagaatacatgggtggccagcgggaaaattttttgaggttggaggccttggattctacactatcttcatcttctgatgccggagttatcaaatctggatttagtattgataaattaagccatggtcatggaaacagcacaacttctaggtctttcaaaaggggaatgagaaggggatctgaaggactgaaatcaattgggcgatcgcttgggttgggagtatctagggctgtgttcccagaagatcttaaagtgtcagaaaagaagatatttgatcctcaagacaagtttctgctcttatggaataaactttttgttatctcatgcattttggccgtctctatagatccactatttttttatctcccagtcattaatgattcatttcattgtcttggcatagaccgaaagttggcaacaatagttacaaccttaaggacattggttgatgctttctatcttctacacatggctctccaatttcgtactgcttatattgctccatcttctcgtgtctttgggcgtggtgagcttgtgatagattcagcacagatagccaagcgatacttgcagcggtatttcatcattgatttcctatccgtgttgccgataccacagattgtggtttggagatttcttcagaggtcaaaaggttcagatgtactagcaacaaagcaggccttgttgttcattatcttgcttcagtatgttccaagatttctccgaatggtaccattgacttcagagcttaagagaacagccggtgtctttgctgaaactgcatgggcaggggctgcatattatttgctgctatacatgcttgccagtcatatagttggtgccttttggtacttgttagctattgaacgcaatgactcatgctggcagaaggcttgcagtgacattaggtgcaataaaaatttcctatattgtgggaaccagcacatggaaggttatagtgcttggaataaaacaagtgaagatattcagtcaaggtgctctgcagatggtgatcctgcgcattttgattatggaatttttgggcaagtcttgtcttctggcatcatttcatctaagaagttcatctccaaatactgttactgtttatggtgggggctccagaatttgaggctaacagccattagaaagactgaaacaagtatattctatgtgaagcctgacctgaatactgatataccaagcatttctccagaattatcaagcaacatatttagtgattttagtttaagcaaattagatggaaaaactgttgattattgttgcatcagtaatggagtgggtattagaaaaagtagaaagggtactaagggaattgtactgactgctgaggctgaagagtgtgagaagagcagaggcttataccaatctgcacacacggcaagggatttgggacttcaaactagcacctatcctggggaggttatcttttcaatagcactagctataagtggcctcatcctttttgcccttctgattggcaacatgcagacatatcttcagtctctcaccattaggcttgaggaaatgagagtcaaaaggcgtgattcagaacagtggatgcaccatcgcttactcccacaagatcttagagagcgtgtgagacggtatgaccaatataagtggctggcaacgcgtggtgtagatgaagaaaatttagttcagagtctaccaaaggatcttcggagagatattaagcgtcatctctgtttggccttagtgaggagggttccactatttgagagtatggatgagagattgcttgatgctatatgtgagagattgaaaccgtgtttatttacggagaatacttacattgttcgggaaggagatcctgttgatgagatgctgttcatcatacgtggtcgccttgagagtgttaccacagatggtgggaggagtggatttttcaaccgcggttttctaaaagaggctgacttctgtggggaggagcttttaacctgggccctggatcccaaatctggttctaatctcccatcttctactagaacagttaaggcattaatggaggttgaggcttttgccttaactgctgatgagttaaaatttgttgctagtcagtttaggcgccttcacagtagacaggttcaacacactttccgtttttactcccaacaatggaggacctgggctgcatgctttattcaagcagcatggcgtcggtattccaaaaagaaaattatgaagcttcgtcaaaaggaagatgagtcagacggagctcatgaaaatgttggtggcagttcctacagctttggtgctgccttgttagcctcaaagtttgctgcgcacaccctacgtggtgtacatcgcaatcgacttgccaagactgccagggagttagtgaaactacagaaaccccctgagcctgacttctctgcagatgatgctaactaa

SEQ ID NO: 203 - DNA, 135 bp, Glycine max
  Peptide Sequence Number=SeqID_91888
atgaggttgaaagagtctccaaacgttgagattgcattctgcattgtggagaaggagaaaaatagcaaaaaaagaaattttccgggaaaaggagtgaggtttgggagtgagaataacagaaacgttgaagattga

SEQ ID NO: 204 - DNA, 282 bp, Glycine max
  Peptide Sequence Number=SeqID_91889
atgggacatgagtgtttgacggataagaggctttcagctgaagaaatggcggttggtggggatctacattgggatctccttgtaaagcaaggtcatagagagagagaaaatcaagggattgtgtgtggattctgttttgtgaggaaagggaaaagtgaagacaagacaaggcatagagaaaatacaatgtatggtggtggtaatgtggttttgacaaatttctctgcaagcttggaatggatgacgtgggtaccacttattaggagagaaaaagattgttga

SEQ ID NO: 205 - DNA, 594 bp, Glycine max
  Peptide Sequence Number=SeqID_91890
atgacgcataaactatttttttatctcaaactaagcaatggaattgaactcactattctgcggaaggtaattccgaagctgaactccggatccaagccgtactcggagaattcggaagcgtcgtgtttcttagcgacggaaccggaggggcgaggttcggaggaggaggaagggtttagggtttcgacgtggaaatggttggagaaacccttgaagggcttcttgacaggaagaaacacgatttttctcgacagcaaaggaggagcggcggtagtagtagtggacgaagaaggatccggcggattcggaggctccgtttggatcacgatggtttcggccattggtggagttcgagaagcttcgaaaagagaagagaagaagaagacgcggaagaagcagagggtttcggcttctggaaagagaaggcctgggcctgggcccggaattgagtgtatatatatgtgtggccttgaaaatcctgggtcggtaatagaacaactgggccactcaaacttgaaccgcgtggaccggggtggtcaaacttcaaaccaggatagatttctacttattcttaccttcaattatggaatctaa

SEQ ID NO: 206 - DNA, 2046 bp, Glycine max
  Peptide Sequence Number=SeqID_91891
atgggggtggaagaccgttttccggtgggtatgcgtgtacttgccgttgacgacgacgaaacgtgcctctcagtgttggagaacctgcttcgcaaatgccagtataatgttactacaactaatcaggcaattaaggcgctagacatgttgaggaaaaacagaaacaagtttgaccttgttattagtgatgtgaatatgccagacatggatgggtttaagctgcttgagctagtggaacttgaaatggacctaccagttatcatgttgtcaggatacggtgataaagagcgggtcatgagaggtgttatacacggcgcttgtgactacttaacgaaaccggttcgaattgaagagttacagaacatatggcaacatgtagtgcgaaggaggattgatagcaaggataagaataagactgcaagtgagggaaaagcctgcagtatggctggtaagcttgcaaatgaggagaaagcctgctatatggctggggaatgtagtcaagccatggcatcaaaaagtaatgccgaccagaatataaaactgggtcaaaaaaggaaggaacaaagcgaggatgaggaagaggaagaatatgatcaagaaaatgaagaaccctcaaatcagaagaagcctcgtttagtttgggatgccgagttgcataggaaatttcttgctgcgattaatcatctgggaattgacaaggctttccccaagagaatactggacctgatgaatgttgaaggacttacacgagaaaacatagcaagccatctgcagaaatacagactcggtctcaaaaaatccactcaacagcctagcatggttgctacgttgggtaatagtgatccttaccagcagatggattcaatagaaggctttcgcactttgtcgggatcaggaggaatgataagcaccacactaccatcatatgcatctggtggactgttttgtaggctgaactccccatctggcttgagaggaattaactcttctcttcttgttcagcctgttcattctcaaaacattgatagcaggtccataaaaacacttggaaacatgcagctatccatgttttctgcaaatcaaacctcaagtttattacagggcattccaacatcaatcgatggtaaccaatttcagcagaataattgttcaattggtattaggaagttgagtccacttgatgatttatcaagtggatttaaagtttcctctggtttctcaaacagtagagctactgttagaaatccaaataattctctacatggtctctcaaataatcatttacttttacaaggaaattccccaccaacacataattctggagcattcggaaatcactcttctcttggagctgcttcggtgaaaacacaatcctttgaccctggcatctgtgagttgggttataatcggtgtaataaaagctggcagggaacaactcagatatctaagtttcctgccaatacttctgcagtcagtaacaatgatcagctggctcaaaataacttgaacttttcctcatccactttttgcagtgggaacagcccagttgatttttcttccactagtgttgttgctcctcccttggaggatgctagaggtaagctacgatgtcaagaaggcttacttgagaatatcttactgacatcatgttacacccagcatcagagctgggaagcagataaccggggttgcaacaaagaaatgagtcaaactttcaacaccataaagtctgtctctcctaatggagacactagttccttaggacatagtttagaccaaaacaatacagttagcagcaagagaattgatgtatctttggttaatccatcagtcacgcagtctagtgaagatgagaaattctattcgatggagtcaattgatggctgcattttgcagagcatggagtcccaagaagatctcatgcagaatacttttgagtcgttggatgacataatgagtgaaataaccaaacaggagcaaaatgccattatgttgatggatggagaaatggagtttgatgcttaccatgttggatcatgcatttga

SEQ ID NO: 207 - DNA, 1671 bp, Glycine max
  Peptide Sequence Number=SeqID_91892
atgggaatccacctcggcttgtttctctttctggcttctcttcgaatgactttatctcaagatgttgaacatggttcagttctagtagatggaattcaagcaattgctgaaactgatgataacttcatctgtgctactattgattggtggcctcatgataagtgtgattacaactattgcccctggggggattcatctgctgtaaatttggacttgtctcatcctttctttgccaaggcaatccaagctctcaagcctttgaggataagagttggaggttctttgcaagaccaagtgctgtatgaggttggaagtttgaagtccccttgtcatccatttcaaaagatgaaaggtggattgtttggattttcaaagggatgtttacaaatgaaaaggtgggatgagctgaatcattttttcgatgagacaggggcccttgtgacatttggtttgaatgcactccgtgggaggcatcagattagtcatactgtttggggaggagactgggacccatccaatgccaaagattttatcagttacactatttcaaaggggtacaaaattgattcatgggaatttggtaatgagttgagtgggaagggcattggggctagtgttggtgctgcacagtatgggaaagacttgataaagcttaaagaaattttacacacattatacaaaaactccacgttcaaaccttcccttgtagcacccggaggattctataataaggagtggtttgataagcttcttcaggttacaggtccaggcattgtcaatgtgctgactcatcacgtgtataatttgggcccaggtagtgatgagcatcttgataggaagattctagatcctgagaacttgagcaagatagaatcaatttttagcaatctttcagaaaccattcaaaaatatggcccttggtcttctgcatgggtaggtgaagctggcggagcattcaacagtggtggtcgttcaatttctaacacatttgtgaatagcttttggtacttagatcaacttggaatagcatctagatacaacactaaggtttattgcaggcagactttaattggaggaaactatggtcttctcaataccactactttcattccaaatcctgactactacaggcaagtcctggtgttgtttttgagcagtgcacttttgtggcgtcagctaatggggaagactgttcttgcagctagtagtgatgttttttcaccatctttacgcacttatgcccattgttcaaaaggcagagatggtataacattactgctgatcaatttaagcaatcagactcatttcacactcacggttcatgaccgggtgcctgtgagcaatggaggaaatgaaaatgctaaaagcatccatacagaaaactcattctttagtcatctcaagagggcattttcttggattggaacaaaaggatcagatgtcacattcagggaggagtaccaattaactccaaaagatgattaccttagaagccaaaccatgttgctgaatggtattcctctagagttgacaaatgatggagaaattccaacattggatccactactcaataatgtacattctccaatacacttggctcctttatccattgcttttattgtattccccaactttgatgctccggcttgtgctgaacacagaaaactttaa

SEQ ID NO: 208 - DNA, 1146 bp, Glycine max
  Peptide Sequence Number=SeqID_91893
atgtcaaatagctgcagaagtgataatcatactcccttaaatgcggagcaacttagtacaagacgtagaagagagcatagaaaagagaagggtgttttacaaagttctcaatcccaaagcattcaatcagtccagatgcagatactagaacaacacaagatgtcatttttagaagctcacgctgaagataagaaacacattcaggggttggaaaaagagctgctgaactgttctcaagaaatagattatcttcaggatcaactcagtgcaagcaatacagaggtgaactacctggaagagcatattcgcagccttgaattgaaattagaggggatggaagatttacaagaggaggttttcagattaagggaggagctgaaaagatccaattcaaagcattttttcttgatccaggaactagatactaaagaaatagaattagagaagtcagctttgtccatagagaaactagaggaatcattttcatccataacattagagtcccagtttgaagtagagagcatgaagcttgatatgatggccttggaacagagtctttttgaggccaagaaaatccaggatgaaactctagatgaaaataatagaatgagtagatcaattgaggagctccaggttgcattgcaggatgcccaaaaaatcatcatctccctaaatgaagaaaataggaaacttaaagagaagcttgatattgccaacaaaaactctagaatttcttctcaaaaggatgaatactggctggaaaacaatgacagattgcaactcgagactcaatcttccttgaatggacgaggcaacaactctaccatactggaggacatacgcacttatggagtacatggtccacatgttggaagattggcaatgatcctatatctagctgcagatttaaaagggaagatggaaatgtcacaacagatccaagaatatgaatgtcttatcaagaaacttaaggaagaattaagagaggaaaagttgagggccaaagaagaagcagaggatttagttcaggaaatggcagagctgagataccaatttactagttcactagaggaagaatgtaagcgccgtgcttgcattgaacatgcatccttgcaaagaattgccgagttagaggctcaagtatga

SEQ ID NO: 209 - DNA, 1140 bp, Glycine max
  Peptide Sequence Number=SeqID_91894
atggcttactcaaaaagtttttcattcctcatttccattctccttttcatctttcataatttccatgtatccactgcacaaaaaatcaaaggagggtactggttccccggcagcagttttgcagtgtcagacatcaactccacgctttacacccatctcttctgtgccttcgccgacttgaacgcctctacttaccaagtcaccatttcctcctcaaacgcacctcagttctcaaccttcacccaaaccgttcagaaaaagaacccttcagtcaaaaccctcttatccataggaggtggtgcttccaatccatcaacattctccgccatggcgagccaagccggtcgccggaaaacattcatcgattcatcgatacaactagcccgatcgaacaacttccacggcctcgacatggattgggagtatccatcaacttctacagacatgacaaactacggtttcctcatcagagagtggagaacagctttggtcaacgaggctagaaactcagggaagcaaattttgctcttagtaggagcagttttttactcttccaattattactcattgaattacacaattcaggatgtaattaacgcctttgactttgtgaatgtgatggcttatgatttctatggaccaaattggtaccccaatttcacagcaccaccagctgctttatatgctcttaaccatccagcagctaatcgggttagtggtgacatggggatcagagattggattggatccggtatgcctgcgagtaaactggtgctgggtgtgcccttttatggctatgcatggcgtttgttgaattctaataaccgtggattgtttgatagagctaatggttcggcctttggtggtgatgggtccatggggtacagtcagataagggagtttgtaagccagaatagagcagcgtgtacgttcaattcaactgtggtctctgattattgctcttctgggacaacatggattggttatgatgacgtgcagagtgtgtctgcaaaggttgcttatgccaagacaaataatttgggtggtcattttgtttggcacgttggtgcggattacaattgggttctttctcaagcaggtgctgtttaccctgacatgtattgttgttacagagtataa

SEQ ID NO: 210 - DNA, 1062 bp, Glycine max
  Peptide Sequence Number=SeqID_91895
atggattcactgcttcttcgatctttccctaatattaataacgcctcttctctcaccaccactggtgcaaatttctccaggactaaatctttcgccaacatttaccatgcaacgacctctgaaaaatctcttgagtctgaacctcaagcttttgatccaaaaagcattttggactctgtcaagaattccttggatgctttctacaggttttccaggcctcacacagttattggcacagcattaagcataatttctgtgtctcttcttgctgttgagaaaatatcagatatatctccattattttttactggtgtgttggaggctgtggttgctgccctgtttatgaatatttatattgttggtttgaatcaattgtctgatgttgaaatagacaagataaacaagccgtatcttccattagcatctggggaatattcctttgaaactggtgtcactattgttgcatctttttcaattctgagtttttggcttggctgggttgtaggttcatggccattattttgggccctttttgtaagctttgtgctaggaactgcttattcaatcaatgtgcctctgttgagatggaagaggtttgcagtgcttgcagcgatgtgcattctagctgttcgggcagtaatagttcaacttgcatttttccttcacatgcagactcatgtgtacaagaggccacctgtcttttcaagaccattgatttttgctactgcattcatgagcttcttctctgtagttatagcactgtttaaggatatacctgacattgaaggagataaagtatttggcatccaatctttttcagtgcgtttaggtcagaagccggtgttctggacttgtgttacccttcttgaaatagcttatggagtcgccctcctggtgggagctgcatctccttgtctttggagcaaaattttcacggttcaaatcttgaaattagcctctcctcttgcaggcaagggggaggctaccttcatctaccctcccccagagcccactagagtcttgtgccatttggcaattgtctttttcacagttgtcttctga

SEQ ID NO: 211 - DNA, 723 bp, Glycine max
  Peptide Sequence Number=SeqID_91896
atggaaggagatcaccatcgaattcaagaattgaaacacgcgtgcaagttctgcggcaagtgcttcccctgtggcagatccttggggggtcacatgaggtctcacatcaccaacttgtcgtctgagatgatgaatgaaaaaaaagaaaagctttcatcttctctcaacaatggtggagacaaagattctgaagctgctgctgcaactaacgctgctgcaagctatggtctcagagagaacccaaagaagacttggagaatctcagattattcaagtgaagaccctttggtgtttgacaagttctgcaaagagtgtggcaaagggtttcactcttggaaggccttgtttggccacatgaaatgccattcagagaaagagagagtttccaacagcttggaagatcaagattcttggactaatagtgctaagatggttatggatagccaatctgataatgaagcaactgctccaaataagagaagaaggtccaagagaagaacaaggtacacggtggttgcttcttctgcagcagcagcaacaacttcttctgttgtgtcttttgcgaatccttcatcttcttctctctctgaggttgagcaagagcaagaagaggttgctatgagcttgatgatgcttagtagggatgtgagtccttggagtggtcgtcattctgtggctgagtcctctgacaataactctgcttatttcgaagctcgatcttcg

SEQ ID NO: 212 - DNA, 456 bp, Glycine max
  Peptide Sequence Number=SeqID_91897
atggaaaatctagagaaagaggaagcagtgactcccacaaggagactcaacattgagtacaatggcagtgacctatacgactcgttcgagttcaaacagatgactttacaactcaacgaggccattcaaacctcaaaagaatcttcaccagcttacagagagatgacgcacaggcacaagcttaaaaaggccattcagggctctaatggctcatcgccatcattagtcttccacctaaattcacccttttatcgtcgccacctgaagcgtctctacaaagaaagcacaaaggcaccaagaagaatctctagtcctcaagtaccagataaaccaacgtgcgtaagaggaacaagggaaaaaggttttgttactcgcctgtggttgaaggttaaaggtttactagggaagaagcatgaaggtgaagaggggagaaaccagccctcgaaagcattttga

SEQ ID NO: 213 - DNA, 280 bp, Glycine max
  Peptide Sequence Number=SeqID_91898
atgcacctgaagaaaagaccatgcgaggttgaaaagcgtaacgagccagagaagggcataataggaaacgacaacataggagcctcgacgacagacgccgttgagattcttcttggcgtgcaccctggcgacagagcttggtcttccatactcagtgacatggtttcaggggctaaagatcgcaaattcgtaaccattggacattgtttggtcggtggcaaagtgagagttttctttccttcaacgagatcgtggaattcagttgatgatgatgatggag

SEQ ID NO: 214 - DNA, 519 bp, Glycine max
  Peptide Sequence Number=SeqID_91899
atgaaatctgagataagcaaaacagcaacatttaaggtacgacacctctacatcatatgtgaaggggatcaaggggaggctcaaccggttgccatcggcgacatgttcatggacaccgtcaagaagggaaagcctgatctccgtaaggtgttgcctgtcgctattggtgaaatgaaaggctctactatcactggtccaattgggaatgagtgtgctgaactctggaccaggattaagaagaagaaaggacagaattgtcaaagaagagaagaagttgcagcaaggaatggacatagtgcaagtatgaactatgaaccaagtcaggaaggaggtacagactcaacagaggttaaggagctgccagaatacattgagctgatggagaaacaaggctttcaccggaagacacatcaacagccaatgatggaaaatgcaaacaatggaacctgccttgtttggggagagcaagagcaatacacttacagagatcttgctaatgcaacagagcttccttcttga

SEQ ID NO: 215 - DNA, 1782 bp, Glycine max
  Peptide Sequence Number=SeqID_91900
atggcgtcgtcgtcggcggcaaagcgatgccactacgaagtcctcggcctcccccgtgattgcgcccccgatgagatccgttcagcctaccgccgcctcgccctccagcgccacccggacaagctcgtgaaatcgggtctctcccaagaagaagccaccgcgcagttccaggaactccaacacgcctacgaagtcctctccgaccccaaggaacgcgcctggtacgactcccaccgctcccaaatcctcttctccgaccccaacaccgtctccaactccttcgtccccgacctcttctccttcttttccaacaccgtctattccggctacaccaacaccgcaaagggattctacaaggtctattccgatgtattcgataaaatccacgccaacgagatcaatttcgcgcgcaaattggggcttgactctgatgcggttagacaggcgcctgttatgggtaatttagatagtccatacgcgcaggttactgcgttttatagttattggttagggttttgtactgtgatggatttttgctgggtggatgagtacgatgttatggccgggccgaaccggaagtcgcggcggattatggaggaggagaataataaggtgaggaggaaggcgaggagggagtataatgacactgtgaggaggttgggggattttgtgaagaagagggataagagggtgattgatatgaaggtgaagaggagtgtggaggaggagaggaagaaggaggaggagagggagaggaagaggaggttggagaaggagaagaaggagagggctatggcgtacgaggagccagagtgggctaaggttgacgaggatgtggaggaggtggttgaggaggaggtggaggagagggagaatgaggagttatactgtgtgctgtgtaaaaagaagtttaaaagtgacaagcagtggaagaaccacgagcagtccaagaagcataaggagagggtcgctgagtttaggggttcgattggtgatgatgaggaggatttggaagaagaagaagaaggagaggagggattggaaagtgcagaagttggggtgaatgatgagactgataatgggattggtgatttggaggcgaggattaaaaatggtcttaatgttgaagagggggagactagaaatgggattgaactgaatgatgatgatgagtttattgatgcctcacgtgtgaaggaaggcgaagaggccggtgtgtctgttagttttgatgaggatggcaatgaagaagaagaagaagaagaagaagaaggtgatattgaaaatggtgttcttgaagcaatggtggctgggcacaagaacagaaaaccacgagcttcaacacacaaacccaagacttcagtggcaccattgccaattgaaaatgagaatgatgatgagcttggccctatggaatataacaaccaaaagggggcaagaaagaaacgtagagccaagaaagagaagggtaggaaaaattgggaagagtctcaggaggctgctgccagtggggattatgaggatataatcagtaatgcaaatgataattctcatgcagaggagtcttcttcccaacattttatggaaaatgaggataatggtatagagaatgagcaggttggtagagatgagaagatttctaatcaaccggctgataaaaaaggtagagataagaatatttctcagcaagcggctgataaaaaaggagctggcaaggacacaaaaactaaagcaaaagtttcatccaaaggaagaaaaggaaaagtaagaacttctgagtaa

SEQ ID NO: 216 - DNA, 1510 bp, Glycine max
  Peptide Sequence Number=SeqID_91901
gtgggaaaaggttgaggtgaaggcgataggcacaacaacagagggtggtggcggtggagggccagggaagaggtggggtcacacctgcaacgccgtcaaaggtggcagacttgtctatgtcttcggtggttacggcaaagataactgccagaccaaccaagttcatgtcttcgacactgtgaaacagacatggagccaacctgctttaaaaggctccccaccaactcctagggacagccatacaagcacagccgttggtgataatttgtttgtgtttgggggtacagatggaatgaaccctctcaaggatttgcacatattagacacttctttgcaaacatgggtttctccaaccataagaggagaagggccaccagcacgtgagggtcatagtgcagcagttgttggcaaacggctattcatctttggaggttgtggaaaatctgcagataataataatgagctctactacaatgatctttacatattaaatgcaggcactccaccatctcctcgtgatagccacagttgttcatcttggagaaacaaaattattgtgataggaggtgaagatgggcatgattattatttgtctgacgtccatattcttgatactggccaattgttgccacctcgagctggtcattccactgtttcttttggcaagaacttgtttgtttttggtggatttacagatgcccaaaacctctataatgacctttatatgctcgatattgatactggtgtttggacaaatgttacaactgcaaccaatggtccttctgctagattttctgtggctggtgactgtttagacccttttaggagtggtgttcttatattcatcggtggttgtagactaaatatcccagtaaaccaatccctacctcctggtaagaaaatgtttgaagccaaggttactgaaaacatctcagaaggatatactattgaaactgttattgatggaaaacctcttcgtggaattctgtttttaaacaagcctatctctctgtacacagatgctcatacttgcagtaggaaaaggactgttggtgaaattgatagtgttgtctcgaatggtatacaccctaaccaatttaagactcctaaagtggtcaagcaaaatcaaatggaaaaccgagaagcatctcgtggagacagttcagaatctcatgaacaccgcactgaatccattgccgtgcttatgtcaagtaacccaatgactgccaatccttctgatacccataaggtttctgccaacccagaagcagaagctgctgctttgaatcaaaatgatgaaaaacatgaaacacccaaatccttaattggaaacttgacaaatgatggagcgaatgatgtgacaagttctaaagttccaagacgcgataaaacaagtgatgctccaaactacaacactgaatttctgaaacctgctgcagctgagagtgctttgcatctgtcaaatcaaggtgaagacatattttcagaggtagggtttcaaactggctag

SEQ ID NO: 217 - DNA, 1773 bp, Glycine max
  Peptide Sequence Number=SeqID_91902
ggaagaggaaagagggatggtgcctcggaaggtcaagcctcagaccttgagcatggtgatgcagtgccggcggcaaatgtgggattctgtagggtgctttcacttgcaaaacctgaggctggaaagttggtgatcggtactgtggctctgttgattgcagccacatcaagtatcttagttcaaaaatttggtgggaagataattgacattgtctctagggaaatgaaaactccagaggagaaagatgaagctttgaatgctgttaagaacaccatactagaaatctttctggtcgttgtcttcggttcaatttgcactgcacttcgagcttggcttttttatactgctagtgaaagggttgttgcacgactgagaaagaatttgttcagtcatcttgtaaaccaggagatagccttctttgatgttactcgaactggggagcttttaagtaggctatctgaagatacacagatcataaagaatgctgcaactaccaatctttctgaggccctgagaaacttttcaactgcattaattggtctgagcttcatgtttgcaacatcatggaagttaacattgttggctttggctgttgtacctgttctttctgttgctgttcgcaagtttggccgttacctgcgtgaactttctcataaaactcaagctgcagctgcagttgcttcatcaatagctgaggaatcctttggtgcaataagaacagtaagatcatttgcccaagaagattatgaagtaacacgctactcagagaaagttaatgaaacacttaatcttggtcttaaacaagctgtgagccttaatgctgcatctacactttcagtcattatagttgttatatatggagctaatttgacaatcaagggttccatgtcctcgggtgatcttacatctttcattctttatagtctctcagtgggttcttctatatctggtctgtcaggattgtatacagtagttatgaaagctgcaggtgctagcagaagggtatttcaacttttggatcgtacctcatccatgcctaagtcgggagataaatgtccactgggtgatcacgatggggaagtagaactagatgatgtgtggtttgcctatccatcacgccctagtcatccagtgctcaagggcattacattgaaactgcatccaggaacaaaggttgctcttgttggtccaagtggtggtggaaagatcagtatagtgagtcaggagcctacactcttcaactgttccatagaggagaacatagcttatggatttgatggcaaagtgaacgatgttgatatagaaaatgctgctaaaatggccaatgcacatgaatttatatcaaaattcccagaaaaataccagacctttgttggagagcgtggggtaaggctttcaggagggcagaaacagagaatagcaattgctagagccctgcttatggacccaaaaattctcctcttggatgaagccaccagtgccctagatgctgaaagcgaatacctagtgcaggatgccatggagtctctcatgaaaggaagaacagttctagtcattgctcacaggttatccacagttaaaactgctgatactgttgcagttatatctgatggccaagtagttgagagaggcaaccatgaagagcttctcagcaagaacggtgtctatactgcattggggcaaatgatactgaggcacaagttccttggaagaccttcacttccacagttgcaagttacagcattaccctctgtatcagaggaaagaaaatga

SEQ ID NO: 218 - DNA, 1380 bp, Glycine max
  Peptide Sequence Number=SeqID_91903
atggatcacgggaatcatcttcttgtttttactttgctctctttcttattaagaggtgagtcatggggttggttttcatcatctaaggagactccctctagtggcaagactcatgccgccaatgaaggcaattttagtgctgagttctctatcgagtccttcaacgaccataagggagtgaagttaatagaaaatgctaagaagaaaatgattagctcaaactcatgttggcaaaatgcttaccaacatctttttgctggatgttctgaaatcttggctgttgatgagaagaggtctagattggcttggcacctaagtgattgctttcagagggattctggtaggtctccttttccccattgtgaccccaagtcttccattgttgtatgctcaagatccttagatgaccttgcccataaggtttaccttgaattctaccttgaaaccaacaccatttgttatcagttgcaggcacatgcattcaaatatgaaactgagagacttgtgactgaattaaaaacttcagcccagtatgttgagcacaagctagatagcattgaagagaaatcagaatatctattacaaggctcaagacagattcatgattctcttgattcaattggtagccacacaaaacaagtagttcaaactgctaattatctggaaggtcacattgattctgtattaacacattcgaggagtgcttacgagcaaactacaaaaattgcactatcacaaacacaattaaacgaagggaaagagaatatgaagagaaacttggaggatgggttagcgatgctcaaagactcttacaattatttgggcaaagaaattgaaaagatggacaacctgaaaagcaaagctgaagatattgggaatatggctgggatttccatagataagcaacaacaactcttagaaggacaatccacagcgcttgaggaactaaactcattgactgagtttcaatccaaagcactagaagagagcaggaaaacccgacaatattttgctgaatatgggcatagacaacatgaagaacttattcagcgtcaacaacaaattcaaggatttcatgatcgtttaatggaaaactcaagggaaatattgtcttctcaggtttgcaatttctggaattatgagaccttgaaccatcaaatgctgctaactctgataaacaaggttaacagcatgcaaaaagaaaaggagttgccatgggacttgtatactgattatgagggttggtcggaatggatagatgccgatttacccgatgatgtgaattgccttgatgatcctgaccatatacaagaagttgcagagaatccaatcacagttacaaaaaattacaatctacgcaatcgcaatctttttcattga

SEQ ID NO: 219 - DNA, 546 bp, Glycine max
  Peptide Sequence Number=SeqID_91904
atgatgaaaacactggagaagtaccagaagtacagctacagtgcactggagaccacccgtccaattaatgactctcagaactatcaggaatatttgagattaaaagcaagggtagaagttttgcaatgttctcaaaggaacctacttggggaagatcttgcccaaatgaatacaaatgagctagagcagcttgagaatcaactggagacagcactgaagaatattaggtcaacaaagactcaattcatgcttgaccaactttctgatcttcatcaccgggaaacattgcttattgaaaccaataatgtgttaaggagtaagttggaagaaactaataattcacaagttcaagtaagtctagctttggaagctggagggcctagcatccaatacaccaactttccacctcaatcagaggggttcttccagccaatgggagtgaatcccaccttgcaaattgggtacaaccagactaatccacatgatgcaaacgttggagcttcatccttaagtatgcatggattcgcctctgagtggatgctttga

SEQ ID NO: 220 - DNA, 1368 bp, Glycine max
  Peptide Sequence Number=SeqID_91905
atggcacaggaatctggtatgttcatggttaaccaaacaattggcagtgttttgtgctgcaaatgtggaattccaatgcaaccaaatgctgctaagatgtgtgtgaagtgtctgcgatcggaagtcgatattacagaaggactgctgaagtgtctagtactggtgcattgccctgagtgtgagagttacttgcaaccaccaagaagttgggtcaagctgcagctggagtcaaaggagctgctgacattttgcttaaagaaattgcagaagaatttgaattcgaataaagtgaggttggtgcatgctgagtttatttggactgagccccattccaggagagtaaaagtcaaggtcaaggttcagaaggaggttcttaatggagcaatacttgaacaatcttatcctgtggagtatgttcaacaagagcatatgtgtgaatcttgttctagggtccaggctaatcctgaccagtgggttgctgctgtgcaactcaggcaacatgtttctcaccggcgtactttcttttacttggagcagctgattctgaagcatggtgcggctgccactgctataagaatcaagcagatggaacaagggaaagttgctccattaaggagccatcacgataagcagcttgtttctcatgatccaaagagtaataactacaactacaaatatacattttctgttgaaatcagccctatttgccgtgaggatctaatctgtgtgcctcctagagttgctgctggtttgggaaatattggtccacttgtgatttgcactaaggttaccaacagcattgctttgcttgatccatttaccttgaggcactgtttcatagatgctgatcagtactggagagcatccttcaagtcattacttactagcagacaattggtggaatatattgtgctggatgtggagactgtttcatctgaggttactattggtgacacgaaatatcgtttagcagatgctcaagtggctcgtatttcagattttggaaagaacgacacgatatttaacatcaagactcatcttggccatcttttgaatcctggtgattatgcacttggttatgatctgtgtggggctaatagtaatgacatggaattggacaagtacaaaggacacattcctgaagcaattttaataaagaagagttatgaagagaagcaccaaaagaaacgtgggaagcctcgttcatggaagcttaaatcacttgagatggaggttgatgataagggtagagttgatcaagagtacaagccatctgatggtgatgaatcttctgttccattggaggagttgctggctgatcttgatctgagtgagcatgaagatgaagaggataacatgacggaatga

SEQ ID NO: 221 - DNA, 564 bp, Glycine max
  Peptide Sequence Number=SeqID_91906
atgaagcgaaccaaaggtgagatcatcttaaccatgaattgtgtggttgtgtggtgcggtttcgatttggataataagcgccgtctgcgcttctctggcggaagaagcggtgtcggcattggcgaatggtggtttcgtgagattgttttaagttcgatctggggtgaagcaaggatctcggcagagtgggaaggtttgatgggtctgaagaagtgggagagtaaggttcagaaagtgggaatgggtgtgttaggttcggggggttcaggttcaggttcgggttcgggttcgtcgcggtcgagaatgaagatgtggatgatacgggcaaccacatcggtgttattgtggacctgcatcgttcagttaacggcgttgggtgacatgtgggggccgagagttttgaaaggttggccttcttgtttcactcacgagtctgccgttagagcaatggatgtcgagttaccgtcacagcgtccacctcttctccctcccaagagggtttataaaaacaatggataccttatggtttcgtgcaatggaggactcaaccaaatgagagctgcg

SEQ ID NO: 222 - DNA, 2114 bp, Glycine max
  Peptide Sequence Number=SeqID_91907
gccttgcacttgatccttctaagtgcagtaaattgagtatggaagaaaaaagagaacttgtatatgaagtatctaagtggtcgcatggtgcatctgagatgctgcagtcatggagccgtcaagagattttgcaaatattgtgtgcagaaatggggaaagagagaaagtatactgggctgacaaagttgaaaattatagaaaatcttctaaaaattgtttctgaaaagaaatcaggggggaatgaaactgcgacagaccctgaaccacaatcttctcctgcacctggtcagaagcctgctaaaaggcagagaaaatctgagaatccttcacacgtgcctgttcctgcgaccagcattacagtcaataatggtggtgattctgttaacaccgcatactgcaaaaactcagcttgcaaagctaccctgaatcaatcatatgcattttgcaaaagatgttcatgctgcatttgtcatcaatatgatgacaacaaagaccctagcctgtggttaatatgtagttctgagaatccatttcctggtgtttcttgtggcttgtcatgccaccttgagtgtgctttaaaacatgatggttcgggaattgccaaggatggtgagcatcccaagcttgatggagggttctactgtgtctcttgcgggaaagtaaatgatttacttggccaaagacttttacaaggaactgaagtgtatgaagaactttataaaattgttgatgaagcagtgaagaaacttgaacctgaagtgggtccactcattggctcaccggtgaagattggaaggggaattgtgaacaggctttcttctggacctgaggttcagaaactctgtggttttgctctggaatcacttgattcactactttcgaaaagaattttgccttcgtcacccaagccaacaactcaagatgcacatttgctggctccaaatatggtgaggtttgaagacgtcactgccacaaccctcactattattttgggttctgaagaaccctctggtgaaattattgctggttacaccttgtggcatcgcaaagttgatgatgtggactaccccaccgacccaacttgcacctcgctcctaccaaatagaaggttccgtgtctcgggtctaattccaggcacagaatacagtttcaaagttgtttccaatgatttgagggagtcaggtatgtgcgaagttcaagtctcaacagagcatggcgaggaagaagtccctaattgctctgcaacagaaagaagtcagagcccagtaaccaactgtagcagcctttccaatccgtcatcagtggaagatgaaactaataactgtaatccatatagtgatctgactgataaccgagcagaccattatccttcttatcacaaggatagcaaccaacttgcttctggaaatttatccaatgatgttattaactgttccaatctaggcagtgtgggacttcctcctgatgcagattctttgtcagacaagcagcatgctggaggaacgactgcctccatacctagttctgatgtgctaaagctcgaaaacaagcattcaccagaggaacaagtcactgaggacatgagcactgatgatgggttgaattccccagctctaacagggagggaatgtgtgccgttagtaggtagctcaaaaggaggcttgcctaatactccctgcaagttggaaacacttaaggatggacctggaaagaataaaagatctaagtcgagtggcaaagatcaagaaaatgtatccgggaaaagggagggcccccaagatggaagcacatccaagaagagaagtggagaaaggcaagaggagggccgtgttgcaaatggcttttcggatcgggattttgagtattatgtgaaggtaattaggtggttagagtgtgaaggacacatagaaaagaacttcaggcagaaatttctgacttggtacagcttaagagccacatctcaagaagtaaggattgtgaaaatatacattgatacatttcttgaagatccagcatctcttgcagagcaacttgtggacaccttttcagaatgtatatccagcaagagaacatcagtggtgccagcggggttctgcatgaagctttggcattga

SEQ ID NO: 223 - DNA, 1105 bp, Glycine max
  Peptide Sequence Number=SeqID_91908
tgactttcaagacatatttgatgtggatcattttatcgcgtccttgagagatgaagtgcggatattgaaagagttgcctcccagactcaagatgaaagtggaacgcggctttctttacaccatgccacctattagttggtctgatatatcttactataaggaccagattctacccttgatacaaaagtacaaagttgttcacttaaatagaactgatgctcggttggccaataatggtcaaccgatagagattcagaagctgcgttgccgggtcaattttagtggtctgagatttacttcccagatagaggagttgggcagaaaggtgatcaggcttctaaggcaaaaaggtcaatttcttgtgctccaccttaggtatgagatggacatgttggcattttctggctgcactcaaggttgtaacagtgatgaggtggatgaattgacaagaatgagatatgcttatccttggtggaaagaaaaaataattaattctgatttgaaaagaaaagatggtttatgccctctaacacctgaggagaccgcccttacacttaaggctcttgacattgatcagaacattcaaatctacattgcagcaggggaaatatatggaggggaaaggagaatggcaggtcttgcaaaggagtacccaaaattggtaaacatcaatactcaaggcagtatggtcaggaaggaaacgctgttggagccatctgaccttcgtttcttccaaaatcattcatcccagatggcagcattggattatcttgtctcgttagagagtgatatttttgttcccacatatgatggaaatatggccaaagtggttgagggccaccgcagatatcttgggttcaagagaacgattttattgaacagaaagctcctagttgaattgatagatcagtacaataatggagtgctaaactgggatgaattctcttcagcggtgaaggaagctcatgccgatcgcatgggtagccaaacaaagaggtttgtaatccctgagaggccaaaagaagaggattatttctatgccaacccacaggagtgtttggaacaatcagcagatgaaccgttggcgttgagtagtagtacgtga

SEQ ID NO: 224 - DNA, 1524 bp, Glycine max
  Peptide Sequence Number=SeqID_91909
atggcaactggtcctgctgattcttatactgaaaccaaatgtggtgtttgtcatgccgggacagatgaacatcttctactactttgtgatctttgtgatactgcttcacacacatactgtgttggcctgggctatactgttcctgaaggtgattggttttgtcacgattgtgctatttcccggaagatcaatatcaaggaagactcggaccaacaaaatgttgtgccaacagctgagcccagagtaaccgtcgatatctttgatattgtgagggaaacaggcagccaggtggttcagagaccaagggcatctcctttacaacagaacctttcatctccttccgttattcctttacctgataggttaagttacttaagtagattaaaaggaaaaagacctgtcacagggttctgtcatatgcagcggaatgtaaaggcttttcgtgaaaattggaatgctttgagaagtggttcattacagttccgttgcaattcatctcaacctggaagcacagttagtcaaaaacaagattctagttccttatcacatcacaaattggatgatttgcattctatggcttccacaagccttcaacaatcgactgtccaaggtggtccttctaataaaatgttgaatgagagagtctttaaagatgctgacaaggcatggaaaatgatggacagggcaaagaaaatacaactgcctcatcatagaacaggcagagtagataaaccctcatgcagtggaggagctagaaaaatatcattagcacattgcaacttctccgaagtgaaagatcaacattccaaagcattagacttgaggaacactaaaaaagagaagcagtgtgactattctaggctcaaccagaatttggaaaatcgctctactctgaagttggaagagaaaaggcaaagtagggatacatgtgagaagatgatacatgtgagggaccatactactcattcaaaaggatattgtgaacgcccattgtcaagaaaggtccatactagtatccagggtggtccctgtcgtgaagatggactgagaaatgttgctgaggaacaaagcttgtatgcttgcttggtaacatcagcagatttagcttcctctcgtgacaaatttggcagtatgttctctaataggggtgtgaatcttgttaatgaagaaaagagattggctaaaagctctgaggatggaaacacaagaaatattgttgattcaaaaactgagatccagtctcttgttaaattgaatctgaagctcttaactagagataaaaaattaggctttgataccttcaaggtagttgcaaggcaggccactcataccatcttggctgcttgcagttctgatcagcaaaagtctagtacatcctcctctagctcagtatgcagccatgccgacaatactcctcagtttcagaaatctactttaatgcctaattgttgcaggcaatgcttttataactttgtaaacaatgttgtccactccaccatattggagaaagtgggttgcgcttga

SEQ ID NO: 225 - DNA, 1479 bp, Glycine max
  Peptide Sequence Number=SeqID_91910
atgtcagtgcagcggtgtgttttagagaatcttggaattgaaccagaagtggaaaggattggcaaatacaaaagtgtaggagatcaacttacccgtaaaaccatgtctgaagatcatcatgagatgcttactgcgttgcttgataatatctatactaattggctggacaaagtctcttctgctagaggaaagaaaagggaagatattgagaacttcataaataaaggtgtctatcaagtagagagacttaaagaagagggcttcttaacagacataatctatgatgacgaggttatcactcggttaaaggagagacttcaagttaaaactgataaaaatcttcctatggttgataacaggattcaattgcaagttatgggacttagtcccacattggaagtatgggattctagtgtggggttggttctatcaattggtatcagagcattccaccatgtctcagttgcaaatgagcggcacagaaaatactctggagttaggaaatcgactcttggactatcaggtggcaaagaattaatagccatcatccgagcttcagggagtattcgccgtatcgagagttcattaagtacccgtagctctggtatcattggagagaagttaattgagaagatacgcaaagttagagagtcaaataaatacaaggctgctattatccgaattgacagtccaggaggggatgctcttgcttctgatttgatgtggagagaaatcaggcttctggctgcctcaaaaccagtcattgcttcaatgtctgatgtggcagcaagtggagggtactacatggcaatgggagcaggagttattgttgcagaaagtcttaccttaactggttcaattggagtggtcacaggaaaatttaaccttgggaaactttatgagaagattggcttcaacaaagaaatcatatcaaggggtagatatgctgagctccgtgcagctgaacagcgttctttaagaccagatgaagcagagctattttccaagtctgcgcagcatgcttataaacaatttcgagataaggcagctttatccagatctatgactgtagacaagatggaagaggttgcacaaggaagggtttggactggtaaggacgcagcttctcacggtttggttgatgctattggtggcctttctcgagctgttgccatagcaaaattgaaggccaatataccgctggacagacagacaattattttggtaatcgtgcttgagctatgtcaggttactgtgttggagctctcgagaccgagcccttctctacccgagattttacgtggtctaggtaattctctcgttggagtagacagaactttcaatgaattactacaggacttgacattttcccatgaagtccaagcacgaatggacggaatcatgtttgagaaattggaaggatatccatatgccaaccccattttggcattgataaaagattatcttagttccctgtag

SEQ ID NO: 226 - DNA, 1287 bp, Glycine max
  Peptide Sequence Number=SeqID_91911
atggctattgtaagattgatgaagacaagcaacaagaaacgacacacttataataatggatcttctacgtctcctataaaatcacttccaaaagatttgttggtagaggtggttgcaagggtagcctctgattccatcgttgatcttcgcaatatgaaacaatgttgcaaggattttcttgatgcttcggaagataattacgtgtggcagcaagtttctttagacaagttcccattaatgcgatggcttcctaatgacaaagcatcgtgcttcttaaaatgttgtagggagagtggaaatattgaaagtttgtatagagaaggattgctgaaattctttaattacccaaacggaaacattaatggtctcggagacttgaaaacggctgctctaaagggtcacatcgaagcaaaatatgtatacgagggtgacagtgaggccatttttggtgctcttaatctgaacccgcaactcttctgtaacgaagttctcaacattgtcgacgatgtgctcgacgaagctttcaatttcttctaccaggacgcatccacgaagctcaacatcgaaggcacccaaaggtcccaggatctgaaaaagggtgttgattgcgttcggctgaatgttcaatctgttttggacaaacaacttgctgcttgggagagttacatcctccgtcactgttttgctcttccccaaggttttcgtatgccaaacaccgcaaatgttagcaattattatgttatgctagtggtggaattcaaagccatgaccagtatcgcctcaacccctatgttagttgttgatgttgacctttatagcatttgtgttcgagatattgcaatagacgatgatgaaattcctgatgaatcaaatgagaatgccctagatccaggtgctccttttgatccagatatagatgcccagttagattcattgagagaaaaactaattgaggtggggaaggagtctgaaatgcttaatcaagaaatgcaagcattagaaagaaagtctgctgtcaatgtggctggacatatcaatgaagctgtacaattatatgagcaaaattctatgcatgaggtgtttcaggagattgtgacgaccgcctcagaacttggagcaaagatggcaaagctaaactctagcatgattgaagagactgaccaaacaaaaactaaaaggatttacagcacagaaatggatctatctgctataaatcctgctaaaggcctgtcaaacatgaagttagacgatgttgaagaatttgtaagtgttatgaagagtatgtga

SEQ ID NO: 227 - DNA, 255 bp, Glycine max
  Peptide Sequence Number=SeqID_91912
atggcgtggggaggtttgagtggagctggaactcctcagtttcatttctcgttgcttttggtagcacgtcaagggtgtcgtccaagatggcctgaaacaacaacaacaacaacaatagagtcactgcgtgatgttgacgtgaacaactcgagaggggtagcaaatactacacaagttgatgaagggcataacattttggtaatcgtagccggagaagagcacccaactcatttggcaaagcccctctccttgtga

SEQ ID NO: 228 - DNA, 1797 bp, Glycine max
  Peptide Sequence Number=SeqID_91913
atgcctaccgtcagtgtggggcgtgatcgcctgtatgctgctctaggaaagacttacacgcaagaggaattcgaagacttgtgcttcagtttcgggatcgagctcgacgacgttacgacggagaaggcaattgtgagaaaagagaagcatttggatgaagaagaagctgacgaggacgaagaagttatctacaaaatcgaagttcccgccaacagatatgacctcctgtgccttgaagggcttgctcaagccctccgagttttctgtgagttccaggagattcccacttacagattgtccaacatcagtaaagatgcaatacagaaaatgcacgtgaagccagagacttctctgattcgtccatatgttgtatgtgctgtattaagaggtataacctttgataaagtaagatacagcagctttatcgatctgcaagacaagcttcaccaaaacatatgtcgccgaagaactcttgttgccattggaactcatgatctggataaattggagggccctttcacctatgaggctttgccaccttcaagtataacttttacaccattaaagcaggaaagaaacttcagggctgatgagctaatggagttctacaaatcagatttgaaactcaagaaattcttgcatataattgaggattctcctgttttccctgttatatatgacagtaagagaactgtgttatccttacccccaattattaatggtgcacattcagccatcactctggagacaaagaatgtatttattgaatgtactgcaactgatctgacaaaggcgaagattgttttaaatacaatggtgacagccttctctgaatattgtgaaaacaaatttgtcattgaaccagttgaagtgatttcttctgatggcaagtcaaacatataccctgatttatctgtctacaatatggaagtttctctatcttacattaatggattgattggggtatcattggaggcagaagaggtcactaagtacttaaatcggatgcaattgcatgccaagcagtctgcatctcataataagcagtgtaacattgtggtatctgtacctccttctagaagtgatgttcttcacccatgtgatgttatggaggatgtggcaattgcttatggattcaatgctattaaggataaagcagtagtagataataagggctcaaagaggttggctgcttccttgactctacttcctctgaatgagctcagtgatcttatcagaaaagaggttgctttaattggtttcacagaggtcttgacatttatactctgctctaaaaaggaaaactttgccatgcttaaccgcaaagatgataaatctaaagcagttattattggaaaccctaggtcttcagactttgaggctgtgcggactagtcttatgcctggcattttgaaaactgttgctcacaacaaggatcatccaaagcccataaagatttttgaagttggtgatatagcagttttggatgaacaaagagatgttggtgcaaaaaatcttcgccaacttgctgctctgtactgtggtgctaatgctggatttgagataattcatggcttggtcgacagagtaatggaaaagaatggggttccctttgtttcacctggtgataaatcaggttattatattgagcggtcagatgagcctgagtttcttgctggtagacaagctagaatcatttacaaaggaaagcatattggcacttttggcattgttcatcctgaggtacttttgatccctgaaattatgtctgcttgttttaatatggccatttgttag

SEQ ID NO: 229 - DNA, 387 bp, Glycine max
  Peptide Sequence Number=SeqID_91914
atgtcactccccggctctcagtttaaagcggctaaccggtacgctaaaagcttggcaactctctccaaattctgttccgaagaagaagcctcgtctcggattagggtgaaatatggagataccctcaggcgcttcagtgctcgtgttgatgagaataatcggctggaacttgacatggttgacttgagggcaaagatatgttctatcttcagtttcagtgctgatgcaaatttaattctgagatatgttgatgaagatggtgacttggtgactctagttgatgatgatgaattgcgtgatgtgatgaggcagcaatttgaaagttctttgaaatttgatgtacacatgacaatgacagtgggggttaattcaaatgctggggtctag

SEQ ID NO: 230 - DNA, 270 bp, Glycine max
  Peptide Sequence Number=SeqID_91915
atggcgtcaaagttggagaagagaacggaacatttggaacttttctacaccgagggttgtcaactaataagaattctatcttgtgtgttaaaatggaaaaaagaagggataaaaaagatgttcaatgctgaggaagatcaagaagaggaagaggcaccagaaactaagatatcaagaaaagaaaattataaatccaccaccatcaggaagcaaggaaaaccagaattgcaaatagaagttagattctggctgattgctactggttcttga

SEQ ID NO: 231 - DNA, 90 bp, Glycine max
  Peptide Sequence Number=SeqID_91916
atggaggggaatggtcctcgggagagtaatagagatgactgtgttgttggtggtgcaaatcatatattatataataaccctaatgaatga

SEQ ID NO: 232 - DNA, 864 bp, Glycine max
  Peptide Sequence Number=SeqID_91917
atgcccttaacacttatattgcctggtgtcagtcatgaaggaatagagatttatagtcgtcacattcttaagatgagaactattctcactagatatgtcctatgtgtgtggattcgaccagataggcaaacattattatggagtgctacatggccaagggatgttgaaactctggcaaggcagtttctgcacaacccatacaaggtaattattgggtcaccatacctgaaggcaaatcaatctataaatcaaattgttgaagttgtaacagacatggagaaatacaatagattaatcagactgctgaaagaagtgatggatggtagccgaattttaatatttatggagacaaaaaagggatgtgatcaagttacgagacaaatgagagtggatggatggccagcactatccatccatggtgataaaaaccaggctgaaagggattgggtcttggctgaatttaagagtggcagaagtccaataatgactgccactgatgttgctgcacggggtcttgatgtgaaagacataaaatgtgtgatcaattatgattttccaacaagcctggaagattatgtccacagaattggtcgaactggtcgtgcaggggctaaaggaactgcatacaccttttttacacatgccaatgctaagtttgctagggatctgattaagattttacaagatgctggtcagactgtgagtcctgcgttgactgcattggttcggtcagctggttctggtcaatttggatcagggggaggttttcgctcaagaggacgaggaggctatggaaatcgtggtttaacgtcaggttccaatgccattcctctaggttcgaagcggccctggcattgtctatag

SEQ ID NO: 233 - DNA, 135 bp, Glycine max
  Peptide Sequence Number=SeqID_91918
atgtaccccatcacatctgaccacaacattcaatcaacggcgcaagacatgacccaggtcctccacgtcgacgagcatctctgtcgcgtgatggatagtgatggctactccctgactagcagattatcagtctag

SEQ ID NO: 234 - DNA, 1884 bp, Glycine max
  Peptide Sequence Number=SeqID_91919
atgtctaggacccaatcaagccatcctttggaccctttatctgcagccgaaatctctgtggcagtggcaactgtgagggcagctggagccactcctgagctcagagacagtatccgctttattgaagtagttttgttggaaccagataaacatgttgttgcactggcagatgcttatttcttttctcctttccaaccatcattgcttcctagaactaaaggaggagcagtaattccaagtaatctccctccaagatgtgctagaattgttgtttacaataagaagacaaatgagactagtatatggattgttgaattatcacaagtacatgctgtaactcgaagaggtcatcaccgtggaaaagtaatttcatcacaggttgttccagatgctcagcctccaatggatgctatggaatatgcagaatgtgaagctgttgttaaagatttccctccatttagagaggctatgaagaaaaggggcattgaagacatggatcttgtaatggttgatgcctggtgtgttggttattacaatgaagctgacgatcccaaccgtagacttactaagccacttatattttgccggggcgaaagtgacagccctatggaaaatggctatgcacgcccggttgagggaatctatgtgcttgttgatatgcaaaacatgctggtgattgaatttgaagaccgtaaatttgttcctctgcctccagttgatcccttgaggaggtatacacatggtgaaacaagaggtggatttgatagaagtgacataaaacccttgcaaattattcagcttgaaggcccaagctttcgtgtcgatggatcttatgttgcatggcaaaagtggaactttcgtattggattcactcctagagaaggtttggttatatattcggttgcatatattgatggtagtcaagggcgaaggcctgtagcacatagactgagttttgtggagatggttgtgccatatggagatccaaatgaaccacattacaggaagaatgcctttcatgctggggaaaatggcttgggaaaaaatgcacattctctcaagaaggggtgtgattgtttgggctacatcaaatactttgatgctcatttcacaaatttcactggtggagttgagacaattgaaaattgtgtatgtttgcatgaagaggatcatggaattctttggaagcatcatgattggagaactggcttagcagaagacggaaaaattgaatctgaagttaagctaaccggaattctaagtttaggatccttgttacctggagagtttcgtaaatatggaaccacgattgcgccaggtttatatgctccagttcatcaacacttttttgtagctcgcatgaacatgactgtggattctaaacctggcgatgctttgaatcaggtcgtggagatcaatgtcaaagttgaggaaccaggggacaataatgttcacaataatgcattttatgctgaagagactctgctcaaatctgaattggaagccatgcgtgattgcaatcctttggctgctcgacattggattgtaaggaacacgagaataggcaatagaactggacagttgacaggctataagttggtacctggctcaaactgcttaccattggcaggttctgaggccaagtttctaagaagagctgctttcttgaggcataatctttgggttcctcgtttggaagactggccagttatgccagtagaacgcatcggttttatgctcatgcctcatggattcttcaactgttctcctgcagtggatgtccctctgccaagtccatgtgagttggattctaaagaaaatgacatgaatgaaactgaggcttcaaaggaaattgagggttgtgtattagtggcaaaactttag

SEQ ID NO: 235 - DNA, 1320 bp, Glycine max
  Peptide Sequence Number=SeqID_91920
atgctgatggtatgcagtggagacccaaccatatatgaaagattttggagacaagtgggtgacaagaccacaatcataattccaggatggcaatccttgagttatttttctgatggctcaaacatttgctggtttttagagaccgagtttgcaagggaagtagtgaggttacataaagtggtggggaatgctgtgacagaaggtcgccatattgttgttgggacaggttcctctcagctaattctggctgccctttatgccctgtcctcgcctgatgctgctgaaccaatcagtgtggtatctgccgcaccctattattcgtcctacccatcaatggcagattatcagaaatcaggcctttacaaatgggctggtgatgcagagaattttgacaaagagggtccttatattgagcttgttacttctcccaataaccctgatggacatagaagggaagctatggtcaaccgaagccaaggactattgattcatgaccttgcctattattggcctcaatacactccaatatcatccccttcagatcatgatctcactcttttcactgtctcaaaatccactggtcatgcaggaatgcgcatagggtgggctcttgtcaaagataaaggggtagcaaagaaaatgactaaattcatagagataagtacaatcggtgtctcgaaggattctcaactcagagctgccaaagttttaaaggcagtgtctgacagctgcgaacatgaaaactcccaatatgaggaatcatttttcatgtacagctacaacataatgtcacaaagatggaagcaactgagagcagtagttgaggccggtgatttgttcactttgccacaattttctcctgcattctgcaccttctttggtcaggagacggagcctcaaccaggacgttgcgggtgttccggtgagtgtgagcggcggagattggtggctaaccaagcaaaggaagagatggaggtgatgccgaagactccggatgtgaggaagccggcgacggcgagagcgatgaatagggccgcggggagcaagacggggctgaaaatgacgaagagtggggtgacgacggtgaggctgatgacggtggcggagaggttgtcttgttgctgtgggtctgccatgggaggaattgaagctagctatgtatgtgtaagagggattgtggggtatggaaagcgagagaggggtggtgatgagaatttaaggaagaggaaggtggtgacacgtggagagggtgatgaacacttgggaggaggcttgcatgggaagaggtacatgtcgtttgatagcgaggaaaggtgttag

SEQ ID NO: 236 - DNA, 966 bp, Glycine max
  Peptide Sequence Number=SeqID_91921
atgaaggcaacactacggtacttagcaggacttgctgggccaagtggtttcggctcaaattcaacagctgagcaagtcactcaagattgctcttccttgctcccttcaaatctaaccgctctcatcactggtgggacttctggtattggagctgaaacagctagagtgttagcaaagagaggagtaaggattgtgattggtgccagggacttgagaaaggccaaggaagtgagagagaaaatccaaaaggaaagtccccatgctgagaagtatattcatgaagggctaaaagttagagttattgttttccacagaaacaatgcaggaatgtactctcaaaacttggagttctccgaagagaaaattgaaatgacattcgctacaaattacttaggacactttttggtaacgaagatgctactagagaaaatgatagatactgcaaagaagacaggcattcaaggaagaataataaacgtttcttctgtgattcatagctgggtgaaaagatcttgtttttctttcaacgacatgctctgtggaaaaaattataatggcacacgcgcatatgctaagtcaaaattggccacaattctgcatgtgaaggaagtagccagacagctgaaggaaaggaatgcaaatgtaactattaatgcagtgcatccaggcattgtgaagacgggaattattagagcacataagggcttaataacggattccctatttttcattgcatcgaagttgctgaaatcgatatcacagggtgcatcaacgacgtgttatgttgctctaagcgaacaaacagatggagtgagtgggaaatattttacagattgtaacgagagtaactgctccagtctagcaaatgacgaatcagaagctagaaagctatggaatgacacccatgccttgcttcacaaacggctacgtcaagcaacaaattcaaagtgtttcttccccacctag

SEQ ID NO: 237 - DNA, 624 bp, Glycine max
  Peptide Sequence Number=SeqID_91922
atggtgctcatgcgaactgtgtacccaaccatcgctgttcctcttcctcttcctctttcaaaccttcccgttaggaccaatttcgccgttcgatgtgccaacgttcactcgcaaacgcaactcgactcgcgcaagttggttcttgccgtgaaggaaaagcttgaaaaagaacaccataacctccctgttggcagaaatggaagagatgatgaagatatgatactgtggtttctcaaagatcgcaagttttctattgatgatgctatttacaagttgactaaagccattaaatggcgtcgagattttgaggtgtctaaattaactgaagaagtcgttaaagatgctcttcaaactggaaaaggatacgtacacgaccttttagatatcaatggccgacctgtggtcgtggtggttggatcaaagcatattcctcaagcactggaccctgcagacgatgagagactctgtgttttcttaattgagaaggcattgagtaagcttccaactggaaaagaacaaatacttacaatagttgatctcagaggtttcagtaccgaaaatgctgatcttaaattcttgacattcttggtagtattttttatcatctgccaaatatcattttga

SEQ ID NO: 238 - DNA, 387 bp, Glycine max
  Peptide Sequence Number=SeqID_91923
atgcactttctggaggtgactctagacaaatcatatgggcatatacttggagtaccaaagttaagagcaaggcttcagaaaccgcagactgcgcttgttgttgtctctgaggatcactcacaaatcagtgatctccaaaaagctcctaaagacacgtttccaattggcaactcatgttttcatatatcaggaaaggatggaagaaagccagtagtctcattttgtaaccgcccatttagcagagatattgaagtcatttcatcatcaaattcaaaaaggactcggatcagcatatcatcgtttatggtcccttatgtcctcgttgcttctttcctttatcctcaattcattttgcctgaaataatccctaaaatttctggaaactaa

SEQ ID NO: 239 - DNA, 1014 bp, Glycine max
  Peptide Sequence Number=SeqID_91924
atgtccgagtcggaagtagcaggtcagaggtaccgtgtgggctatgctctccaaggcaagaaagtcgaaagcttcattcaaccctcactcctcgatcacgccaaacaacacagcatcgatctcgtccaaatcgaccccaccgcacccttacaacaacaaggtcctttccactgcatcattcacaaactccacacccaacactggaaaaacctcctccaacaattctcatccaaacacccaaacaccgtaatcatcgaccctcccgagctggtggatcgcctgcacaaccgggtttcaatgctcgacgcagtgacccacttacaattttccctcgaaaacgccaccattggggttccaaagcaagtggttgtgaacgaacccaaatccttcgatttgcacaaattcgaagaagaacagggcttgcggttcccggtgattgcgaaaccgctggcggctgacggcggcgccggctctcacgaactgtgtttggttttcgacgaggagggactccacgcgttgagcgttcccatggtgctgcaagagttcgtgaatcacggcggggtcgtgttcaagatttacgttgctgggcagcgcgtgaattgcgtaaagcgcaagtctttgggtgacataacggaagagaagctgaaagtgttaagggggtcgctgccgttttctcgtgtgtcgagtttgggggttgaagacgagggtggcggcgccgttgaggacgctgaaatgcctccgcagagtttggtgggtgagttggcgaggggattgagggaggcattgggacttaacctttttaacgttgatgtcattagagatggtaaggaaccgacaaggtacctcgttattgatatcaattactttcccgggtatgcgaaattgccctcttatgagccttttatcaccgattttttgttggacattgtacgctccaagactgcgtatttcactagtctcaactgtagtgtccagtgcccttgcataaaacttggtttggaacgaggatgttaa

SEQ ID NO: 240 - DNA, 339 bp, Glycine max
  Peptide Sequence Number=SeqID_91925
atgattcgaaaccgttgttcccagttcagagcattttctgagttcttacctgcaagagggagaaagatagataaagagaataagttgtatatacatgaacgttgcggcggcgaggacttgtggcacgggggcgaaggccttgaggattttcctgggcgacagaggcggtggcgtggacggcggcggcgagggagaggggaaggagaggagggcgaagagggtgcgcgtgcagagggacgagacggaggcgtcacaggactcgtgtcagacggcgacgcgtgcgacgacctcgaggtggaggacgcgggatcggagggggaagatgaggttgaaggctag

SEQ ID NO: 241 - DNA, 1638 bp, Glycine max
  Peptide Sequence Number=SeqID_91926
atggagaacactagcaacgacgctggcgtcgaagccctacggctgctgaaagcgacggaaccgccttcatttctcactccgaacccagcgctgtcggaagctgctcgtaccgcatcgcaatacttgttctcttccctaaaaccgttttccccaaaatcgccactggaccaactccttgtggacggtttcgacgcagaacagatatggcagcaaatagacctccaaacgcagcctctgttatccaccattcgccgccgcgtgaaacagctggtcgaaaatcccgaagagatttcccagctgaaggttccttcggagggtgggaacaagaaggaggagaagagtcaagacgagtgggaagaagagagtgacggttttgacgaggaattggatgaggaagaggaagaagatgaggatgatgaagtaaaggagggagaaggagaagaagaagaagaagagacggaggatgaagaggaagagggggaggataatgaagaaggtggtgtcattgaggataaattctttaaaatagatgaattgacaaagtacttagagaaggaggaagatgatttcgagaatggcgaggcagacagagaaggtgaggaggaagatgacgaagaagaaagtgatgaggaaggtgattttgggattggtgatgatgatgatgaggatgaagatgaagaagcagagggcatagaaagtgcaaggtatgaagacttctttggaggtaaaaaggaaagggggtcaaaaagaaaagctcaagtacttcaggaatctgaatattctgatgatgaagatgatatggaatttgacaagcagacgaaagggactgcatctgcccatgaaaagcaactggaaaaaattcagtccaagatagagctgatggagaaagctaacatagatccaaaaacatggactatgcagggtgaggtaactgctgcaaagagaccaaagaatagtgcattggaagttgatctggactttgagcataatgtgaggcctgctcctgtaatcactgaagaagttacagcttcaattgaggatataatcaagaaaaggattattgaggggcactttaatgatgttcaaagggttcctaaattgccatctaaagcacctcgggaagttaaagagttggatgacaataaaagcaagcagggtcttgcagaactttatgagcaagaatatgttcagaagacagaccccacttctgctccattgtcatttaaagatgaacaaaagaatgaggcaagcatgctgtttaagagactctgtctgaagctggatgccctttctcattttaactttgctccaaaacctgttatagaggacatgtctattcaagctaatgtgcctgctctagcaatggaagaaattgcacctgtggctgtttcagatgctgctatgttggcacctgaggaggtatttgatgggaaaggtgatattaaggaagaaacagagcttacaaaggcagaaaggaaaacaaggagagctaataagaaaagaaaatttaaagctgaggcagtaaaaaggacgaataagaaggcacaagaaggggtgattcgtagcaaagttaatggcttctataaagttatggtagaagtcacatcccttatgagtggagcttgctttctgtcataa

SEQ ID NO: 242 - DNA, 171 bp, Glycine max
  Peptide Sequence Number=SeqID_91927
atgcaggtcgatgatggcgaggagaataaggtttttgtcatagcggaggatgtgcacggcgggcggcggtggagtgatgcgaaggaggagatgggtggtgtggaggagtggaaacaaaaccataaagggaaagataaagaggcgatagtgtggcacgtgaaagtgttctag

SEQ ID NO: 243 - DNA, 1881 bp, Glycine max
  Peptide Sequence Number=SeqID_91928
atggagcccctacgattgaagaccaactaccgctgcgtccccgctctgcagcagttctacactggcggccccttcgtcgtctcatcggactcctccttcatcgcctgcgcctgcggcgagtccatcaagatcgtcgattcagccactgccgccatacgctccaccctcgatgccgactctgaatccttcaccgccttggctctcagccccgacgaccgcctcctcttctcctccggccactcccgccaaatcagagtctgggacttgtccacgcttaagtgcgtccgctcctggaagggtcacgagggtccggttatgtgcatgacgtgtcacccttctggagggttgcttgctactggtggagcagataggaaggttctagtgtgggatgtggatggtggttactgcactcactactttaaaggtcacggtggtgttgtttcttgtgttatgttccattccgatcctgagaagcagcttcttttttctggcagtgatgatggtggtgatcatgcaactgtaagggtttgggatatttccaagaccaagaaaaagaactgcattgcaacactagataatcatagctcagcagttgtaacattgtgggatcttcatggttatagtggcaagaagactgtcattacaaatgaggcagttgaagctgtttgtgtaattggtgctgggagtccttttgcttcatctctcgatttatatcagcaaaatgcaaaaatacatgatggttccgaaatattctatttcattacagttggtgaaagaggcattgtacgcatatggaattccaaaggtgcaggttgcatctttgagcaaaaaacttcagatgttacagccggcatggatgaggatggctcacgtaggggtttcacttctgctgttatgcttgcctcagatcaaggattgctttgtgtaactgcagatcagcagtttctgttttactctctggacttcactgaacagttgttgcaattaaatctaaccaaaagacttgtgggatataatgaagagattgtagatatgaagtttattggggatgatgaaaaattccttgctcttgctacaaatcttgaacagattcgggtttatgacctttcatctatgtcatgttcgtatgtcttatctggtcacactgaaattgttctatgccttgactcctgtgtatcaagttctgggaaaccactgattgttactggaagtaaagacaacagtgttaggttatgggaaccagaaagtgcaaactgcattggagttggtataggtcacatgggagctgttggagccattgccttttcaaaaagaaagcgagatttctttgttagtggcagtagtgatcatactcttaaggtgtggagtatggatggtctcttggacaatatgacagtgccaattaatttaaaagcaaaagctgttgttgcagctcatgataaagatataaattctgtagctgttgctccaaatgatagtttagtatgtagtggttctcaggatcgtacagcttgtgtttggagacttccagatctagtatctgtagttgtatttaaaggtcataaaagaggaatttggtcagtagaattttctcctgttgatcaatgtgtagtaacagcatctggtgataagacaataaggatatgggctatatctgatggctcctgtttgaagacatttgaaggacacacttcaagtgtgttaagagcattgtttgttactcgtggaacacaaattgtttcttgtggtgctgatggcttagtaaagctgtggactgtaaaaactaatgaatgtgttgctacttatgatcatcatgaagacaaggtgccagttgatcctttgatatatttattttctgatgatttttctttcaattcttaa

SEQ ID NO: 244 - DNA, 2400 bp, Glycine max
  Peptide Sequence Number=SeqID_91929
atggcgcacacgggcagcaacagttcaatgcaccggtcgagttcacggcctcagctggatctgagcaaagcagaaattcaaggaaacttcgaagagaagtatccaaccattttgctacccaatcagtctcatgatatatctcacctcgctcttgatattggaggatctcttataaagttggtgtacttttcaagacaccaagaccaatcaacctatgacaaaagggtgaaaaatgtgaagaatcgactgggatttccacccaatggtaacaggagaagctatcctattcttggtggaaggcttcattttgtgaagtttgaaactagcaagattaacgagtgcctagacttcattagctcaaagcagcttcactctgctggtggggaatcacgttattctgatgccaggactgattcaaatgccataattaaggctactggtggtggggcacacaaatttgctgaccttttcaaagaaagactcggactgagtcttgacaaagaagatgaaatgagctgtcttgtagcaggagcaaatttcttgctgaaggcaattcgtcatgaagcttttacacacatggagggccagaaagagtttgttcaaattgacactaacgacttgtttccttatcttctagttaatattggatctggtgttagtatgatcaaggttgatggggacggaaaatatgagagggtcagtgggactaatgttggtggtggtacttattggggcttgggaaggctgttaacaaagtgtgagagctttgatgaattacttgagctgagtcagaaaggagataatagtaatactgacatgcttgttggggacatttatggtggcatggactattctaagattggcctatcggcttctaccattgcttcaagttttggcaaggctacctcagaaaaaaagggacttgaagattacagacctgaagatatatcgctctctcttctacgaatgatttcatacaatattgcccagatagcctacttaaatgcattgcggtttgggttgaagcgtatcttttttggaggattttttataaggggtcatgcctataccatggatgctatttcttttgcaattcatttctggtctaatggggctgcacaagcaatgttcttgcgacatgaaggatttcttggagcattaggtgcatttatgagttatgaaaagcatggtttagatgacctaatggtgcatcagttagttgaaagattcccaatgggtgctccatatacaggaggcaagattcatggccccccacttagggatttgaatgagaaggcaagtgagaggaattggaaaaccttgatgtttgctgtgcagatttcatggatggagaagtttctacaaaaggtaactgagatcactgcccctgtgccgatggctcctcctggaactactggactcgggggttttgaagttcctttgtcaaaaggaagtactctgcgatctgatgctagtgctctaaacgttggtgtcctacatctagtacccactttagaggctaccattgtctctagtgcttggcttctgtggctaatgcaaaatttgtatttgatgaaggtattggttcaagattttgtcagagcacttgccagatcttgtggacaaggtgggactgatgatgccaagagaaggggtgatgcttttgctcgtgcattttctgcccacctggctagggaaaatgaggcatcacttgctgtcctacctgatttgttgatggagcttgatagcatggatgaggaaacaagactacttactctcattgaaggtgttcttgctgcaaacatttttgattggggatctcgtgcatgtgtggatctctatcataaaggaactattattgaaatttacagaatgagtcgcaacaaaatgcagagaccttggcgtgtggatgattttgatgcctttaaacaaagaatgttaggaactggggacaagaaaccacccccacatagaagagctttactttttgtggacaatgcaggtgctgacattgttcttgggatgcttcccctggcacgagagctcctccgccgtggaactgaagtggtcctggttgcaaactcccttcctgctttgaatgatgtgaccgcaatggagctccctgacattgttgctgaggctgccaagcactgtgacattcttaggcgagctgctgaatctggtggcttgctggtggatgcaatgactaataccttggacagtcctagagaaaattcttcttctgttcccttgatggttgttgagaatgggtgtggtagtccatgtatagacttgagacaggtcagctctgagctggctgctgctgcaaaagatgctgatttgggatgggtagagctcttcataccaacctcaatgcccgatttcagtgtgatgctttga

SEQ ID NO: 245 - DNA, 804 bp, Glycine max
  Peptide Sequence Number=SeqID_91930
atgccaggtcctggtcctcacctcatgtatgccatgggttctggtttgtgtctcacaagcatcagcaatggaaggttcggtccccaccacacactcttctacaccatcaacgccttctttggccctgatgttggttccttcacggagtggcttggttcactctttggtggttctgctcatgctttgggatcttcccttgaagatctcattcaccatcccttcttctacatccttcttttaggacttcctctctcttttctctattctcggatatcctcctatcttctccacacgcagcttcttgattctgtctccagagttggtctatctctcttttttgtttcctctgttgtggaaaattcaggtttcaccgctggctcttttacccacttctttcttgatcatctgtttgaggagaatgggaaaacaaccacgtacacatggattttgagcactggctggtggcaaagtagagcaccagttaacccagatgctgttgttgtagttgtctttttatgtgcttgcttaattggtggctttttttacctcaacagagcaaatgcctcaaactccatgatgaaaaagtcatatcaatcaatgcttcttgtgatgtccatagcttgtttatactgcttatggtgtgcgattcagatatactggatcagtcctcctcgtccagccgttggtgaagaggccgatcttggtgttctcgtattcttagctatatactttttcctaccttatggtttgtgtataatgtccatgtccccaaaagatcatgatcctaatcagattcctctttag

SEQ ID NO: 246 - DNA, 633 bp, Glycine max
  Peptide Sequence Number=SeqID_91931
atggcttcttttcgcagatcaacagctctagcccagcagaaggtggcacgaagctcagatttgggcgttttgggtttggaccttgacgtgaaaataaggagcaagatttcttggaagcatgggttgggggagggacacgcaacaactccaacctccaaacttcgcctcaaacctctctcttctcccttttcaaccgccctcgaaaccctccagaaacaactcgggtacaccttcaagagcatcgatcttcttcgtcgcgccatgacacacgcttccttctccgaagaaaacaacaaagctttcgccattctcggcgccagcgtcatcgaaacctccgtctctttccatctgctctccagagacgttgatctttcttccaaagagctgaaccgtcgattgtcccaaatcaccaacgtcgattcctcctgcgccgtcgacggaacgcgattagggttgcacaaggtggttcgcgtctcgcccaagacaaattcctccgcccccgccgtcgtttgcggcgccttccgagcaatctttggcgctgttgctattgacaccggcaagtccgatgacgcaggcaacgttttctggaaccttcatggcggtggtgacctaggagttgccgtggctctttga

SEQ ID NO: 247 - DNA, 267 bp, Glycine max
  Peptide Sequence Number=SeqID_91932
atgggtgaggaggaggtggtggcagcgagaacagttgctggtggtggtggggcaggaggaggtggtggtggcaatggtgacagcaacaagccaacaatggtagtaatagtaatcagcagtggcagcaaccatggtaaaagggacactggtggtgacaagggtggcagctgcaatggcagtaggggcagcaaaaacaaggaaaataaatgggcaatgtggggtgaggtaattttgattcagagggtagggttgggaactgtgaattga

SEQ ID NO: 248 - DNA, 861 bp, Glycine max
  Peptide Sequence Number=SeqID_91933
atgggagtgagaagcaatttggtggaatggagtccattcatagcaatggtgactgtggagtgccttaacgtggggctgtccacgttgagtaaagcagccatgtcaagaggagtgaaccacttcgtccttgttgtctactccaataacaaggccatccctttctttctcgcttctctgcaagttcttcctcctcggcattctaggatttgcagcataactgtcatgcagaattgtgttttcatcggcattaactacagctctcccactcttggatccactatgagcaatttgtctccagcaatcacttttgtgctagcggttaccctcaggatggagaagttgaatattagaagctcaataagccagatcaaggtcatgggcgcagtgctgtccatatctggagcattagttgttaccttttacaagggcagttccatcagcacctttagaattcaaccatctttgttggctgaaaccaataactgggtcattgggggtctcgtctttgccatggcctctgtttcttttgcagcctggaatattactcaggctattgcgggaagtgttgtgacattttctgtaacggcatggtgcataaaaaggaaaggacctgtatttgttagcatgttcaagcctgcggggattgccattgctgccttttccagtgttgccttccttggtgaaacactccatgttggcagtatcattggcgcagttataatcgccatcggactttacacagtattgtgggcacaatcaaaagaggaaaacttgaaaggtctcgaagttgatagaaaaccatccccatctacccaaacaagtcctctactagagtcccaccaaagaaacattttagcataa

SEQ ID NO: 249 - DNA, 606 bp, Glycine max
  Peptide Sequence Number=SeqID_91934
atggcatcatttgcaggcactacccagaagtgcacagcatgtgaaaagaaagtgtattgggtggaacaactcactgctgacaacaaggtgtaccacaaatcttgcttcagatgtcaccactgtaagggtaccctcaagggtgtcctatactgtaagccccattttgatcaactgtttaagatgaccggcagcttggacaaaagttttgaaggtattccaagaagtgctagggttgaaagatctgctgatcaggtccaaagcaacaacaaggtttcaagattattctctggaacacaggaaaagtgtgttggttgcaagaaaacagtgtacccaattgaaaaggtggctgttgatggcaaatcctaccacaagtcttgtttcaggtgcactcatggaggttgtgtaataagcccatcaaattatgttgcccatgaacatcgtctttattgtagacaccaccatactcagctcttcaagcagaagggcaacttcagtcaattagacaagcatgacagtgtccaagtcgtcatcactgagaacacaacacaacatccggatccgagtaatggcaataccgatacaactccagctgaggaatctagttaa

SEQ ID NO: 250 - DNA, 621 bp, Glycine max
  Peptide Sequence Number=SeqID_91935
atggctgcaacagcttcaaggttcatcaagtgtgtgacagtcggggatggagctgtaggcaaaacttgcatgctcatttgctatacaagcaacaaattccccacggactatattccaacggtgtttgataatttcagtgcaaatgtggttgttgaaaacacaactgtcaatttaggcctctgggacactgctgggcaagaggattacaacaggctgaggccattgagctacaggggggcagatgtctttgtcttggctttctctttagttagccatgcaagctacgaaaatgtgttgaagaagtgggttcctgaactgcagcattttgctcctggtgtcccagtggtgctagttggcaccaaattggatcttcgagaagacaagcactatttggctgatcatcctggtctggcgcctgtgacttctgagcaaggtgaggaattgcgtaaactggtcggagctacgtattatatagagtgcagctcaaagactcagcagccgagttcacctggtgagacaagcttagttgttgtgaatatggttggtatatggcagttgggaaaaaagttaaatcagtatgtgaagggaccatactattatggtcctgaccataagtggtga

SEQ ID NO: 251 - DNA, 1620 bp, Glycine max
  Peptide Sequence Number=SeqID_91936
atgtcagccccaagtcaaacaattgtaataacagcgacagctactgcagccactatgttactttttgctgtgacatttttttacttccaaaaatttgttcttgctcgataccaccatcggtacatagttgcaacaagttttcttagagaagcaggattgaacaatgaggatataaagaaagttggtggcaatatgaaaggattacttgttgaagaaaatgggattgatattctgtatatgatggaaacagaaggtgggcaattcaaaactagatttccaaatggaagatacaatcctagttatgaagacgatgaagaaaagggaacagatataatggtccagagatccaaacgaattaagcctcaggatgttacagttccactgccttgtgaaattctagggtcagctaatgtaggtcattcaacagtgtgggatcagatcagtgatcgctcattctggaaatccgtgatgcactccatgttggccaagaacatactcagtgctgagacacttgaaaaactcgctaaaatagctcctacccaagaagaagccaaaatcatgcaattcagtgataatccggataaacttgttgatgctgagtcattcctctatcacatcctgagagcagttccaacagcattcattcatttaaaagcattgcttataagatcgagttacggttgcgaagttattcagcttaaagaacacctaaaaactcttgagagcagttccaacagcatcctgagagcagttccaacagcattcattcatttaaaagcattgcttataagatcgagttacggttgcgaagttattcagcttaaagaacacctcaaaactcttgaaatgggttgtaatgagatgaagactagtagtctgcttttgaaattccttaaggccattctcaaagctggaaacccaatgaatgttggaacttcaagaggcaatgctcatggtttcaacttaagtgctcttgaaaagctctctcatccggtagctcagtttgaagcaagacaacaagctagtaatcaaaagcacaaccttaacagtagcactggtgaaacaagcaacaccaatgaaccacattcagataaccgggtacaaaaagaggaagttaaagagtatctagtgttaggaggtctaagggacgagttatgtgaagtaaagaaagcagcaagcattgagcatcagaatttctctagtatgtactctattcccaatgcttatgttactaaaattcgacagattataacatgctttggcaacagtgagaggggtggatttattaaggtaatgaaagggtttccagaggaatgtgaagtggagcctaaggtggtgagagaggaacaagaaatggtcatggaactgctgaagaaaaccaatgagtattatctaacaggaggttccaaagataacatatcgaacccctttcaactgtttattacagtaaaagaatttcttgacatggtagatgaggtttgcaaagaacttagaaggcagctagaaaaaactaatgcaggaggagaagctgtatcaacaccaccactttcaccatcaaagagggcaccactcagattaacaaacttcaattacattttcggccaagcacgtcaggagtaa

SEQ ID NO: 252 - DNA, 1338 bp, Glycine max
  Peptide Sequence Number=SeqID_91937
atggcttcttcagatcccatctcttctcgccactacacttacaacagaaaacaaaaatctctaggccttctctgcactaatttcttgagcttgtacaaccgagacaccgttcacttgattggcctagacgatgctgccacccgattaggtgttgagagacggcggatctatgacattgtgaatgtcctggagagtatcggggtactctcaaggaaagcaaaaaatcaatacacatggagagggtttgccgcaatccctctcactctacaggatctcaaggaagaggggttgaaggagaattctaattccctacgtgggcctggaaaccatgataaagtttccgacgacgaagatgacgaggaaacacagtccaatcccgccgctactggaagtcaaagtgacaagttgaaccctaattctactcttcctaaacctctgaaaaatgaaaatgaatgcaaaaagaagaaaagatatggttgggatgctttcaaagaaaagaatattgatctaggatggagagttgtaagggaactgggacaccaccatctcaccaaatcatctgtgccgtttgttaaaaggttgctggcagcaactgtggtttatctttgttgctggcagcggcaccaactgttgcgttttgaaaatcgaagagaaaaatctctggctctgcttacccagaattttgtcaagctctttgtctgctctaatgtggaattgatctcccttgacgaggctgcaaaattgctacttggggatgcccataatacgtctgtaatgagaactaaagttagacgcctatatgacatcgcaaatgtgctatcctccatgaaccttattgagaagacccatacaatggatacacgaaaaccagcattcaggtggctcggttctgaagggaagacatgggatgagacacttcacaaatcaaacctaaacgactctaggaaaagggcgtttggaagtgatatcactaacatcagttttgagaggaataaagtggaattgttcacgagtggggacttgaatccgaatcctaagaagccaagaatggaaaatggtagtgggctgggtgaggcagacgaaaacaatttaaaacaaggcataaaacaagcttcaaagagctatgaatttggtcctttcgctccagcttgcgtgcccaaagttggagcctctcagaataataatatgaagcaggtgcatgactggggcagtcttgcaactgcacatagccctcagtatcaaaatgaagccttgagagaactcttctcccattacatggaagcatggaaattgtggtactcagaaattgctaggaagaggccattacaaattttgtaa

SEQ ID NO: 253 - DNA, 987 bp, Glycine max
  Peptide Sequence Number=SeqID_91938
atggaagaagaaaaagcagcggcatactacgacgagctgagccgtaagggcgagggagccgcgaggttcaagcaaggtctcggcttttcctcttccgcgccaaacgacgacgttccaaaaccctcctccttcctctccaaattcgtcaaagcctcctccactgcgccttcaaactctgagaagcaagcgcagcttcaatccatccaccacaagctcaagaaaaagccctcttccgagtctagggtttcgagcagcgatagcgatagaagtagaagacgaagcagagatagatacagggaatcgcggaggcgaagtaggagtagagaaagacatcggcatagggagagagggagacggaggagtagaagcgtttctcctcgcaagcaacgcaggtcggagaaagacgcgaacgatagagggaaagtgagtgaaacgaagaagaggaagaatgctgagattgattattacaagctaattccaggttatgaccgcatgtcatctgctgaaagagtcaaagccaagatgaagcttcagctttctgaaactggtaaggcaaaatatcttcaggctgcacaggattcagaaaagggtgagggctgggagcgatttgagtttaacaaggatgcccctcttgatgatgaagaagttgaagtttatacttttgcatcattgaatggtggtctttccttccagctatatttgcttgtaattggcattgctgaagatgatgcgtccttagtcaagcacattggccaaagtttcagattttctgcagttaaggcaagaagggaggaacaaatacaagctgctcatgaggaagctatgtttggtgctacagcacttctgcctcccaccagtacagacagtgagcctgaaagggataatgagaaggagactgataaaaaagaactggttacaagcctcttaagtgaaacagtgctggccaagcaaaatgggtcttggcgtgatcgggttcgtcaaacttag

SEQ ID NO: 254 - DNA, 291 bp, Glycine max
  Peptide Sequence Number=SeqID_91939
atgagggtgtcggatattcatcaaggaattggacaaatgatcaagggagattttgatgatgagtctaattggcagattgtggagtatgtctttgacaaactcaattctgaagggtgtggattgggaatgaggttctacaatgcactgttagaagctctttggtggatgttccagagagaaagggctgctagagtgctcaatgaagcatcaaagcgagggctgttccctgaactttttcgtaaaagaaaacatatactaacctccctcggtgttgaggcaattgacaaatag

SEQ ID NO: 255 - DNA, 645 bp, Glycine max
  Peptide Sequence Number=SeqID_91940
atggaacctcctctcatcaacgactccacattctcttccgctaacccttccttgtccgagatttggccctctcattttcccacagaccacactcccagtaacaagagacacctctccccctcgactgattgtggcagcaataaacatatcaaatcatcaggatcaggatcccaggatcaaaacggtgccttgaaggcgggtgaagtggacgcgacttcagtagccggtaacaagttacccgaacaaacggcgaaacctagttcttccgagcagccacctaagcaagactatatacacgtgcgagctagaagaggccaagccaccgatagccacagtctcgctgagagagctaggagagaaaagatcagtgagaggatgaaaattcttcaagatatagttcccggctgcaacaaggtaattggtaaagcacttgtgctggatgagataattaattatatccagtcactgcagcatcaggttgagttcctttctatgaagcttgaggcagttaattcgagattgagcatgagccctactattgaatgttttccttcaaaagaaaatacccaggaaatgcccagtgctggtttggtgtacatcgatgcaagctatgatgtgtatcgtacatggataaggaaagaataa

SEQ ID NO: 256 - DNA, 630 bp, Glycine max
  Peptide Sequence Number=SeqID_91941
atggtgactaatatgtgcttggtggagaagaagcaaacaaaggtaggctcgcttgctgtcttgttctctgtcgcaaactgggatcgctcaccagctagaccatgctacgagaaaagcagatcactgcactttctagcagtgctaggagttttctcattggtggttcgcgttgtaatgcagcagatggtagttcatgctcttgcacagaggatgaaacttaagccatcctccttagtatccaaagctacgtctgaagtggatgaaacattggtttcagcaaactcagtaagtgggccagcttgttgcaaggctgagggtgttgataaatctagcactattcagcaaatcgggtctgcttctagtccggcaagtaaaccagattctgtaacatatgcttgtgatattgatggtgttcaggaacatgttgatcacttgtctcctctcaatgctgatcacttgatgattaaggagaactttaccagtgttcatcccagaccctctgtttctactgattcgaagtctattagaaatacttacaccaccatggttggtatcctgggccgtactagaaggtttgatgtgataagcaaattgcaagaacagatcgtgtcacatactgtacattgctaa

SEQ ID NO: 257 - DNA, 1680 bp, Glycine max
  Peptide Sequence Number=SeqID_91942
atggaccttcagaacactgtgaaggaagccctaaatgcactgtaccatcaccccgatgatgcggtgcgcatgcaagccgatcgctatctccaggatttccagcgaactttggatgcgtggcaggtggctgataatttacttcatgatcccagtagcaatctagaaactttgatattttgttctcagaccttgagaagcaaggtacaaagggactttgaggagctcccttccacagcttttcggccgttgcgtgactcattgaataccttactgaaaaagttccacaaaggtcctccaaaagtcagaacacagattagcattgcagtggctgccttggctgtgcacgtgcctgcagaagactggggggatggtggtatagttaaatggcttagggatgagatggattcccatccggaatatataccgggattcttggagttacttacagttctaccggaggaagtattaaattataagattgcagctcgcccagaaaggcgacgtcaatttgaaaaagagcttacatctcaaatggaaattgctcttaatatcttgacagcatgtttgagtatttctgaacttaaggagcagtggtcttatggtgatgttttcatgttaaatggtcaggttcttgaggcatttgcttcatggcttcggctaaagcatgggattcctggatcagttcttagttctcatccgctagttctcactgcgttgtcaagcttgaattctgagttactttcagaggcatctgtaaatgtgatttccgagttaatacactacacaacagcaggaaacattgatggtgtttctgcaaatatgcccttaattcaagtcattgtacctcaagttatgaatcttaaagtccagcttggtgattctacgaaggacgaggaagatgtgaaggcaattgctaggttatttgcagacatgggtgattcatatgtggaactgattgcaactggttcagatgaatcaatgttaatagtgcatgcattgttggaagttgcttcacatcctgaatatgatattgcttctatgacttttaacttttggcatagtctccagttaaacttgactaaaagggagtcctatatttcatatggcaacgaagcatgcattgaagctgagagaaatagaaggctgcaggtttttcgacctgcatatgagtcacttgtatcgctggtgagtcttcctggttggaaacttgaagttggaactaacgtttcctctgaaactgtcaaacacccttgcagtgcatggtttccagctctcatgtgtgctaccttaaaatcagttatctttcgggtacagtatcctgaagattatcaagacctttcatacgaggatcttaaggaatttaagcagactaaatatgctgttgcggatgtattaacagatgcatcatcagtacttggcggtgatgccacacttaaaattctatacatgaaactgcttgaggctgtatctggccatggtaataatgaacacaaggaatggtgtccagcggaggctgctttattttgtattcgggctatatcaaattatgtgtcggttgttgaagcagaagtaatgcctcaggaatgcaaaattgtgagcaaatttctaaactgctgcaacccagccaagtttgatatgatcctcgataggagtcataatgtttttaaggatcgtccttga

SEQ ID NO: 258 - DNA, 243 bp, Glycine max
  Peptide Sequence Number=SeqID_91943
atggcatacaaggcgttttttctcctcggcctctttcttagcacattagcatcagttacttttgcggaagctgttgcagctattctggatgtttcttcactcaatcgaagcagcttcccacaaggcttcatttttgggacagcatccgcggcgtaccagtatgaaggtgcagcaaaagaagacggtaaaggagccagtatatgggatactttcacccacaaatatccagattcagttaactaa

SEQ ID NO: 259 - DNA, 249 bp, Glycine max
  Peptide Sequence Number=SeqID_91944
atgaccttatggcgagttgttggcttgaatggaaccctgcaagttgagcgtggattccaaggacaacatggttacctagtttcattttatggtaccgatggacaaaacaaaagctcctttttccctttcagtggagtaactgaagaattaaaggcttttattaatgatgtatctgaaaacaccctcaagggtgcaagagatgttgctgtgttagaggcaatgcttgaatccggagctaagaggcaataa

SEQ ID NO: 260 - DNA, 408 bp, Glycine max
  Peptide Sequence Number=SeqID_91945
atgcctttgtttgatgcggaggaaggggagggttgtgatgcagcgcgggatctcgccggatattcccctccagtcggcgattgtgatgctggagagacgcgccagcttgcagatcgccggcgagatgtagccggtcatgtagccggtgcggtgggcgcgctcgaagatcggctcctccgactcgccgcggaggttgatgtcggcgacgcggcgggtctcctggtcgcagctcacgccgtaccacttatggcagcagtcggcgccggtccaggagttgaagattccgagatagggctcgtggagcgccgtcctggtgtgtttgcttgggactttgggattctgacaatgctgaagaaaataggaggaacaactgaacatggggtagaagggaaatggtgtgacagatag

SEQ ID NO: 261 - DNA, 1455 bp, Glycine max
  Peptide Sequence Number=SeqID_91946
atggcagaaacagaaggaaaacaagaggcagtgttgttccctttcatggcccaaggccacataatcccgttcttagcattagcacttgaattagaacagagaaaaaagtacagcatcaccatactcaacacttccctaaacatcaaaaaactaagatcctctatcccaccagactccaccatctccctcgtcgaaatccccttcactccctccgaccacggcctccctcccaacacggagaacaccgactccatcccctaccacctcgtcattcgcctcatccaagcctccaccaccctccaaccagccttcaaaaccctcatccaaaacatcctcttccaaaaccaaaaacatcaacttttaatcatctccgacatcttcttcggctggaccgccaccgtcgccaaggaactcggcgtcttccacgtcgtcttcagcggcacctccggcttcggcctcgcctgctactactccctctggcacaatctcccccaccgccgcgtcaactccgacgagttctccttaccggatttccccgaagcgcgtgtcattcaccgcacgcagttacccaataacatttccgaagcagatggcaccgacccgtggtctgtgtttcaaaaaagtaatctttcccaatgggtcaactcggacgggattttgttcaacaccgtcgaagagttcgattccgttgggctgggctactttaagagaaaactgggccggcccgtatggcccatcggcccagtgctgttctcctccggctccggctccggctcgcgcgggaaaggcggcgggatcaacccgaatctctgcacggaatggctcaacacgaaaccctcgaaatcggtgctgttcgtgtgcttcggatcgatgaacacgatctccgctttgcagatgatggaattggggaaggcgttggagcggtgcgggaagaatttcgtttgggttgtgaggcctccgatcggttttgacataaattcggagttcagagagggagaatggttacctgaagggtttgttgaaagggttaaagaatcggggaagggtttggttgttcatgattgggcgcctcaggtggagattctgtcgcattttgctgtgtctgcgtttctgagtcactgcgggtggaactcggtgctggaatcgctgagtcagggggtgccgattctggggtggccaatggcggcggagcagttttataattgtaagttgttggaggaagaggttggggtttgtgtggaggttgcaagagggaaaagctctgaggtgaaatacgaagatatagtggcaaaaattgaattggtgatggacgagaccgagaaaggggttgcgatggggaagaaagcaggggatgttagagatatgattagggatgcggtgaaggatgaagatgggtttaaggggtcttctgttagggcaatggatgagttcttatctgctgcttttgagtcctga

SEQ ID NO: 262 - DNA, 345 bp, Glycine max
  Peptide Sequence Number=SeqID_91947
atggcatggagcccgtacgttgccattgctttttttgtcaattgctacatcatatttgtatcagtagagtatcaaacactaagtttgggatggaaatctgagttaacaaatgacgatgttaattcatctaaacaagccattcgaattctctcaggagttgctggactgtcaagtggaaaccactcattacgccccatttcagctcttgcagctatgatagcatccttgatggcaaataacacagcggatgctaggaaaaatggaggctcaccaacagctttagatgaatggatggccttaacatttggatggccctaccaattagtgcacacaacaataaacagg

SEQ ID NO: 263 - DNA, 1146 bp, Glycine max
  Peptide Sequence Number=SeqID_91948
atggcgttcccagctactattgttattcttcctttaggcattcttttcatcctttctggcttaattgtaaatataattcaggctgtcttctttgtccttcttcggccactatcaaagaactgctatagcagaataaacaaattgctcacagaatcactatggttggagcttatatggctcattgattggtgggctggcatcaagattgagctatacacagattcagaaactcttcaattaatgggtaaagaaaatgcacttgtaatctgcaaccacaggagtgacattgattggcttattggatgggtcttagctcagcgctcgggttgccttggtagcacagtagccattatgaagaaagaagtcaaatttcttcccgtgctaggttggtcaatgtggtttgctgaatatatatttctagaaagagactgggcaaaagatgaaacatcactgaagtcaggttttaggcatctagagcacatgccattccctttctggttggccctttttgttgaaggaactcgtttcacgcagacaaagcttttacaagctcaagagtttgctgcttcaaaagggctgcctatacctagaaatgttttgattcctcgtactaagggttttgtcacagcagtacaaagccttcggccattcgttccagccatttatgattgcacatatgcagttccaaagagtgaggcttcacctactttggtgagaatatttaaaggcatttcttgcccggtgaaggttcaaattaagcgtcacaaaatggaggaacttccagaaacagacgatggcattggacaatggtgcaaagacgcgtttgttgccaaggatgctttgctcgagaaatatagtactacggagatattcagtgaacaagatcttcaacaaatccgtcggcataaaacatctattttggttgtggtttgttggttgtgtctgcttggattccttgtttatgaattcttccagtggacctcactcctctcctcctgggaaggcatcttatttacggtgcttttcctgctcctggtcacagttattatggaaatcttcattcattcgtctcaatcagagcgttctaaaccccccatggttttaccaacacaagaccccatgaagcagaagcttcttcagacatga

SEQ ID NO: 264 - DNA, 798 bp, Glycine max
  Peptide Sequence Number=SeqID_91949
atggctgtggctatggctgcttgcagtcttggacttcacttgagtgctgacaacaccttgagaccttttgaaaaaaccactatcttgaaggccctctctatctctgatgctactaaaccatgttacatttctcacaaaacaagattatcatcttcatcttcaggaataacaatgatcccacgagcaacaacagttattggtactgtggaggatggaaatcaaggagaggctgataccattccaactccggtagttattattgatcaagactctgatccagatgcaactgtggtcgagataacctttggtgatcgccttggggctcttcttgacactatgaatgcgttaaaaaacttggggctgaatgttgttaaggcaaatgtctttctagattcttctggcaagcacaacaagttttccatcacaaaagctgattctggaagaaaagtggaagatccggagttgttagaggcaatccgtttgacaatattgaataatatgattcagtatcacccggaatcaagcgcccaattagctctgggagcagcttttggacttgtgcctccaaaagagcagacagctgatcggcctggattactggtggatcttgtaaagactattacggacattaacattgccgttgaatccggagaatttgacactgaggggctcttggctaaggcaaagtttcatgtcaactacaaggataaagccctcatcaagcctctccagctggttcttgttaacagcttgagatatttcttgaggcggcctgagactgaggaatccagtttttaa

SEQ ID NO: 265 - DNA, 1017 bp, Glycine max
  Peptide Sequence Number=SeqID_91950
atgactgaaatgaacggcgtttattgctccaccaggcccatgcgaattagtgccgctacgcccaagaagaccaccagtgcttatgctgcacccgccgcgcctgtgccgaaaccggtgtatccggttccggcctacactgcgccggttgttcaagttcaaccaccggagtatgatgtcaataatactgccatttttgtcggtaatttggatcttaatgtgtcagaggaggagctgaagcaaaactttctgcaatttggggaaattgtctctgtcaaagttcagtctggcaagggatgtggttttgttcaatttgggaccagagcatctgctgaagaagccattcagaagatgcaggaaaagatgataggtcaacaagtggtccggatttcatggggtaggactctaacagctagacaggacttacctggtggctggggaccacagatggatccaaatcaatggagtgcctattatgggtatggacagggttatgaagcctatgcttatggggctgctcatgatccctcattttatgcatatggtgcatatgctggctatgcacaatacccccaacaggttgaaggtgctcaagacctatcgggtatgtctgtgcctaccatggaacaaagggaggaattgtatgatcccttggcaatgcctgatgttgataagttaaatgctgcatacctctcagtacatggaagtgccattttagggcggattcaacatcttggatgcttcgatggctttaagggaatgaagaggaaaccctttgccttcgttgaggctcttgtgtgtgaaatcaaactccaaattgaggatttccttacacaaggtccacctatgctggatctagttgtatcatcaggcttcatccttggtttccttttctttgggaccaaagttcttaaggaaggtctcaacaaccaccatgaattcatggaaggcgaaaaatttggggagaatgtcatagaaggggtggtggccatagagaaacaacaagggaaaaaatattga

SEQ ID NO: 266 - DNA, 555 bp, Glycine max
  Peptide Sequence Number=SeqID_91951
atggtttggttggcagtgtctcttcttgcggatggtctggctgttgctgggcaggcgattcttgcgggcgcatttgctaataaggacttcgacagggccacagcaactgcatcacgagttctgcagatgggtttggttttaggattggcacttgcattcattcttggaataggattgcactttggtgctaaaatatttacacaagatgctaatgtcctccacctcattcaaattgggatcccgtttgttgcagtcactcaacccctgaattctatagcatttgtttttgatggtgtcaactttggggcatctgattttgcatattcagccttctccatggttgtggttgcaattcttagcatcatttgtctgcttattttgtcatccgctggtggtttcattggaatttgggttgctttgaccatctatatgggtcttagggcatttgctggcttcttaaggaccttgggagttcctaaggagctcatgactgcacatggcagacaccgtagttatagcttcatattaggcctaggtttcagtggtgtttgctga

SEQ ID NO: 267 - DNA, 321 bp, Glycine max
  Peptide Sequence Number=SeqID_91952
atggtagacaaagcgaacatcatgatcataaagaggaggaggaatagagggggaggatgccctacaaggttacagaaacatgcaccggcttctcttgacattgataaggttctcattgatcgtccttcaaacccttttggggaggcttcaagggcaataccattgttatctccactcgttctttctccacagccaatttatgcagatatcactattcaagttcgaacatcagagaagaatgagaataatggtatgaatgagggaggaaggactagcggaagtgtggacacaggatcagaactggctctgataccatcttag

SEQ ID NO: 268 - DNA, 3225 bp, Glycine max
  Peptide Sequence Number=SeqID_91953
atgttgtctgaattggggacaagaccgatgcttggtggtaacgaaggttcctttggggatgaactggagaaggagatagggatgttgcttcgtgagcaacgaagacaggaggttgatgatcgtgaacgtgaactcaatctgtataggagtggatcggcgcctccaactgtggaaggttccctcagtgcagttggagggttgtttggaggcggtggcggtggcgctggcaccgccgctggtgcggtgttttcggagttttctggggccaaaagtgggaatggtttttcttctgaggaagagcttaggtctgatccggcttatctttcatactattactccaatgtgaatttgaatccccggcttccgcctcctttgctctcaaaggaggattggaggtttacacagagactaaaaggtggagcttctgttcttggtggaattggagataggaggaaagtgaacagggctgatgacaatggtggcagatcactgtttgcgactcctcccggttttaacatgaggaaacaagagagtgaggtggagagtgaaaatccaagaggttcggctgagtggggtggtgatggactcattggtttgcctggcttaggtcttggcagcaaacaaaagagccttgcagaaatttttcaggatgatttgggacttaacgcttctgtcactggctttccatctcgtcctgccagccgtaatgcatttgatgaaaatggcgatatcatatcatctgttgaatcagaactggctcatttacgtcgtgattccttggccactgataccttaagatctgtatcaaatgtccctgtgtcatctgctgcccaaaatactggcccacaagcttcctattcttatgctgctgcactaggttcttccttgtcgcgtagcactactcctgatccacaacttgttgctagggctcccagtccctgccccacacctattgggggtgggagagttgtagctgctgagaagagaggtattaacagtcctgatgcttttaatggtgtttcatctggagtcaatgagcctgcagatattgtggctgcattgtctggcatgaatctgtcagctgatgatgtgttagatggtgatagccatttcccgtcacaggttgagtcagatgttgataatcatcagagatacctatttggcatgcaaggtggtcaggatcctggcaaacaacatgcatacttaaagaagtctgaatcaggacacttgcataaatctgcttactctgattcaggtaagaatggtgggagtatgtcagacatcaacaatccatctttggataggcatgctgagctacaaaagtgtgctgttcctcccaataactcatacttcaagggatcacctacctcagcttttagtggtggaggtggcgtgcctgctcagtactcgcccttagatggtactaattcagcatttacttactatggcctgagtgggtacgctggaaatccagcattggcatccttggtggctagccaacttggaactagtaatctgccacccttatttgaaaatgttgctgcagcatcagtgatggcagctcctggaatggactcaagaattcttggaggtggtttgtcttctggagttgctgctccatctgatgtgcatggtcatggtagaatgggaaatcaaattgcaggtggtgctcttcaggctccttttgttgatcccatgtatcttcagtatataaggtcatctgagcttgctgctgcacaacttgctgctctcaacgacccttctgtggacaggaactacttaggcaactcatacatgaatttacttgagcttcagaaggcttatcttgggacgctgctttcacctcagaagtcacaatacaatgttcctctgagtgctaaatcaggtggctccaatcatggttattatggaaatcctgcgtatggcttatcttacccaggaagtccaatggcaaactctttatctacttcgcctgttggatctggaagtcctattaggcacaatgacctgaatatgcgttttgcttctggaatgaggaatttagctggggtcatgggaccatggcacctagatgctggtaacatggatgaaaactttgcttcatcacttttggaagagtttaaaagcaataaaaccaagtgttttgagctttctgaaatttctggtcatgttgttgaattcagtgctgatcaatatgggagccggtttattcaacaaaagcttgaaactgcaactactgaagaaaaaaacatggtttatcaagaaatcatgcctcaagctcttgctttgatgactgatgtctttggtaattatgtggttcagaagttttttgagcatggacttgcatcccagagaagagagttagccaacaagctttttgaacatgttctgacgcttagccttcaaatgtatggttgtcgggtcattcagaaggccatagaagttgttgatctggaccagaagataaagatggttcaagaacttgatggaaatatcatgcgttgtgtgcgagatcagaatggcaatcatgtaattcagaaatgtattgaatgtgtccctgaagatgcaatcaactttattgtctcaactttttttgatcaagttgtgacactatcaacccatccatatggttgccgggtgatacagagagtactggagcattgcaaagaccctaacacccagcaaaaagttatggatgagattttaggagcagttagcatgttagcccaggatcagtatggcaattatgttgtccagcatgtacttgagcatgggaaacctcatgagcgatccgccattatcaaggaattagcaggaaagatagttcaaatgagtcagcagaagtttgcctcaaatgttgtggagaagtgtttgacctttggaggtccttctgaacgccaattacttgtgaatgagatgcttggttccacagatgaaaatgagcctcttcagcttgctcagtcaaggcttgaaatgccaatctttgtccaaataggccatgatgatcacatggcaatgatgaaagatcaattcgccaactatgttgtacaaaaggtgctggagacttgtgatgaccaacagcgagagctaattctttcacgaattaaagttcatttgaatgcattgaaaaagtacacctatgggaagcatattgttgctcgtgtagagaaacttgttgctgctggagagaggagaattgctgctcagtctcctcatcctgcttag

SEQ ID NO: 269 - DNA, 786 bp, Glycine max
  Peptide Sequence Number=SeqID_91954
atggctgttgaactacacacttcgcttccttctcacttattccctgacgacaaccacgacgtcgtttcgtcacagcataaccacaaagacgacatccaccacgcctcagctttaaacccgctccccgagcttcccatgaaggacaacgacgacgatttcatctccgagttaactcaccgcatggctcgctttttgcttccagatgacgacactttcgatttctcttccatcgatcttgattcgtcacgggactcaaaacaggggagtccagaaggttcatctcaggaggcatcagcgccagctacacctgaagagtgttgttggaagagcagctacgacatgtttggaacggttgaggagatgaagcttaacgaaacaggaaattccaacaacaagcttcttcgtagctccaatattgaactctattcttaccaatctctaattcaggaacagattcgagccattgaaatgtctggggtgaagccagagcatgtggtggtgtctccgaagcggaaacccagtacgcgtagagcgcagacatacgaggccaagaaaggaaacggacggagggcccgtccgtcacgacccggcccacagcaaggcggtgcggggatgcgggtcctgtttctgaaagggcccggttctagagctgggactggcgtcttcttgccgcgtggtgatgtagccactaccccatccgattcaaccaacaaacaagtagatccgcatggacctcttaatcttccgttccgaaatttcatgagtctcgcatctagtctcaactaa

SEQ ID NO: 270 - DNA, 1038 bp, Glycine max
  Peptide Sequence Number=SeqID_91955
atggcttcttccaacaaaatgaagatcatcaagtcaacgttccttgttttgtgcctcttagcctcgtcgttcctctgtccaatcaaggctcacggaggaagcggtgattctcatgacgatgaatctgatagcgaaggtttgcattctcggggtctgatcgtggtgaaaatatggtgtttgatcatcttccttgtgagcactttcgctggtggggtttctccttacttctaccgttggaacgagtcttttcttcttttggggactcagttcgctggtggggttttcttgggaacctctttgatgcatttcttgagcgattctgatgagaccttccgagaccttaccacaaaatcttacccttttgcctatatgctggcttcatctgggtaccttctcaccatgcttggtgactgtgttatcacttatgtcaccagcaatagcaagagggaagccaaagtggtggaactggaaggagggacaacaccaccccaagagcatgagcatgaccaagccagagatcattgcgcagtggcggagacaacaaaccctgtattattgaagacttcttctgttggagacaccattctactcatccttgcactgtgtttccattcagtttttgagggcattgcagttggagttgcaggtactaaggcggacgcatggaggaacttatggacaatatccttgcacaagatatttgctgctattgcaatgggaattgctttgctaaggatgttacctaagagaccctttgtaacaacagcagcatattcattggcctttgctgtctcaagccccattggtgtggggattggcattgccataaatgccacaacacaaggaagcaccgcagattggatgttcgctataacaatgggtattgcttgtggggtcttcatctatgttgctatcaatcatttaatatccaaaggcttcaaaccacacaagacaacacgttacgacactccctggtttaggtttgtcgccgtgctttctggtgttgctgttatagctgtagtcatgatctgggactga

SEQ ID NO: 271 - DNA, 297 bp, Glycine max
  Peptide Sequence Number=SeqID_91956
atggatgagaagagaaaggcatcaaagaaggacacaggttccttttcttccccagggtcattattctcaaggagcacctctacttcaaactctcctctccttagaagcttatctcaaaagagttcttcatcttcttccaaatgcaataataataatcttcctaggagcttctcacagaagaacccttccattggccgcaaatgcaccaaattagctaaggaacagaaagcaaggttttacatcatgaggaggtgtgttgccatgttggtttgctggcacaagcatggggattcatga

SEQ ID NO: 272 - DNA, 1863 bp, Glycine max
  Peptide Sequence Number=SeqID_91957
atgtcttgtaatttcttggtcgagttcaacatgaactctcttgtgcaaaactttagtggtcctatcacggaattttcaaatcagaaccaagtagagaaggggtttgactttgagtttgatgattcatcttcttccctttcttccggcgcaagctcaggtggagaatccacagaggtaaccaaatactccaaccaaatcctcagatacataagcgacatcctcatggacgaggaagacgacctggagcgcaaaccctgcatgttgcaggaatgtttgagactccaggctgctgaaaaatccttccatgatgctcttctccatcaaccttcttctcgtttccgtgatgaaagtgttagcatcacagactctgatgaaaattatggtcgcaatgctagcttcgagagcaacggcagctgcaccactgataattcatgtgagtctgtcttggtcaacggtgttggtgaatttgattcttctttcttacaactacaaacccctctagttgattccccacatgatccatctggggagtcaccaggtgttggcttttttcatgatccatttgtgaagtcacaagctgctggctattttcatgatggaacctggaatctctttcagtctcagagtcagaccaagaagccactgatggtggaagagggtttttcagcttcagcaccaagagaaaagagaagccatgggatggatgattatgcttttcatgaacaagaaggaagaagaggcagcaaggtttcagccgtcttttcggacgagtcagagtcaccagagatcttagatgaggtgctgctttgtcaatctggaagaagtcaatccctcctttgtgctgctgcagaaccatcacaaagtgttaatttaggagggccgtggcaagctttgaccaacggaatgcaaatgacttactcagccagattaggcaacactcttcagcttttggggatggactccagcgtttggctcattactttgccaatggccttgagacaagaggttgacaaattatttggcaacccagacattgttagtcttgtggaaaatgagggcagtgttcatattattgattttggcatttgctatggttttcagtggccatgccttatcaagaagctctcagaaaggcatggtggtcctccgaggcttcgtataacaggaattgaacttcctcagccgggatttcggcctgcagaaagggtcgaggagactggacgacgtttggcaaactactgcaagaagttcaatgtcccttttgaatacaattgtcttgcacagaaatgggaaactataaaacttgcagatctcaagatagacaggaatgaagtaactgttgttagctgtttctaccggctgaagaacttgcctgatgaaactgtggaagtgaagtctccaagagatgctgtgttgaagttgataaggatgatcaatccaaacatgttcatccatggggtggtcaatggcacttatagtgcaccctttttcctgactcggtttagggaggcactctaccacttctcatcactgtttgatatgtttgaagctaatgtgccacgtgaagacccagaaagagtgatgcttgaaaaagggttgtttggaagggatgccatcaatgtcatagcgtgtgagggggctgagagggttgagagaccggagacctataagcagtggcaggttaggaaccagagagctgggttcaagcaagtccgttttgatcctcagctggtgaatcatgaaaaggaaatggtgaagaaggaatatcacaaagattttgtagtggctgaggatggcaagtgggttttgctggggtggaaagggcgtattctgaatgccatttctgcttggactcctgcttaa

SEQ ID NO: 273 - DNA, 987 bp, Glycine max
  Peptide Sequence Number=SeqID_91958
atggggagggacccatcttctgccaccgtcgaggtgcaggttcatccgcgccgcgacaccatcgccggttgtgggcggaggctctctccttcaccgccgagcccccccgccgtgcgcgatcgtgacttcagcctcttcaagcgctggttcccatggctggtccccaccttcgtggtggccaacatcgtcgtcttcatcgtcacgatgtatataaacgattgtcctaagcattccttttacggttcctgcgttgcctcttttctcggaagattctcatttcaacctcttaaagagaaccctctctttggtccttcttcctccacattagagaagatgggtgctcttgaagtgggtaaagtgattcatagacaccaggtttggcgccttttctcttgtatatggttgcacggtggggttgttcatctgcttgccaacatgttgagtcttgttttcattggaattcgcctagagcaagaatttggatttgttcgaattggatttctgtatgtgatatccggttttggaggcagtttgctgtctgctctattcatacaagagggaatctcggttggtgcttctggtgcattatttggcttactgggaggcatgttatcggagctcttgataaattggacaatatatgccaataagtttgcagcgttactgactcttatagtcatcgttgtaatcaatttagctgttggaattcttccacatgtggacaattttgctcatattggaggatttgtctctggctttcttcttgggtttatctttctgattcgcccccagttcaaatgggttagtagtagacacaggaattctcactcttcagctgctgcaccttcggtgaaatataagcacaaaccttatcagtatgcattgtgggtcatatccttcatactactgattgccggggatctaattgcattgttttctacaatagggtatttacacaagattgggactttgatgcttgtttcctaa

SEQ ID NO: 274 - DNA, 1869 bp, Glycine max
  Peptide Sequence Number=SeqID_91959
atggtgttgcagaagaggttagactatagcttttatggctatcatgtgccaaccaagcgccgagctactcgatcagctaagaggagggctacatttcaaagaaggttggaagacaatcaaatgtgtgcatttgacttattggccaccatagctgacaatttgttgcaagagaaacagaatccaaccatatccagtgatagatcatcggaaaaggatagggatggattttctaaagtggaatgccaggatgcaaataaaccattcaaaactgagctttctgatgaagcaagttgtgacagaaaatgtcagcatgaatttgttagagaaggatgcccagatgcaaataaaccattcaaagctgagctttcagatgaaggaagtagtgacagaaagtgtttctctaatatttcttcacaattatacaatcaaaattgctgtttgaaggaactcctgcaacatgaaattgatggtcattcatgcattgcttctatagtaacaagttccagttgctcagagaagattgttgctgagagactggtggatggaaaaggccacaatggagtggaaaatttagcgagcaaagttgaattaggttcctctggatgtctagagagtagtggttgcaagttagatggtgatgttagtaaagtaaaagatggtaaggttgggaaggttccaattgatactgggactgggatgtgctgttttgaggatcccttggatgaaaaacctcctgcactgatcagttcatgtggcaatgccaagatgtctgggtatgatgacagcaagcctcagagctcattgtccaaaggttgtgacaatgtactagtagatagtagagatgatgacgaaaacttttctgggaaccagttgctaaataaatttaaaatctttgatgcagatcatggaacatcatccttgggacactctgcattacgatctagagattctcatgtgaagcttaggatcaaatcattcagagtgcctgagctttttatcgagattccagaaactgcaaccgtcgggtccctgaagctcttacaacaatttgctctgcagaggacagtgatggaggcagtgactgctgtacttggaggtggattgcgcgtgggtgtgattctccatggaaagaaggttagagatgacagtaaaactctacttcagactggaatttctcatgataaccacctggatgctttgggctttgccttggagcctaattgttcacaaaaccgatcatctgcatgtgctacaacagattctctctgcgttcctggtgcagatatgcatcagcctttaatagggtatccttcaagtcgtgctgcaattcatcagaggattcagggcttttctaacatgttagctgagcatcaagcaaccggtttaggtaaccttgttgaaagtgatcatgactcagcaccttctccaatcaacacatcaggtgaaaaaaatttgacagattcaaaagaacttattactgttcctgaaatgggtatggaggcactagctgtactacctgtgcatcagaagtcaaagcgaactgagatcgcaccacgccgaattcgtaggcccttttctgttgctgaagtggaagcattggttcaagcagttgagaaacttggaactggaaggtggcgtgatgttaaacttcatgcttttgataatgcaaagcatcggacatacgtcgatttgaaggataaatggaaaacactggtgcacacagcaagaatatcacctcagcaaaggaggggagagcctgttccccaagaacttttggacagggtcctaactgcccacgcatattggtcccagcagcagactaagcaacagctcaagcaccactctacaaaaccttgccttctcctttaa

SEQ ID NO: 275 - DNA, 261 bp, Glycine max
  Peptide Sequence Number=SeqID_91960
atgaaacgggcttctgaaaaatccggccaagccgtagctgctgaagataacgtgaaaaacaccgagttccttggccacgctggctgtccatccgaagatgtcggctatgatgcaaagttgttgctgatggacgatggctggtctcatggtaggcgatgctatctgtggtcggaggaagtgaaagggatttcgaagaagacgacggaggagtctgggctaatgccacgaaaggagttatcagttatgtggccttgtgcatga

SEQ ID NO: 276 - DNA, 270 bp, Glycine max
  Peptide Sequence Number=SeqID_91961
atgaaccatgtacacttgttcccggcttatcgtggattgatggatgtggataaagctcaggctgatagcctgtgtaggtatggagtcaaaacttgtcatataatggggtacatcgtgggtcaaaagggtagatatgatgctcttggttttacaagggaagatttatacaactattttgatagccttatccatgctcagattaaagatggggatattgttgcttcgttaagttatcttgatgagatgtcagacactgatcccatgctatag

SEQ ID NO: 277 - DNA, 879 bp, Glycine max
  Peptide Sequence Number=SeqID_91962
atggatattgagatggatgcaaagggtgcgttttattgggggtgctggaagaccccttgtgccatgcatgttgcaaacaacactggaagagggggtgtgaatagggacatagaaagaacaacaacaagtcgtgagccagagatggagttggatttgctgcacaagccctttggagaagagggtactgttgagtcagagttgatgaggctgcacaatctggctggcccaccaaggtttctcttccccatcaaagaggaaactaaagaagatttggagtctgaagataggagcagaaaggggtcaagaacaaggagtttgagtgatctcatgttgacaattgacaccccctttcttacccctgtggcttcctcgcctttgaagtgttgttctttgcctttggaccctcttcattcttataagcatcaaggattcaaccctctctttgaatcctccgtggaattagagtacaacaggtttagatcttcgccacctccgaaattcaagttcatgagggacgcggaagagaagttgcataggaaattgatggaagaggcgaggagaaaggctgtggataataataatgtccaagaatgtggggttaaagattgttctaatgaaacattggccacagattttagagatgggtcctttcttaagttcattcaaacaacagaacacaaacagcctcaacaatatctaccacagtttccttcaggttcatctcagattctcccattggcatcttctcctacaactttgagaccacttgaaaaggcatccatttcaatgcttaatgctaacgcagttagcaaaagtggtgtacagataatgaatttggaatcgcttgcagaggttattgaacattgtaggaaggcttga

SEQ ID NO: 278 - DNA, 750 bp, Glycine max
  Peptide Sequence Number=SeqID_91963
atgagctttccacccaactacccaaatagtccgccatcagtgaaatttacctcagagttatggcatcccaatgtgtaccccgatgggcgagtttgcatatcaattcttcatccacccggtgatgacccaaatggttatgagcttgcaagtgagcgctggacgcctgttcatacacattgcattaacgatagctcacatagtcatagtaggatagagctttccataccatgcactgtcaatgagaagggaaatattagtctactagtagagagtatagtattaagtatcatatcgatgctttctagtcctaatgatgaatctccagcaaatgttgaagctgcgtcctatcttatggctacttatttgcatcccagagaagaaaaggccacaaggcctgcacttgccttgacctgttgctctattttgtcctgtgccgcactgccttatcctgtccttggtgagcagaaggagtggagggataggagagatgaattcaagaagaagcttggattctcatcttccttttgtgaactgaaggatatacaacttaatgtatggattggttcacctgttactgttgatcctagtagactgccatttgtcttggaaaaacaaattgtattgcttctttacctgtacatggctgttttgcctagcgctgcattactttggttacttaaaagggatgacaacaaggctactacgagtaatagtcactcagtacttatctcgtcagacaaatacccttag

SEQ ID NO: 279 - DNA, 351 bp, Glycine max
  Peptide Sequence Number=SeqID_91964
atgaaccaaggaagtagagacaagaatctaatgggcaagaatctctcaaatacgaagcaacccaaaacgccatacacagatccaaacacggttccttgggccttaacatttgctgctctaaatgtggcttgggtgttgctaggtgcacctagcattttgcttgtgcacccagcattgaaagaaaattttaaaaatgtccttaagcgattaaacaatctggattggagaaagagggttatggtttttgcattggattcgggaacagttagtgaaccgccacgtaacatgctcctcgaggctgttaagaacatgtttaaggtcttggtcgagaaaattgctcattgggaatga

SEQ ID NO: 280 - DNA, 978 bp, Glycine max
  Peptide Sequence Number=SeqID_91965
atggatcaattacgtaataatgtgaatgctaggtcgttgcccggaagcaacgcgctgtatggctcgagtacagtgtcaaaagatagaagtatgaagcttatctgcttggccaaaacgtttatcaactgccagttatattttgagtgcatactgttgcttataagtaatcatcacttgcttcaattttcctttagggaacttttacacacaagaaatcgacaggatgagacatgtgaaagattgaatgctgttctgcgagactcgtgtatcagctgtgaacttcaattggcaggtccagaatatgagtataatcagggtatctcttctctgtctcctgcattagctgaggagctatttcgatgtgagttatcagataacgaagttcgtgctcaagctcttagccctgatatgacaaagttgaagaaaaccaatgtaacaatggacaattccttaagcccagctcacacgctagttcaaatacgatgtgctgatcacaagggtcttctttatgacattatgagaactttgaaggacttgaatatgaagatttcatacggccgattttcacccaattcgatggggtatcgtgatttagatatatttattcagcagaaagatgggaaaaagattttggatccggagaagcagagtgcactctgctctcgtttgaaacaagaaatgcttcatccattgcgagtaatcattgcaaaccgaggaccagatactgaactgttggtcgctaatccagttgagctatctggaatgggaagacctcgagttttttatgatgtcacatttgctctcaaaacagttggaatttgtgttttctcggctgaagtaggacggcattcaacttcagagcgtgaatgggaggtgtacagatttctcttggatgagaactgtgagtttcaattaacaggtgttgctgctagaaataagattgtaaatagggttcgaagaaccttaatgggttggtaa

SEQ ID NO: 281 - DNA, 252 bp, Glycine max
  Peptide Sequence Number=SeqID_91966
atgatatgtgttaacaccaagaatgcccaggtggtctcatcctttgaggttattttcttctggtgttcagatgaaaagaatccgagagcaaaaccctacactttttcaaatcaaaagctgaaagatttgggattggaattcactccagtgagtcagtgtctatatgaaacagtgaagagcctgcaggagaaaggccaccttccagttcctgcaaagcagcaggaagaagattcaactaccgtgaaatcctaa

SEQ ID NO: 282 - DNA, 294 bp, Glycine max
  Peptide Sequence Number=SeqID_91967
atgaagcgatgggaaatcagactcaaaacaaaaatccaatttcaggaagaaagaaaaaaagaggatcggaggttggagaagaaggaggaagtggatgttaccagagagaccaagggaaagtttggtgatgagagttccggtgatggcgaatccaaccaagaagggccaattccgcttccattctctcttgaagaaaacaggccatggatcgaacagtctcattttttctgcacttctctctctctctctatgtgttcttcagcctttccttctcaactcaactccgagatctaa

SEQ ID NO: 283 - DNA, 1164 bp, Glycine max
  Peptide Sequence Number=SeqID_91968
gaaaagatcatgagagtgccgtatggagcagaaaaggagtatttcaagcattcactgtttcttgttttctgcaaccgcatcacaacatctgctgtttctgcttgttctttgctggcaagtaaaaaagcaatggacccagtagctcccatttataagtattgccttatctcggtatcaaacatactaactacaacttgccagtatgaggccctcaaatatgttagttttcctgttcaaacccttgccaaatgtgcaaaaacgataccagttatgtccaataatctttacctcaagtgtaagtctcttccacatgatagtctctccctcaagcagaataccttgcaccgtcgcaacacttgtggacccactgtttggcctcaaccgtcagaaagactttcgatacaagagatctccatgtccatggatccatcactgtcatttactcgtctgagccggtcaccaaatcaaatcatcagctctgataccaattgttgggaaattcgaggggtctggggtgccctcattatgcagaagagataccagggacctgactatttgttggcttttttaattacccttggttgctcagtatttatcctatatccggcaggagcagacatgagtccttacagtagaggaagggaaaatacagtttggggagttctcctaatggttggctatcttgggtttgatggctttacaagcacattccaagataagttgtttagaggctatgacatggagatacataatcagatattttacacaacattgtgctcttgtattcttagcctgacaggtcttatcttacaaggacatttaataccagctgtagaatttgtttataaccatcatgattgtttctttgacatagcattgctttctactgttgccacagttagtcaattttttatttcatacacaattcgcaccttcggtgctttgacatttgcaaccataatgacgacaagacagttggtgagcattatgctgtcatgtgtgtggtttgcccatcctcttagctgggaacagtggattggagctgtcattgtctttggctccctttatggaaaaagcttctcgaggaaaatgcctcaaaagacaacctcctccataacacttgttcaaaagggggatccaaataatttgaaggacaatccgtga

SEQ ID NO: 284 - DNA, 567 bp, Glycine max
  Peptide Sequence Number=SeqID_91969
atgtcaaactctacttcatcatcatcacagttaaccacccttaaggaggaactggagatgtttcttgcgactctgcctaaattaacaaatgaagagcacgaacaatggtgcgaaatggcgaagatcacgttgaaggtcgtggttccaccagatactattttaaacaccgttagcgccaaggaccagatttacggtgaagttagtttgtcatttgttgtcaggtggaaggacgtacttgaccgcttacgacgtttcatcaacgaggatggaaattttcataccgttgtctacaatcaagatttggacaaactagtcattgtagcagggtggacaacactaagagatttttatcacgtgaccgcatatcatcaagtgtcgttaactcattatggtaagaatgtgtatctcactccgcagaaagttagttgcagcagtctggacgttccaaacaccatgtattattttcttaaagataaaggctggactcattcgtatttggatgacgttgcagaatgttggcttgtgttcaatcactggagaaagacacttaaaattggagctggatga

SEQ ID NO: 285 - DNA, 186 bp, Glycine max
  Peptide Sequence Number=SeqID_91970
atggttttcaatttgccaaatgccaaaactgcaagtgccacactgaagtaccattcctcatccaaagaaatggtttggttagtcatggccgtaaagtctatgagggagctagatgaggacgttggggttaaagacgaacgggaagccatggaaggatcttacaggaagccagaaagaatactgtaa

SEQ ID NO: 286 - DNA, 642 bp, Glycine max
  Peptide Sequence Number=SeqID_91971
atggaacttatacgggtgccacattcatatattggtaatgaaagtgaggtcaaatatagcagctactaccctacaagccctcaagactcgagagaacagaggatgggcttgaaaaattcatcaaacatgggttcagtctctggtcaccttgcattgtggtatatgggtagtgttgagaatgctgtgatgaagactagaatatggctaggaacgtttgaaacggcagaggatgcagctagagcgtacgatgaagcagcaaggttgatgtgtgggccaaaagcgcgcaccaatttcccttacaatcccaatgagccacagtcatcttcatcgaagctcctctctgctactctgactgcgaagctacacaagtgtcacatggcctctctttcccttcaaatgagcaagcagaaacaatctcagacagagcctcatcaaggatcatccaacgactcaggcaattccattgcgggaacaagttcagataacacccagtttagatggccagaagaggaaggacaagttgaactgctagaacaacagcaacaatttcagccagttcttcaagatgatcacattgaacagatgatacaggagcttcttgattatggctcaatggagattagttttgttcactcagcctaa

SEQ ID NO: 287 - DNA, 768 bp, Glycine max
  Peptide Sequence Number=SeqID_91972
atgacattatcaagctggatttgtgttaataattcaaagaccatgcttctccagattgtccatcctggtggccatgttgaactccatgacagaccagtgactgcagctgagattatgtgccggtatccaagatgccatgttgcatatccatatgtgttccagcaaccatgggcggttgttgaaccagagacaatgctcatgcttggacaaaagtactatgtagtaccaaatagcacaataagaaagcttcaaaggctttccccaaggagctctccttctccttctccttctcctgctcctgcttgcgaaattgaaatcagttcttcagttgatgaaattagaaacacacaatccagcaaagaggaagatgatgttatgctctccacttgttgtgtcttcaggaataaaagcagtgcaaagcaatccaatatctacaagcaatattccaaaaataagagcaagaaatctgaaatcagagcagatgtaagaaatttgagtctaaatattaataatgataagaatggtggtttatcacatgatagttgtttcgtgagtatgtttattggaggcaggactaaagcaaatgctagtgatatggcaaaagaaacaagaacatcatcaagcagtgctcacctttgtgatggcaataatacattaaccaggaagaggacaaaagatttggcagggaatggtttaagaagctctcctaagaatgtatggtcttctgagcattggcaaccaagtctagagagtatcactgaagaatga

SEQ ID NO: 288 - DNA, 348 bp, Glycine max
  Peptide Sequence Number=SeqID_91973
atgacaaagacaaagatcaatgtcatagagaagttgaataactcacccagcaaagatccatgcagaaaagagattgacgatgaagaggaacgaggtgattccgctgattgtaaaactcctttgaacagaaggaatcagattatgctacgtcaggattttgacaatcttgcacatgacgtatttgctctgtactgtactggggatcaaatccacttggacactcagacaatacaggaaattaaaagtttcaatttccaacatctgaatcaaatggcatggatggaactatcaagtacagctcaagaaccagatgaaatcgattctgttctttttttcaaaacatactaa

SEQ ID NO: 289 - DNA, 912 bp, Glycine max
  Peptide Sequence Number=SeqID_91974
atggaggagaatccatgggggagttggtctgccgatatggaagtggatgacgaggttgtgaatgaaagtttgtgccacacgaacctttttgatgaagagttcctaagagatattctgcaacggccacaagagggtgctccaaatcttaacaactcatccatcatgtcgtctctttgtgctcaagacattaagccaactaccttatttccaaccacttacatactctctttcgacaattccgctgcattgttaccaacagaaactgatcgtgatttttcttcttccaaattgccctcatcaaattcaagggccaaccatggaatcaagaagcctggaagcgcttcggagtcactgaatcacatcatgtcagagagaaataggaggcaggagctcaccagcaaattcattgcacttgctgccactatccctggcttgaagaagatggacaaggcccatgtactaagagaagctatcaattacgtgaaacaactacaagaacgtgtagaagagttagaagaagatatccagaagaacggtgtagaatcagagataaccataacaagatctcatctctgcattgatgatggcacgaacactgacgaatgctatgggcccaatgaagcacttcctgaagttgaagccagagtcttagggaaggaagtgttaatcaaaattcactgtggcaaacattatggaattctgcttgaagtaatgtctgagctcgaacgtcttcatctctacatatccgctagcaatgtcttgccttttgggaatacccttgatatcaccattattgctcagatgggtgacaaatacaacttggtagcgaaggatctagtgaaagaactgagacaagtggctatgatgaagtcattcaataaaaagatagagactatgtttgctcggcgttag

SEQ ID NO: 290 - DNA, 2658 bp, Glycine max
  Peptide Sequence Number=SeqID_91975
atggcggcttgtctgcaactgtggcaatgcaaactagcgagaccctttgactcattaccggtgcgaaggtcaattcctttgagtctgaggtgttcggccgcgccctcttcttccaagccgacgcgctcctacagcatcactctcatccccggcgacggcatcggccccgaaatcatctcggtggccaaagacgttcttgtcctcgccggttatctcgaagggattaaatacgacttccgcgagatgcttatgggtggagctgcattggatgccacgggactccctttaccccatgaaaccctttctgccgctaagcaatctcatgccgttctccttggtgccgtcggaggttataaatgggataggaacgacaaacatctcaagcctgagactggcttgcttcagatacgtaaagagcttggagtatttgcaaatcttagaccggctaccgtatactctccgttagttgatgcttctactttgaagagagaggttgctgaaggggttgatatcatgcttataagagaactcactggagaacccaggggctttggcaccaatgataatggtgaagagattggctttaatactgagatttatgctacacatgaggcatcaatgttatggaggaagagatttttggcaatagcacaagaatatcctgatgttgagctctcacacatgtatgttgataatgcctcaatgcaactaatccgcgatccaaaacagtttgacaccatggtgacaaacaacatttttggcgatatattatcagatgaggcttcaatggtcactggaagtattgggatgcttccttctgctagcctgggggcttcgggacctggactttttgaacccatacatggttctgcacctgatattgctggacaggacaaggcaaatccatttgccactgttcttagtgctgctatgcttttgagatatggcctaggagaagaaaaggcagctgaaagaatagagaatgcagtgatggacactttgaacaggggatttcgaactggtgacatatattctgctggaacgaagctggtaggatgcaaacagctaggtgaggagatactgaagtcagttgaatctaacgttcctgctggtgctgctgcaggatgtccgatgaggaacctagcgaatcctccttctccacctctctcttctggaaacgacactccttctactctaccccctctcgtttgcgttgtcggcgtcccaaatcacatgacctatgcggatttctgccagttctgtggttccttcattcaacacatgctagagatgcgcatagtctgggaagggatgtggagttcaacttcaagcacagcagcgattccctccgacgaggaacctagcgaatcctcctcctcgtcctccttctccacctctctcttcaatttctcttctggaaacccgagaatcgaggagacccgtggcctcatgcatctcttcccagacgacactccttctactctacccgttggacggaagcctctcgtttgcgttgtcggcgtcccaaatcacatgacctatgcggatttctgccagttctgtggttccttcattcagcacatgctagagatgcgcatagtcaggatggatgggatggaggatcagtacagtgttttagttcgctttgacgatcaagactccaccgacagcttctacaagcactacaatggccgccgtttctcttctctcgaggttgaggtttgccgtgttcttttcacattagacgtgcagtacactggctccattgaacatgcacaaccctccaatgctacttcaactgaactgcctacttgtcctatcaggacaccggtggaattcttacaactatatgcaaccattctttccattgttcctgtatttctaaatgggcagattcttcttgtcctgtatgccgctattgccagcagcaagctgaaaaatctatatgttttgtttgtcaaaccactgagaacctatggatatgtgttatatgtgggtatgttggctgtggaagacaactatgttcatagacttattcagtccaaaactgatgggaagttgattgagctgaacactcagtgtgcgcatgcagacaatggatgtggaagttgcagctgtgaagataatgccatgaatgaggctatacttaatagtaaagttgaagctattgtcaatgagtacaatgaattgcttgctactcaacttgaaaaccaaaaattagtaagtgtacttcatttgtcccttgctgtgaatctgcaaaacattgcctccttaaaagaagaatctgagagaaaaatttccaaagctgttcagaaggctatcagtcttaaacagcagaagattcagtccaagattgacagatgtaagaaagagaagaaatttctggatgatcttaatgagaatcttgtgaaaaatgaggacatttggaaaactaagatacttgcgattgaagagagggagaaaaaaaccacgagactgatgggtgatagagtagcggacctggaaatgcagcttggtgatctcatggtttgtcttgagggtgggaggacggtagaacagctggcagcttcagatgagattaaagaagggattatcttggacaaatcaatagaatcctcgacaactagtggctctgacctggtgggaagagacgcataa

SEQ ID NO: 291 - DNA, 1890 bp, Glycine max
  Peptide Sequence Number=SeqID_91976
atggaaggggacggttgtaatgtgaagatgttggttaaaattcacacaaattggtttgccccatttgcgttcccagtccgactggcacacaagattgagggttgttttgagttgagtaagtacgtgttattcacgcgtcctcccatatcttcatcatttgaagtggataacgataaagcaagaaaaagaagatcaagttggcgttgtggttgtggttcggaggaagctcgtagggccgtttcaagttaccttggagaattgggggtgtcggaggaggattcggtgtggatctcgtcaaagtcaccggagtacgtgaagatgttggtggaaggtgtgagggatttggagcagtggcaaattgcgcttgctgggttgagcttcaaggacaagattattcatatcgccgctcaaaaaggggacaagggcaaagttgcctacttagagagtctgggctttactctctcttcctccatgaacattgccagatatctcccctctgacactcacactcttccatctctcatgcacaaggttactcgtatcaagcaactcttgttcttttctcccactcccgaccatcacttgcttatcaaaagcattcgcctcatgatgcgccacctctccatttcaattgatgaagaccttcaacacactctgtcctttttcgaaaagctccaagcaaagcctggtggtcttggcattttggcttacaagaatgccgctttccgttccttaatcgaatcatttcctcgtctacttcagttatcagtggacaaccacttcacacccatactccattttctccacaattttggaatccccacatttcgcatctcaaacataatactggcttttcctcctcttctcttctgggatcttcaactccttcaaactagactcctcgtcttcaaggagattgacctgcctgataaagattatgctaagctgttgctaaaatatccttggcttctatctacaagtattcaagaaaactatacggagctccttgccttttcatattctatcaaggttccaaagacacagatagaccgtgcaattgaaagccaccctcatctattgagttgttcaactagcaagctgaagtcaatggtggatcagtttgctgaactaggagttcgaaacaaaaagttaaatcaggttattgctaaaagtcctcaactactattgcggaagcccaaagactttctacagacacctcaaggaaaagcttgtgtcttgttgctttgggtcaaacctcagtttgagcatttcaaacatgaaacattcgttgaaattttgcacaaggtaggcggcttgtgcacgatctgcccttcaagcccaaaggggtcttgtgtgagggagcaaattaaagaggcttatgatggaagggtgtttggtcttgggaatttggggtatataaacattactttggcggcaatgtggctatgcattaataaaactctacaaaggaagattgagttccttggtagagttggtgtttctaaaactttccttcctggggttatcagaaagtatccagaattacttgtttctgacattgacaaaactttgctacaaaggataatgtacttgatgaagttaggtctttcagagaaagacattgcatatatgggggttcttaggccaaaaatagaattccttgtgaactcaatggagaggccagtaagagatgtggtggattaccctaggtattttagctattcactagagaagaagataaagccaagatattgggtgttaaaaggaagggatatcaaatgcagcttaaaggatatgctgggaaaaaacgatgaagaatttgctgctgagtttatgggtattggaaggatgctcgtctatcctcctgtgtcgtctaatgatagccagtaa

SEQ ID NO: 292 - DNA, 324 bp, Glycine max
  Peptide Sequence Number=SeqID_91977
atgggtggggtgcccgtggccttgatagtgctcagatggtgcagtgatgatcagatctggagtggtgcggcggttgagttgtttggggaagaatgttcagaaagcgaacccatcttgaatcatcaccatcttcatttgccaccacccggagaatcctccttttcctgtgaaattattcctatttctgctgctgcttccggcgatgatgatttacaaaacgttcgggttgatgagacttgtcatctcgtaaatgcagatcagccacaatgccgaatatgcctcgatattggaggtttattcacttattcatatccattcccttag

SEQ ID NO: 293 - DNA, 399 bp, Glycine max
  Peptide Sequence Number=SeqID_91978
atgcttagtggtgatattgcacttctatctataaggtctgatgttaatggattttataatttacagttacgaaaaatgcttgatcttcttgtgcatgcatctcaatgtcgttctgcccactgccaatatccaaattgtcgcaaggtgaaggggcttttccgtcatgggatgcattgcaaaatccgtgcctctggaggttgtgttctatgcaagaaaatgtggtatttgcttcaactccatgctcgtgcttgcaaggaatctgaatgccatgtaccacgttgcagagatttaaaagaacacttaaggaggttgcagcaacagtctgattcaagacgaagagctgctgtaatggagatgatgaggcagagagctgcagaagttgccaacagttctggatga

SEQ ID NO: 294 - DNA, 558 bp, Glycine max
  Peptide Sequence Number=SeqID_91979
aagacgagtgcaggaggtgccggaaaaaatggggaaaggagactgacggcgagacttccggaagaagtgttccggaaactttccggaagaacacttcttccggaaatcccaaacgtttccggaagaaaccttcttccggaaagtttccggaagcagggttcttccggaaaacgtttggtttcttccggaagaacacttcttccggaaagtttccctaacgggtcttccggaagtctcgccgtcagccccctttccccattttttccggcacctcctgcactcgtcttctaccctatgcctaatgctacaactacacagtgcataataaaaccaaatggaaggttaacgaaacttacctcgaacggcaatggcgtccaggcgaaagaagcagcagctgggctcgcggtggcttgcggtggaagagaatgctcccggaagaggaaagaaaagaaacaaaagcactgggtgaaagtgaagagaatgctcccggaagaggaaagaaaagaaacaaaagcactgggtgaaagtgaatccgggagaaaagagggagtcttttaa

SEQ ID NO: 295 - DNA, 1707 bp, Glycine max
  Peptide Sequence Number=SeqID_91980
atggccgttacaacactctctctgctcccaccctccactcgtccctgcttctgcggcaccgtccatctccgctcccacaacagcttcctttccatccattctacttcttcttcttcctttctttccttctcctcaatttcaattcccaaccactctcccacgcgccgtcccttccacactgtcctcgcctcttcctccgactactattccactctcggagtccccaaatccgccaccggcaaggaaatcaaagccgcctatcgaaggttagctcgtcagtaccatcctgacgtgaataaggagcccggggcaactgaaaagttcaaagagattagtgctgcctatgaggtgctatcagatgataaaaagagggccttatatgatcaatatggtgaggcaggagttaagagtgcggtcggaggaggatcaagtgcctatacggcaatttttggaaaagagaaagaattcgagctttctcatttggaaacatgtgaagtctgtaccggtactggagcaaagataggctccaagatgagagtatgttcaacttgtggtgggaggggtcaggtgatgaggactgaacaaacaccttttgggttgttctcacaggtttcagtatgtccaaactgtggaggggatggtgaagtcatatctgaatattgccgtaaatgcaacggtgaaggacgaatacgggttaagaaaaatattaaagttaaagttcctcctggtgttagctcaggcagtattctaagagttacaggggagggtgatgctggaccaagagggacaaatgtcccatcaaagcttgagtattcatccatagtaaatggcactgaagggttggatataaagaactctaccatacagcctactccaaatgtcttttattctcaaaaagttaactcaagggaggagaattgcccaagtcttacaaggggtcctccaggagatctttacgtatatcttgatgtgcaagagatacctggaattcaaagagatgacattaatctcgtctcaatgttatcaatcagttatctagatgctatacggggggctgttgtgaaggtaaagacagttgaaggcatttcggaactacaaatacctgctggtacccagcctggagatgtcctcgtccttgccagaaaagaacttgctactctaggtgacgcaagcagacgttcaaaatcccgtcccaggactcactcttccggaggtggtacggaaagtcctacagctcaaaaggatgaaagtccaacagcaacagtcgaagaaaaaactgaaaaatcagaagatgaaaacgatgtatggaataaattgaaggactttgctggatctccttcggtcgcaagttcgatctgtctccttctcctcgttggcaccatcacactccttctcgtcagcgccgtcactctcatcctcactggcgccgtcaccttagtctggttctacaatggcttctatgtcctcgacaacaacttgcagatctggattaaccttcgccgccctcctccaaccactgtacatacagccactatcaaagcgttagtctcacggtggagtatgtctatgacgacggaagttgttgttggtgagacgtgtggggtggcatcactatcagtggtggttggagggagaggagtggatgcggtggcagaggtggaggaggaaggcgacgacggtgtcgaggagaagaaacggagatggtga

SEQ ID NO: 296 - DNA, 1017 bp, Glycine max
  Peptide Sequence Number=SeqID_91981
atgtctgctgcggtgtgcggaagcaagagatctttgttcgaagagcttcccccttctccgccagtatccaagaggctccgctgttcctcctcccctattcgcctctctctcccttccctcatcgaccaccttcgctctctcttccctcatatggatgaccaggtcctcgagagagcgctccaagaatgtggcaatgacctagatgctgccatcaagagcctccacggcctctgtttgggatctgctgatgataattctcaaattgctccacaacctgacctccctaatgtcgtccacacaggcacgttggaagagaatgacgatgcttctgcttctggggatcagcccgcttccggcaattttcccgccgatggagcagaatggattgacttgtttgttagagagatgacgtgtgctactagtgttgatgatgccaggtcccgtgctgctagattgctcgaggttctagagaaatcaatcactgcacacgcaagttccggggcaacaacggctcttcaaaggttttcagcttcacccttcatcaagattcatgagcataggtccatcgttcacccaccaggccactactgtttgcaacttcccaatctctgctcagcagctactaatgtagcttttgaagaggattatggaagtgggaatttggaaacagggttttttgactctgtgtgcatgagtagcatgtgtccatgtggggtcaagggttggggaatttgggctgaatgggttgatctcaacgaaaatttgatgctgaaggagcaaattgaagcgttgactaaggagaaaaattgttttaaaagtgctttcagaatccaacttgaacgtctttctgattatgagaataaaaatcaagagttgcagcagttgaagcagttggtgtctcaatatcaggagcagatcagaactcttgaggtgaataactatgctttgcgaatgcatttgaatcaggcacaacagtacaacccctttcctgggcgtttccctcccgatgccttctag

SEQ ID NO: 297 - DNA, 1317 bp, Glycine max
  Peptide Sequence Number=SeqID_91982
atggagaagttgttaccggacgttgatgtatcaagaagtgccccggtggcaatgtttcttgagctagaagctgctgctagatcatcattccatgatgtgaatgagcatgtttcggatgaagcatctgctaatgctaccacaccgtcacatatgatccaagataactcacctggttctgtaaaagctcacggttcatctgcagcaatagttcctggtaacaatgaagtttctgagctgggaacaccacaacatggaaaggataactgttctgatcaaatcatggataattcaacattggaacatggcttaattaatccaactgaaacgaatgttcattgtgccacatccagtgaaaacttcgtttataaggataatattacagacaaagtcactgggtatactgctgatgctatagctattcacctagatggaactgagtttacacctgctgtacaagattataacttgaatgctcatgttaagagactgtcaacagaaaacattacaagtgacttaagttctctaaggaataccgaaacatctaatttaactacaaccactttggttcaggatgctttgcatagccttgcggggagccatgaagcctcaagaaactcagatttattttttacttttccattggatgagcagcacaaattgaagaaaattcttaatacccagaaacagagattggtgactacaaaagctgatgttgaagatcttatagcaagattgaatcaagaaatggctgcaagacaatatcttgtgacaaaggtatccgtggtttacacaaatgcagtgggatatggaggaacttcggaggaaatgcctgagacagaaatgaaattgaagttggaagaggatgaaaggctgctagcagaatctacgaaagaatctgtcattcaggagaagcaaatgttgcagcaagagctagatgtagccagagaacaacttaagcacttgcaaaaacatcatgatgagtttgagatgaaatcaaagacagatatgaaggttctgataaaggaggtaaaatcccttagaagttctgagttagaactgaaacagcagctaagtgaattgatgaaggagaagttagatttggaggggatcgtgaagagtttgctgcatcgaagctgccatctccatgaatctttcatcaatcttggaactgagacgattttccacgcaatcttcaatttcacgctgataccacttgttaaggtaaatctaggagaagacgggaagaattacattacagagaagagtagggaagccaatgaaggaatgacatccgaatctttgttagaaaggaaatga

SEQ ID NO: 298 - DNA, 1851 bp, Glycine max
  Peptide Sequence Number=SeqID_91983
atggagaatgcggaggagatgatgcagcaaaacgacgaggttttgtcggttgaacttccagctccttccggttggaataaactgtttttccctaagaaactgggaacaccaagaaaaagtgagattgtattcattgctccaactggagaggagatcagtaccaaaaaacaattggagcagtacctaaaggcacatcctggcaatcctgtcatttcagagtttgactggggaactggtgagacccctaggcgatcagcaaggatcagtgagaaggtcaagtcaactccaccagcagatagtgatactccaaagaaacgagctcggaaatcatcaggatcaaagaaggataacaaagaaactgaatctgcatcagaggaaggcaaggcaaagtctgatactgaagatcccaaggctgcagaggaggagaaaaatgaaggaaatgataactctaattctggaggaaagcaacttgagaatggagataaaactgaacaaattgatgaacaggccaagaagccagatgtagatatggaagaaaatgatctgaatgatacaaacaataaattagaaaatgattcagatgaaattaagaacagtcatgtgaacggcgaaaatgtgattgctgaaaggcctgaaggtgaagaagctcaaaagcaagaagttgaaccagcagagaaagttgccgaagaagctgctaatactgcggagactgaaaaatccctactgactgaattagaaaaagaaaagaatgaggagaaaacagatactgcgactctagaggctaatgggggaggcgagaaagagaatcctaatgctgcacaaatgatagctgacaacttacctcccccagaaagcgtggttaccctactcaaagcagcaaaaattaagaacattaggatatatgatgctgatcatcaagtcctccgtgccttcaaagggtctggcattgaaattgtggttggtcttggcaatgaatttctcaaggacatgagtgtgggggaggatagagccatgagttgggtcaaagaaaacgttcagcaatttcttccagagaccaaaatttgcggaattgcggtgggaaatgaaatcttgggaggcacggatatggaactctgggaagttttgctccctgcagcaaaaaatgtttacaatgcccttagtaagcttggtctagcaaaagatgttcaggtgtcaagtccacattctgaggctgtgtttgctaattcctttcctccatcctcatgcactttcaaggaagatgtccttccttatatgaaacctctcttacaattcttctcacaaattggcactcctttcttcattaatgcatatcccttccttgcctataagaatgatccacaacatattgatcttaactatgccctcttcctaaaaaatcccgggatttatgatgcaaagactaagctgcattatagtaacatgtttgaggctcaggttgatgcagcttatgctgccttggagaaggttgggtttgacaagatggatgttattgtttctgagactggttgggcttctcatggggatgataatgaagctggagcaacaataaaaaatgcaaggacatataatggtaatttgcgcaagcggttgctcaagaagaaagggaccccttataggccaaaaaaagtggtgaaagcttatgtctttgccttgtttaatgagaatttgaagcctggctcaacatctgagagaaactttggattgtttaaggctgatggaagcattgcatatgatattggcttcactggacttgtaccttcttcagcaacttcatctttcctttccttcaaggtatatggactatggatactcctctactttcactattaa

SEQ ID NO: 299 - DNA, 396 bp, Glycine max
  Peptide Sequence Number=SeqID_91984
atgcttgatacagacacagaccctcataatcataccccgccaaagcctgagaagaaaacttccatgtcaagaagtaatgtccttaagaaccatcggagcatcaagatgaaagaaagtgatcaagtggaagaagcaaagcaaaaaatttacaagaagaaactaacaccaccttcagttcgaaaactgttttcaagttctggtttagatatgcatgaaggtagcaggttgcagactttagtgatgggtggtgggatggggagtggtggtggcaggatttgtggtggtggaagaggctcacatggtagggatgggacagatgcttattaccagaacatgattcaagcaaaccccaataatgctcttttgcttggaaattatgctaagtttttgaaggag

SEQ ID NO: 300 - DNA, 1458 bp, Glycine max
  Peptide Sequence Number=SeqID_91985
atggattttgaatcaaattatgatattgctgcctctgccaacttcattcacactcacaacttcatcaaagttgctttacaatttccagataatctcctaaaacattcaactagagtggtcactgctctgcgcaacacacttcaatccacggaggtaggattgtttgtgatggccgacacggcctatggcagttgctgtattgatgaagttggagcatcacacattaatgctgattgtgtcatacattatggtcatacttgttttagtccgacaacaactctaccagccttttgtgtttttgggaaggcttccatttgcatagctgattgtgttgaaagtatgtcaaagtatgcactgacaaatagtaagcctatcatggtcctttttgggctggagtacgcacactcaatgcaacggattaaagaagcactgctagaatcatcaatgtcatgcagatttgaccctaagtcagaagttcactttgctgatgttccatcttcagttatgtttccatcaaaagatattaaaaagataaacgtactccaagaaccagtcagtgattgcaatggagcaagtgggactatgtatagcattggaggattgacatggaaattacctgagggacaaagcatggatgactacttggtcttttggattggacatgatgattcagcttttgctaatgttgtgctcacattcaatgcctgtgaaatagtcagatatgatgcaaatgaaaatcgaatggtgacagacctgtttcaacataggaggattcttaaacgtagatattacctggtggagagagctaaagatgctaatattgttgggattttagttggaactcttggtgttgctggttatcttcacataatcaatcagatgatggagctcattactggggcaggcaagaaggcatatactttggttatgggaagaccgaacccagctaaacttgctaactttcctgagtgcgatgtttttctatacgtttcttgtgcccaaactgctctgctggatagcaaagagtatctagctccagttattactcccttcgaagcaatgatagctttcaataggggaagccaatggacaggagcctatgtcatggaatttcgagatctaattaatttgcctcaaatgggagttggaaaccaggaagaagaagaagcacgattttcattcttgaagggtggatacgttgaagattttgaaaatcaagaaaatgttgaagaagaaagagaaactctagctttagtaaatgcaacagaaaaggcactgcagttgcggaataactctaacgttctaatgaaagggagtgcgagatcaggagcggaatttttggcaaatcgatcttatcagggtctgaacatgtccagtgagaacacctccccagaaccatatctcattggacggaggggaagggcatctgggtacgaggatgagaagaacaaacaatga

SEQ ID NO: 301 - DNA, 234 bp, Glycine max
  Peptide Sequence Number=SeqID_91986
atgcatgttaatattctgaggtaccagaagaacaataggcaacatatagggggagtggtacagaaagggggtcataaggagaagaaggaattgagaggaagtggacatcaaggcagggataacagaacatatgcacaggctgcaatacctctgaaaaagatggaaacacaacaatggatcggagggtcaaaagggggaacaaagaggaggagatactatagagaattgttttga

SEQ ID NO: 302 - DNA, 672 bp, Glycine max
  Peptide Sequence Number=SeqID_91987
atggcagcacctcaactttcaggtgactggtattgtggtgcagctaactgtggtgcacacaattttgctagccgttcaagcttcttcgagtgtgctgctgtcaataatgactcagctgctgacacctcacgctcaagagcctttggaggcgctgggactgcatggaaatctggggacaatttgtttgctgctgtttttgaagattgtgaaaacacagttgcaaaaggcaacattggcattagagatgtgcaatattatgatctttgttgggttccactttcctttactgcctttaggaggtcagaaggttctgaagaggttaaatcttcaggtttgacaagtgagcttattcctaatcttattgagccagtagacccaataccttcttctgggtccatccagagattcctaaacaaagctgctgatgaaggcttggtaataattcagtctccaaaggggaggcgtgctccaccatcatgtaaagagaaacaaaatgttgaggaggggcaagtgatttgttatattgaacagcttggtggtgagctgccaattgagtctgatgtgtcgggagaggtcatcaagatcctacaaaaggacggcgatcctgttggatatggtgacgcacttgttgcaatattgccatcatttcctggaataaagaagcttcaatag

SEQ ID NO: 303 - DNA, 1605 bp, Glycine max
  Peptide Sequence Number=SeqID_91988
atgcagagtctcaaactgcaactagtgctattcctctcaatctcaacttctcacgctgttttctccttcacagatgggttgttgccaaatgggaacttcgagcagggcccaaagccatcacaattgaaagggtccgtagtgactggccacgatgccattccgaattggacgatttcggggttcgttgaatacataaaatcaggacaaaaacagggtgacatgttactagttgtgcctgagggtgactatgcagttagacttggcaatgaagcttccattaagcagaagctgaagctgattaaggggtccttctactccatcaccttcagtgccgctcgaacctgtgcacaagaggagaagctcaacgtgtcagtggttccaaccactgagaagagggactggggcatcatccccattcagactatgtatggtagcaatggctgggagtctttcacttgtggcttccgagcagatttcccagaagctcaaattgtcatccataaccctggcaaagaagaggatccagcttgtggtcccctcattgattccgttgccctcaaggttttgtacccacccaaaagaacaagagccaatttgttgaaaaatggcaatttcgaagaaggtccatatatatttcccaactcgtcttggggggctttgatcccaccgcatatagaggattctcacggtcctttgccaggatggattgttgagtctcttaaggcggtgaaatacattgattctgatcactttgctgtgcctgagggaaaaagagctattgaacttgttgcagggaaagaaagtgcccttgcacaggtagtgattactacaattggcaagacttatgacctcaccttcgccgtgggtgatgccaacaatgcatgtgaaagttccatgatggtagaagcatttgctggcacgaacaccgtccaagttccatatcaatctaagggtaaaggagggtttgtcagaggcaagcttcggttcaaggccgtctcaacacgtactcgccttaggttcctaagcacattttacaccatgaagagtgataactctggggcacgtgcaatgggatggcacacgtggcaagggtattgggtttggccttggcccctggaggaaactcctcagatcgaaatcgaaaccatgtggcggagactcttctcttcttcaaacctcaaatccctacacacagcactctctccttctcgtccccgactcgccgcccctctcctcacccgccacgtgaccgctcattcaggtgcttcttccgtcaaaaggagggttgaagatgtcgtgccaattgctaccggccacgagcgtgaggagattcaggctgatcttgagggaagggatattcttgaaataaaccatcccgtcggcccttttggcacaaaggaagcacctgctgttgttaaatcttactttgacagaaggatagttggatgcccaggagatgaaggcgaagatgagcatgatgttgtctggttttggctggagaaaggcaagcctaaagaatgtccagtgtgctcacagtattttaagctcgaagtggtcggacctggtggtgatccttatggacatggagatcatgatcaccattga

SEQ ID NO: 304 - DNA, 210 bp, Glycine max
  Peptide Sequence Number=SeqID_91989
atgttggcacataataacaacttaattataaaggatgtcactacaaatggcgctgtggagaaatgtccaagcttaagagaatcaagtgggaagggtaataggaagaagatcattgatggccctcctgaagtaatagtagagagaaggtatcttgggtggagagttaaggctaatccattgagttacattgaaggagtggatctcaattga

SEQ ID NO: 305 - DNA, 273 bp, Glycine max
  Peptide Sequence Number=SeqID_91990
atggttaaatttgcacccaattatgatagcagtaaatatttgaaaacaacatcatggcccaatccagtacaggtgcttagcgcgcgtcacgcgctaagcgtgcaaggcagcacaagcgctaagcgaggcgttaagcacaaggatgtaggattcattacgcgcgctaagcgtgaggcacacgccaagcgcgcgatccaacagaagcacatgctaagcctacagcacgtgctaagcgcacgatctgaacgcgttaagcgcaaggtgtcgcgctaa

SEQ ID NO: 306 - DNA, 666 bp, Glycine max
  Peptide Sequence Number=SeqID_91991
ataatattccccaagaatatgctgattgaccataactgtaaaaggatttcagatctctgcaagaatgctggctcttggcttgttgttgataatacatacgagtattttatgtatgatggcctgaaacactcttgtgttgagggaaatcatattgttaatgttttctcattctcaaaagcatatggaatgatgggatggcgggttggatatatagcgtacccctctgaagtaaaagacttcgctgaacaacttctcaaagttcaagacaacattcccatctgtgcttcaatattatcacagtatcttgccctgtattcattggaagtggggcctcaatgggttttagaccaggtaaaaactcttgaaaagaacagagaaattgttttagaagctctctcccctcttggagagggttctgtgaaaggaggagaaggtgctatatacctgtgggcaaagctcccagacttagacgctcacgatgattttgatgttgttcgctggctagctaacaagcatggggttgcagtaatcccaggaaaagcatgtggttgtcccagcaatcttagaatttcatttggaggcttgacggagaatgactgcagagctgccgcagaaagactgaagaaaggcttagaagaattggttagagacggactgcgggagtaa

SEQ ID NO: 307 - DNA, 1353 bp, Glycine max
  Peptide Sequence Number=SeqID_91992
atggcgactctgaatctgttctctcaaccatggcaacctacaatttcaccttctttctgttgttctaatactaacaacaacaacaacgttgtctatgcctatcataatcataatagcaattccaacaattctaaattacatttattttccaattctcgccaattctctgttctttctcagttgtccaccaactcctcaaagtcagggagtggaagttcatggctgcaaaacagttcctttgttgctggcattgagtacaggaagcgtcctctatattctgtatttcccacaaagcctgctcaagtttcctctgtggaagatctctatgaatttatttgctcgggacctttgcttgacaaaataggcatcacacaagagcaggtggccgagtccatcgataattggttattatatggccggtacctatgcagactgtttcagcttaatgaattgtaccttacagagcctcaaaaggctaggatttatcattactatgtacctgtcttcctctggtgtgaacagcagattgctgagcatcagtccaagttcaaagatggagaagatatacctcctttagtgattggttttagtgctcctcaaggttgtggaaagacaacccttgtctttgctcttgactatctttttgaagtgattggcaggaagtctgcaactgtatctatagatgatttttatttgacggctgaaggtcagaataaactaagagaagctaatccaggaaatgcccttcttgagttgcgtggaaatgcaggaagccacgatcttgctttatctgttgaaactctactggctttaaccaaattgacaagagaaggtatgaaaatgaagttaccaagatatgataaattgctaaaggcggattgcctgttgatgatgcagtctgcattcaatgggagaggtgatcgtgctgatccttcaaggtggccagaagttgaaggcccgatgacggttgtgttgttcgaaggttggatgcttggtttcaagccccttcccgttgaagcagtaaaggttgttgatccccagctagaaactgtaaataaaaaccttgaagcttactatgatgcatgggacaaatacataaagtcttggatagtcatcaagattaaggacccaaactgtgtcttccaatggcgcttacaggctgagattgccatgagggaggcaggcaaccctggaatgacagatgatgaggtgagagattttgtttcacgctacctaccggcatactatgcataccttcctacactttactcggagggaccaaatggatcagatcctcaacatctcctaaccattgaaatagatgaagggagaaaccccatccttgctacctag

SEQ ID NO: 308 - DNA, 165 bp, Glycine max
  Peptide Sequence Number=SeqID_91993
atgactcatagacaggatacattgaataaaaaaagagacctaagaaatattagggcaagagatgaaatggtagtgaaccatgaaggaggaaggacaggactcgcgagtattggaaatagattgacgattgtgtcaagattcgaggaaaggaggaaaggacattga

SEQ ID NO: 309 - DNA, 315 bp, Glycine max
  Peptide Sequence Number=SeqID_91994
atggtgagcagtagaacgaagaagaagaacgcgctgcaaggtgaagcaccaccaccaatcgaggtcgcacaggaggaggaggagaaagaagaagaatcaacccacgctgccaacaaaggttgcgtagaaggaggaagagaaagaagcagtaaggtcacgggagttgctaggtgcatggtcgaaggaagaaggaaatcaataggcgccgaagaaagctgggcactactgggggatcatactcttatatttgatgtggcaaatgaaataaaatcttcttcttcttccaacaaagtgacatcagagcttgagttctag

SEQ ID NO: 310 - DNA, 2964 bp, Glycine max
  Peptide Sequence Number=SeqID_91995
atgcctctcagactcgaaatcaagcgcaagcttgcgcaaagatcagagagagtgaaatgtgtggatctacatccaacagagccatggattctggctagtttatactctggaactgtctgtatctggaactaccagtctcagaccatggcaaaatcttttgaggttaccgagttaccagttagatcggccaagtttattgcacgcaaacagtgggttgttgctggagcagatgatatgtttatccgtgtatataattacaacacaatggataaagtcaaagtatttgaagcacatactgattacattaggtgtgtggcagttcatcctacccttccttatgtgctttcatcatctgatgatatgctcataaagctttgggattgggaaaaaggctggatctgtacccagatatttgaaggtcattctcattatgtcatgcaagtaacatttaatcccaaagacacaaacacctttgcaagtgcatctcttgatcggacaataaagatttggaatcttggctctcctgaccctaattttactttggatgctcatcagaaaggagtgaattgtgttgattattttacaggtggtgacaaaccatatctaatcactggttctgatgatcacactgctaaggtatgggattatcagaccaaaagttgtgtccagaccctagaaggtcacacacacaatgtatctgctgtatgctttcatcctgaacttcctataatcattactggttctgaggatggcacagtacgcatatggcactccacaacttataggcttgagaacacattaaactatggtcttgaaagagtctgggctattggatacttgaagagttctcgtcgggttgtgattggctatgatgaaggaacaattatggtcaaacttggtcgagaagtacctgtggctagcatggacaacagtgggaaaattatttggtctaagcataatgaaattcagactgtcaatataaaaagtgtaggagcagatgtagaggttgctgacggagaaaggttacctttagctgttaaggagttgggcacctgtgatctctacccccaaaatttaaagcacaatccaaatgggaggtttgttgttgtatgtggagatggtgagtacattatatacactgcattggcatggagaaataggtcatttggttcagcactggaatttgtttggtcttctgagggagaatatgctgtcagagaaagtacatcaaagattaaaattttcagcaaaaatttccagactgttaggcatcccacagttgcagaagttatgagaggggaaaaaaggataataatgagggggaaggatcagaaagaggaactaggctgtaatgaccttgcttatgtggcaaggggtgtgggaagggaatgtgggggagcaaggatgaaaatgtatggattagatcctggactcatatcagtaacagtgatcatattccgggaaaagaggagtgtccgaccaacattttcagctgaaagaatattcggtggcactttactggcgatgtgctccaacgatttcatctgcttttatgactgggctgaatgcaggttgatctatcgcattgatgtcaatgtgaaaaacctctactgggctgacagtggtgatctagtaacaattgctagtgatacatcattctacattctgaagtacaatcgtgatgttgttgtatcacatttagatagtggaagacctgtagatgatgaaggtgttgaagatgcttttgagctcttacatgaaatgaatgaacgtgtcaggacaggcatctgggttggggattgctttatctacaacaatacctcttggagacttaattactgtgttggtggtgaggtaactacgatgtttcatttggaccgccctatgtacttgttgggatatcttgcaaaccaaagtcgtgtttatttgattgacaaagagtttaatgttatgggatacacactgcttttaagcttgattgagtacaagacacttgtgatgcgtggtgatttggaaagggccaatgatattctgccatcaatccccaaagagcatcataacagtgtggctcatttccttgaatcacgagggatgatagaagatgctcttgaagtagctactgaccctgagtacagatttgatctatcaatacagcttggaaaactagatgttgcaaagagtattgcaatagaattacagagcgagcctaaatggaagcagttgggagaattaactatgtctactggaaagttagaaatggctgaggaatgtttgaagtatgcaatggatttgagtggcttgttactgctatattcttctttaggagatgctgaaggaatatcaaaacttgcaatccttgctaaggagcaagggaaaaacaatgttgcattcctttgcttatttatgttgggtaaattagaagactgccttcaactgttggtagaaagcaatcgaattccggaggcagctttaatggctcgatcttatctcccaagtaaggtctcagagatagtggcaatttggagaaaagacctcaataaggttaatccaaaagctgctgaatcattggctgatcctgaagaatatccaaatttgtttgaagattggcaggttgcactagctgtcgaatctaaagctgtggaaacaaggaatgtgtaccctcctgcggagcagtacgtcaaccatgctgacaaatcacaaattacccttgttgaagcctttagaaacatgcagattgaggaaggagaggagcatctggagaatggggactctactcatgagttgacagaacaaagtggagaagagcactacacagaggatcaggaggaacagaatggagaggaaggaagccaagaggaggcagttgtagtggatgcagattctacagatggtgcagtactcgttaatggtaacgaggctgacgaagagtggggtacgaataatgaaggagccccgtcagcctaa

SEQ ID NO: 311 - DNA, 1131 bp, Glycine max
  Peptide Sequence Number=SeqID_91996
atggctgattcttcttccaatttctctttaccttgtgatgcattaagcccaacacaaaagagtttctcaattttccatacctctggttcttggttgggggttggtgctaaaggtttgcctgattctgaatctgtttggagccctacatctcctctggattgcagactcttctcaaatcttagcaacccgtttagtgccaagtcttctagaccatcgtttcaaactgggcataagaagcagtttgatggcagtaaagtaggccttggcatcataagctctcttgctaatgaaaccaaacttaacaatgacatccttggtaaatttaagaggaaaggtataatttttggaccacaggtgaaaactggcatccttaaattctcaaacaaaaaccatgaatcccttgcgccttatttgaaatctaattcctttccaaaaaactgtgtaatttcgcttccttctgaaaccacaattcccaaatctgaactggaaaacttttatgatgtctctggaaagaaagatggcaattgggaatccgaaactttcaaaagtactgtgacttctttgcctgattcctttagcccttcctcattaatcaactcaactcaaaactccaaaatgggaatcaatgaattaggtgtagaaaatacatctgcattaatgagtttgcctcaactgacaagcagaggttcacaggttgataattgtttgaaaattaaatcaaattcacttccaatttccattgattttagtaaagggtgtataggctcactctctgcaagagagatagagctttctgaggattatacctgtataatttctcatggtctaaaccctaagagaacacatatttttggcgactgcattttggaatgtcacaacaatgacttcactgagttcaacaagaaggaagagcctgctttcagctcttctcaagttcctgcattttcagatggatcagccccttatccttctggcaatattttgagcttttgttactcatgtaataagaaattagtaaaggaggaaggcatttatagatacaggtttgtcccaaacatttctctaagctactgttacttcagtcaagtcaaaagcgccagtggtaatatattgtatatcttgcagaggtga

SEQ ID NO: 312 - DNA, 657 bp, Glycine max
  Peptide Sequence Number=SeqID_91997
atgggaactggaaaaaccagcatagcattgcgatttgtaaaaggccatttctttcctaaccaggtttacttccatttcatcgcattaattgaaattggaaagctgctttcccagcacaataacaactacagtttaggaatcttaacattaatctacgcacaggaaccaaccataggagctgcttttttcacccaaatattatcattatctgaagcaactgtaaagttcgatatatgggacacagcaggacaggaacgttatcatagtttggctcctatgtactaccgtggtgcagcagcagcaattgttgtctatgacatctcaagtgttgatacatttgttcgagccaaaaaatgggttcaggaattgcaaacacatggtaatgcctcaaactcgaagtcggtgatggcattagtggcaaacaaatcagatttggagccaaagagagaggttgaagctgaggtaggagagcaatttgctcaagagaatggaatgttctacatggaaacatctgctaagactgcagagaacatcaatgagcttttctatgaaatagcaaaaagactagctagagctttaccaccaaagcctactgggatgaatttgaacagcgatatacaagatagagggagaaattatttttgttgctcagcctga

SEQ ID NO: 313 - DNA, 405 bp, Glycine max
  Peptide Sequence Number=SeqID_91998
atgggtgaaagtcccccaaaaccctatcatgattccaccaagtggaattcatgtggagggtttcagagacccgccaatactgaaatgtttgagtgtccagatttctttgcagtggacataagtggctcaaagaataggaagtttagcttgacaatattttctgatcttccggaactacgcgagctaagaacgttgttcacagggaaatttgggaattctcttgaactttacataagtaaagagtttgttgaaaagttgaggcaagatcttccttcgaaagaaatgaagatccagctgttgcatgatgtagcgcaagagttctctattgaatggaacagcaaggctttggagcagagacttcagtcaccgcctcagttacatgaagtaagttttacttatcattga

SEQ ID NO: 314 - DNA, 2211 bp, Glycine max
  Peptide Sequence Number=SeqID_91999
atgaacggtgcagggagacaggggctgagatctggtgcggcgggggtgcaccaccagcgccagtactccgataacttcctcgacagctcatccaacggcaacaggtggctccagtcggctggccttcaacaccttcaatcctcctccaatcaacttcctccgcttcaggactataacttgtacggcggtgcacaaggaggaagaatgtaccggaatgcgccaaggagctttaacggaggaaacgagtattatatggagccttccacgcctcccggtggttaccgtgcttcgatgcagaaaaagaatggcgaagatttgtccggtgatttcagccccggcttgttggatctgcagtccttcgacaccgagcttcttcctcccgagatcacggctacagaaattttcaatttctttgagtctctaacccttgaaagtgtcatactatgcagaattttcgttgatgttgtggaaaattatgcacatgaaaagctgccagtctccaatgcatatgatgccaactccctgtatcaacctggccggggtagaagctttgatgactctgaaacttacatgctgagcaaacagactggcagagctcgtgctcctgaaaacatattgaaaagtctccctgcagacaaagagaaatctaattctgtagcaaagattaaagtggtggttcgtaaaagaccaatgaataagaaggaattagcaaaaaatgaggaggacatcatagaaacatattccaattctttaacagtgcacgagactaaactgaaggttgacctaactcagtatgtagaaaagcatgaatttgtctttgatgctgttttgaatgaagaggttacaaatgatgaggtgtatcgtgaaacagtagagcccatagttccaataatatttgaacgcactaaggcaacttgctttgcatacgggcaaacaggaagtggaaaaacttacacaatgaagccactgccacttaaagcatcaagggacatccttagattgatgcatcatacttacaggaaccagggatttcaattgtttgtgagcttctttgaaatatatggtggcaagctctttgatctccttaatgatcgaaaaaaactttgcatgagggaggatggtaagcagcaagtttgcattgtgggtttgcaagagtaccgagtatcggatgtggagaacataaaagacctgattgagaaaggaaattccacaagaagtacaggcaccacaggtgcaaatgaggaatcatcacggtcacatgcaatacttcagcttgctatcaagaggtcagttgatggcaatgaatccaaacctctccgtttggttggcaagctctccttcatagatcttgctggaagcgaacgtggagcagataccactgataatgacaaacagacaagaatagaaggtgctgagatcaataagagcttacttgccctaaaggaatgcataagagctctggacaatgaccaaggacacatccctttcagaggcagtaaactgactgaagttttgagggattcatttgttggcaactcccgcaccgttatgatttcatgcatatcaccaagcactggttcatgtgaacatactctgaatacattaagatatgctgacagggtaaaaagcctatcgaaagggaacaattcaaagaaggatgttttatcgtcaaatttcaaccttaaagaatcaagtacagttcccttatcttctgttactgggtcagcctatgaggatcgcgtgacagatggatggcctgatgaaaatgaaggggatgattttagcccctctgaagagtattacgagcaggtgaaaccaccattgaagaaaaatggaaagatggaatcatatgctacaacagatgacaaattgaagaaacccagtggtcagatcaaatggaaggacctcccaaaagttgaacctcaaaccacacatgctgaggatgatttaaatgccctcctacaggaagaagaggaccttgtaaatgctcaccggacacaagtagaggagaccatgaacattgttagagaggagatgaacctcttggttgaagcagatcaaccagggaatcagctggatgattacataacaagactaaacgccattctttctcagaaggctgctggcatcctgcagttgcaaacccgtttagctcattttcagaaacgtttaaaggagcataatgttttggtttcatctaccggttactaa

SEQ ID NO: 315 - DNA, 60 bp, Glycine max
  Peptide Sequence Number=SeqID_92000
atggcagaggcaagggaagcaagggggaagggagaaagtgacgtatggagtggtaattaa

SEQ ID NO: 316 - DNA, 219 bp, Glycine max
  Peptide Sequence Number=SeqID_92001
atgaaggcggagttggtgaagggaagagatgaagacgcgaaccttaatggatgcgttggatccaggaatcaaatcgtggacgtggctttcgaagtggtggagctcataattgaattatggaaagaaaacgtgaaggcgggaatgaaggttcggtttgatgagctctgcaaaagtaatactttgcgagggatgacggatcctcctccaacgctattctaa

SEQ ID NO: 317 - DNA, 231 bp, Glycine max
  Peptide Sequence Number=SeqID_92002
atgaagaaactaaaaagatataatgtacaaccaaatccacaagtgtgttttaaaggcttggatttggaggcccttggtttgcattcagaggcagcgagtgtgcgtgggagtaaaagccatcaaaagaagacggaagatggaagtacaatagtgtgcaacaaacgggtcccacgaatttctcactttcttaattcttatccgtgtgatagaaataataagtgggcaaagtga

SEQ ID NO: 318 - DNA, 1281 bp, Glycine max
  Peptide Sequence Number=SeqID_92003
atgtcgaacgggaaaactggtgctagttatgcagagagcaagccacaggaggatagattgctggagacagttgcaagttctggtggtgtgcgcctgcagcctactcgagatgccattcaagttttccttagagaggctgcaaagttggatgccatggctttatgtcatgccattgaacgaaagctccaatctccgatgtggcaggcattccatcgtcagaaagaagatgatgaggatcatttttcacgtatggcgtcttactttgctgaaaataatgttctggtgttgagatgttctgaatccccccaagcttctttgagggaaaaggcaaacaaggttcttggtcttttaggtggaaaccaactaaacagtgctattaactcagagaaagctgtgaagacggatagtgctgctgttgctgagttacctgacttgatagacactggtgatttgaatgactatcatggaacaggtgataatacaaagagtaagaatggtcaaaatatagcaaatttgacaccatccacacctccagctctggcggatgatttatttgaaaattttatgaactctggagtagctagtgatgaactaaaaaatgatgatccctttgctgatgtgtcatttcattctaatgacaacaaagagcatgctgatatcttttcaagcatgactgttggtgatgataaattggatcatcatgtgagtcatggtctggggaatagaaatgaacctgacagtgatgatttattggctggcttgtcaattgacgaaaatacctctagtacaaaacagaaagcaacatctcctgccatgcaatctgaatctttattttctggtttaaacaatcatgttagccatctgggacctgacaatggcttaggtagcatgttgggcactcaagcagttggcttcaatgtaagttcaatatttccttctggtcatcctccttgtattacgcagcctggcattatgttgaaccagccatattcttctcagccacttaattatggtgccatgggaaatctcttggctcagcagcaatttctggcgacaatggctaatttccaacaccttaataatgtcaacaagaatgatggcagtactgctcaaaatgctggatccaatggaaaaacacctcttccggacatattccaatcaaaattctcaactcaaactcctagctcaatgatcagcaattcaaagaaggaagaaactaaagcatttgattttatatcggaccatctagctactgcgtgtgattcaaggagagtgatttga

SEQ ID NO: 319 - DNA, 873 bp, Glycine max
  Peptide Sequence Number=SeqID_92004
atgtatgggatgggttttgaccacagctttgggctttggtttattgcctgctggctgaagccagatctgatgatcgagagtggtgctttcaaaggacattcaacttgggttttgcggcaggctatgccagacacaccaataatttctctttcacctaggcatccagaaaagtacctgaaaaagggacctgcttatgttgatggtaactgcacgtattatgctgggaaggactttgtggattttgggagcattgactggcccaacgtgatgaagaaacacgggatttcggaccttaatcgggttcttatattttttgatgaccaccagaatgaattgaaaagaattgaacaagctttgaaagctgggttccgacatcttgtctttgaggataactatgacactggaactggtgatcattattcattaaggcagatatgtgatcaatcttatattagaggtggggggcacaattgctttaaagacagtgatgaagctaggatcaggtcaaggaggaagaaattctgggagaaagcagtcgatattgaagaactctgtggtccagatgaagcatggtggggagttagaggctttatgcgggataactttaatcatagtaataagccaatatcttatgctcaacatttccagaatagccgatatattgaatctattcttgatgtttactgggagctccctccagttgctggtccttccctcacccatcaaaccagatatgatcctgctcgtgcacccagtcctattgttgaagatgggcggtatggcttgttccgaaggctaggtttggccaaccttgacaattctgtatttaatggatacactcagatggtttatttacagatatctgaacaataa

SEQ ID NO: 320 - DNA, 471 bp, Glycine max
  Peptide Sequence Number=SeqID_92005
atggggtcactcttacagggccataattggatcacctaccaatatccagtcttcatcgcgaggggacttacagcagggcacgccgagggatccgaaatcggagtcgaggccatcgaagccgaagaagccggcgccagagacggggctgtaggaagaggagatgcagacgaagccgcgagatgtgaagaggaaggagaaggccaagaagatgaaaaggaggatgatgacgcaagggaggtagaaggaaccggaaccggcgattcgggagaggtaattggaggctctggtggtgatgcggaagagaatgtgttggttcttctttgtcttggattcgtcggcgtctccgtcggcgtcgccgtcggcgcaggagttgacgcggcgggaggagagagtccgctccaacatggagggcgcggagagattgggatgacggtgagtaggggtggtggtgctgctgctctgcgtctgtga

SEQ ID NO: 321 - DNA, 2907 bp, Glycine max
  Peptide Sequence Number=SeqID_92006
atggcgcaagtatcaaagtttgggcaccttcttcttcattcttctctccccaaaccctccaactccaacattcaattccgttctcttctaacacttcttgcctcgtcctccaaacgacaccgtagcatccctcctttccgcagaaaaagcacgacgccaaagccaatggaagtgaaggaggagtcgtcgagcttcaacaagagaagggcccagggcagagacaaaaacgacatctcccagaagaacctctatctcaaagttcgcaagctcaacccaatcaataccatctcttttgttcagatattgggaactggcatggatactcaagatacttctccgtcagtcttgcttttcttcgacaatcaaagatttatattcaatgctggggagggattgcaaaggttttgcacggagcataagattaagttatcaaagatagatcacatatttctttctcgtgtctgttctgagactgccggtggccttccaggcttactgcttactttggctggcatgggagaagatgggatgtctgttaatatatgggggccatctgatctcaagtatttagtagatgccatgagatcttttattcccaatgctgccatggttcacacaaagagctttgggcccatcttcaacactgatggacccattgtgccacatcaaagcaagcttttggaccccattgttcttattgatggtgaggtggtcaaaatatcagccattatcctacaaccaaattgcattgaaggtcaggtgctgacaccttcagaaagctcttcacaggagaggatggatcatagtccagaaacccttgactctcccaatggcaaaaagctacctgctgcaaaacctggtgatatgtctgttgtatatgtttgtgaactgcctgaaatcaaggggaaatttgatccagagaaagctaaggcccttggtctcagacctgggcctaagtatcgtgaactgcaacttggaaactcagtgaaatccgatcaccagaatatcatggttcatccaagtgatgtcttgggtccttctgttcctggtcccattgtactccttgttgattgcccaacagaatcccatttggaagcattattgtctatgcaatcacttgccagttattgtgatcaaacagacaacctaccagaggctggtaagagtgtcacttgtgtaattcacctaactcctgcatctgttgtgagttgttcaaattaccaaaaatggatgaagaaatttggttctgcacaacacatcatggctggacatgaaaagaagaatgtagagattcctattttgaaagctagtgcaagaattgcaacacgacttaattacttgtgtcctcagttctttccagctccaggattatggtctcttcctaatcacgatagctcaaaatttggctgtcttgcttcacgtgaggattcactttcagaattttctgaagtcatttctgctgaaaatcttcttaagtttacattgcgtccttatgctcaacttgggttggatagatcttgtattcctactagggcggattcctcagaaatcattgacgagttactgtcagagattccagaggttttggaagcagtaaagcatgtaagtcagctctggcaagaatgtagtcagacaaaagaggatttaactccagtggcggatcatgggatgatgaatgaggaaccatggctatgtgctaatggtattcctgcttgtttggaaaatataaggagagatgatttggagatagttcttcttggaactgaggaggtttgctcttggattgtggtgaaggaaccttgggacaacttaaaagaaggcaaatatggtgttactggcgctgatgatgctgtgagaactttgaggtgcatttggatttctcatattcatgctgatcaccatacaggcttggccaggatccttgctctgcgccgtgatttgctgaggggggtgcctcatgaaccagtgcttgttgtaggaccaaggcagcttaagagatatttagatgcataccaaagactagaagatttagatatgctgtttcttgattgcaagcacaccacagcagcttcattggaagcttttgaagatgatttcccaggaaattcagttaattctcagaatctgaagaataataatggggacttaattgcatcaaaagttaattctactttatttgctagaggatctcttatgcaaagctattttaaaagaccaggtagtcctgttgacaaagatgtagtttctcccatcctaaagaaatttaagggggtaatccaggaagctggtctgaaggccttgattagtttccccgttgtacattgccctcaggcatttggtgtcgttttaaaagcagaagagaggactaatagtgtcggaaaagtgatacctggctggaagattgtatattctggtgacacaaggccctgcccagagctaatagaagcatctcgtggtgcaacagttcttatacatgaggcaaatccatcattgataaaccaagccttaaatctagaagtttttggttctccaattggtaaatctttggcaaaactaacctcttccacgttaataattaacttctgcacggcaactttcgaggatgccatggtagaggaggctatagcaagaaatcacagcaccacaaatgaagccataaaaatgggacagtctgccaatgcatatcgaaccatactgactcatttcagccaaagatatcctaaaattcctgtattcgatgaaacacacatgcataaaacatgtattgcatttgacatgatgagtgtcaatgtagctgatttgtccgtgcttcccaaggttcttccatatttgaaattgcttttcagaaatgaaatgatggttgacgagtcagatgatgtagtggaagctgtgacttcagcttcttga

SEQ ID NO: 322 - DNA, 144 bp, Glycine max
  Peptide Sequence Number=SeqID_92007
atggcgcgaacggagtttgacggaggtggcaacgcagcaccagaggagagagaagatatgggagtagatttctggtttggagaggagggaggtggcaatggtgatggagaaagaggggacgatagaatagattgtagattgtag

SEQ ID NO: 323 - DNA, 2109 bp, Glycine max
  Peptide Sequence Number=SeqID_92008
atgccctttgcttctgcttccatggaaaaaaggagtgaagagctaggattaagcttaatgaacactgattctgctaaccatgacaggattcctggtgttcgccaccagaatgatactaccgtccctctgcctctggtttcaccatctcctttcccccactggcatttgcatgagacatcccaatattataacaatgaaccagctggagttaattcaatgattgattcctctcagttcagaagttatcagaatttccagatggaccataattactatcacagagcagaacataatttccttccatgcgaaacagattcttgttttccatgtccagaaggatacatagggtggccgtatcaatatgataggcacaataatctgacaatccctgtcgatgtgagggatgcttccttcaatctaaataattttgagaagcctggcaatggtgggatgtgtgtgaccccaagttatggttcagctagcaggctacaaatggccaaccctagtggagcatcaatgagtgctaatactggtcagccttcactagatatgaatttgggaatggctctgtgtaatccaaataaaggttgtgtagaaccattgcttacaataggaaaacgtgatgaaagatttatgaccactggttctggaagtaataacaaagagtccaaatccagtgctgtaacactaaaattcaatttgactggtaattctgacagggaatttcttcctccagtcaatatatatcacaatcaactgggtagcagaagttccttaaaccctggtttagacatgaatgccaccttttctgcttttcagaatgacagtgaagtcatatctgatttagctcctgcaagcaatcatgaagctctgtttgattctagacctggtttacgtttggggccatcatatgcttttcaatggccagctgctggagaccaaaaccattatttagggcaggtcaaccgggatttaggtcttggaggtgtgaaagacacaagtatggaatttacagctgtaggtcacaaaaatggccttggatgcatggatctaaattcattgccaattgttggcagtctaactatgccttttgaaagtggacagagatgggcgaatagacagttagctccctcttcaagtggaacggtaactgataagttgcctactgagctgttacctaaaaataatgataagttctcattacagcttttttctagtcctcctttagctgtggccagtggaagcacccgagagcaagatctttcaaattcatggcctcctgtaggtaatcatggtcaatcacaggcaggtggttctattcagcaatcaaactctcttcttcgaccacagtctacttctgatgtaggaatacaagctggaaagggatacattactgctcaagtttcaaggccatccaacttgtcatctctaaagagagctgcttcccaaccactgtcatccactatccagaatcaacaaaggaagactctaccaactcagttcatacatccatcaattccaactccttggaccagattggctccatcagtcccaaatacatcccgggcaatgtctcccttggtccgtccagccctgtctctcacaccccaagctcctcactctgttgttcctccatcattccctatgacttggactaaatctgttctacaagccccaaacacaacctgggcaattcctcccagaatgtacacagctccatttctcgcacctaatgacaagagaatctcatcttcccaccacccctcatcccatacttcaccttgtacaaaccaatctaaccatcaagcgttagctcgggctttgactcgccaacgcttgaaggctccaattataccatctgctcccagtattgcttccaattatattaaatttaaagatcaaacagcagaaccaattggttataaatgccttttgtgcaagagggatctctcctacgcaccagaagggcccatttcccagccacccgttccgcctgctactgctgttctaccatgtggccacacctttcatgagtattgtttggagcgaataacccctgatgaccaatccaaatatcctccatgcattccttgtgctcttctcgagtag

SEQ ID NO: 324 - DNA, 813 bp, Glycine max
  Peptide Sequence Number=SeqID_92009
atggagatttgccgcaacatcattttccccctcaggcgtctctgccttgctctctctgctcgcctcaagcctcgcaaaaacggagctggactgctcaagcttcaggatgatgtacagacatgcggatatcaagatgtacaagtgatgtgggaaatgctacagagaacagaagcattttggaacaaatgctatgaaattgaaaactttgcaggctttgctggagctgaaccggcatcacttgctggtacgggtgatattagcggaacagatacttatggtcaggctgcttcaaatttagttgctggtagtagtcttgagcagactattcagcaaattatggacctgggtggtggcagttgggacagagatacagttagtcgtgctcttcgagcagcttacaataacccaaagcgtgctagaattcctgaagcagcagaaattgctgtgccagctgctccttacccaatcagtcaaacaacggaaacaggtggggtcaccgccggggctgtttctgggcctgtacttcaggaacttggaaagcagaatcttagtctctcaagacttattcaagagcatcatggtgaatttctccagttgattaacgatcctgttgagggttctgaaggtgatatatttgatcaacctgagcaagatatgcctcatgctatcaatgtgacgccagcggagcaggaggcaattggaaggcttgaggctatgggatttgatagagcctcagtcatcgaggcatgtgaccgtgacgagcaattggcagccaactacttactggaaaatgctggagattttgaggattaa

SEQ ID NO: 325 - DNA, 2703 bp, Glycine max
  Peptide Sequence Number=SeqID_92010
atggcggaaaccactcaattaactcgccacattgagtcctatgtcgactcttcttctactcccgctcagcaggcttcaagtttgaacgcagttgcatctctcgtgaacactgatgccttacctctagaagcactggttagagagttggagatgtatttgaccacaacagataacgttgttcgtgcaagaggaattcttcttctagcagaggtaatgactcgtattgaatcaaaacctcttaacagtgcaactatacatagcttggttggattcttcaaggacagactggcagattggcgagcagtacaaggtgcacttgtcggttgcttggcactgataaggagaaaaagtgttgtgggtatggtaacggatagtgatgccacaaccattgctcagtcttttttacaatacatgcaagttcaatctttagggcagtatgacaggaagggggaggaccttatttatggaatttgtgaagccatagatgcagaaaaggatccagattgtttaaagcttgcttttcatattgttgcatctttggcacaattaaatccagattcatctagtctacttgcaagctatgcaaaggattctgcattctcttctacacctctctttgagccgtttgtcattcctctgcttcttgagaaactttcttcttcactgcattctgcaaagatcgattccttaaaatatcttagagtgtgctcttccaagtatggggcagagagaattgcaaaatatgccggggctatttggtcttcattaaaagacaccctatctacttatttgggggagccagatttttcttttactatagcacctgtagatggtattggcttcccagagaatgaatttgtgatagaagctctgtccctccttcagcagcttattgcgcaaaatagtagtttgttggttagcttgataattgatgacgaggatgtcaacactattttcagcaccattacctcttatgagacttatgatgctattcctgtgcaagaaaagaagaaactacatgctattggtcgtattctgtatattacttccaagactaccatttcttcttgtaatgccatgtttgaaagtcttttcaccagaatgatggataatttgggattttctgttaggtttccaaatggtgatatttccccctctcagagactcaagtttggattcctttatctctgcattgaactacttgcaggatgcagggagttaattgttgggtctgaggaaccagctctgcaatatgtttttgagcatgagacttgttgcactatgcttcatagtttttcaaccccattatttaatgcctttggttcagtcttggcagtaagtgctgacagaggccctcttgatccagatacatacgttggagcttttggaatgctattcttgccagttgctcccatggtattcagctcttcaggacttatattcactttgcttatgctgatccatgaaaatggaggttcagaggactttgtgatgcaatttgctgtggacatttggagtcaagctggaaattgcatggatttgagtaccccattcgagggaaagggtcttcttgacgcaatgatgaaagcgatgagactttctgtagggagttgttctgtggagagccaaaaccttataattcgcaaagcttacagtgtactgtcttcacacactaactttcagcttaaagaagttgaaagattaccactaactcctggaaaatatgacatttcccttagagatgaagggataatttcattatttgcatcagtagttattgcagtttgccctaaaacatacattccaaatataagagtacttgtgcatctatttataataaccctcctcagaggtgttgttccagttgcacaggccttgggttccatacttaacaaattagtttcaacatcaagcactgcagagaactctagtgatcttaccttggaagaagctctggatgctatattcaatacaaaaatatcgttttctagtactgatatgttgcagagatgtaatggaacaagtaatgggaatgaaatggtttttactgatatatgcctgggcattgcaaatgatagaatgcttcaaatcaatgccatttgtggactctcgtggatgggaaaaggtttacttctacgtggtcatgaaaagattaaagacatcactatgatttttatggagtgcttaatatcaggcacaaaaagtgcctcgcctttgatcaaagattcacttgaaaatactgaagagcagattcaggacctgttagtgattaaatgtgctactgatgcttttcatgttcttatgagtgattcagaagtttgtttgaacagaaaatttcatgccacaatacgacctctatataagcagcggtttttctcttctgtgatgcctatcttgcagcagatcattacaaaatctcactcctcattgtccagatcctttttgtatcgagcttttgcacatatcatgtctgatactccaatggttgctatagtgagtgaagctaaaaagcttataccagttctactggattgcttgtccatgttgacagaaatccaagataaagatatgttatatggtctgctgctagtcttatctgggatattgatggagaaaaatggacaagaagctgtcgttgagaatgcacacattatcatcaattgtctgattaagcttgtgggttaccctcataagatggtatga

SEQ ID NO: 326 - DNA, 510 bp, Glycine max
  Peptide Sequence Number=SeqID_92011
atggacggcggatccggcagccgggaagaacagaatcacgccgagaaacagcagcagacggagcaagagccagaacacgatgttcctcggagcaccgaatcatccgagaataatgccacgatcaatgaagaagaatcgaggcagaaagcattggatcaagcaaatgatgcaaaggtaaaagggaacaagctttttggagatgggaagtatgaagaggtgttatcgcaatatgaacttgctttacaagtagcaccagacatgccttcatctgtcgaaatacgttcaatatgccattcaaacagtggtgggtgctttcttaaactgggaaaatatgataacacaattaaagaatgcacagaagcattagaactgaatcctgtttgcgttaaagctctggtaagaagaggagaagctcatgaaaagcttgagattttgaagaggccattgctgcgactagagccccttgctgcagaaaaacgagaaaagatgaaggaggaaatgattggttag

SEQ ID NO: 327 - DNA, 1224 bp, Glycine max
  Peptide Sequence Number=SeqID_92012
atgtacagagcagtagcttcacgtctcacccttcccaagggaaatgggagaaccttgggagcctccagaggtttattcaactggcttactggggaatcttcaaatcctcttcctccccttgacaccccacttagaggggtttccctgccaccttcattgccagattatgttgaaccaagcaagaccaagatcacaactctccccaatggtctaaaaattgcatcagaaacctcaccaaaccctgctgcctcaattgggttatatgttgactgtggttccctctatgagacgccattgtcaagcggggcgtcacacctgttagagaaaatgtctttcaagagcacggcaaaccgaagtcactttcgtgttgtaagggaagtggaagcagttggtggcaatgtaggagcctcggcctctcgggagcaaatgggctacacttttgatgctctaaaaacttatgttccacaaatgattgagttgctggttgactgcgtaaggaacccggccttcttagattgggaggtcaatgaagagcttcggaaggtgaaatcagaacttggagaactatcaaacaatccccaaggcttacttttggaggcagttcactctgctggttattctggagcattggctaatccacttttggcttctgaatcagcactgaacacattaaatagctcccttttagaggaatttgttgctgagaattatactgcatctagaatggtacttgcagcatctggggttgagcatgaagaacttttatctgtcgctgaaccacttctctctgatctaccaagtgttccctgtcctgaagaaccaaaatctgaatatgttggtggagatttccgtcgtcaaggtgaaccaggggttgcacatgtagctattgcttttgaagtgcctggtggctggaaaaaagagaaagaagctattgttttgactgttctacagatgcttatgggaggaggtgggtcattctcagccggagggcctgggaaagggatgcactcaaggctgtttcttcgtgtcttgaatgaacatcaacagattcattctttttctgcattcaacagtctcttcaacaatacagggttatttggcatctatgcaagcacgggctctgattttgtggcaaaagctgtggatttagcagccagagaattaattgcaattgcatcaccaggacaaggtttaatctgcattgctttttgtctcttgctgtga

SEQ ID NO: 328 - DNA, 207 bp, Glycine max
  Peptide Sequence Number=SeqID_92013
atggctatgctgatgtttagtagtacagcagaagaggttaacccagcgttgaaggcagtacacgttggtgcagtaagagagaggaaaaaagctagaaaacttttcagtggtagtaggaaaatacaagcaactgggaacttaattggcagtgtctattgttgtaggttaatagtgaccattattggagtgagtgactggaagagataa

SEQ ID NO: 329 - DNA, 1470 bp, Glycine max
  Peptide Sequence Number=SeqID_92014
atgggaatgtccaggagtttcctagttacttttctaggatgtctagttcttgccgttctgattcaagctcaggatcaatcaggattcatcagcatagcttgcggagctcctgcaggtgtgaactttactgtgccgaatacaggcttaaactatacatcagatgcaaatttcataaatactggtgtgagcaggacaatagtacctgaactcagagatcagtttctacaaaacgtgtggaatctcagaagcttcccggaaggacaaaggaactgctacaaaataaacatcacaagaggctccaagtatctgatcagggcttcttttttgtacggaaattatgatggcttaaatatgttaccaaagtttgatcttcttctcggggctaaccggtggcttacagtgaacataaacaatgcatccgttagtctagattttgagatcatatatgtaccttcactggattacgtacatatctgtatggttgacacaggccttgggacaccatttatatcagctatagagttgaggactttgagaaatgacatttatgaaactgaatttggatcattggaaacgtacacccgtgtggatttaggttcaaacagaggctacaggtacaactatgatgtttatgatcgttactggagcggtgccgatctagatacatggagaccactaaattttccgattgatgctgattctttagtgcagaacgactacaaaccgccagctgttgtcatgagcaccgcaattacaccagcaaatgttagtgctccattggtaataagctggaagccagatgatccaaaagattcattctatgtttacttgcacttcacagagattcaagtgttagcaaagaatcagacgagagagttcaacatcaccctgaacggaaatccatggactgaaaatatatctcctaggtaccacagtgtcaatactatatatagcacttcaggcatcagtggggaaaaaattaatttttcatttgtgatgaccgagacttctaccctacctcccatcatcaatgccattgaaatttacacagtgaaagtgttcccgcaaccagacacgtaccaaagagatgttgatgcgattacaaccatcaagtctgtttatggggtgacaagagattggcaaggtgatccatgcagcccgaaagattacttgtgggagggtctgaattgtacgtatcccgtaattgacttcccaagaatcataactttgaacttatcttcaagtggattgtcaggaaagatagacccttcaattttaaatctcaccatgttggagaagttggatttatcaaacaatagcttaaacggtgaagttcctgattttctgtctcaattacaatacttgaagatcttgaacttggagaataataacctctccggttcaattccctcaacacttgttgaaaaatctaaggaaggttccctatcattaaggtatggatcctattga

SEQ ID NO: 330 - DNA, 1614 bp, Glycine max
  Peptide Sequence Number=SeqID_92015
atgcgaatgtccaggagtttcctagttgcttttctaggatgtctacttcttgccgttccaattcaagctcaggatcaatcaggattcctcagcatagcttgcggagctcctgcaggtgtgaactttactgtgccgataacaggcttaaactatacatcagatgcaaatttcataaatactggtgtgaagagcacaatagtatctgaactcagagatcagtttcaaagacacgtgtggaatctcagaagcttcccggaaggaaaaaggaactgctacaaaataaacatcacaagaggctccaagtatctgatcagggcttcttttttgtacggaaattatgatggcttaaatatgttaccacagtttgatcttcttctcggggctaaccggtggcgtacagtgaacataaaaaatgcatccgttagccgacattttgagatcatatatgtaccttcactggattacgtacatatctgtatggttgacacaggccttggtacaccatttatatcagctatagagttgaggtctttgagaaatgacatttatgaaactgaatttggatcattggaaaagtacatccgtcgggatttaggttcaaacaaaggctacaggtacgacgatgatgtttatgatcgttactggaactatgacgatgcagatacatggtatgacaatgtagataaatggaaacagctaaattttccgattgatgctgattctttagtgcagaaacagtaccaaccgccagctgttgtcatgagcaccgcagttacaccagcaaatgttagtgctccattggtaataagctgggagccatatgatccaaaagattcattctatgtatacatgcacttcacagagattcaagtgttagcaaagaatcagacgagagagttcaacatcaccctgaacggaaagctatggtatgaaaatgagtctcctaggtaccacagtgtcgatactatatataccccttcaggcatcagtgggaaattaattaatttttcatttgtgatgaccgagacttctaccctacctcccatcatcaatgccattgaaatttacagagtgaaagagttcccgcaacaagacacataccaaggagatgttgatgcgattacaaccatcaagtctgtttatggggtgacaagagattggcaaggtgatccatgcagcccgaaagactacttgtgggagggtctgaattgtacgtatcccgtaattgactccccaagaatcataactttgaacttatcttcaagtggattgtcaggaaagatagacccttcaattttaaatctcaccaagttggagaaattggatttatcaaacaatagcttaaacggtgaagttccggattttctgtctcaattacaatacttgaagatcttgaacttggagaataataacctctccggttcaattccctcaacacttgttgaaaaatctaaggaaggttccctatcactaaggaaaaagaaaagggagagaggaagaggacaaaaagaacatgttacacccatagtagcgtcagttcgtggggttgaaagttatccttctagaagccaaaaattatcatgttgtcatttaactgagaaatttaaggattga

SEQ ID NO: 331 - DNA, 327 bp, Glycine max
  Peptide Sequence Number=SeqID_92016
atgctaaggttccattgctatgctaacagtgatgcacattacaagctaagggtaagggaaaggggaactaacctgttcgcggagaagaagaagaaagccttggcgcgcctcgcggagaagaagcttcacggagaagagaagaagcaggttccgggagaagaagaagctgttccgggagagaagaagctgtgttccgggacgggagagaagaagaatttgttcgaaaaaaagtggcaaaatggtactttcaatcaattgctgggtgcaccagcaatattgctgggtgcacctagcaactcccctctcggagttgtcttgcacacctaa

SEQ ID NO: 332 - DNA, 648 bp, Glycine max
  Peptide Sequence Number=SeqID_92017
atggcttgtgttgtgtttttttttttttttttttttttttttttttttttatgctctgtacttgcagctgtccaagaatgttggagagatccacaacttggtttttctccctacagtgttcattcacacaagggatttcttaagcatttgatgctgagaactggaagggatgtaacaacttatcagcctgaagttatggtcaactttgtgacctcttcctacaagcctgagctgttgaagttcctagttgataaagtttctgtatttcctgaagtggtaagtgtcgttaataatgtaaatacatctgttggggaggaagaatacactttgtacggtaaatctagcattacagagaccttaagagggtgtacattccaaatatcagccaactctttctttcaaacaaatacttatcaggcagaggttttatataagcttatagaagattgtgctggagtcaggggtgatggctcagaaattgtccttgacctgttttgtggaacaggcacaataggtttgacgcttgcaagaagtgatagacatgtttatggctatgaagtagttcctcaagccatcacagatgctcatcttaatgccaagataaatggaataaaaaaatgcaacatttgtccagggagatctcaataa

SEQ ID NO: 333 - DNA, 780 bp, Glycine max
  Peptide Sequence Number=SeqID_92018
atgcaggatccaacgttgttccaacccatgaaaccccactttccggaacaggagcagcttaaatgcccgcgctgtgactccaccaacaccaagttctgctactacaacaactacaacctctcgcagccacgccatttttgcaagaactgcagaaggtattggaccaaaggtggtgccttgagaaacatccctgttggtggtggaagcagaaagaacacaaagcgatcatcttcatccaacaacaacaccaaacgcgcttccccatcacccccagtttcctctgcacccgctccagaacccgaccctacccggattggccccaccccggttgttggtggcgggagtttcagttcccttttggcatcaagtggccatttgggcctggggaacctcttggagggtctgaattcaagtgggtctaatctgaaaactgtgcaaatggaagagtttggggagaatgttagttcgggtccggttgcggatccggattcgggtcggaatcccgggttggagatgcaaagcaatgggaacgcagagaattttctgagtttgcaaaatggtgattcaagctgttggaatgacatatgtcgtactattatggaggatcacaaaccagaaggccactgctataggatcattagctatatcaatgatggaagagaaatggaaagcaagtcatattttagggcagggtatggggggtatatgaatgttgttgtagtgagattgttttcagtctcatcacgtagaggaagtgttgccatggcttggagattctaa

SEQ ID NO: 334 - DNA, 663 bp, Glycine max
  Peptide Sequence Number=SeqID_92019
atggctgggaacgttgtggtttttgacttcgactcgacaatcatcgagtgtgacagtgataattgggttcttgatgagtttggtttaactgaaaagttctatcagcttcttcctaacatgccttggaaccctctgatggataagatgatgaatgaacttcattcacaaggaaaaaccattgaagacattgtacaagttctgaacaggactccaatgcatcccagcattgtcccagccattaaggcatcatattcccttgggtatatacctttttcctttctcttttcactcaccctttattacaagtacgatatgcctaatagcatagtaggaacaaagggaatgatcatagaaaggatccaaaattcggttgatgctgcaggaaagaaattcatctatcttggagatggaagtgtagacttttgccctagtttgaagctcaaagatagggattatctgatgccaagaaagaattttccattgtgtgatttagtatctgaaaactctaatctcataaaggcagaggtacatgcttggagagatggggaagaactttatgatgttctgctccattttattaacaaagctattggtgaaggaaacggcagtattagtagttctactccaataatatccgttgattgcaagttggagttcaattga

SEQ ID NO: 335 - DNA, 2280 bp, Glycine max
  Peptide Sequence Number=SeqID_92020
atggaggaaaagcctaagctcctcatccatggaacaattgaagctaccatcttcaatgccacaccttactcaccttcgtttcccttcaattgtgtatgcacaaatggaaagcctgcttatgtgaccatcaacatagacaacaatagggtggcgaaaacgacccaagaacatgaacgtgtgtggaaccaaacctttcagattcagtgtgctcatccagaagactcaactaccacaattacactgaaaacatcatgctccgttttgggaaaattccacgtgcaggccaagcggttgaaggaagagagtttgatcaatggtttcttccctctccttatggaaaatggaaaaccaaatccacaactaaaattaagattcatgttatggttcaagccagcagatatggaaccaagttggacaaagatactaagcaatggggaatttcaagggctgagggatgctacattcccacaaaggtccaattgccaggttaaactctatcatgatgctcaccattcctctactttccaacctccttttgatctatgtggagcaccaagaaagctgtgggaagatgtctataaagccattgagggtgcaaactatttgatttatattgcaggctggtctttcaatcccaagatggttctggttagagatccacaaacagaaatcccacatgctagggagataaagctgggtgaactattgaagaagaaggcagaggaaggagtagctgtgagggttatgatttgggatgatgaaacatctttgccttttattaagaacaaaggtgtgatgaagactcatgatgaggacgcttttgcctacttcaaacacacaaaagtaatatgcagaaagtgtcccaggttacaccacgagtttcccacactctttgctcaccatcagaagaccataactgtggacaccagagcacccaactctgttcgtgccagagaaattatgagctttttgggtggtgtagatttgtgcgatggtcggtatgacacagagaaacactcactgtttcagacactcaccgaggaatcacattaccatgacttctaccagacaaacatagcaggagctagcctcaacaaaggagggccaagagagccttggcatgatgctcatgctagtgtaactggtgatgctgcttgggatgtgttaaccaattttgagcaaagatggacaaagcaatgtgatgcttctcttctagtccctgccaacactctagaaaatctcattcccacatgctcaagccctcccaaagagaggaattggaaagttcaagtatacaggtcaattgaccatgtgtctgctagccagttgtttagaaagctaactgtggagagaagcatccatgaagcctatgttgaagcaattaggcgtgccgataggtttgtgtacatcgaaaaccaatattttattggggggtgccatttgtggcagaaagataggcatagtggatgcaggaatctgattccggtcgagattgcactcaaggtggtcagtaagattaaagcaagagagaggtttgcagtgtacatagtcatcccaatgtggccagaaggagtgcctgaaagtgaaccagttcaagatatactgcactggaccagagaaacaatgataatgatgtataagttgattggagaagcaataatagaaagtggtgagccaggacatccaagagattacttgaatttcttctgccttgcaaatagggaaaagaagggaaaagaggagtatctttcaccacattctccccatcctgaaacacaatactggaatgcacaaaaaaataggaggttcccggtttatgttcactccaagatcatgatagtggacgatatatacatattaataggatcagccaatgtgaaccaaagatccatggatgggcaaagggacactgagattgccattggggcctaccaatctcaagatggagctgatcaccacattataagccgtggtgatattcatgcatacagaatgtcactgtggtatgagcacactggaatcactgaggaattgttcttagagccagaaagtttgtcatgtgttaagagaatgctgtcaataggggatcacatgtggggagtctacagtagtgaagaaactgtggacatggaaggtgtgcaccttgtaagttaccctgtgaaagtaacacaagaagggtctgtgaaggatacggttgatggtggagatcattttcctgacacaaaatctccagtgaaggggaaaagatcaaaattcttagcccctatctttactacttaa

SEQ ID NO: 336 - DNA, 2583 bp, Glycine max
  Peptide Sequence Number=SeqID_92021
atggttatttgcttgaagctcataataatgtggaatgtggcactgcttctggttttttctctaattggttctgctaaggcctcagtgtcctatgactcaaaggctatcaccattaatggccagagaaggatcctcatttctggatccattcattacccaaggagcacccctgagatgtggccagatcttattcaaaaggccaaggatggaggtttggatgtgattcagacttatgttttctggaatggacacgaaccttcacctggcaagtattattttgaggggaactatgatctggtgaagttcataaagctggtgcagcaagcaggcctttatgttcatctcaggattggcccttatgtctgtgctgagtggaactttggtggtttccctgtttggctaaagtacattccaggaatcagtttcagaacagacaatgaaccatttaagcatcaaatgcaaaaatttaccacgaagattgttgatttgatgaaagcggagaggttatatgaatctcagggtggtccaataattatgtcccagttgactagagtggggatgagtactaagactgttatctttactactggtgtttttgttcagattgaaaatgaatatggacctatggagtatgaaattggtgctgctggtaaagcttacactaagtgggcagcagaaatggctatgggacttggtactggggttccatgggtcatgtgcaagcaagatgacactcctgatcctcttattaacacttgcaatggcttctattgtgattatttctctccaaataaggcttacaagccaaagatgtggacagaagcttggactggctggtttactgagtttggaggtcctgttcctcatcgaccggctgaagacttggcattttcagttgcaaggtttatacagaaagggggatcatttataaattattacatgtatcatggaggaacaaatttcggtcgaactgctggtggtccctttattgctacaagctatgattatgatgcaccacttgatgaatatggattgctcaggcaaccaaagtggggtcatctgaaggatttacacagagcaataaaactctgtgaaccagctttagtatctggagatcctactgtaacaaagattggaaactatcaagaggctcatgtctttaaatcaaagtcgggagcctgtgctgcattccttgcaaactacaaccccaaatcttatgcaacagtggcatttggaaacatgcattacaacttgcctccttggtctataagcattcttcctgactgcaagaacactgtttataacactgcaagggttggttctcagagtgcccagatgaagatgactcgtgttcctattcatggcggattctcttggctatcattcaatgaagaaacgaccactactgatgatagttccttcaccatgactggcctgttggagcagttaaatactacaagagatttatctgactacttgtggtactccacagatgttgtgcttgatcccaatgaaggatttctgagaaacggaaaggatcctgttcttactgtgttttctgctgggcatgctttgcatgtttttataaatggtcagctatcaggaactgcatatggaagcttagaattccctaaactgacatttaacgagggagtgaagcttagagccggtgttaacaagatctctctactgagtgttgcagttggactcccgaatgttggtcctcattttgaaacatggaatgctggtgttcttggtccaatttcattaagtggtctcaacgaagggagaagggacttgtcttggcagaaatggtcttataaggttggtcttaaaggtgaaatcttgagtcttcactctcttagtggaagttcctcagtggagtggattcagggatctttagtttctcaaaggcagccattgacttggtacaaaacaacatttgacgcgccagctgggactgcaccattggctttagacatggacagcatgggcaaaggtcaagtgtggttaaatggacagaatcttggccgctactggcctgcttataaagcatccggtacctgtgattactgtgactatgctggaacttataacgagaataaatgcagaagtaactgtggcgaggcttcccaaagatggtatcatgttcctcaatcatggcttaagccaacaggaaatttattggttgtgtttgaagagctaggtggagaccccaatggaatctttttggttagaagggatatagatagtgtatgtgctgatatttatgagtggcagccaaatcttataagctatcagatgcaaacttctggcaaagcacctgttagaccaaaagttcatttatcatgtagcccgggacagaaaatctcatcaatcaaatttgctagctttggtactccagcaggttcttgtggaaacttccatgaaggaagctgtcatgctcacaagtcttatgatgcctttgaaaggaattgtgttggacagaactggtgcacagtaacagtgtcacctgaaaattttggaggagatccatgtccaaatgtcttgaagaaactctcagtggaagctatttgttcctga

SEQ ID NO: 337 - DNA, 141 bp, Glycine max
  Peptide Sequence Number=SeqID_92022
atggagagaaggaagaaagtgagtcaaagagaaaaggtgacattattttttgccaaaggggagaagggtatgacaagtcaactgggattgattctgcctactctctcagcttttagaggtatgggtattcatattcaataa

SEQ ID NO: 338 - DNA, 1113 bp, Glycine max
  Peptide Sequence Number=SeqID_92023
atggtggtggaggctggtaatcgtggtattttgttcccagaaggatgcattgagccagttgggagccaacagtgtaagacaggggaaggagttccttctgagaaccagatttatgtttttaatggaaattgtgtacataagggagcgtggggaattgaagtatttttggtcttgctggcttggaaggtcttgatggctcacagagtatatctacttcgtggaaatcatgaatcaagatattgcacagcaagatatggttttaagaaggaagtgtgggccaaatatggtgatcaaggtgaagatgtctacaatgaattcctagtgtgtttcaaggagcttccattagcttcagttattgttgactctgaattatccgaagttaaaagatcttttgtagatttcccttatgaaggtcctaacatattattgagtgatattctctggtctagaccgtctaatagggatggtctgagggataatacaggtgaagagttaggtttacggtggggtcttgattgcactgaggcattcttaaagcagcacaatttaaaggaaggaccagatgcaagggctggtagagatgaatttggggatatgctgagtggatacagcatagatcatgatggagaatcgggaaaactatatacactttttagtgcaccagactatccacagtttggtaaaaggagatataacaataagggggcatatgcagtattgaagtcgcctgattttgccagtctttcctttcactcattcaaggcggcagaaagaccaatggcctcaatctctaccctttctgcccctcaaagattttatccagatgggatgagacctgagtttgactttggggcattaggcatatataatgccccatgttggaatgtagaacttcgtgatggttcaggtggtactcaagttgtggaggttccaagggcaccattggcggaaggattgcctctgcctccaaacatacagactgcttatgagtatttgtttgagctagttaatggcctgaaacatatgattgtaacaagggagactgagaacagggcccgtgtgtctgctttgagaagtagagctaggaaacgaaagggtaagggtaattcatag

SEQ ID NO: 339 - DNA, 3813 bp, Glycine max
  Peptide Sequence Number=SeqID_92024
atggcacgggggaggatcagagcaaggatccgaaggagccatctttacacatttggtggttgcctgaggccaactaccactgaggaggtgcctcatccccttcaaggtccgggatactcgcgaacagtatactgcaaccagcctcaactccttgaaaagaattctctattttactgcaagaatgatgtatcaaccaccaaatacaatgtcatcacgtttttccctaaggcactgtttgagcaatttcgaagggttgctaatatatacttccttttggctgcttgcctttcggcgtctccaatttcacctttcagcccactaagcatgattgctcctttggcgtttgttgtggggctgagtatggcaaaggaggcattggaggattcgcgcaggttctttcaggatgtcaaagttaatcgccggaaagctagtctccataaaggcaatggcatttttggtctcaggtcgtggcagaagattatggttggggatgtggtaaaagtagaaaaggaccaattttttccagctgacttgcttctcttggcgtcaagttatgaagatgggatatgctatgtggagacaatgaatttagatggggagacaaacttgaaggtgaagagatctttggaggctaccttgtctctggataatgatggggcttttaaggatttctctggaacaatacgttgtgaagatcccaatcctgatctttacacttttgttgggaactttgagtatgaacatcaagtttatcctcttgatcctggccaaattcttctccgtgattcaaagcttaggaacactgatcatgtctatggagtggtcattttcactggacatgacagcaaagtcatgcagaattctaccaaatccccttcaaaaagaagcacaatagaaaaaaagatggattatatcatatacactcttttcactgtccttatatcgatatcttttattagttcaataggatttgttgcaaagaccaaataccaaaccccaaagtggtggtatttacggcctgacaatattgaataccagtttgatcctggtaaacttggattggctgggatgagccatctgatcactgcactcattctttatggatatttgatacccatctcgctttatgtttcaattgagtttgtgaaggtattacaggcaaccttcattaaccaagacattcaaatgtatgatgatgaatctgggactccagctgaagcacgaacatcaaatttgaatgaagagttgggtcaggtagacactatcctatctgataaaactggcactttaacctgcaaccagatggactttttgaagtgctccattgctggtactgcatatggtgtttgttccagtgaagttgaacttgctgcagcaaagcagatggcttctgatcttgaggagcaggaattggatctctctaatttccccatgcgtaaggagagtaacgtgcaatgggaaaatatcacagaagatgaagaaactgaactggggactgttgttacttccagggatgatggagctcgtaggcctgccataaagggatttggttttgaagatgaccgccttatgaatggtaattggttgaaagaacccaatgccgatgtccttttgctgtttttccggatattagcagtttgccatacagccattcctgaactgaatgaggagactgacagttgtacatatgaagccgaatcacctgatgaaggggcttttctagtagcagcaagagaatttggttttgaattttataggagaactcaatcaagtgttgtccttcgtgaaagattttttgctttgggtcaagtggttcaaagagaatataaaattttgaatctgctggactttactagcaaaagaaagcgcatgtcagtcattgtgcgtgatgaggagggaaacatcattcttttctgcaaaggagctgacaggacactgggaccttctattggtttctacaatggaatcattaaaatcctattcatgcttgtggagtttatattctacttactactaccatactatacaatcacagcaactccctgcttccagaggatgcctgtgaaaatacacattatcatatttgatcgactgtctaagaatggaaaaatgtgtttggaggctactactagacatttgaatgaatatggagaagctggtttgagaacgctagccctggcttacagaaagcttgatgaccaagagtactctgattggaacaacgagtttcagaaggccaagacagctgttgggtctgagagagaggcaatgcttgagcaggtttcagatattatggaaagagagttgattcttgttggggctactgcagtggaagataaactacagaaaggggtgcctcaatgcattgataaacttgctcaagctggtctaaagatctgggtattgactggggataagatggaaacagcaatcaacattggattcgcttgtagtttacttcgacagggcatgaagcaaatctgtatcacaatgaattcagattctgtaactaatgatgggaaagaggtcatcaaaggcaacatcttgagtcaaatcaccaatgcttcacaaatgataaagctggaaaaggatccacatgctgcatttgcattaattattgatgggaaaactctaacatatgctttagaagatgatgtcaagcaccaatttttgggattggctgttggttgtgcatctgttatttgctgtcgtgtgtctccaaagcaaaaagcattggtaacaaggttagtgaaagaaggaactgggaaaaccactttagccataggtgatggtgcaaatgatgttggcatgattcaagaagctgacattggtgttggaatcagtggggttgaaggtatgcagcatgtaacatttgtggaagttgtggaactcaagcttgcaaattcttttcaggcagtaatggctagtgactttgctattgcccaattccggtttttggagcggcttctggttgtccatggacactggtgctacaagagaattgcacaaatggcctttgcgggcttctctggacaatcggtttatgatgactggtacatgatattgttcaatgtttttcttacatcattgcctgtcatttctcttggagtttttgaacaagatgttccatcagaagtttgcttacagtttcctgcattgtatcagcaaggacccaaaaatttgttctttgactggtatagaatcttgggatggatggggaatggtctttattcctcccttgtcatcttcttccttgtgataataatcttctatgaccaagcattctgtgtgaatggccagatcgcagacatggctgctgttggtaccatgatgttcacctgtataatctgggctgtcaattgccagattgcactgacaatgagccatttcacatggattcaacacctcgttgtgtggggcagcataaccacttggtacatctttctgttgttgtatggcatgcttccaccacaatattccaagtctgcctaccaactattgattgaggttcttgctcctgctcctatttattggacagcaaccctattagtaacaatcgcatgcgttcttccttatcttgcccacatatccttccaaagatgttttaatcccatggatcatcacattatccaagaaatcaagtactacaagaaggacattgaagatcaacacatgtggaccagggagcggtctaaagcaaggcaggtaactaagattggattcacggcaagagtggaagcaaagattaggcattttaaaggcaagctgcagaagaagcaacagtcttcactgggggctttgtccccatcatga

SEQ ID NO: 340 - DNA, 1068 bp, Glycine max
  Peptide Sequence Number=SeqID_92025
atgctggaaaatgtgaaggacaatgttcctgatttttgcacaggaatgggaatgcttgcgataagcaaggaagagtttcctttcttgaatgatttctacaagaacaacataaacttgaatgatttctacaagcctgaacaatctactagcttgaagagaaggaagaagcttttctgggttgcggaaaatcaaagcatggaggtggaagttcatggtgaagatggttccaaattcgcactgggaagggatcagaaaacagtgtttggacgaggctgcggattcagcacccacgaccgcacagtgtctcgtcgccacgtgtccttcgaactcgaccattcacactcagaggatgctaatgctagggtttctttccaagtcatggggaagaaccccttttgggtgtacgacggagaagcgcttcggctcttcagaaagttcgacaagggtcacctgcaactcggacaccgtttctgcttctctcccaacacacccctctggttcactcttactaatattcagcctctgcctcaacttaaccttgatgaaattcacgtttcggaaatcgatcccgttaaagagtttggttttcttgtgatggggcatgagtttgaccactatcccaaggggatgatccggaatgcaaagaattgggactggttccttgaggaacgtaggaaggatagtgaggatgaggaagatgttgagaagcagaggaggaaaatgaggggaaagcgaaaaatgggcaaggttaatgaagatgatgagtggaccggtgaaagtgaagatgataagggccttgttgccaatatgcggaaaggtaagctgcccaggtactccacaaggtcaaaagacagtaaaggaggtatcaaagataccaaagctagtaaaaattctaaacaaaagaaagcgactagtggtgatgatactggtgaagaagaagatgatgatgatgatgatgagacactgggaggcttcattgttgctgatgaaggtgatgataaggaagaggaaaatgatgatgaagaagaggaagagtttgaagatgatgatgatgaattggatgattaa

SEQ ID NO: 341 - DNA, 978 bp, Glycine max
  Peptide Sequence Number=SeqID_92026
atgacttcaccagcgacggccatcctcctcgccgcaaccctaatcggcgtcgtttcagccgcaacaagaccaccagacccaccggaatgcgtgccggaaccgaatcagaacctgcagatcctccgccgcgacaaactcacggtcctcatgaacggcttctcggagtcccgaatcccgctcctccaatccctggccgctacgtactccctctcccccatcgtgtcctccgtgctcgtcctctggggcgaccccgccacatcgccacgtgtccttcaccgattggcccacaacctcaccctctcttcttcctcctcagcaccaatctcactcctcctccaaccctccaccagcctcaacaaccgcttcctcccgcgccccaacgacatttccaccgacgccgttttggtctgcgacgacgacgtggaggtggaccccacaaccttggaatttgcgtttcgcgtttggacgcaaaacccgcaccggttagttgggctcttcgcgcggtcgcatgatttcgacctggaccggagggagtgggcctacacggtccaccccgaccggttctccatcgtgctaacgaagttcatgttgttaaagacacgctacctgttcctctacacgtgcccgggtgggccccgcatggcgcgcgtgcggggggtcgtggacgaggtgcggaactgcgaggatatactgatgaactttgttgtggcggaggaggcggaggtggggccagttttggtcggggcgaagagagtaagggattacggtgatgccagaaatgaagaaaaaggagtgagtgtggtggggttgagtagcaggaaaggggagcataggaagaggagagggtggtgcataagggagtttcataggctcttggggacaatgcctttgaggtatagctatgggaaggtggtggattctgttggggaacaagccttgtgtttcaaaggtcgcaagttggtgtattgtgatcagtga

SEQ ID NO: 342 - DNA, 387 bp, Glycine max
  Peptide Sequence Number=SeqID_92027
atggccgtcctctggcgcctcactaaggagtcaaactcctactgtgttcccaacagcaggctaaccggccacttccacttgttccacgacgtcgttttatcgacaagacaagtcacagtatggggccttcgttccagctacaaggatattgtccaaagagagcatagaagtgattcactgtgcagtgaaatgattgggatggcggacaaggctatgcagatatacgcatccatgattggccttcttcttcttcttcccccgataagttcactttcaccatatcgttcagatatctacaaacatgacctcgtggaaactctcaaacaagactgtcttcactatgtggattcccctcatgccagaaccagacatgtcgatttcgtatga

SEQ ID NO: 343 - DNA, 1173 bp, Glycine max
  Peptide Sequence Number=SeqID_92028
atgtttgattggaatttggaagagatcgagaggcagtttgcactttacacacctcaaggcattgggcccactttagaatatagaaaattagaagacgaagatgctgccaaaacccgcccccgtcttgtaattgtaaagccaccacaatcgctacccttggctgcaagcttaagcctaagcctgagacataccatagagaaacctaactgcacctgtgcacacactttcaatgaagttcttctattctcgaatagtcctccaccaaaaccttgggaacaagcgggttcctcttctggtccagcacctttcaaacctccgtcagctggcaacacaagtgatgtagttgaggcttcagggactgcaaaacctggggaaattgtttctagttctgataggagtgcagctgtcaacaggaatactcttgggaggcctgttccctccaggccatgggagcagaattatggaaacagcacctatggaggatatggttctacaatgaattataattctgggtatggatctggaatgtatggatcttcttatggtggactaggaggtggaatgtatggatcttcatatggtggggggatgtatggtaacagtatgtacaggggaggatatggtggcctgcatgggtcatccgggatgtacggaggtggaatgtataacagtgccttagggggtccaattggtggttatggcatgggtggtggtccttatggagatcaagatccgaacgatccgttcggtgcccctccttctcctcctggattttggatttccgtcctacgtgtgttaggagtgcttatgagccatgtgagacaatacactatgatatcaggggtaatgctaatgcaaggtgtggttaacttttttggtcgaatatcaatactcatagaccagaacacacaggctttccatttgttcatgactgcacttctccagctgtttgaccgctctggaatgttgtatggagagctagctagatttgtgttgcggttgcttgggattagaacgaagtccaagaaggtttacccgccaggtccaaatggacagccgctgcttggacctggaccacacaatccttccggaaatgtaaactacattgaggcaccaaaggctgctccaagtggttcttgggacaacgtttggggaaatgacgccaatcaatga

SEQ ID NO: 344 - DNA, 2022 bp, Glycine max
  Peptide Sequence Number=SeqID_92029
atgcattcaagtgtaggaactggttcattggcatatgttgttggatccaaagtaatggatatgaggacttcatccaaagatggacggaaatcacaagctaaaatagaaggatcaacttatgataataatgttgaagtagggaaatgttatgataggagcattatttgtacagaggtagaaaattcaagccattgggaaagctccaataatggggttgacctagttagcttgagagtaagtgctgataatgcagcatgtgattcttctggtaaaaaaaactccagttccccaaagtcagggggagaagaagaggaatcagaccgtgtaactgaatgtagttttgattttcctcctttatcggtcactaatctgtttgagaagagtggtaaagataaaaattcaggcacagagcatggggataaacttcctgcaccagaacaatcaagatttgaagttgacagtatgcatagctttcaaattaataacaatgtagagttagttattgaatcgaattgccaacaacctcttgctaccttaaatcccatggactctgaaattggaattgcttcacctgatgaggaagaaccagaacttctgtctgagaatcaagtttatgaagcgcagatggtaaatcaactgaaaatatcagatgttccacagccagcaatgataagatccccaatttctcaaggatggcctgtcaatgaagagagagtatcagaatggctttggaccttgcataggatagttgttgatgttgtgaggactgatagtcatcttgaattctatgaggacaagagaaatttagctaggatgtcagatattcttgctgtctatgcatgggttgatccttcaacggggtattgccaaggtatgagcgatttgctgtctccctttgttgtaatctttgaggataatgcagatgcattttggtgttttgagatgcttttaaggagaatgagagaaaattttcaaatggaaggcccaactagagtgatgaatcagttgcgagcattatggcatattcttgaactgttagacaaagaaatgtttgcccacctgtcaaaaattggtgctgaaagccttcattttgcatttcgtatgttgctagttctctttcgaagagagttgtctttcaatgaggctctttcaatgtgggagatgatgtgggcagctgactttgatgaatccatggcttatgatttagaagagaactgtctggaagcattggagttacaacttcctagagactcaagcaatgatatgagagaagaaattgcagatagtgatggtggtagtgtgaagagtggttcacggtcaaatcataatgaaaatgacaacacaaaagccagcccacagtcaaatcatgaaagagctgatcactcagtatatgacagcaaattgaagtcgctctcatcccataccttttgtggcttggcaaggaatatctggcctagaaatcatcaagttcaaatgagcagtatttccttaacaaggaaaggaaataatgagttggccatattttgtgttgcagcaattcttgttttaaaccgtcagaagatcattcgagaaactcattcctttgatgatatgataaaggcaggtgcattgatcttttgttttactcagcatttaattactgctatgaaaatgttcaatgacaaggtgttaaaaatcaatgtgaaaagctgcataacaaaagcaatcaaactccgaaagaaatattttaacaagggatatgaccaaaatagttatttaagtaaagggcaaccctcacctcatcaacgtggggttgagttagactcaagctcaaattctaagatggtatcggagtctatcctaacagttattgttgggtctatcacgattcaggctaggccacctattattggaccacatagaaaggggactaagcttaaagtggttttgctttcagaggttcatccagctgctgtatgtccattgtcttcattactcttttttacgagatccctagatggtctttaccaggcatttctgtag

SEQ ID NO: 345 - DNA, 915 bp, Glycine max
  Peptide Sequence Number=SeqID_92030
atggcgaacccatctgggaaccatcaagaacacacgcacgtggtgtcatcttctgctccggagacttcaggtgcggctctcgccatgaagcacaaccctggcatatccctcgattggaccgcagaagaacaagccattctcgaagatggactctccaagtatgcctcggaatccaacatagtacgctatgcaaagatagccctacagctacagcagaaaacggttcgtgatgtagcactgagagtcaggtggatgaataagaaagaaaatagcaagagaaggaaggatgatcataatttaactcggaaaagtaaagataaaaagttttggaatagacagaatattgtaagtgttaaattttctaaccaggaagaagctagcatggcgtgttgtttcctcatttttggcttgttaaataggggatggtttagcatcttggctgaaagggtttctgatcctgcagtaaagtcatctaacttcactgctcgatccaatgtctccccatatgctccaccaatgattacaatggacaatgatgatggcatctcttatacagcaattggaggtcccaccggtgacctattagagcaaaatgcacaggccttgaatcaaatctccacaaatctttccgctttccagtgtatgatgttgttagatgctttggaagccatatttgagagtggggtttcttcaataacttatctgaaagcaacaaaacaaagggaaagtagatgtgaacaagtacaggagaacatcaatcttttctgccaaactagagataacatccttaaaattatgaacgagttgaatgactcgccagaggtgatgaagcaaatgccacctcttcctgtgaaggtgaatgaagagctagccagttccatacttccaagaacaaatctcccaccacaatcatga

SEQ ID NO: 346 - DNA, 2838 bp, Glycine max
  Peptide Sequence Number=SeqID_92031
atgaatttgcaacaagctgggcagtctaaatcctccaatggatatggccgccgaaaatctgaaagagaaggggcaactaaatcggagaataagatcttgtctgggaaattaaatgccaacagattggcaaatgcaggcgcagtgactggcagtaaaggtggcagttatgagagcccttcacatgaccgattagtatatgtaacaacatgtcttattgggcaccaagtggaagtccaggatggttctttacgaggacagaaatctggcacagaatttgtcagcaagcccctttcaaagattttaattatacctgccaaagaccttgtccaagttacagcacaggatgttgctattaccagggatggcttagctaatgagtatcaccatgatatgcatcaggaaatcatggttgattcattgatatctcagtctcgtcacgttgatctagggcgagaattaaaaccctgggtacctgatgaagacgatccacaatgccctgaactggaaaacatatttgacggccattggaataggggatgggatcagtttgaaacaaatgaggcattgtttggtgtaaaaagcacattcaatgaggacctttatacaacaaagcttgaaaaagggcctcagacaagagaattggaaaggcaagctttaagaatagcaagagaaattgagggtgaggaaacccaagatcttcatcttgcagaggaaagaggccttcacttacatgaagactttgatattgatgaagaaactagattctcttcagtctataggggtaaacgtgttgatgatagtggatttgatgagggcgtactgtttgattcacacaattctgaaacttttggtggggaaacttttggtggtgtgtttggttcggtcgttaagaggccaggtgaaataagtggtggaaaaggaaatgatggagctcaaacattggcaaattcctcctccgtggacataagcataaatgattattttttcgataaactgagtgagagtgagagagaaaatgaaaaagataaagctgatattattgctcagaaagaaaaactcaatgagttagatacaacagaggatcacacactatcatctcagtcaaatactggtgtggatttaagccgctctggttcttctgatcatgcgaagcagttagcatctgaactccctgccaaaagctactcgacatcggatggggaaagcaggattcaggagaactcgaatagtaatcaacatggagacaatggtattaccaaggaagaaaatctgattcaagctgaggatgttcaactgtcaaaatctgaggattcacagggaccactctacatgaataaggatggctctgataaaggggtattatctcctaatgccagctcttatgccccttcatctcatacttcatcaaaaactcatgagaagatgggatcacatggagatttggtcgatggttcagcatcgggcaaagctaatggggaaacgaaatctgtaaattcacggggaacacaatctgggtcagatttggttggaagcattccagcatcttctgctcttggtttatctccaagttcatcagttggttcactgtcttctgaaaaatcaactctgaatcccaatgcaaaggaattcaagcttaaccctaatgcaaagagttttattccatcgcctgctcggcctcccactccagtgtctgatggttccttctattttccaactaatgtaactactgtaccaagtatgccaggcatgcccatgggtattggaattggacctacttttgctagtccacaaccggtcatatataatcctcaggtagcacaaatgccgtctcaaggatattttcatccgaatgcaccccagtatggacagcttcttggtcatcccaggcaagctttatacatgccgagttacatgcctgtaggccttgagccagagtggaaaacaatgaattgcttatgtgagaaagactctggtctattttcttctcattcaacagctccctatgttcttggatgcccatcatgggcgacttctgaatttgaagtccaacgatcatctatgtccagaagtttgagctcaaaagtggatgttcttccacaacaatgccacaatagcaagacatttaattttcaattccaagaacaggatgcatcttcaaccaaatccactgatcaatcttatccagaagttggtacggtacaatccggtcaaatttctgtccagcatagttctactgattcaacacttatcagaaatgaggggaagagtatgggatgtgtcatcaggtcatttatggggagtcaggatttccctttccctcctccactactggatcacagaccaatacttgcgcatattgcatgtcactatgctgatccatgctatagtggcctagtggctgctgcatatagtccacagtctaagccagtggaaactgctcctgttcgaattcctcttcaattggattttgcagaagaacctatatacgtgaattcaaagcagtaccatgctattctgaggcgaagacagtatcgagcaaaactcgaagcgcttaacaaacccatcaaggatcggaaaccgtatcttcacgagtcccgccatcaacatgcactgaagagagctagaggcgctggtggacgctttctcaatacaaaaaaacaattacaatcaaatcatacacctgggaatattgcagaatcaaaaatgcatcacattgaaaactatagagatggtgctgatgtctcatatgcatttaacagtgatgcaagaaacatgcagaatgatgcagctgataagggtggtggcaccactcagcaacctctatttgtctacatgtga

SEQ ID NO: 347 - DNA, 909 bp, Glycine max
  Peptide Sequence Number=SeqID_92032
atggcagatctcaaggagaggctactagcaccaaaacctgcatcagctcttaacgtaagagaggtttccaatcgaccatctgcctctggaaggcaagctttccaaggggtggatgttttggggctaaagaagcggggccaaggtctccgttcatggattcgggtcgacacatctggaaactctcaggctattgaggtagacaagtttaccatgatgcgacgttgtgatctacctgcacgtgatcttcgcctacttgatcctctgtttgtctacccatcaacaatccttggtagggaaaaagctattgttgtaaatctagagcagatacggtgtatcattacagcagatgaggttcttctcttgaattcccttgatagttatgtattgcactatgtaatggaactgcaacgacggttgacaacaactggggtaggggaggtttggcaatcagacagttctgacatgaaccgaagaagaggaagtaggaattttgaaaacgtatttagcaactcttcccctgattatttaccttttgagttcagggctcttgaagttgccctggaggcagcatgcacatttcttgattcccagaatgcaaagtctatagaatcttctgttgcaactttttttagagaaagccagtatgtacctctacgacctatattggatgaaaatcacacttatttcctgttagcagtggcactaaaggattcggtgttattgcaatcccctccctccactgcagttaatcctttatgtgactacgagcgtaaacacttttttcttcatcctattgtagagaaagctatgagaggatcacttggctgtgcagtaatttcaactagttccattgtgtccttgttgtcagaggatgaatttcaatttggcaaatcatttagcctatgttag

SEQ ID NO: 348 - DNA, 2478 bp, Glycine max
  Peptide Sequence Number=SeqID_92033
atggcgaatctggtaccgggggtgcttctgaagcttctgcagcacatgaacacggatgtgaaggttggtggtgagcacaggtcttcgcttttgcaagttgtgagcattgttccggcacttgcagcagggggtgagcttttcccaaatcaaggtttttatctcaaagtctctgattcctctcatgctacctacgtgtctctccctgatgagcatgatgatctcattctcagtgataagattcagttgggtcagtttgtgtttgttgatcgtttggagggcgcttctcctgtccccattctcagaggggttaggcctgttcctgggagacacccttgtgttggaacccctgaggatattgttgcaactcattcccttgctttccttgatcattgtagtgacaagaatggggtttcttctggtgccggtgacacggatagatcgaagtctccgaggaaggtgtttggtggtggggttggggagaaggagaagaaggagagagtgagatcaaatgttggtggtgggagtggtaaagaggatgtgcaatccagcaaagcaagtgctgttttcggtaggagcaaatctcagcctcagcaacctcagcctatcaagcctgcactcaagattcaggtgaagaaggaatcattgactagattgaagtctaccaattcgcggtccattccttcgtcaccgagtagttgctactcgttgcctagttcttttgagaaatttgccaatggggtcaggcagcatcaggcaaaggttggggctaaggtgggagtggcggagacggaaaagtctgttcgaggggctagtagttcggttgggaagaaaattgtggtgggaaatccgattagaaatttggtgcagggaattgagctggggactaaggctttaaggaagagctgggaagggagtatggaggtcaagactaaagagtcttccaaaaccagggttgcatccaagtttgatcctaagcctgaagcaagtattcctagaaggagaagcatttcaaatgaaaagttgctatctaaagaggagagcaggatccaagcaccaacaaagccctctaaggaacaacataagattcaaacgcctacaaagaaggctaatgctaatggaactgtagaggaaccagaaaagtcgagtaagcaaagaacttccatcggaaagaaatcagcagaagtttctaacagtggactccctggaaacttggtcaaagttgctgtaagtaatagaaaagtgacagatggaagtgttcaatgggcatcactcccatcatctatttcaaagattggaagggaagtaatgaaacacagggatgcggcacagatggcagcaactgaggctatgcaagaggctgctgctgcagagagtttactgcaatgtctaagaacatactcggagctaactaattctgctaaggaacataacctacagccagcagtagagcagtttttaactcttcatgctagcctgaatagtacccgaacaattgctgaatccttgtcaaaacccattccagatggttcatctccagattatgaaaggagcacagtggaagaagcgctaaaagtaaaatcagatcgacaaaaacaatcggcttcctgggtccaggcagccttggccaccaatttgtcatcatttgctgtttttactagagaatctcaatcatccaagcctccaacttcaagcaattctcaaaatcagaagactgttgtgggaagtcaacacatgttagtcctacacaattccagtgaagatgcttcatcaaaagttcatgcaaaaactcgtctgacagcttattccaagcatgcctcactaggaactcttcgcaaaccaggtgatgcgttattaaatgggcagaagcagctagtgcaacctcccccagaatgggttagaggaaatggtctgaatgaggtagttaatttggctgaaatgttacagttacagtcccgagactggtttttgggatttgttgagaggttcttggacagtgatggggacactaccttgtctgataatgaccaaatagcaggaatgctcactcaactaaagagtgttaatgattggttagatgagataggatcgagcaaggatgagggagaatcatgcgagatatcagcagagacaattgaccggttgaggaagaagatatatgaatatcttcttacacatgttgaatctgctgctgctgcactcagtggtggatcacaatcgtcacctcaggtccaaacaatacaaagtaaagccaaaaggaacaattcaaacgtgcagcacaaagtcttatcatggaagaatgaagcacaactttgtaaaattaactttggtttgaagatatcgagaaagtcaaagtcaaaggatgataagaatgtatgcaatggaatttttctagtgccacaagctgtgattgttagctgtaatcacttatcacaggtcacaggaaatagtgaaaaagaagatggaataaaagcgggttaa

SEQ ID NO: 349 - DNA, 2829 bp, Glycine max
  Peptide Sequence Number=SeqID_92034
atgccgcctccttcgaaatccgtggaaggcgaggagtggggaacccccaccaacaacctctgggtcgggaatctgccgacggaggtcacagattccgatctcatggaactattcgctccgtacggttctctggactcactcatctcctactcctcgcgcaccttcgctttcgtcttgttcaggcgcatcgaagacgctaaggcagcgaaatccaacttgcaaggcgcgttgctgcgcgggtttcaaatcagaatcgagtttgccagaccggcaaagccgtgcaaacaattgtgggtgggtggttttagtcccactgttgcaagggaagatttggaagcggaatttcgcaaattcggtaagattgaggattttaagttctttatagaccgcggcactgcgtgtgttgagtttctcaatctggatgctgctgctcgggcgatgaaagtcatgaacgggaagcggttaggtggacgccagatttgtgtagatttccttcgatcacaatctacgagaagagattttttggttgatcatgggcagtttcaggctagaccacagcatttacaaccttcaattgggaggaataatcaacccagtaaaatcttgtggataggttttcctccttcctttcaaattgatgaacaaatgctccacaatgccatgattttatttggtgaaattgagaaaatcaagagttttccttctagacattattcatttgttgaatttagaagcattgatgaagctcggcgtgccaaagagggtcttcaaggacggctttttaatgatcctcaaataacaattatgtattcaagcagtgagctggcacctggaaaagattaccctggcttttatcctggaggtaaaggccccatacctgatggattaggtaatgagcatccatttcgaccgctacaaacagatgtatttggtcataatcgtcctatggttccaaataattttcctggacaattgccacctggacataatgtcccaatgcgaccttttggttctcaaggtcttgaacctcttatctctggtcctgattttaatgagatgggtccaagctggaaaaggccatctcctcctgccccaggaatgcttccttctcctgtgcctggtattaggcctcctacaagatccacctccggtgcatgggatctacttgacataaaccaatttcagagagattctaaacgtttgaggatagatgatgctttgttcattggtgatgctccatttcctttaaggaatatagatgatcgtggattaggagtagaacagccatttgcaattgattcagttattgatggaggtggttctggtccaaagagtcaccttggtccagtcggcactaggatcacatctggagtacctggttctgtccaacctgatattgatcatatatggcgtggaattattgcaaaagggggaactcctgtttgtcgtgctagatgtgtgcctattgggaaagggatagtgactgagattcctgatattgtagattgtgctgccaggactggattggatatgctaacaaaacactatgctgatgcaattggttttgacattgttttctttctccctgatagcgaagaggattttgcttcatacactgaattcctttgctacctcaaagcaaaaaatcgtgctggtgttgccaagtttgttgataacaccactttatttttggtaccaccttctgatttcttgaccaaggttttgaaagtcacaggacctgaacgcttatatggtgtggttcttaaatttccattagttccaagtagcacatctatgcaacaaccaatgcatttgccttctccctctactcagtatatgcaacggattcctccttcacaagctgaatatggttcaatattggtaaaggaggaacaggttttaccaatggattataacagattgttgcatgaggattctaagcatctgccaaaaccacttcatccagctacaaatgtccccccttcagctcattctgttccttctgattatgctcctacttatactgcttctgcatcccaagctgttacatggacacctgaacttattgcaagtttaacttctttactccctgcaacaacgcaatcatcaaccacgggtggcccaatggcagtggctggtccctctattgtgaagccatcttttccttctgttgcacctaatgatggaaatcaatctcatttgtggaaacaagctcagcaaatccctgatccttctagtcatcctcctcaacaatttgggagtattcataatgttcaatatcaaccttatccacctgcatcttctactgaccaccctgctcaagtggtctctggcagttcttgtttccaagataccaattccagtctccagcagccagttgctgtttcgtctacacccatgactaatttcatcttacctcctcaaaatggacaggtagctgtgtcccctcaagtcagtcaacagtatcaggtggaagtcccccatggcactgagaaagactatggagttgttcagggaacagatgcctctgttttatatagttctaaggcgttccaacaacctaataattttatttcctcatccaatcaagttgccaatgctgcatcacagcaacaatctgtgatgccctttacagtggacaaagataattcagtgcccacaaatcagcaacctcaacctgctttatttggagttggccagggagtgtcagaattggaggctgataagaaccagaggtaccagtcaacactacagtttgctgccaaccttctccagcagatacaacaacagcaaacacaaggagggcatgggccaggaaatcaacaataa

SEQ ID NO: 350 - DNA, 528 bp, Glycine max
  Peptide Sequence Number=SeqID_92035
atgatccatgtgatattgtctttgttgttgatagggaagtcttacatccatgaagagtctatcccatatccagtttttcctggaggagcaattattggatgttcagctggcttcatgaatgtgccaaagataaagggaactcacacggcaatgaaatcaggaatgcttgcagctgaagttacatttggtgcacttaatgaaggtctagatatggatatgtattgggatgctttgagaaattcatggatttgggaagaattgcataaatctcggaactaccgaccagcctttgaatacgggcttattccaggactggccttaagtggtctggaacattacatattcaaggggaggcacccagttactttgaagcatggtaaacctgatcatgaggctatgaatgctgccaaatcacattctccaattcactatccaaaggctgacggtgtcttgtcctttgatgtgcctacctccctgcacaggttttggaacacttactcccttctgttgcttactgttgagagttga

SEQ ID NO: 351 - DNA, 468 bp, Glycine max
  Peptide Sequence Number=SeqID_92036
atggcgttgaacaatggcgtccccgccactggcaccggcctcatcgttagcttcggcgagatgctcatcgacttcgtccccaccgtctccggcgtgtccctggccgaggcccctggcttcctcaaggcccccggcggcgccccagccaacgtcgccatcgccgtgtcgcgactcggcggcaaagccgccttcgtcggcaaactcggggacgacgagttcggccacatgctcgccggaatcctcaaggagaacggtgtccgcgccgacggcatcaccttcgaccagggtgcacgcaccgcgctggccttcgtgaccctacgcgccgacggggagcgtgagttcatgttctaccggaaccccagcgccgacatgctcctcaagcccgaagaactcaaccttgaactcatcagatctgtatgcatcttttccctctctctcgctctctctactttctcggaaaatatttaa

SEQ ID NO: 352 - DNA, 474 bp, Glycine max
  Peptide Sequence Number=SeqID_92037
atggcttgggatgagttgaaggcaattactgatggcatgatggctccttgggctatggcaggatacttcaattttgttttgtttaatcaatcttcaactggaagtctttatttcaatcagaattacactctcaaagctctgggcttaatgggtgtcaccctcttacgtcatccaagctattgcccttcctggctaaaagaaacttcccccggtacctacccatgctttgaagaatggatggagatggaagcgctaaatattctgcttcctcctgacatttgcaatatgattgctcctaaggagagttcagaggatgttcctatttggaagggatctaaggatgatagcttctcattaaaggaagcttatctttatctagccaagaagatcgatgataataggaatatgaacagtgatcatttcaaactcctcaggaagtggaagggccctcagaaagtgagggtcttcctttag

SEQ ID NO: 353 - DNA, 2511 bp, Glycine max
  Peptide Sequence Number=SeqID_92038
atgggggttatgtccaggcgggttgtccccgtctgtggtaacctctgtgtattttgtccttctcttcgtgcaagatcaaggcaaccagtgaaacggtacaagaagttcattgctgatatattcccccgtaatcaggctgctgagcctaatgataggaaaattggaaagctatgtgagtatgcttctaagaatccattgagaattccaaagattactgacaacttggagcaaagatgttacaaggatttgcgtaatgaaaactatggttcagttaaagtggtcttgtgtatatacaggaaattgttatcgacatgtaaggagcagatgccactgtttgccaatagtttattagggatcattcggactcttctagaacaaactcgagcagatgaaatgcagatcttaggttgcaacactcttgtagaatttatagatagccagacagatggtacatacatgttcaacttagagggttttataccaaaactatgtcaattggctcaagaagtgggtgataatgaacaagctctacttctacgttcagctggactgcaagctctatcccatatgattatatcagtgattttggagaatttcaaggatctccaatccaaatccaatcttgccaaagtagagaaactgaattcacaatctcagagtcagttggtccaaggatttcccgaaaaaggagctgagacagagcctaagttggacactaaagatcctgcttattggtcaaaggtttgcttgtataatattgccaaattggcaaaggaagctacaactgtgcggcgtgtcctcgaactgctttttcataattttgatagtgaaaaccactggtcttctgaaaagggagttgcttcttgtgttttgatgtatttgcagtcccttctagcagaatcaggagataactcccatcttctgttgtccagtttggtcaagcacttggatcataagaatgttgctaagaagcctatccttcagattgatattattaacaccaccatgcagcttgcacaaaatgtgaagcagcaggcttcagttgcaataattggtgcaatatctgacctcattaaacatttaaggaaatgtctgcaaaatttatctgaagcatccagcaatggaaatgatgcatataggttgaatgctgaacttcagtcttccttagaaatgtgtatattacaactttcaaagaaggttggggatataggaccaattcttgatttgatggctgtggcactggagaatatcccaattactaccatcatagcaagatcaacaatcactgctgctttccctgatgccttgtttcatcaattgctcctggccatggctcatcctgactgtgaaacacaaattggagcacatagtgtcttctccatggtgcttatgccatccatgttttctccttggttagaccacaaaacaaagattgctcagaaggcacagaatgacagcttctccactcagcatgaaactttttctggagctgaaaacttgaatgggaaactggaagaaggaaaggcaatagccagtgtcaatgggaagaaatatgtgattcatccatatcatcgctacagctttagtccgaagctaactgatggaaaagatgatcgaagttcactcaggctgagcagtcaccaagtgagtcttttgctttcttcaatctgggttcaggcaacatctgtggaaaatggccctgcaaattatgaggcaatggcacacacctatagcattgctttattattttctcgttccaaggctgtctgtatagaatcagagaagataatttatggatctcaggaagatgagttcactgctgtgaagtctctttcagctgtagaattggatgacaagctgttgaaagagactgatgaattgtctagtgtaaagaatcaacttctacagggtttttcccctgatgatgcatatccatcaggacctccattatttatggagacaccaagactatgtcctcctcttgctcagattgagttcccatactatgatgagataatggttccagatgatttgatagaggaagagactgaacctgaacatagtggaagtcagccagatcgcaaaacatcaatttcagccaactaccccgatgttctaaatgttaatcaactcttggattcggttttggaaactgcacggcaagttgcaagtttctccacttcctcaactcctttaccttatgaccaaatgaagaatcagtgcgaggcacttgtaacagggaaacaacagaagatgtcagtcattcagagtttcaagcatcaacaggagagtaaggccataattctttcaagtgaaaatgaagtaaacgtttcctctctacctgctaaggcactggaatattcaaatggtgatttgaagttagtgactcagcagcaatttcaagcacaggatcaagcacgccaccaatctcatgaatctgggcagcaacactctttgagactaccaccttcgagcccgtatgataaattcttgaaagcagcgggatgctaa

SEQ ID NO: 354 - DNA, 1718 bp, Glycine max
  Peptide Sequence Number=SeqID_92039
ctaccagaatgagtttgacagaaaatgccactagctgctgcatggcacctgatgaacatataatgacaggtcatcactcttgtaagcttagaaaccaagtggatgttatttgcctgcgagtatcatcagacagcaacatgaagttttggcattcgctatctgttgaagacaaaagctatgctgttaattcatttcatctttttgctaatgtgttggtagctttttggttgttcctggtggcaagctcttactttctcttgagcaaaaatgtcaatctttctggcggttgtagaggaaaacgtgcagagaaagtttcttcatctgtcagaactatctcagatgcaaccacagagaatgatgcaactgctgcaaatgatacgtttagctgttctgagagtttttcgtccaataatagctggggtgagctatgcaccaagtgtgatgcttactatgagatttcagattttgataaggcaagttacatgcattctttactcagtcttgaaggtgaagattctgagtggctcgcagattcaatgccttgtgaactttcatatgagaacccttcaactcctcttagcagctacaagtgtgatgcttaccatgagatttcagatttcgagcaaggaagttacatgcattctttactcagtcttgatgatgaatctgagtggctttcagattcgaagtcttttggagttcaatccgagaacccttcaactcctattagctacaatcttgaacatgaagactctgagtggctctcaaattcgaagccatttggatgttcatccgagagcatttcaactcctcttagctacaagtgtcatgcttcttctgtgatttcagatttttccaaagcaagttgcatgcattctttactcagtcttgaagatgaggactcagcagagtggctctcagattcgaagtcttttggatggtcatctgagaacccttcaactcctcttagctccaagtgtgatgctttttctgatatttcagatttggacaaatcaagttacatgcatccctcaatcagtattgaagatgaaaactctgactggctctcagtttccaagtcttatggattttcatctgagaattcaactcctcttagctacaagtttgatgcttataactatgagatttcagatttggacaaagcaagttacttgcattccctactcattcttgaagatgaagactctgagtggctctcagattcgagtagttggagtattgtggttcctccttcagtctctactagttcctcattcactggagtaaactgtggcaactcagaagaagagttcagtgctgatgaaccacttttttggccatttgaagggaaactcaattggaattctgaggaaccgtggacttcattttgtagctccccgagaagaaggtttgactctagatcaacgacatcaaggataaaggggtgtaataataaacagaaaggcaatgaggctctatgcattgtgaactatgaaacttcaaggttaagcatgtggcctaaaagttcagaaaagatagtacctctagtatgtgaggatttctattcaaacaaggaccaccttttgggaaaggagtattctgctttgtgtcaagagcttactattgaggcattggtggggctaaaggaatttgatggacatgaagggcttgattcggaattcgatcaagtttttctgatggaccaatatctccaataa

SEQ ID NO: 355 - DNA, 444 bp, Glycine max
  Peptide Sequence Number=SeqID_92040
atgaagtcttcaatagtcagaattaaagtgttatcaaatggcggccatggcggaaaagcgtggcggaattttgaaaaaacgccacaaatagcggtggcgtggcaggttactagtggcggccgccatagccatgacgggtcatggcagaatagcgggaaaggtggaatagcggccctttttgtttttttcgcggtaggtgttgggctgacccgacccaacccgataatatattttgaacagcgcagcagccacgaacagaaacagaacagcagcggaccagcacccgcacccatcagccaccactaccagcagcgacgaccggcagcagcacgaccccgcgaagcagcaaccagcacccgcacgaccccgcgaagcagtgaccaacacccgcacccagcagcattgcagcgaccagcagaccagcagcactatgaacggtggtga

SEQ ID NO: 356 - DNA, 393 bp, Glycine max
  Peptide Sequence Number=SeqID_92041
atggagcttgatctgttctttgttgggaagaaggtcatcaccaaacagattgatgttgttcatgtgcctgcagctcatcaacttgctgatattcttaccaaggccctctctcctgcttcatttgtttcattcagatccaagctcagatcgtttgcttatatggtgtacttggagcactgtctacttccaagagttaacgcttattcaaggattgtcaatggccttctgaaaaccgctttgggaccacctacagggtcaaccactgctttgtctccagcacaggatattactttccgacatgaatctgtgaaatgcttggcaaagcagcacagacaagagatgggaggtattatggatagcactgtcattgattatttggaatcacagaaatag

SEQ ID NO: 357 - DNA, 792 bp, Glycine max
  Peptide Sequence Number=SeqID_92042
atgggcgattaccatttcgtgtacaaggatttagaaggggcttctactcaatgggacgatattcaaagaaagctcggaaatttgcctccaaaggcacccgctttcaagcccccacctttcacccctgcctctgatgatcaacccaaagacaaaacatggatcgattccaaaacctccgaggaactcgaagacctcgaagacaacctcgatgatgatcgcttcctccaagaatacaggaagaagaggctggctgagatgcaagaggcagcaaaagtattgaggtttggatctgtgattcccatttcgggatctgatttcgttcgagaggtgtcacaagctccatctgatgtttgggtggttgtcatcctatacaaagaagggattcctgaatgtgggttgttgatgcaaagcattgaagaattggcactaagatatccttcaacaaaatttgtgaagataatatctactgattgcataccgaactacccggatcggaatcttcccactttgttggtgtacaacaatggagcagtcaaaggaaattatgtgggtttgcatagtttcgggcgaagatgcactcctgaaggtcatgctttatgctctgcattgtttttactttttggtgaggaaatcaagaacataattgctagcaaggaggttcctgcagagggttgtgaggaatatagaatgagggaggaaaatgatttgctggcaggattgctccttgttttttacaacggcttggagatcaaggaagtgagacttatcgagcatgaaacagatgaaaaatag

SEQ ID NO: 358 - DNA, 327 bp, Glycine max
  Peptide Sequence Number=SeqID_92043
atgagtttgggttcaaaggccaacaactccggtgattctgaggggtcaagtttgtggttgaggcgaccagaggtattcagatatgaagatgtgtctacactttctgaggcgcaacctattgccgaggagaatttggttgatccggttgaggccttcgctcttttcctcctcctcgctctcttctccgccgcctccgctcaagaattatcccccgcctcgtctccggcaccgtcgcctgaagcaggagccgcagactccgtgccttgctccgccatcatgatcggtgcctcgctcgttttgtctctcatggcggtcttcaagttctag

SEQ ID NO: 359 - DNA, 885 bp, Glycine max
  Peptide Sequence Number=SeqID_92044
agatattagggattgcattccctgctgcactagctgttgttgctgatccgattgcttctttgatagacacaacattcataggccacttgggaccggtagagcttgctgctgcaggagtttccattgctttattcaaccaagcttcaaggattaccatattccctcttgtcagtattacaacttcctttgtggctgaggaagatactatccaaagcaaacccaaagttggaaagaagcgcattgcttcagcatcaacagcgttactttttggcactattctaggcctccttcaaactgcaatcctcacatttgcagccaaacctcttttatatgcaatgggtctaaaacatgattctcctatgctaattccagcagagaagtatctaagattgagatcaattgggtcacctgctgttcttctctccttggccatgcaaggaatctttcgagggttcaaggacacaacaactcctttatatgtgatcgcatcattggcagcaaggctaggttcaattcctatggctgcatttcaacctggcctacagatttggttggcatcatcccttcttgctgatggtttggctgtggcagtacagacaatgctagcttgttcctttgctgagaaagactataacaaggcaactgctgctgcaacacggacactacaaatgagttttgttttaggcgtggggctctcttttgcagttgcacttgggttatactttggacctggaatattttccaaaaacgctaatgttgtgcacttaatcaaaataagcatgccgtttgttgcagctactcaaccaatcaattcattggcctttgtctttgatggtgtcaactatggggcatccgattttgcatattctgcctattctttggcaa

SEQ ID NO: 360 - DNA, 330 bp, Glycine max
  Peptide Sequence Number=SeqID_92045
atgcaagggatattagatgggaacataacccagacaggtctggataagggccagttaatatgtggtaacaagcattgcaatgagaaagatgggttagcaagctatgaggtgaacttttgttactttgaagctggagaaaacaaacaagccctagttaaattggtaacatgtgagaggtgtgcattcaaactcaactacaagaggcaaaaagaaaaggagctgttagaaaaaagacaagaagaacaggatagacgaaagaggaatcgttcaaagagtgatgatgatctagatgacttccaagaaagcaaagagagaaggcggaaagaatag

SEQ ID NO: 361 - DNA, 2994 bp, Glycine max
  Peptide Sequence Number=SeqID_92046
atgggtcgacctagaggtgatgaaaagtactggaatgaagtaacgagttttgaagagaacgggaagcagaagtggaagtgcaagcattgtgaaaaaacgtatggtggaggttattcaagaattaaactgcatttagataaagaacaaaaaggacaaggcattactaaatgccccgtttattgtagcaatgaagaagttctcaacatcattgcttccacttcaatccatccacaagaaactgtaaatacactgaatccattacaagtggttgaagatgttgttgctggcgaaatgattgtccctgttggtgctccaattaaccatcaaacaaataatgaatcaacaagtttattcgaaggttgggcaccagagcatgctattgtcggaagcaacaattcgaatggtattttccaaagtaagattagtgtgataaatgagttggtttccgatctatcaagagaggaagatgacatcaaggaacaattagaatggctagaatctcgcggcaagaagcgcaagggtgatgttgatgactggatggatgaactacgagacctgaagaaacatgttgctgatgtggattggttagggttcactaacttttatgcatcggatttggttgataaattgcgaaagcataagattgataagcctctggtgttgtcaaatgaatttgttggtgaacaatttgagttaaatgttggaaagatgtggaagcttctggtggatgaccaagttttcgttattggcataaatggaatggggggagtggggaaaacattcctagcaacttatatggagaatgagataaaaagaaagggaagtttcaggcatgtcttctgggtcactgtttctcatgatttcaccactttcaaattgcaacatcagattgcaaaaaaaataggggtaaaacttgatggagatgatgagagatgtagagcaacaattttgtcatcggagttggagaaaatagaaaattcagtacttattttggatgatgtttggagatatattgatctacaaaaggtgggaattcctcttaaagtaaatggcaaagtaaatggcattaagttgatcatgacaagtcgtttgaaacatgtgtgtcgacagatggattgcctaccagataatacaatacaaatataccctttgaaaaaagaagaagacgaagaagaagattgggagttatttttgctaaaacttggacaccatggaacacccgcaacacttccccctcaagtagtggagattgcaagatctgttgtaaggaagtgtgatggtttaccacttgcaatcaatgtgatggctagaaccatgaaaggttgttatgacactattatgtggaaacatgaattgaataaacttgaaaatttggagatgggagaagaggtgaaggaagaagtcttcacagtactaaaacgtagctatgataatttaattgaaaaggacctgcaaaagtatttgttatattttgcacagataccaaacaattctggtttccagtcaaaaagctacttagttaaaaagcttgttgagagtggtttgttaaaaaatgtaaagaggagtttgagggaagtatttgatgaggcgtgtgccatggcgaataaactcgtagaccattctttgtttgtgggttatgattaccatacaaaaatgcatggtctggtgaggaacatggcatgccgtatcttgaatgagagtaacaattacatggtgaaatgtgaaggaaatttgagtgagatacctgacgtgaaggagtggatagttgatttggaggtagtttcattggggggaaacagaataaaagaaatcccagaaggcatatcacctaattgtccacgcttgtccaccttgattttatctggtaattgtatcggccacattccggagggttttttcatacacatgaatgctctaacagtacttaatatatcatataatgatttcttgacatctttgccgcattcgctgtccaacttgaggtctcttgtttctttagtgctccaaaattgttcaaatttggaatatatacctccattgggagagctacaagcattgtcaagattggacatttcaggttgttcgattcgccaagtaccagaaggcttgaaaaatctaataaacttgaaatggcttgatatgtccataaatgagcatttaacgctggcaccaagatgtgtactgcccggtttgaccaatttgcaatatctggatctccgttgtgattcagctataatagcagaagatgtacaagggatgagtatgcttgaatgttttggaggaatctttctcggcaaagataattacaatagttacgtgcaagaaattctggacagaggtcatggacctaaaacttatgatatccatgtagaagatgttagggatctgatatttgcatttgatattgatgatccagtttctctatacgaagatcatcaaaatgtacggttttggcaatgcgaaggattgctgtatttactacccagagaccttaagaaattgagtatggaacgcaatgatcaatgggtgtgcttatgtggtgctctgtcatcaagtggtcctctttcttctttgaatcaaattgatattattggcggctatagtttcactgcaatctgtgaggaagatgctgttgatttaacacgatctttgtctccaaggggtgtgttctcaaatctcaagaaatttcagctcagccaatgccatgaaatagagacgttgctgacaccattgttagtgccacaacttcaaaacctagaggttttatcggtcgagagctgtaggtccatgagagagatatttgcagtgagtaatagtggcaatgatgataatttcaacattatactccccaaattgatcagattgcggttgtggaatttaccagaattgacgaccgtgtgcagagaaattttagtatgtggatctgcggatatattgttcattaatcattgtcccaaattagaaaggctaccaagaatcgtcgtgtatgattga

SEQ ID NO: 362 - DNA, 1590 bp, Glycine max
  Peptide Sequence Number=SeqID_92047
atggaggcaaagagcattgctcctcgacactttttgtctccaacttgccctattccttttccaattctcagtgccgtcgaggaagatgctaaccgtgctattgagctgaagaatggtacatctgttgaaggccggaaaattgtagtgaagcatgcaatgcctcgtcctccctgtgaagaacggcaatcaaaaccaaataaagagggcaagacagatgatctcacaaagccaaaagacgatgatgaagacagcacattatctggagcagagaagaacgtttcagttttgaaggaagaagaaacgaaaaaatcagctctctgtgatgatgtaccagatgagggtagttgctcagaaaaacagagggttgctagaactgttatatttggtggtctcataaattccgatatggctgaagaagttcacggcaaagctagagagattggcactgtgtgttcaattaagtaccctctttcaaggaaagatctcgagcaacatggtctcctgcaagatggatgcactttagatgcttcagctgtgctttatacaagtgtaaaatcagcccgagcttctgttgcaacgttacatagaaaagagataggagggggaaacatttgggtgcgccaactgggtggagagggctccaagactcagaaatggaagcttattgtcagaaaccttcctttcaaggccattcaaaagctcaatggatcaaagtttgcaaaacgactcatagctgttgattgggctgtttcaaaaaagatatttagcagtgatacaaataatgctcttgcctcagagaaaggacaacaaaacatgagtgatgaggatagtaccgatgaagattttgagcttgttgataaaagatctggtcaaggagatagtgatacagactactctagtgccatggaggaagaaggcacccctcctgaagataattttgataaggaagcagacattgcaaaaaaggttcttaacaacttgcttacatcctcgagtaaaggaacatctgtaaacaatgattctatgttgatcaaagaaaacaagggatcaagatctgatgaaattgttaaggatgcagatgaaaaagcatctaatgagtctgaaaaggtttcaggtgtttctaagcctgaaatttccagcagaaacaacttattaaatcctaagggaacagaagatgatttgcagagaacagtttttataagtaatcttccctttgaatgtgataatgaagaagtgaaacaacgattttctggatttggggaaatagaatattttgttcctgttctccaccaagttaccaagcgacccagagggactggttttctaaaatttaaaactgtagaagcagctaatactgtaatttcaactgccagggctgcttctgggatgggtattttattgaagggtagaccattaaaagttttgaaggctttggataagaaatcagcacatgacaaggaactggagaaagcaaaaaatgaggttcatgaccaccgcaatctttacttggcaaaggagggacttattcttgagggaactacagctgctgaaggggtttcagccagcgatatgttaaaacgcctagagtga

SEQ ID NO: 363 - DNA, 1902 bp, Glycine max
  Peptide Sequence Number=SeqID_92048
atggcttattcttctccctccgttattaaggatgccaaggtgcttatggttggcgctggcggaattggctgcgagcttctcaagaccctcgctctctccggtttccctgacattcacatcgttagttctcttctctattcgggtctttccaacttcgagctgtgtgtgtttggtgacataggaggtgtttgtgagagtgaggaggggagccatgttggtgcttatagtctgttggcttcaattgcttttgtgctaatcgaagtccgtgatgatggaagtagggtgtttgttagtggggtttcagttttccatcaatctgatgaagtcttcaaccaggttgctagggatgctgtgttaaaatttaggccccacataaacattacaccataccatgcaaatgtcaaagatcctgaattcaatgtggacttctttaagcaatttaatgttgttctaaatggacttgacaatctagatgcacgccggcatgtgaatcgcttgtgcttggcagctaatgttcctttggttgaaagtggaactactgggttccttggacaggtaactgtgcatgtcaagggaagaacagagtgctatgagtgtcaacctaaaccagcccccaagacatatcctgtctgtacaatcacaagtaccccatcgaagtttgttcattgtattgtctgggctaaggacttactttttgccaagctatttggggacaagaatcaagacaatgatttaaatgttcgatcaagtgatgctgccagctcgtccaaaaatgtagaggatgtatttgaacgtaggaaagatgaagacattgatcaatatggaaggaaaatttttgatcatgtttttgggtataacattgaattagctttgtctaatgaagagacatggaaaaatcgtaataggccaaaacctatatacagcaaggatatcctgtccgatgaaccggctcaacaaaatggaaatttggagaaaaaatatgaatctgatgaattatcagtttccgccatggcatccttgggcatgaagaacccacaggatatttggagtctcaaagaaaattctagaatatttcttgaagcatttagacttttttttacaaaaagggaaaaggagattggcaatctaagctttgataaagatgatcagttggctgtagaatttgttactgcagctgcaaacataagggctgcttcatttggcatccctctccaaaacctttttgaagctaaaggtattgctggtaatattgtgcatgctgttgcgactacaaatgctgtgattgctgggttgattgtcattgaagcaatcaaagtgctgaaaaatgacattaaaaattataggtatgatgtgatttctcctcctgcaaagcttgggatgaaccttcctcttattatgtgtgcttcaaacctgctttatgaagctggtgatgttgaggatgacatgattgctatttatgaggccaaccttgaaaaggctctggctgagcttccttccccagtaactggtggcacaatgcttacagtagaggatatgcagcaggaattcgtttgcaatattaacatcaagcacagagaggagtttgatgaagagaaagaacctgatgggatggttctctcaggatggactcaaccagtgtcagcagcagaaaacaaagacaaatctgttggaaatggtgcaagcacctctgatgcattaataacagctgtggaatctgaaaaggatgatgagataactatagtttcagccttgaagaaacgaaaacttcccgacgaatctgatatttcaaatagtgcagctgaagcaaagaatcagaagcaattggaagtaattgacgatgaggatgatcttgtcatgcttgatggggatttaaacagcgttaaaaagagaagattgtcatag

SEQ ID NO: 364 - DNA, 1095 bp, Glycine max
  Peptide Sequence Number=SeqID_92049
atggtgaaggacactgcgtattatgacatattaggtgtcaattatgatgcatctgctgcagagatcaagaaagcttattatgtcaaggctagaattgttcaccccgataaaaatcctgaggatcctaaggccgcagaaaactttcagaaacttggtgaggcttaccaggttttaagtgatcctgggaagcgtgcggcatatgatgagcatggaaaggagggagtaccacaagattccatgatggaccctacaactgtatttggaatgatttttggaagtgaattttttgaagaatatattggacaacttgcactggcttctttagcatctatagaaattgaggaagactcacaggatcctgaagttttgaggcagagaattcaagaaaagatgaaagcttggcagaaggaaagggagcaaaagctttcaacatttctgaaagatcgcctgcaaccatttgttgatggtcgagaagatgaatttacagcatgggcaaaatcagaagcacgtagtctttctaaagctgtcctggccccaatgtggtttctgaatcaagaacaaggcaaagacaatgaaatgaacactcctggactttcgggagcttttggagaagccatgctacatacaattggttacatctacacacgaaaagctgcaagagaacttgggaaggatatacggtatatgaacgttccctttttggcagagtgggtgcgaggcaaaggacactgtataaaatcacaagtaacagcagcctcaggagctgtctccctaattcaaatacaagaagaactcaagaagctaaatcaaggagaaaacaaagaagaaagcatagtcaaagctattgaagataagaaggatgccatgattaattctctatggcaaatcaatgtgattgatattgaatcaactctgtcacatgtttgccaaactgttcttaaagatcctagtgcctccaaagatgttctgaagtctcgggccaaagcattgaaaaagttaggaactatctttcaaggtgctaagattgcttataacagagaaaacagcctacgcagagaaagtggcaaaacaccagatgctgcttcctcatcatag

SEQ ID NO: 365 - DNA, 1419 bp, Glycine max
  Peptide Sequence Number=SeqID_92050
atggaagctatcttccttacaaactcaagtcccacatacaccacatttacaaccaaaaatatgcttcaactgtttcactggccactattttctgctaatgacgtgtacattctccctgtttcttacccagatgtagcacttgtcacatctttgagggatggaatgaatctttttgctggtgctgcacagtcacttggtgctggggctattcttgttaacccttggaacatcacagaagttgctactgcaatttccaaggctctgaatatgccatcggcagaacgcgagaagagacataagcataactatgaacatgtaaaaactcacactgctcaggaatgggcagaaacttttgtaagtgaactaaatgatactgttgtcgaggcacagataaggacaaatcaagttccaccacggctcccaacagagactgcagttgaatgttatttgcagtcaaataatcggttgcttattttgggtttcaatggaaccttaactgagccaattgagagagaaggtgatcggtttaaagaaagggaactcacagtgcatccagaactgaaacagcccttggccgaactttgcagtgacccaaagaccacagttgttgtgcttagtggaagttgtagaacagttctagatgaaaactttaaagaatatgacatctggctggcagcagagaatgggatgtttctaaacccttcaaagggagaatggatgacaacaatgcctgagcaactgaatatggaatgggttgacagtgtgaagcatgtttttgattacttcacggacagaacacctcgatcgtattttgaagaaagggaagcttcacttgtttggagttacagacatgcagatgttgagttcggaagactgcaagcaagggacatgctgcagcatctctggacaggtccaatttctaatgcatctgttgaagttgttcaagggagccgatctgttgaggtgcgagctgctaatgttacaaagggagcagctattgaccgcattctaggtgagatagtccacagtaaatccatgacaacaccaattgattacgttctgtgtataggacattttctgacaaagcaggatgaagatatatacgcgttttttgagccagagctaccacgaagcaaggtaacagaaggagtcaagtttcctgttgagagggtatcgtcatcccaaaataagggacaacggcctgtgtcaaactctgagaagaaaacaaataatcatgtctgccgcctgccacggcggccggctcctgaaaagatctcttggaatgtgcttgacctcaagaaggagaattacttctcgtgcgctgttggacgaacacagaccaatgctcggtatacgcttgcttcaccagatgaagttgttgcatttctcaaggaactccatactttgtctcagagctaa

SEQ ID NO: 366 - DNA, 933 bp, Glycine max
  Peptide Sequence Number=SeqID_92051
atggcggaggatgttcctcaggtgactgaggatgtccctcatatgactgacgatgttgttcagaggagtgaagatgtgcctcagatgactgcggacatagatgcgactgttgcaaaggacttaggtgctgatggtgctgaggggtcacatgctgatgaaggattccctggtgggtcccgtgacccatcagttctgacttcatttgcggagcatgtcgcacatgccatttggactggacaggagcgtcttgagttgaagttggtgtcgcacgtgaggaaggtggagttaattgggaggtcagtgcctgcgattgaagggctggttgtcgccacaagattaagtccattgattgagtgtttagttgtaaccgacgatcctaaacttatatccacatttgtggagaggtggcacagggagatcaacaccttccaccttccagtaggagagttgacgatcacactagatgatgtgtcgacactcctccatctccctatcggtggtgccttccacagcttcgaggctctttccgtggacaaggcggtatttttgttgatggagttgctcgaggtgtctggtgaggaggctagagccgagacagcttttcgcgacctgggtcagagtgggggctatgcctggggagctgcggccctggttcatatgtatgaccaattagatgaaacttctaggaccacaacacgacagattggggggtaccttactttattacagtgctggatctatgagaattttccgagtgtgcatcagtgtgtcaccaatgatgcgtatgaggagacgtcccctcgtgcctcccggtggctgacgatgaaggctcataggaagggaattacaggagcatcgtatcgtgtacgttgtgatgctttgacggtcacagacgtggtgttggttgccttacagagaccatcgaggggttag

SEQ ID NO: 367 - DNA, 174 bp, Glycine max
  Peptide Sequence Number=SeqID_92052
atggaatttgttggtgctctccgatccatcaagaatttaagtcttgccggtaactttatagctagaccttttccgataaaagaattgtcacttctaccaaacttggaagtgttagatttgagtatgaatcatcttgttagttctgtcacaactcaagttttaaatggaaattaa

SEQ ID NO: 368 - DNA, 162 bp, Glycine max
  Peptide Sequence Number=SeqID_92053
atgactgttatatcaaaaagagggaaatgtcagttcactaatcataagatgttgcttaattaccctgtggttagatcaaagtggaatggaaatgtggggaactctggtcttgttctaagagttgatgttaccaacaacaaagctttgtctttatgtgaatag

SEQ ID NO: 369 - DNA, 474 bp, Glycine max
  misc_feature (128)..(128): n is a, c, g, or t
  Peptide Sequence Number=SeqID_92054
atgaaggctcataggaagggaattacaggagcatcgtatcgtgtacgttgtgatgctttgacggtcacagacgtgtgttggttgccttacagtgaccatcgaggggttagggggtttgagctgatttnatcgttccaaggtcagctgagatggggtcctacggtggtcacaattcgaccggagaaagtgctacaccaatttgggtacattcagagcatccctccaccgtctgttagcgcttcgttctcatatgatgatatagatgacaggtggatccatttctcggaccacgtagtagttgtgggtgacctttgtgtagtgtctgggcagacaagtgaccaacccagacatgcacctgccccagaccatgaggactacatgcaaccggacatcccacaggttccagtggcatttgacccccctcgacatgcaatgatgattacgaaggctatgaggcgatcgcagaaaggttga

SEQ ID NO: 370 - DNA, 207 bp, Glycine max
  Peptide Sequence Number=SeqID_92055
atgttggtggcgactccgcgcatctttcctcctttggaaagcgcacccgtgagcctcgccttcgctcgcccgcgaagggcacgttgcgacacctatacacatatatgttttgtgagaacaacaaagttagaatctggaaccttgtgcaaattaactatcctgaccctcctactactagctagactgactttagtgggatataattaa

SEQ ID NO: 371 - DNA, 261 bp, Glycine max
  Peptide Sequence Number=SeqID_92056
atggatatttgttattgcttgctgggaaaaatggaaatgaattgtagtggaaaatgtaatttagcagactggttcctcaaaggtgtgtcgatgcagagtgctgtaggctggacaaaggattactttgaaatttcaaaagaaagggatgtgggagtcatttttaggaaattttgccaaggcaaaaatatggaaatctggaccaacaatctgatgctactgttatacgtcgtggttattgtacccaaagcaaagacgacataa

SEQ ID NO: 372 - DNA, 1467 bp, Glycine max
  Peptide Sequence Number=SeqID_92057
atggaatcagtgaagccgtcggccgtgaccccgcgaaagaagttggcacgcaattttgcgaaggttcttcatgtcaaagcactgattggaattgcttcagttgatggattgaagaatgttatatctgatgcaaatctcaaggatgaagggaacattggtaagagtaaggctacactgaattggtctgagtcattcaatgaagatgatgatgaagaccttcaagagagagaggccaatgaagcacttttggcaaagctttttgctagcatttcaactgttaaagctgcatatgctgagttgcagtatgctcagtcaccttttgaccctgatggcattgaagctgctgatcaattgctagtgtctgagttgaagaacttatctgagctaaagcaatgttacttgaagaaacagtttgatccttcacccaagactgcaatactcgaggccgaatccaaggaattgcagggtgtgatcaaaacctacgagatcatggggaagaagttggagtcacaggtgaggctcaaggattccgagataatttttcttagggagaagttggaggaagctaataggcagaacaaggcaatcgagaagagattgaatcaaagtggccaactatccgggcttgataatcttcacataacaggattaagtcctagccatttcatcacggttcttcgccacacggtccggtccattcgcaactttgtgaggctgattgttgatgagatgagatatgcaggttgggacgttgatgccacggtcgacgccatcgagcagaatgtggtttatatggcggaagatcacaagtgtttcgcgatcgaggcctttgtttgcagggaaatgtttgatgcattccacattccaaacttcgccctttcaagcgagtctcttctagacaaaaacaggagacaacagtggttctttgggaagttcaatgagatgaaatcaatgaaggcaaagtactacctagccgagaagccaagatcatcgttcgcaaagttttgccgggtcaagtattcgagacttgtccatcccaagatggagtcatcgttttttggcaaccagagtcataggaaccttgtgaatgcaggagggtttccagacactgaattctttgcctcattcgccgagatggcgaagagggtgtggcttctacactgcttggccttctcctatgagcctcaggcttcaatcttccaagtggggaaagggtgcagattctctgatgtgtacatggaaagtgtgaatgatgaagtcttcctctattcagaagtggaatcagatccacaagttgctttcacagtagttccagggtttaggattgttgttgtacgatgtacattgggttttgcaaatgtattgaaagctagctgggccccacatgtgaagcaaactttattcaacgaagtcggtgttgaaggggcatgtgaagacaatatttgcaaacctttctttgtcccataa

SEQ ID NO: 373 - DNA, 546 bp, Glycine max
  Peptide Sequence Number=SeqID_92058
atgacaaatagggtgtccgtgctgcatcagatgttgaaagagttgtaccctctgatatttacttttagtgcttggtgttttttaggaaacaatggtggatcaagttggggtatctcatccctttttggtggagatgatagccgtatgactgtgaaggagaatatagctagtaaaccacatactgaacaaccagttcacagcaaggagcaatcattctctacgatccatttgagagagccacctcctatcttgaggccgtctgagagcaattcagagacagatgttattaaaataacagcaaataagttgcttctgagatcatactacgacattgaactgcctctggaagctgaaacagttgaaaatggatacaatttgcctgaaacaacttgtgtgcctgttattcatggattaccaacaccatccatgtactctacaagcaatgatggagacgactattatgcagcttctccgaagtacccaaagtcagatagattccaatggaagcagaaggccgttcatgtcaggtttttatcctacggttga

SEQ ID NO: 374 - DNA, 1965 bp, Glycine max
  Peptide Sequence Number=SeqID_92059
atgtcgcgttcgtcggggaagccggtttccgaggtggtcggcatagacgccaccttcgccgatcggttccgcgacgcgctgacctgcgacgacggcagcaacaacaacaacaatattaacaagcccgacttccgagaactcgatctgggctcgccggtctcgccattgcggaccacgcgcgggcctgccgccagtagcagctccagctcctcgggctccttctcgggccgaaccgggcccacccgcaagcctgaatcggctcaaaataatagcaacaccaacactcacactcatagtctcagcaacaacaacaactccggtgaactttctggttcaagtgagaacagccccaccgcgcgtaaaccgggtcacaggagatctgactccggatctgcgctggtgccgttgatatactccggtcagacggcgacttcgccggccatgaatgttcttccgaccgggaacatttgtccatctgggaagatcttgaaggcggggatgatggcgaatcggagtagcagaactagtagaagcgatgttttggggtcggggatgggaaactacggccacggaagcataatgcgtggcggagggaaggtggagccggcgagttctcgcggcggcggcggtgggaatgagacggtgaagaaaggggggcacgtgcagagtgtggatccggaagagttgaagaggttggggaacgagtgttacaaaagggggaactttgctgatgcgttgagtctctatgatcgcgcgattgcgatgtcgccggcgagtgccgcttaccggagcaaccgcgcggcggcgctgacgggcctcggacggttgggtgagtctgtgagggaatgtgaggtggctgtgaggttggatcctaattatggaagggctcatcagcgtttggcttctcttttcctcaggttgggacaagttgagaatgcaaggaagcacctttgttatcctgggatgcagccagagccgtctgagatgcagaggttgcaagtggtggaaaagcatatcagcaaatgtggggatgtacggagggttggggaatggaagagtgttctcagggaagttgatgctgctgttgctgctggagcggattcttcgcctcagctctttatgtgtagagcagaagcgtttttgaagctccaccagattgatgatgcggaatcaattttgttgagtattcccaaatcagagctgcaaattaattcctcttctcaggcaaggttttttgggatgctatcagaggcttattcctattttgtcagagctcagattgagatggcattgggaaggtttgagaatgcagttacagctgctgagaaagcctgtcagattgattcccggaatgttgaagttgctgttttgctcaacaatgtgaggatggtggcaagggctcgagtgcgcggaaatgatctttttaaatctgaaaggtacactgaggcttgctcggcatatggggaaggtttgagactggacccttcgaattctgttctatattgcaatagagcagcttgttggtttaagcttgggcaatgggaacagtcaattgaagactccaaccaagctttacatatccaaccaaattacaccaaggcccttcttcgaagagctgcatcaaacagtaagctagaaaggtgggaagaagcagtcaaagattatgagatcttgcggagagaacttccaaatgacaatgaagttgctgaatctcttttccatgcacaagttgccctaaagaaatcacgaggggaagaagtatataatttaaaatttggtggtgaagtggaagaagtctcaggtcttgagcagtttagagctgcaatttctttaccaggtgtatctgttgtccattttgaagttgcatctaacttgcaatgcaaacaaatatggccatttgtcaatacactatgtggtcgatatccatctattaacttcctcaaggtatctcactttacaacttaa

SEQ ID NO: 375 - DNA, 3627 bp, Glycine max
  Peptide Sequence Number=SeqID_92060
atgttgatcagcaatgaaacagaggatttatgtgatgataactttgaaggatctaacgaagaaagacagattttttcagaggtattttctggtaatggcatttttcagtctaatcagaagtgtcttgttcctgtagctatcagctttgaacatgaatccgctaaaaacacatttaaatcattctgctctagtaatgaaaactcagttgtattgcatccatcatcttctagacttacacaccctgaagaagaggactttaatgtaattcagcattccaaagaggctgctctggggtgtgtgccagagagtttcatttgtgaagaccagaatgacgaggatgtgaatgtcaaactttctaacctgtctcgtgctgctacaagctgtgatagtgaaccaattgcatttcatttagttgaatcatctaaacatggtgtgatatctagctgctatctattgaaccataacaaggtaaataaacaagctgccaaggataaggtagatgttacaaattttaactcaacaacagcagatggaaatattgcaaaagagttgtgtgtaagtaaagcagctgcttctcctgtttcccaggaaagctttgcgaacaggcgtgtagttaccagtccgtcaaccactgttgtgaagaagtctgggtctcctttaaatcccgaggaaatggtggaatcttctaatgtaggcatctcaaatgcatcctcaatgctagaggaagaggaccctcgtactatactgcagtttcatattttgcagttgctaaagatggcaggatggtctattgagaagcgtcaacggcctagtaggcgttacccagagtcagtttataggacaccagagggaaagactattcgggagtttacaaaggcttggagattatgtggtgagctattgtctgttgaaaaatgcaattttatgtgcagagattataaggaatggactgatattagtcaattctggtctgatctatccagtacactgataaatgttgaaaaaacaaagatgcagtcagaagaccctgctgctgtattggcttatcgatggtggcttttggatccttttgtagtagttatattttttgatagaaagattggtgtgctgaaaaagggagaggcagtgaaagcaacttggagtttagtttctagcaaatatatggtggcatgtgctcccattggttcaagctctgggaatttgaatcaggtacctggagggtctaatgtaggtgctgttcatcaagccagaattagaaattccaaaagttttgataaacagagttcagagaactatctggaaacaaataaaattattgatggagatctgccaatggacatgtcagaagaaaataatgcatccagtgtgagccatggcctggttcattctcatgactcaagggatatgcaacagtctgaatgtagtgaggaagaaggtggcaaaatctcagtagattctgtatttgggaaagataacaaatattctgcttctgatgttattcttaaaaagaaaatgcggaggaagtgcaaaagggtatctgaaatcaaactgagtatgttctaccatagtgacatgctgggttcaactgttactgaccaggtgcagttactagatggtgaagcaagtgggttggaagaggtccaggattatctagttgacaatgcgggaaagaaaagaaactgcagaaagttatcatctgttggtgcaattcagagaaatattaggaaaacaaactgccccacagctggaacagataagtctaacagatgccagattaaagacgatgatttattggtgtctgcaatattcaggaataaggacttcagcccaaaggcaatccggggtaattctagtgctaaatcccgcaaatcaaggggtcagagaaagcttaaaagccaaaagggccgttgcaggttgctaccaaggaatccctgtaatgcagggaagcacaataaggactgcaataggttttatttgggtgctaggacaatattgtcctggttgattgataatggggtcatatctttaaatgatgtgattcaataccgaaatcctaaggataatgttgtcattaaggatggtaggatcaccaaagatggtattatttgtacatgttgtgataaggtgctcacattatcagagttcaagtttcatgctgggtttacagtgaatcgcccctgcttgaatattttcatggagtctggtgagccctttacactctgcctccttcaagcttggtcagctgaatacaaagccaggagaagccaaaatcaagccgtacatgctgatgataatgataaaaatgatgattcgtgcggattgtgtggcgaggggggtgagctgatatgttgcgataactgtccatctacttttcacctagcttgtttgtccactcaggtgtactctggactccagactcaggtggggttagttaatcaagttgctgatggcatctcatggacccttcttagatgcatccacgatgatcaaaaagttcattctgcacagtggtttgccctaaaggcagtatgcaatacaaaattagccgttgctcttactataatggaggagtgttttgtgtcaatgtttgatcctagaacaggcatccacatgataccccaagttttatacaactgggggtctgagtttgctcgtttaaactttcaagggttttacaccattgtattggagaaaaaggatgtattaatatctgtagcatctatcagggtgcatggaactacagtagcagagatgcctctaattgctacttgcagtcagtatcgtcgccagggaatgtgccgactccttgtgagtgctattgaacaggtggaaaagcttgtggtatcagccattccagatttggtcgagacatggacaaagggctttggatttataactgttgatgacattgaaaggcaaagattgaataaaattaacttgatggtttttcctgggacagtgttacttgtgaaatccttacatgggaaggagaaaattgaaggactgtgtgatctatcaattctagcaacagatgaatcaatcaaagcaggtatctgttctgaaggaatggccatttctgaatcatttgcacaagttgttggaaacataactaccaacaaaggtggagcaaagtcagaacatgaacctgtggatggaaaaaatcaatcagactatgaagctggcagtgaaacaggcagagatgataaaatacaagctgttgacactgcaatagaagccaaagaatcaacagaaataagtagttcttctagagaagagaaggtcacccagttgaaagtgtcaggtgactcagagaaatctattgaagaaaacaatgtgaatgaattgagaacaagcaacaaagcagaaatgacaagtgattcagtacagcaatctagtgagaattgttgtgctgacaaagatggtgctgaaccagctattagtattgttgaggacaagaatatcaaaatagtctgcaagctgaatcagaagttgaaagaaagtagatgtttagagagatggtgtgatgatgctcataacaaacttgtagggtatcttagggaaactaactgcaaaatatggaaaaataaccggttaggtaaggtcaaaggaggttgtgctacaaattag

SEQ ID NO: 376 - DNA, 306 bp, Glycine max
  Peptide Sequence Number=SeqID_92061
atggctatggtggtttggttgtttgtggcacttatcataacacagtcttacacagctaaccttgccagcatgctaactgctgaacggcttgaacctaccatagatgatatcgatcagctacggaatagcaacatcaaggttggatatggtaaaggatcctttttgaaaaattttgtgcaggaagtgttacagttccatccttcaaacatgaggcactttggagcacttgaagagtatgctgaagctctcagaaggaaagaaataggagttgcatttcttgaagtgatgttgcagaaaatcctatga

SEQ ID NO: 377 - DNA, 846 bp, Glycine max
  Peptide Sequence Number=SeqID_92062
atggacttcaccttcgggagtgttttattcgagaagcaggaccttatccccgtgcttgctgtttggtttgccaatatgtgtggtgcagcagtatccgcaagatatttgcctttccttgacggcaaggggctggggtgtccgtgcttcataagttataacagctactgcattaccatcaatgggaagcctgagtgtgagtgcccggatcattattcccctttcgaacacgacaatctcacaggttgtagaccagatattcccctgcctagctgcaacaaagacgggtgggagcagaataaggatcttgatatgtgtaaacaaaagtgccttgaggattgcttttgtgctgtagccatatatggtgagggacaatgttggaagaagaagtatcctttgagcaatggaaggaagcaccctaatgttactagaatagctcttgtcaacgtacctaaaagagatttggacaagagtgggagagaacaaactacacttgtgcttgtcatatcaatagtgcttgggagctcagttttcctcaatgagcttgaagaagcaaccacggggttcaaacaaatgttgggtcatggtgcttttggaacggtatatagaggggtgttgacatcagacacaagcaggtatgttgctgtgaagaggctagataaggaggtgccagaaggggagcatcctcttctggtgtatgagtacatgcgcaatggctccttgtctagctttctctttgggatctcaaggcctcattggtaccaaagagtgcaaattgcgttgggaattgcaagagatctcacatatttgcatgaaagtgcagcactcagatcattcattgtgacataa

SEQ ID NO: 378 - DNA, 1014 bp, Glycine max
  Peptide Sequence Number=SeqID_92063
atgtttaagaaggcggtggaggcgaaatctcaccagaggttgtctggtgcggacaggaagaagctgagacgaagcattaagcaaaaattccaaagggtttctgattccgacttagatgccttgcttcctcccaaggctgagattacagtagccaagcttcaaaaccgcgtccatgtatatgctgtggagggaggctttccaatgtttttcgatgttgatggccgcggctcagacatttttcctacagtttatgcactgtggatggtccctgagctactgccagttttcgtgctgaagggtggcgaggtatcccggttcgttatcggaggagcagacttgatgttccctggtataattgtgcctcctgatggtcttccttcctttcgggctggggaaccttgggccgccaaggtacctggaaatcctgctcccatcgcatgcatgcactatttaatattgggtcttgctaaccaagggcactgggaaactgccgagggccgttgcgtgcctaatgcaggttttttcgaagatgttgtctttgaggatccttctttgttacaagcttctcatgattctgatttgactgaggttgctggtgagacatcaattgatcagcagaaaaacccaaaaagtgatggatcggaggaatctctggatgtaaatgagttgcaaactgattctgcccctgcattggcaacaccaaatggcgatgaaaatgataccacagctgaagtaactgaaggcgtggctgatttgaagttaccggatactgtctctgctaatgaccaagatgaccaactgactctatcaactgcagatgtagattccttgttagataagtgccttctacaagctttgcacacaacagtgaaggacaaagaccttcccttgcctggaagcacgctatggtggaattttctccctctttttctcttggttgacctagttgaaccatttgaaatagattggccaaagaatctagcaaaccatgaatttcagttgacaattaagtag

SEQ ID NO: 379 - DNA, 531 bp, Glycine max
  Peptide Sequence Number=SeqID_92064
atgaggttgagtgaggaatcacgaggtctagcggcgacacaacagtgcgacaacagtgaggaagtttggcgttgcatcacgagtgacgaatgctggagtgttatgtggaagataggtgaagagaaagagaatggagtgccacgagtgcgaaagcgagagatttcaagtgagagtcagaaagacaaagtgaggaagcttgagggttcccaggaggagagagaaacccaaggggatgctggagtacttgttgatgtagtcctcggtggagccgctattgtatggattatcatatcgatcaaagagcacaactatagagtaatagagatcatgccgatggaagatgaaatggttgctgcacctcattgctttgcaaagggcaaaaatgtggaggttgttacgaaactagatgaagaggacaccataaagcacaatggcattggaggggttgagggggatgggaagagtagggagaagaaggagataaattggagaggagaggaggagaggattgagcaaccgactcccaaatag

SEQ ID NO: 380 - DNA, 852 bp, Glycine max
  Peptide Sequence Number=SeqID_92065
atggagtgtccaagggtcaagcttaaagaagcgaaggagtcagcaggaacattcgttggtgaggtcacaaaggatacaaagagtaatgtggctgaagtggcaggacgagttggatcgatggtgaagagtcggtgggcacttcttcaacagccatccacaagacatgctgtgcaggatcgtttcatatcagctgctgctacaactggtacactcctgaggagaggcttctcagggacaaaggataaggtggttgtgggaaagtccaaggttgaagaggtggcaaaaataacagcacaaaaaagtaagactatcttgacagatattgaaagatggcaaaaaggagttgcaagcactgatgtatttggagttcctattgaggttactgtgcaaaggcaagattgctgcaaacctattcctcagatattaatcaattgtgcagattatcttatagtttcaggattgaactcgccacatctttttaaatctgaaggggataaaaaggttattcaccagttggtttccctatacaaccaagattctactgcttcagtaccagaaggaacaactcctgttgatgtagcagctcttgtaaaatattatcttgctagccttcctgagccactaaccacattagagctttataatgagattagaggtgctcgatccagtatatattccatgagaaacatactcaagaggctttccagtgtaaactacatgactctggagtttataacagcacttctactccgtgttagccagaagtcacttctcaataaggtaggagtcttctctgcatggtttagtcgaagtagggatgggtgggtgggagattgggtttcatatgcctga

SEQ ID NO: 381 - DNA, 1215 bp, Glycine max
  Peptide Sequence Number=SeqID_92066
atggagcttgatttgaatcaggagccatcggatccaactcacgcttctccagatgaatttgattctttgttggaagaactagaatctgcccatgaacatgtgcaggaccgtattaggcgccttgaagcgataacttccagaaccaggcagtattcgagttggccgctgtttcacactccaatccaaataaccaactctactggacaaaccagcgcgctagctgatgctcgtgaagaagaaatgccgagccgggaagttgaggaaagagtcgttgaaagtgggagagggttcaaaaggaaaggtgcccatttagtagctaaggcattggggaggattgaaacagatgccaataaggaagggggaagcactggaaatttctatgattgcaatatatgtttagacagggcaagagatcctgtgttgacctgctgtggtcatttgttttgttggccatgcttctatcaggtgcaaattgtctattcaaatgcaagggaatgccctgtttgtaaaggagaggtcactgaaactggcatttttccgatttatggcaattcaagtgccgatggcagttgtgagtcaggattgaaaggagctggtttgagaattcctcctcgacccgctgcacccagaattgagagttttaggcagcagctaataagtcagggagcatcttcttctgtaatcctaaatatccggcggtttcatcaccttattggtgggttaggagctcgagttcagtcacaaaaccccaatgctgcaactgataggaataatggtttgctcgctcaatctcgcccgccatcaagcaatgatcgaggtactggttcctctcagactccaatttcaaccttgttagtgcaaggagctgcttcattttcatccctttcatcagcattaaattctgcgatggattctgctgaaagattagttgaggaccttgagtcatattttcataatcaccagacaaatggtgtcaatacaagttcaactcataatgggaatgttgctgcaactgattccacacctgcagcttctacatctccttttagtaggaatgttgacaccactgctaatattggctcagaaattcagacaacagataataacatacagactgagactagtacattggacccttcttcatctcgcagaggaagcactcgtgtttcaacttcaagacaagttacaaatgatcgcagaaggaggtcaagatga

SEQ ID NO: 382 - DNA, 2477 bp, Glycine max
  Peptide Sequence Number=SeqID_92067
ggagtggatttaggaaatgccttgggtcacgcgctacactgctagaagtgcaaccgttactgcaagacgctatagctgagcgagggaaggacgaagttggcggcaacacgtcgctggaaggcggtggcttgttggcggcggagcttcgcgagattaggttcggatcgctcggtctcgctaggcacttgactaacattgtgtctgttctagctaaagcttgtgttgggagaaagcaaagagcatctagtttgttaacaatggaagatgatctgttggacacagaagacaggaacaacaatggcagttccaccgcaaagaaatcgaagcagcggcgaaagaggaaggagtacatggtggacgaggatgggcaggtgggggcacgagagaagctggcaaaaagaatcttgttgtctctgacgaggccttcctatgttttgggattgggtcccaaacctcttagggtggaacaccgtgcaaggttgcgctacctgcttcggcggctcgtcagccagcatcattgggttgcagccagtggtgttctcagtgtctacttgaagggaacacttgatgataactctccctacaggaaccgtcttaagttttgggttttactggagcttcttaagcatgtggaaaaccactctattaatccaacacgaatcaagaacctctatgatatttggtctaagaaaattggatcaatgaagacttggccagttgagcagagcagatatgcagtccatttggagttcatgcttttctgtcttttgcaaggcaatgctgaggatgcataccagcttgctctatgccttgggcaagaaaaaggtgatattggtcctatgtcaaagatgatgatgggtttgacattctatgagttgtggtattcttctatccccaaagaattccagtggagaaattcagatcagtttgacttgcaagagaactcagatatggagggaacttcattcaacaatgaaactgtacagtcagagaggtataattcagttgaatcccacatggctgactcccagtcccagcgtgattcagatgcctctgtcatgaatgataagaagatatctggggatgttgtcttcaatgaagacatggaggttgatgctaataaaagagaaaaaccacatcagaactttcagccagaaggtttttacttaaattctgaagagcataaaggatttggagatcctttttctaacaatggaggtcttacacaggatatcttgtatggccttggggaacttgatttgtggttgctacccctgcgtttatctgatgaccacagttttgaggagttcatgtatttgcaaggaaatcagcctaatgactattacaaaaatgcagtgaaatatttacaacttgcacttgactcagaaccttctgcttcagcagcattacttccattgatacagctgttgctgattggaggtcaagttgacgaggctctaaatatgcttgagaagcaatgttgtaattcagcctctgtactcccaataagagtaagggctgctctcttggagcgttttgatcgaaacaactctctcctgcttcttagctgttttgaggatatattgaagaaggatccaacatgtagtgacaccttagcaaaacttatcaagatgcaccaaaatggagactatagtcttgtatctctgctggaaatgattgctttacatttagatgctacagatgcagagtacaatacgtggaaggtgttctcttcatgtttcttgagactgtcttcctacgaagaagactgcatgtcttcatgccccattcaaaatgaagatggacataagcaacattttccccttaacaaaacccctaaaatatttacggatggtatatcaggaaaatcttggaggcttcgctgtaggtggtggctaactaaacatttcagcaatagcaagcttgaatccgagattaatactggtgacttgcagttactcacatacaaagcggcatgtgcatcgtatatgtatggacgggaattcagctatgttgcgaaggcttactctcatttagaaaaagaagatgataaggagttgctattcgcgcagaagacacaaacttgcggcgaacacatgaagaaaccgaagcaaactctgttgagccccaattgggttcaacttcaacaaaagctgaagctgaatggctccaaggcttcaaggaccttcaaaacttcagatgaagacaccccagaatcaatattggggaaacgtaaagagagaccagatgatgaatccaatgattgtcagattaatcctcttgttcctgtaaatgacgattcaagtctgacagatgcagtggccatggattgtgaaatggttggcgtaggtcaaggaaacaaaagtgcccttggaagagtaacactgtggacttcacctgcagtgctagattttgaaatcccactggaagtaccaaacggtcagggctatggcatcggactcttaagtggatattaa

SEQ ID NO: 383 - DNA, 321 bp, Glycine max
  Peptide Sequence Number=SeqID_92068
atgccatcaaatacatggttaggaatccaactatctgctaactttgaaacttgttggatgagaatttctgggagcaggaacaccaacacgtgtctgtttgaacagctagtttccattgacagtgccagtgctattgttgtttctctttccatccactgccatgagcaattcaacaaagtgacggtggtgacatcaaaaccaacacaaagcgaagaaagaaaatgggaagaatctttgcggtggagcttgagggcaggtcttatagatgcaagttctgcagaactcacttggcccttgcaaatgatctcatctccagggtag

SEQ ID NO: 384 - DNA, 1032 bp, Glycine max
  Peptide Sequence Number=SeqID_92069
atggaccacaccgaagctcacttgccacctggttttcggttccacccaactgatgaggagctcataacttactaccttctcaagaaggttcttgacagcaccttcactggtagagccatagctgaagttgatctcaacaagagtgagccatgggagctccctgagaaagctaagatgggagagaaagagtggtacttcttcagcttacgtgacagaaagtacccaactgggttaagaaccaatagggctactgaagctgggtactggaaagccacagggaaagatagagagatttacagctccaaaacttgttctttggtggggatgaagaaaaccttggttttctaccgtggtagagctccaaagggagagaaaagcaactgggtcatgcatgagtatcgccttgaaggcaaatttgcttaccactacctttctcgcaactccgaggatgagtgggtcatatcacgtgtgtttcggaagagtaacaccacaccgatcaccaatggaggctccaccatgtccgcttctactaactccaagaagacaagaattaacaacaccacctctcttatccatgaaccaggttcaccctcttcagttttccttccacctcttctagactcttctccctacaccaacaccaccaccaacaccttcaccgaccatcacaatagttcttatgatagtgccaccaaaaaggagcacgtgtcctgtttctccacaatagctgcagcaacagctgttgtctcccccaacaacaacttcaacaatgcaagcttcgaccttccaccttctcagcctcttgcaaccgacccttttgcaaggtttcagagaaacgttggtctttctgcttttccaagtttgaggtctctacaagacaaccttcagctacctttcttcttctccacggcggcggcgcctcccttctccggcggaggctccggcgacttcctcagctggccagtgccggaggatggtgtttccaacatgccactgggcgtgtcggagcttgattgcatgtggggctactaa

SEQ ID NO: 385 - DNA, 2061 bp, Glycine max
  Peptide Sequence Number=SeqID_92070
atggtgcatttagtgatgcgtggtagtaacatgggctcagagctgaagaagtgtttcgcttggggcttgaagtctctgcaccaagcgaagcaatgccactgccttctcctccgtctcggtctccaccaagacacctacctcatcaacctcctcctacgctcttccctccacttcgccgccacgcaatacgctaccgtcgttttcgcccaaaccccgcaccccaacatcttcctctacaacaccctcattcgcggcatggtctccaacgacgccttccgcgatgccgtttcggtctatgcctccatgcgccagcacggctttgccccggacaacttcaccttccctttcgtcctcaaagcctgcaccagactcccacattacttccacgtgggtctcagccttcattcccttgtaatcaaaactgggtttgactgggacgtgttcgttaagaccggccttgtttgtttgtactccaaaaacgggtttttaaccgatgcgcgcaaggtgtttgatgaaattcctgagaaaaatgttgtgtcttggactgctataatttgtgggtacattgagtccggttgctttggagaggctctcgggttgtttagagggttgttggagatgggtttgaggccagatagcttcacgttggttcgcattttgtatgcttgttcacgggtgggggacttggctagtggacggtggattgatgggtatatgagggagagtgggtcggttgggaacgtgtttgtagcgacctcattggttgatatgtatgcgaagtgtgggagcatggaggaagcgcgcagggtgtttgatgggatggtggagaaggatgttgtgtgttggagtgccttgattcaggggtatgcttccaatgggatgccgaaagaggcacttgacgtgttctttgagatgcagagggagaacgtgagaccggattgttacgccatggtgggagttttttcggcgtgctcaaggctcggggcgttggagttggggaattgggctaggggtttgatggatggggatgagtttttgtctaatcctgtgttgggtactgcattgattgacttttatgcgaaatgtggaagtgtggcacaggcgaaggaggtttttaaggggatgaggaggaaggattgtgtagtcttcaatgctgttatttctgggctggctatgtgtggacatgttggagctgcctttggggtgtttggccaaatggtaaaggttggaatgcagccggatgggaatacttttgttggtttgctttgtggatgtactcatgctggtttggttgatgatggtcaccgttattttagtggcatgagtagtgttttttctgtaactcctactatagagcattatggatgcatggtggatctccaggctcgtgcaggtttgttggttgaagcgcaggatttgatcaggagtatgccaatggaggccaattctattgtttggggggctttgttgggaggatgtaggttacataaggatacccaattggctgagcatgtgttgaagcagctgattgagttagaaccatggaattcgggacattatgttctcttatcgaatatatattcagcaagtcatcgttgggatgaagcagaaaaaatcaggtctagtttgaatcagaaagggatgcagaaattacctgggtgtagttgggttgaagttgatggggtcgttcatgaattccttgtaggcgacacttcccatcctttgtcacacaagatatatgaaaaacttgaaagtttatttaaggatttgagagaagctggctataacccgaccactgagtttgtgctctttgacgtagaggaggaggagaaggagtacttccttggctgtcatagtgagaagttagctgttgcatttgcactgatcagtactggggccaaagatgtgattcgtgttgttaaaaatcttcgtgtatgtggcgattgtcatgaggctataaaacttgtttcaaaagttacagggagagagattatcgttagagataataacagattccatcatttcactgaaggctcatgttcttgtcgggattattggtaa

SEQ ID NO: 386 - DNA, 501 bp, Glycine max
  Peptide Sequence Number=SeqID_92071
atgagaatctccaatgtcttgtctagtgctttccctgccatgcaacttgcaaatggactcgacatccttctccagacacgcgaatggttccctccctcacgcgccctcgacgccctctctgccttccgccagatgcaccgtgccttccccgccaacaagcacttcgtgcccgacgacgcctacgccgcggagtccatcgacgatgatcccctagcggcgtccagcggccaagtcatcgtcgatgttgagagccgctaccacgtcgtgtatcgccttgtgaacgacaattacgtgctcgaaatcactgtcgccaaccacgacaactcagtaaacgtgttcgagtgcatccacattgtcaaccagaccgtgagcgtcatggtgacgacgtgccgcggcattgacgtcacgccggagaagctcagtcgcaagtacgttagtgaaggtggcggaggagggacatggcgacgacggagagatggatttccaaattcactcccttga

SEQ ID NO: 387 - DNA, 105 bp, Glycine max
  Peptide Sequence Number=SeqID_92072
atgtatagattccgtggaatgaataactatgaaccatcgtcttccaaactctctccacttcctctccgtaggctaagcaaccttatggggttatggcctttttag

SEQ ID NO: 388 - DNA, 1479 bp, Glycine max
  Peptide Sequence Number=SeqID_92073
atgacgagttctcgagagcgtttggtgaaggcggtgaagcagttcgtggaggttcggtacaaggttttcagcaaccgttatggccaaaacatcatcgacatcctcgacttcccgattaaggttgtcttgtctcctttcactctcgccttcgacattgccggctctgctcctcgcggcttcggcgtccccgaactcatctccaagctctccgctacctccgtcttcgaaatggagattaaaggtcacttccttgatgctgcgtcgtttgcttatttggattctgagaatgtttttgtttttgttataaaaattattgggtatgcaactgcttatactttgagagagaatgttattgctcacagtggtcttactgccggagctcgagcaggaatttctcatgtggaggatggaggatacattggagaaaaagcgactgctgaatctgtagcagatgccattgccaacaaccgggctgagttggtgcatataccatcgtccttggattttcagaaaccattaccttcaaaagagtgtccaacttgtgatggaacgggtgtaatgagttgtcctgaatgcaaacacagattgctacatgttaggatctcagcagatgatgtgagtattgttgattctatgattatggagcccccatggcaagcttataatgtcttgaaaaagattgattatccatatgagcacatattgcacagcatgaaagatcccagtattgctgcattttggctgattacatttcctcagattatgggtggatttacctatgacgatgatgtgaagcagaaaatatggtggcagtacaaggaaaatatgcggtatgatcaactccgagatgtggtggccaagagaaaaccagggtgggagtatctgcaggatgccttgatatctattgatcctgcccgtgcaagggatgatcctgtcatagtgaaaaatgtcccttactataaggctaagaaggcactggagacagaggttatgaagattgatcctccaccaagaccgccaaattgggcttcacttgaacactgttacgaggatgacctttgtgaagtgcattctatggttaaaccatggctcctattgagcaatgttctcaattttaacataaaagagaattggcaggagctagaccttccattgaatgcatcatcttggagtgaggaggatctccaagatccagataagttctatgaaatgactgttcttcttaatgcccaaagagaaatctctgataagatcttggatgcacagtgggaaactaaatggcgtcaggacaagatcataccctatgctttgttagttcacaatgtccttggtattcttggttcttgcttcaaaattcaggatgcaaagctatctgtgttgaatgagatgttggaggcaaaagtgaagccgtacatccaggatatagacaacgcagttcttcctgagcctattttattaaagccacaaaatcaggaaaag

SEQ ID NO: 389 - DNA, 204 bp, Glycine max
  Peptide Sequence Number=SeqID_92074
atgaagatgctcttgataccacatggtgtagctccatgtggagcttgtaggccttggatcttcttcatcaatggagtctttttcttcttaaagatcaatggcagcggaatggagaaaaagatagatgattggagacgccacttcaaggagaagatgattcaagaacaagctcaccaccataggaagccatggataagagcttga

SEQ ID NO: 390 - DNA, 691 bp, Glycine max
  Peptide Sequence Number=SeqID_92075
atggaaatcgatgacgaaggggtgttgctagatagttacctcaacgttagggcatgtgtgctggcattgaagttcctcgccgttgcccacccatctatcaaaatgcttactggttggccacgaatatacccttacattcgtaatgtctctggtaccacgtgcccagacaaggcattgaagctcaattgcgcagggggtggctttggtacggaccgtttcggtgcatccattggaaccaagctaatgcttgtccttccattagcatcggagccgtcgaaccttggcacatccagcttcagccgatgcggcgctgcaacagatcctgacgccaaaaacgaagatacctcaggctgtgcttgggaagggttgaatctagtagcttcaagatgtgctagtctctccgagagcgtttccatctttgcttccaccgttgccgagaatttcgcgaacaactcctccattttttctaaggataacgctttcgatctcgtgccttcaaccatgcttcaaaccttgtgctcaatgaaaacaccaatgatgcctagcgttcgagggctagggaacctccctctgcgcgtgcctcacgagaaggttgaactcgtagagaagaagggacgcaggttcagagaagagaggaagagaaagagtttgaaagaaataagcttctggaaattctcattgccctttgcaa

SEQ ID NO: 391 - DNA, 526 bp, Glycine max
  Peptide Sequence Number=SeqID_92076
atgaaaagagaaaaatatgcctgctatagtagtcataactcttgcaagagcctaagtgaagaacttcgtgactattacgaaggcaggcataggtcgcatcttagacctcactcccatagaagagaaaaggaaagaaagcctcaagaggctaacattaacctcccatacttccatgggaaggacaataaagaccaaggtcaaggcatcttaggggtgacaccttctaagcccaaagatgataaggggaagacaatagaaaagcaatcccctaaggctagctactacttcaccttccttagtgaaagtgaagaagcaaaaggggaagaatctagtgaagaaatctacccccaagaagaaggacaaccattagtggttaaagagaagtgtaaggagacacttgctagcattgccacacctcttgggcttgggtttatttctcaagtaaagaagttgttggatgagggtgttgagggaaggagcccagagtatgaagaacctcaagatttgaggtcaaatcctttccaag

SEQ ID NO: 392 - DNA, 666 bp, Glycine max
  Peptide Sequence Number=SeqID_92077
atggaggtgccgaagggtgttgagatagatgctgatggtggtggagttggagcacaaggagctggaggtgtagaagaagaaggagcagtagtagaagccttaggtcttggagcctgtgccttgtgggtccctggaaatgtgatcgaaggatcatccagagactcaaaggtgagggagtctgagacaactcctcaggcgacgcacaaggctgtgataagtgcgggaaagccgagcctggaggatcaaatccttcatcaggagcttccggggcgcaccctctgcattaagtacaaatcccttccctgggatgtagagtctggaagccagctcctgagggtctatgcgagtgatgtagactgctcccctggctccagaactagtggtgtctccagaaaaacattcagagagggccacatctatgttctcatccatttgcctggtcaaggatttatgccagttttgcctctcaagttccctgcggaactcatcatactccgtgatgtaaagaatcacattcctctctggaagaatgttctgagcatatctctcctaggcaccctcagatatgaatctagtggtgtcatagggctcccggggtctggagacagtggatttcctcttcctggaggccatctgcataaaaaagaatcacaggaatcaagttag

SEQ ID NO: 393 - DNA, 186 bp, Glycine max
  Peptide Sequence Number=SeqID_92078
atgaccaagagcaagggcaaggatccacttgaaggacttggagggtctatgacaagggctagagcaaggaaagccaaggaagctcttcaacaagtgttgtccatactatttgaatacaagcccaagtttcaaggagaaaagtccaaggttttacactcagccattaaggtttttttaattccctag

SEQ ID NO: 394 - DNA, 267 bp, Glycine max
  Peptide Sequence Number=SeqID_92079
atgaaattttggcatcttggtgatgtaagctccattggaccttcggaatggagaaggaagagagagaggagacgccacttcaaggagaagatgagtctagaagaagctcaccaccataggaggccatggataagagcttggaggaagaaggagatgaatgaaggaagagggagagaagagcacgaaattttgtgctctaaaagagctctgaaatctgaacccactaatccaagatcaattccaagattctccactaagtgtgcttag

SEQ ID NO: 395 - DNA, 444 bp, Glycine max
  Peptide Sequence Number=SeqID_92080
atggctggtgcacctagcaacaccccaatatgctatactgtagtttacaaaagcaaaggtgaaaggaaagatattgagctggcagaggaggaaaagccatggattggtgctgattgttctagtgcaacctctaataaatctgagatttataaggaggaagcagggaatgcagcacagaagcataaagcaaagatggtggagagtgtcaatgctgatgcagaagcctttggtgatcagtggaaaacaggagattcaactgtgctgaagataggagattcggctaaagttgtgataaaagaagacatgaagggaggagagcataaatatgggtttaacaacaataaacgtgaaaagccagagaaggtaaaggtggtggatgatgaaactggcgacaaacatgagttgtatgaagtcctaaggatgccatctagaacaaaaaattga

SEQ ID NO: 396 - DNA, 887 bp, Glycine max
  Peptide Sequence Number=SeqID_92081
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgtcaacattagacagatcaatgagacagaaagttaacaaacatatccaggacttgaactcagctctgcaccaagtggacctaatagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 397 - DNA, 655 bp, Glycine max
  Peptide Sequence Number=SeqID_92082
gaaggataaagcggctgaaggaaccagttccgctcccgaatatgacagtcatcattttatgagcgctgagcaccagcagcgcttcgaggccatcaagggatggtcatttctccgggagcgacgcatccagctcagggacgacgagtataccgacttccaggaggagatagttcgccggcggtgggcatcgctggttacccccatggccaagggtcagtggatcccattcgatgcggatgctctcagccagttcctgggatatcctttagtgctggaggagggccaggagtacgagtatggccagaggaggaaccaggccgatgggtttgatgaggaggctatcgcccaattgctgtgtataccaggctcagcaacatccagcccaacgatcataattccgacctccccctgccgaagtgttagctggcaccctctggacccggataagtccaacagggccctgggatttcccgctttgatcacaggactctgccagtcgttcggagtccccgtcgcacctagcaaggtgattcggccgcccatcacccgagcttttattgagaagtattgcacgcagagacaggcccagggggatgctccgcaggccgcagtacgcgctgccacctcatcaggctggcccaactggatcatttga

SEQ ID NO: 398 - DNA, 392 bp, Glycine max
  Peptide Sequence Number=SeqID_92083
atgggtgaagtagaggaggtgcaagagcaaatgaagtccaacacggaggccttgaaagagaaaatggccatgatgagcataaaggagataatggaagccaatgcaattgcagttgccactgccagcgttgttgctaaggtgaacctgatgcccccatctggcctcaagcaaatgaatcatccaacctcagatatggatgtcaataactccgctcccatagtcattgagatccggcaacctcatcatgtacatgtctctcaacccatgggggagacacatgaaattccccaccacaatctagctgactttgagccttgcctcgaatatgccactgaagggctcagggccattgaaggaggtgaagattatgcctttgctaacctagaagagtt

SEQ ID NO: 399 - DNA, 285 bp, Glycine max
  Peptide Sequence Number=SeqID_92084
atgataatcccacaaaagctgcgccctcgcctcttacctatggttctgggcagtgcgctgctcgcggtggccgcttctggctacgcggaagagatgaacgcaggccagacgaattcaccggatattctgctcgggcccctcttcagtgacgttcagagcgccaaactcttccccgatcaaaaaacctttgccgacgcggtgccaaacagcgatcccctgacaatccttgccgactaccgtatgcaacgtcgtcagtccgggtttgacttacgccattttgtcgag

SEQ ID NO: 400 - DNA, 339 bp, Glycine max
  Peptide Sequence Number=SeqID_92085
atggcacctacactttgcacacacattgagatattaggccttatactcgggtctataagtgctgaagttgatgtctcgctaagcgagctcaatgcgcttagcgagtgtcatccgctaagaaaggcatcaacgcgcttagcggataggaggaatctagaaggaaatctgccatgcaggcacgcgctcaacgcatcatcagctcacttagcgagtcgtttgtcaccttccaggcttagcgcgagtttggcactaagaaaaaactcacttactcgcgctaagcgcgagaatggcgctaagcacgacgtcgaggtcagtgagccccttttaagcctggaatag

SEQ ID NO: 401 - DNA, 252 bp, Glycine max
  Peptide Sequence Number=SeqID_92086
atggaccctaagagaataaaggtcattcctgagtggcctactccaccatttgtagcaccactcattgagttggtgaggaactatgttctctcatgggaagatggtcaggaaaggggttttcaatctttaccctactctaacatacccaacatcaccgaaagcctaaagtttcaagaacctcgggatttgtggtcaaatccttttccagggggagagaatgacgcaatcctacccggcaagggcattggatag

SEQ ID NO: 402 - DNA, 315 bp, Glycine max
  Peptide Sequence Number=SeqID_92087
atgtcccatgctgtcaaggacaatcgagggaaatgggccccgaattacgaagggccttttgttgtgaagagggctttctccggaggagccctggggcaggatcatcttgagctaccttctggggtagagacaaaacatgaacagcagaaaccaatcaaggtacacaggaacggatgcaagtggggatggggtcacgaccgactgatcgtcgcccctttctccacgctaagcaagcggagaatgtcgctgcaaggcagccccgtatcctttgtattcgcagttttcttttactttttgttttttaaaaataagtaa

SEQ ID NO: 403 - DNA, 276 bp, Glycine max
  Peptide Sequence Number=SeqID_92088
atggcctcatcatcgatcaagtgcagcacaggtgtgcctgctggtgatccttgcggggtgctcagctcctacactggtgtagatactggtgatgcctacggactggcctccacaatcattggatctgcctctggatcagtttctggcctaggatcttctttatcaatgtattcctttgcttcttggaagataaatggcagcggaatggagaaggcagagagagaggagacgccacttcaaggagaagatgagtcaagaagaagctcaccaccatag

SEQ ID NO: 404 - DNA, 348 bp, Glycine max
  Peptide Sequence Number=SeqID_92089
atggtggtgacggttaaaaagctcgtagttggaccttgggttgggtcgatcggtccgccttccggtgtgcaccggtcggctcgtcccttctgccggcgatgcgctcctgtccttaactggccgggtcgtgcctccgaacgaaagttgggggctcgaagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 405 - DNA, 324 bp, Glycine max
  Peptide Sequence Number=SeqID_92090
atgtcaatcctttaccccttgggaagcaaaaaaagaaagagaaaggaaaatttccaatcaaaagagaaagcaaaaaaggaaaagaaaggaaatttccccaaatccaaaagagtggggagaaagcaaaaaagaaaagaaaagaaaattcccaatcaaagaatgggagaaagtaaaaaggaagaagaagaaggaaagaaagctcctgatcaaggatcgaaagaaaacagaagaaatgtgcagaaaggtctttggaccagacaatatctgaacaatacagaattgtctccaaatgaacaaaaagaaggaagggaaaccacgacctaa

SEQ ID NO: 406 - DNA, 405 bp, Glycine max
  Peptide Sequence Number=SeqID_92091
atggtgaaagttggaacctcttacgtgccgatcaacgtctcattttcgccaaaagttggcccagagcttcccggtatcaacagggacaccagggatttatttattctgcgaagtgatcttccgtcacaggtatttatttcggcgcaaagtgcgtcggctgtccctcctgttcagctactgacgggggtggtgcgtaacggcaaaaagccccccccggacatcagcgctggcaagtgtagcggtcccgctgcgcgtaaccaccacaccccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaa

SEQ ID NO: 407 - DNA, 672 bp, Glycine max
  Peptide Sequence Number=SeqID_92092
atgggatcaagtcaaatgccttcgcttaaaaagaggttctatcaggttaaggtcaagagcctagggaccaccagtctaaaagagttagggcagttaatgggtcagctccagcggcaagcttttcgcaaagcttacggtaaaatctgggacttagccatggtagaagtctctacagtaggccattgcctccctgcccagtattatgatcagccgatgaggtgcttcacctttggggacttccagctatcacctatggtagaagaatttgaagagatcctaggatgccctctagggggaaggaaaccatacctcttctcagggttctatccctcattagctagaatttccaagatagtccaaatctcggcgcaggaattagaccacaggaactctttatgtatggttagtttcacacctttttcgccaaaaaagaaaggaggggaaaattgggaccaactcttagcaagcaaagaaggagcatctgtcaactggttccctcgatggaaggaaggaagaaccggagttcttatttcatgcggaggatttcccaatgttcccttgatggggacgaggggttgcatcagttacaatcccgttcttgctataagacaacttggctaccctatgagaggggcaccactaaaggaagagctcgcacctattattgcatga

SEQ ID NO: 408 - DNA, 402 bp, Glycine max
  Peptide Sequence Number=SeqID_92093
atgtctaggaatactagacgatccacatggctcaggatgttgactagaagaaccttggatcagccgcgacctattgtcgccgttgatgctgcaactgggcgaggatcgggcccccataaagagaaattccacaactatttaggtgttgtagctagagaaaaagttccaattgtacataacagttggaaggatgtaccagtcacactaaaggagctagtatggaatgagattttggccaagtttgatatcccagaagccctacatgcaaagaaaaaggtgatgtcaactacggtcactagatggaggcagtttaaatcatccctgacaagtaaatttgtgtttagtatttatgaggaccaacataaagaagatccttccatcaaatatggctttgatgcatag

SEQ ID NO: 409 - DNA, 327 bp, Glycine max
  Peptide Sequence Number=SeqID_92094
atgtttgtccccgcggctgaagggaccagtgccacccccgagtttgatagccaccgtttcaggagcgctgagcaccaacaacgtttcgaggccatcaaaagatggtcgtttcatcgagagagacgcgtccagctcaaggacgatgagtacaccgactttcaggaagagatagctcgccggaaggccaggagtgcgagtttagttagagaaggaaccgggccgatggatttgacgaagaggccattgcccaactgttatgcctaccgggtcaggattttgcccggaccgctgccaggaggcgggtgcggatcatgcgcaccagcatga

SEQ ID NO: 410 - DNA, 392 bp, Glycine max
  Peptide Sequence Number=SeqID_92095
gaaatctccgccccgttcgtaagccatttccgctcgccgcagtggtaacgaccttgagcgtacagtcatgcacaggatcgaattcctgcagcccgggggatccactagttctagagcggccgccaccgcggtggagctccaattcgccctatagtgagtcgtattacaattcactggccgtcgttttacaacgtcgtgactgggaaaaccctctggcgttacccaacttaatcgccttgcagcacatccccctttcgccagctggcgtaatagcgaaggaggcccgcaccgatcgcccttccaacagttgcgtcagcctgaatggcgaatgggacgcgccctgtagcggcgcattatgcgttcggctgggtgtggtggttagcgcagcgtga

SEQ ID NO: 411 - DNA, 408 bp, Glycine max
  Peptide Sequence Number=SeqID_92096
atgtaccctcccttgttctctttgaacaacctagtggatgtatcctccactagaactgatccacaagagatgtaccctctcttgttctcagtcacaacaacccaagtagatgtaccctctacttgtaccacaaaggatgtaccctccaatgttttaagacaaagttctcaagcagttagtcctttgaaactttgtgaagggggaaacaaaagacatctcaggcgggagaaaggagacacaaaagaattcaggcggttagtccttcgttcttttggaaaagggagaagagagacacaaaaagaattcaggtggttagtccttggcgaattcattttggcaaagggagaagggaatgaaaagatgaatagcacaagttttattttcaaggtttggaaaccagaaacttaa

SEQ ID NO: 412 - DNA, 369 bp, Glycine max
  Peptide Sequence Number=SeqID_92097
atggccaagtttgatccagacatagtcctcgaattttatgccaatgcttggcctacggaggaaggcgtgcgagatatgaggtcttgggtaaggggtaagtggatcccgtttgatgcagatgctattggccagctcctgggatatcctttagtgctggaagagggccaggagtgcgagtatggccagaggaggaaccggtccgatgggttcgatgaggaggccatcgcccagttgctatgtataccgggggcaagattttgcccggactgctgccgggagacgggtgcggatcatgcgcaccaacatgaccaccctgactcagatatggatgactttgctgctcaacaacatcctgcccaccgatcataa

SEQ ID NO: 413 - DNA, 282 bp, Glycine max
  Peptide Sequence Number=SeqID_92098
atggatttatggtatatagcaaacattaaggatgcaagacacatcagatacactaagattcaatcctatatgcaatgtggtaccatgtcagtgaaaaacctcgtcaggcgcctaggaggagaccagtcagcgtcacagtgttttgcgagaatgctccaaccatatgggattggtacaggcttaaaggagcactcaaaccgggtgacccccaaggcctacactctgaagagtccattagagcctttccctcctgattcaggtccaaccctgaaaacattttag

SEQ ID NO: 414 - DNA, 141 bp, Glycine max
  Peptide Sequence Number=SeqID_92099
atggaggaaaacgtggaggaagctttggctgcgcacgagctccgatttcgtattggtaatcgattacagggcccaataagccttctgggtaatcgattacaggatgttgtaatcgattacaggctgcctgttcatgtgtaa

SEQ ID NO: 415 - DNA, 576 bp, Glycine max
  Peptide Sequence Number=SeqID_92100
atgggcgtggatgtaatggaagtcggttttccggtctcttcgccgggtgatttcgaatccgtgcagaccattgcccggaccatcaaaaacagccgcgtgtgtggtctggcgcgctgtgtagagaaagatatcgacgcggcttacgaatcgctgcgcgtggccgacgccttccgtattcacacctttatcgccacttcgccgatgcatatcgccactaaactgcgcagcacgctgccggaagtgatcgaacgcgcggtgcacatgattaagcgggcgcgcaactataccgatgacgttgagttctcctgcgaagacggtggccgtacgccgattgacgacctgtgccgcatggtagaagccgcaatcaacgccggcgccaccaccatcaatattccggacaccgtgggctacaccctgccgggcgagtacgccaacattattggtcagctggtgcagcgcgtacccaacatcgacaaagcgattctgtcggtgcacacccatgacgatctgggcatggcgaccggtaacgccattgcggcagtgctggccggtgcgcgtcagtcgaaagcacgctga

SEQ ID NO: 416 - DNA, 1158 bp, Glycine max
  Peptide Sequence Number=SeqID_92101
gctttcgtagctcacttcgcgggtaatcagctcgacgccctgctgcgccagcagcggtcgcagcgcattggcgatgccctcgtgttcgacgtggtggctgtaccagctgagcgtcagctgggtcacgccgtcgggcttgtgggctggggtgatatcgcgccgatggtgccagcgcggcagcaggccataagccgggaaccagtagcgctgatagccgacgccggcatgattgagcagcgcgatagggttaagcagatcgctcacccagcggcggaaaccggcatcgcgtccgcgttcagagcgctgatcgaacagcagaaaatagcagccctcttcgaggcgactctcttccgatttttcgtcgtcgttttcgccttccagttttacaccggcgtagaccagctcatcgctgatctccggcagcacccagatcgagacatcatcaatcagcgcgcggtagccgaagtagtcatcaaacgcggcgattttcagctgggtttgctgattgcgcaccacgctgtacggaccggtgccaatgggctgacgggcgaagtggcgcagtgtcggccattcacgcggcagaatcatggcgctgacgctggccagcagccacggcagccagcagtccggctggctgagatggatatccagcgtccacggtgccggcgagtgcaactggtcgatgtgcgaaaacagcggctggctgcgcacccggtccagcgaggcgatgacatcctccatctccagctcgcggccatgatgaaagcggattgccggccgcaggaagaagcgccagtgcagcggagaggtttgctgccagtgatgggcgatgtcggcggcgatttcccccttttcctcatttatacgcgtcaggccgctgaatatctgtcgcgccagatggctgcaccagctggtcgatgcgatcctgctccagcaggtcttcggcgcgctgctgctgtagcgccagtccggtgtagcagaagctcagcagcgagcgtttaccgcgaccagcttcagcctgccagatcagccagcccgccgcctgcatggcgttcagcagattacgcatgtggcggcgtgagcagtgcagcagttcggccagctcgctcagcgtggtttcctgatcctggccctgacagtgttgccacaggcgaatga

SEQ ID NO: 417 - DNA, 111 bp, Glycine max
  Peptide Sequence Number=SeqID_92102
atgaggaataccttgcacctaggtagcatggaaaatacctttcaacggaatggccccgaggaagcttgcctcaaagaggtccaggaaggacaaggcggccgaaggaactag

SEQ ID NO: 418 - DNA, 405 bp, Glycine max
  Peptide Sequence Number=SeqID_92103
atggaggagcaccagaaggctgggaagctgcagggaaaggaagaggtgcggtaccgcggcgtgcggcggcggccgtggggaaagtacgcggcggagataagggatccatcgaagcaagggtcaaggctgtggttggggacatttgacactgctgaagaagctgctagagcttatgaccgtgcagcttttaacctaaggggccatcttgcgattctcaattttcctagtgagtactattctcagataaggggttcaccaccatatccacctcatttagcaacaccatcttcctcttctggtgcacaacagaggcctgtttttgagattccgtgtttggatgataaggtgttggaggatcttcttggtcagtcagaggaacacaagaagaaaaacaagggagattaa

SEQ ID NO: 419 - DNA, 825 bp, Glycine max
  Peptide Sequence Number=SeqID_92104
ggatcccatgcaagcttggagcacatagatgacaagatcccccaattggattcaccactttgtctcctgaagcagatttcttttgagatgtcatgcaagtctccaagagatgaaattggtcacaaaacaacactagccatacttaacaagctctcaaactacgagtggaatgcaaaggcagtgctgacaatggcggcttttgcactcgaatatagcgatcccaacaatcctcttgcaaaatctgtggctatactgaagcgagtgccagtgctcacaaggcaagcagcacttcaaaagcatcgccaaaccatcgttgaggaatggaccgttgagtacgacaacaaatttgaggattttaaatgcaagatgccttggtttgcggtgcagcattctagaaccatagcaagcctatatatggttgtggtgttgagccctcaaggaaaggtgcaacactcaaatgcattccatttgatccaggctcatggaaaaagagctttccccttcacatttgtcaaacaagaacaaataaacaatgagatctattgggttggctccgaaataggcaacatttaccccatcataaacacttggttcaccaagaatgttagcatccttgcaagtgatgccgctataacggaggcaaatatttccatagagtggctttgtgtggaaaaggaagacaaaagcgtgatgaggcgcttttggggtggcattgagagtttgtttgtgactaaggttcacaaggcagttgatgcagtgactcaagaagtgcaaaagatgctttctttcaagaatgaatctggatgggacggatctccttattag

SEQ ID NO: 420 - DNA, 228 bp, Glycine max
  Peptide Sequence Number=SeqID_92105
atgcagagatctcttgaaggcacttcagagccccctgctccagtggtagacctctcctcaccacagcctgcagctgacccctctactcttgtagttgatacgccagaggaccagaccacaccagtcctgactctgaacacttctcctccagctactccagtacttcatctgacagatgaggaggatgttcagactcaggatactcaggatctatctcaagacttttaa

SEQ ID NO: 421 - DNA, 284 bp, Glycine max
  Peptide Sequence Number=SeqID_92106
ggaaataaaaatcctgatcctgtcaatgatcctgtgcaaagtccatggcatgctcattcagacccagtgcaggagtgcctgatggtgaatcctaaggaagaggctcaagtggagtgggctctgaggcctttagaatgtcgtcctcctgggttgcagaggcctcaccccctcctgaaggaaaaggctggactcctggcggagggacctgaaagaattggagctgctggtggtgaaggaagaccagaagtagatggagctgatgcaggggagcagggccagctgat

SEQ ID NO: 422 - DNA, 218 bp, Glycine max
  Peptide Sequence Number=SeqID_92107
gaaaatggaggattctttatttacgtggtggagtttctgaagaaaccctcgatagcagagacattcgtcaacattttgctatgcgcggttccgatttggctggccgtgataatcaagtggtcatggcggctgcactgaatgaggctcatcttcctcggcctccgaagcagagacaagaccaaggccaaagctcaagatccctcgccttcgcaatttga

SEQ ID NO: 423 - DNA, 327 bp, Glycine max
  Peptide Sequence Number=SeqID_92108
atggtgaggacgtgtagtcctctgaaggtcaggacgtgtagtcctctgaaggtgagggcgtgtagccctctaaaggtgaggatgtgtagacctatgaaggagaaggcgtgtagccctctgaaggtgacgacgtcaagtcctctaaaggcgaggacgtgtagacctctgatggcgaggacgtgtagtcctcttaaggcgtggacgtgtagtcctctgatggcgagggcgtgtagtcctctgaaggtgaagtcgtatagccctctgatggcgaggacgtgcagccctctgaaggcgaggatgtgtagtcctctgaatgtgaggaagtga

SEQ ID NO: 424 - DNA, 138 bp, Glycine max
  Peptide Sequence Number=SeqID_92109
atggtgcagatgatgtcgttagtcactgcatgctatcaggctttgagtcttacgtcggaagaggctaacttctccggggaatgtggagatgaagacgttagtcactgcttgccattgggctttgagtcttacggatag

SEQ ID NO: 425 - DNA, 156 bp, Glycine max
  Peptide Sequence Number=SeqID_92110
atgaaccctaaaagaataaaggtcattcttgagtggcccactccaccaagtgttgagggaaggagcccaaagtatgaagaacctcaagatttgaggttaaatcctttccaaggtggagggaatgatgcaatcctaccccgcaagggcattggatag

SEQ ID NO: 426 - DNA, 1150 bp, Glycine max
  Peptide Sequence Number=SeqID_92111
atgcggtcgcgcagttcgtcgaccaccagatcgacagacggtcttgcgcaccagacgaccggtggatccagcggcgacgcggggttgggatggcgctggcgggagaggaattctgggacacgtcacatccggtggaagattccgcccggcggacgccggacggcagcggatccgttccacctgccccacgcccaggaaaaccccgagagacagccgcaaaaatcgacgcccttgccggggcgacggttcgaggccgcgcgcctcgtttttctggcacttttattttggatccaatatccaatcaatagcccgacagtacaagccgggcggatcacgcaacaggagcggcagcatgagcattcaatggcaaggcgtatttcccgcggtcaccaccaaactgaagcccgatttctcgctggacgcggacgccatccgccagggcctggagcgcctgatcgccaatggcgtgggcggcgtggtgatgatgggcatggtgggcgaaaacgcccagctcgcgcccgaggaaaagctggaggtgctgcgcatcgcggtcgagaccgtgcgcggccgcgtgccggtggtgtcgggcgtggccgagaccggcaccgcgcgcgcggcggcattcgcgcgccaggcggcgcagatcggcgtcgatgggctgatggtgtttcccggcctgacgtacaagtcggacgagcgcgaaacggtggcgttctaccgcggcgtggcgcaggccagtcccctgcccatcctgctgtacaacaacccgcgcggctacggcgtcgacctgacgccggacctggtggcgcagttgctggaggaaccgaccatcgtcgccatcaaggaggaatcctacgacaccacccgcgtgaccgacctgatcacgcgcttcggcgaccgcctagcggtggtctgcggcgtcgacgacctggtgctggaaagcgccgcgctgggcgtgaccgcctgggtctcgggcatggccaacgccgtgccgaaagcgtcggtggacctgctgcggctggcggtcgaaggcgacttcaagcgcgcccgcacgctgtacgcggcgctcacgccgctgttccacctggacaccgtggtcaagctggtgcagcacatcaagctggccgagcaccttatcaccggcagcgcc

SEQ ID NO: 427 - DNA, 147 bp, Glycine max
  Peptide Sequence Number=SeqID_92112
atgcatgaaaacctcacttttttcattaaaggtgttgatgcaatcctccctaggaagggaccaatcactagaaccatgagcaagaggctccaagaagattgggctagagctgctgaagaaggccctagggttctcatgaaccttagg

SEQ ID NO: 428 - DNA, 628 bp, Glycine max
  Peptide Sequence Number=SeqID_92113
aacctgccccaagacacagcagacacttgtgcatacagcccttacccctaactatgttttgaagagtttgattgctttatggtgtgaaagcaacgatattgagctaccaaagaggcaacgaaactgtagaacaaagaaatatggtggcagctgtctttcaaaggatgctgctactgctctaataaagttactttgtgaaggtactcctacaggtaagaaggatgctgctactgctatcttcaacctatctatttatcagggaaataaagcaggagctgtaaaagctggtatagtagccccacagatacaatttttgaaggatgttgggggtggaatggtagatgaagcactagctattatggcaatccttgcaagccaccatgaaggcagggtagcgatcggtcaggccaagccaattcatattcttgttgaggttataagaaccggctctccacgcaatcgagagaatgttgctgctgctgtcttgtggtcattatgcaccgaagatccactgcaattaaaactagcgaaagaacatggtgcagaagaagcacagcaggagttgtcagaaaatggaactgatagagctaagataaaagctggaagcatattggaactcttgcagtga

SEQ ID NO: 429 - DNA, 204 bp, Glycine max
  Peptide Sequence Number=SeqID_92114
atggaaggaaaatgtgcggagttgccaccaacgtttattcgaggaaaacgtcgaaaaaaccgaaaaaggtgtggtctacgaactttgagtgtgaaaggttcaggagttgtatttacgcacggggaagccgataaaagcaaagaggactgcttaaggcgttggaccttaaaacggtgtttagtgatttttgcggacaaagcttga

SEQ ID NO: 430 - DNA, 643 bp, Glycine max
  Peptide Sequence Number=SeqID_92115
atgacgtcaagcggctcaccgccagaggccggggagtttgagggcccccggaatcttgtggagcgtgtagccttcgctgggattctcaaagaatgcttcaatgctgcgcatcagtgcacgcgcgcggtcgcgctccagcgccgttgcgggtgtcgactgttcggcggcagtgcgaagtgcctggatgatgtcgaagtccaagcagtaggggaccttctccatgaaaggactgttgcccagcagcagcctggatgcctcggcccggatggcttccacggccatgtatctgcgccgcattacatggtcgacccaaagaacatgcgcgacgccgcccatgtcgcccaggtctggtgcgtgacgcaggccgtacgcgatgcggaacagtttctgcagaaggtcgctgcggtaagcccggagcaggccagtacgcgggtccatgagggcgtctacggcatcgcgacagcccgcggccaggccggtgcggggcagcagctgtggaacgttcgcttccagggagaccaggatggaaggaacgccgccgatccagtggctgacccgccaattgtgctcggcaaggaggaaggtccgtccagccagaaccttggcatacagcccagggaagcgcgtgccgagcaggttcagg

SEQ ID NO: 431 - DNA, 228 bp, Glycine max
  Peptide Sequence Number=SeqID_92116
atgtcccatgctgtcaaggacaatcgagggaaatgggccccgaactacgaagggcctttttttgtgaagagggctttctccggaggagccctggggcaggatcatcttgagctaccttctggggtgaggaccaaatgtggacagcagaaaccaatcaaggtacttaggaatggatgcaagtggggatggggtcacgaccgactgatcgttgccctttctctgtgctag

SEQ ID NO: 432 - DNA, 180 bp, Glycine max
  Peptide Sequence Number=SeqID_92117
atgaaagtagattgcatggtttttagtcttctgaaaaagaggggaaagagagcaaggacattggaggaagttgttaatatagatttcatggcaaaaaccgatcatataataaatataacaccaggtctggaccgagacacaaggagtgatatcggtaccagcctggcagcagttacataa

SEQ ID NO: 433 - DNA, 588 bp, Glycine max
  Peptide Sequence Number=SeqID_92118
atggaatcgagagctccaagtgggccatttttggtaagcagaaactggcgatgcgggatgaaccggaagctgggttacggtgcccaactgcgcgctaacctagaccccacaaagggtgttggtcgattaagacagcagggacggtggtcatggaagtcgaaatccgctaaggacctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 434 - DNA, 132 bp, Glycine max
  Peptide Sequence Number=SeqID_92119
atggtatggagaagacaaaacgcggctaaagtggtgacggcagaacgttcgaatgcgaggaagaggaggtgcgaggagttacctgctaagggagcaaacgcgacaaagaggcgaagaggtgcgatgaagtga

SEQ ID NO: 435 - DNA, 210 bp, Glycine max
  Peptide Sequence Number=SeqID_92120
atgaagcttgcttctacacttatggttatccgcaccttttgtcaaccagaggcaagcgagcctgttgacacgcagagactaacttcgtcatctgcaccttttgtcaaccaggggcaagcgagcctgttttacgttcgtcatctagagacattcaagcccgacgacgcacaagattcttctctgctaggcaagaacgatcaagttcgatag

SEQ ID NO: 436 - DNA, 949 bp, Glycine max
  Peptide Sequence Number=SeqID_92121
tccaaatctcggcgcaggaattagaccacagaaagcaagtaaaaaatggggtggttggaataccgagaaaatgtttggaggcaaaagcaagaatcttggcagaggagtcctctttccgaatgtggatgggttggtggatctggcagggatcgatgcttttctcgcctatcatgaccacaaggaaagcccggttgtcgctatgctagccgacctatatgacacgttcggccgaagatgtgaaaagagcaatacaaggactgtttgctgtactccagctctttatgtatggttagtttcacacttttttcgccaagaggagcatttgtcaactggttccctcgatggaaggaaggaagaatcggagttcttatttcatgcggaggatttccaaatgatggggacaaggggttgcatcagctacaatctcgttcttgctataagacaacttggctaccctatgagaggggcgccactagaggatgagctcacgcctgtccgcaaggcatgggcgatgttgcaaaagaaggacaaggaactcaggggcagtaacaatgggcctatcggtggctaccgtaagtggttaaaagcccacgtgcaaggtttggtttggcttccaagtttgagaaccgctaaaagagaggaagttgaggcactggaggaagacgaagaggcgcaggcccttagggcagaactcaagcaagcccaaccaatcaaagaaaggttcaaatcagcagctcttaaaatccgaaaagagaatgccgaactgagagatataaatatagctaccaccaaggccttggaacaagagaccaaaagggcttgtagggaagaacacggccagaacaagttccgaggggctctgtggggtagcaacagtgagcttaagctccggagagaggaaaaggaccaatcacgagtagacagtttgatcttgaaggatgagttgaag

SEQ ID NO: 437 - DNA, 267 bp, Glycine max
  Peptide Sequence Number=SeqID_92122
tgttgctcgcgctaagcgctacccccgtgggctaagcactattcgttgcgacatgcataaggctaagccaacgctgttcgctaagccattatggcatccaggaagagaaagagcactacttctagacctgcagctcagtatgataccaggcgattccaatctttggaagcttggaatagatacacgggcaacattctcagccgaaatatccttccggagagaaatgttaagatttcatcatactgagttcgacaagttcaaagtgga

SEQ ID NO: 438 - DNA, 282 bp, Glycine max
  Peptide Sequence Number=SeqID_92123
gtcagattagggttcattctctaccgaaaccgaaagccaagttggaagattccgcttcaattgaagggttcctctcggtgtggggtttcaatggagaacaacgatggtttgtggtggctaatggtggctgtgggtgatggagaaagtgcttgggataccaaatttcaagaacatccaacgtttaacgaaggctgggaagcgtttttaccgaggcagcttcatgtagcttactcaagaagcttcattaagagacttcctcaagaggcttctttgagaagctag

SEQ ID NO: 439 - DNA, 673 bp, Glycine max
  Peptide Sequence Number=SeqID_92124
ggctacacaccctcgccttagaggactacatctcctcgccttcagagggctacacgtcctcgccttcaaagggctacatgccctcgccttcagagggctgcacgccctcgccttcaaagggctgcacgccctcgccttcaaagggctacacgtcctcacctttagaggactacacgtcctcaccttcataggactatatgtcctcacctttagaggactacacatcctcaccttcagaggactacacgtcctcgccatcagagggctgcacgccctcgccatcagaggactacacgtcctcgccattagagggctgcacgccctcaccttcagaggactacacgtcctcgccttcagaggactacacatcctcgccttcagaggactacatgtcctcgccttcagaggactacacgtcctcaccttcagaagactacacgtcctcgcctttagagggctacacgccctcgcttttagaggactacacgtcctcgccttcagaggactacacgtcctcgccttcagaggactacatgccctcacctttagaaggctacaaatcctcaccttgaaaggacttcgcatcctcgccttcaaatggctacatgtcctcgcctttagagaactgcacgtccttgccttcagaggactatatgtcctcgccttcagtgga

SEQ ID NO: 440 - DNA, 372 bp, Glycine max
  Peptide Sequence Number=SeqID_92125
atggtttggaagataggttgtggtgacaaaattgatttctggcatgacagatgggtaggcgaatgcactcttaaacagcaatacaaccaacttttcatgataagcagtcagcaacacagcctcatttcaatgatgggtaatttctcccaagacaattggagatgggatttgcagtggaggagaaatctttttgatcatgaacatgacttggctgtgagctttatggaagacattacatctatatgtattcagagaaatgtgaaggacattatgatgtggaaagctgaacctaacggtgtgtactccaccaagtcagcttatagcctaatgctgaagctaaatgattccggttcacaagacaaggttttctaa

SEQ ID NO: 441 - DNA, 264 bp, Glycine max
  Peptide Sequence Number=SeqID_92126
atgataacaaaagatgatgacaaaggtgatgacaaaaagctcaaaggtcaatcaaagaatgagttcaagatattcaagatagaatcaagaacacttcaagattcaagaggaaagttgatttcaagaatcaagattcaagagatcaagatttcaagaatcaagattcaagagatcaagagatcaagactcaagattcaagaatcaagaatcaagagaaggcttaatcaagataagtatgaaaaggttttctcaaaaattgagtag

SEQ ID NO: 442 - DNA, 389 bp, Glycine max
  Peptide Sequence Number=SeqID_92127
ggatcgttccagcaagacacccagtggacccagagaagtccaacagggccctggggtttccagctctggttatgggcctctgtcagtcctatagggtgcccgtcccccccagcaagggatcgcgcccgcaagacacccagtggacccggacaagtccaacagggtcttggggtttccagctctgattacgggcctttatcagttctacggagtgcctgtcgcccccagcaaggcacagggcaaggcaccacagcagcctgcggatggccggcagcgggcaatagacgcaccgccgccacctctagagcccctcagctcatccacaaaaaggttagagcattgcctacgacacatggccgaccaataggcgaccaagtccaaagccaaag

SEQ ID NO: 443 - DNA, 468 bp, Glycine max
  Peptide Sequence Number=SeqID_92128
atgaccactcttacacaaatatggatgacgttgctacttagcaacatcatgcgcaccaccacaactccgatctccccttgccgaagtgttagttgggatcgcgcccacaagacaccctatggacccggagaagtccaacagggccctggggtttccagctctggttacgggcctctgtcagtcctaccgggtgcctatcccccccaacaaggtatcgcgcccgcaagacatccagtggacccggagaagtccaacagggtccgggggtttccagctctaattacgggcctttgtcagttctacggagtgcccatcacccctaacaaggtcatcaggccccctattaatcgagctgtcatcaagaactactgcgcccccaaggcaggtgcagggcgagacaccacaacagcctggggatggccgggagcaagcaatagacacatcgctgccacctctagagccccttag

SEQ ID NO: 444 - DNA, 512 bp, Glycine max
  Peptide Sequence Number=SeqID_92129
gaaactttggcaaagtggctgtttttcactctttcgctaagccaagctgctggcttagcgagaattcgctaagcgtaaccttcagtgggctaagcgcgaggaagaatccaaaagaagatgagctgtcaagtttgctaagcgcaccgctccaagtcaacaagcacatcgcttcagctcatccgctaagcgaaataagcgcgctaagcgatccagatctgcggcacgagcatgaacaaggccacctatttaagcctgaaatcagatttgcaaaaggagtttggacatttcttgagaagctctgcatgcacgaaggttctagagagagaaagagatgcgagttcgaagcgaaagccgttctgagacttgagatgagtttgaggttttcggactatggaaagctaaatcctttgttggatcttccctatagtgggaactggtctgattctaaagtccttggtagtacgggacaaagttattgtgctatcataagggatcggggtacaagaacttag

SEQ ID NO: 445 - DNA, 324 bp, Glycine max
  Peptide Sequence Number=SeqID_92130
atgagggacaccatgcatgagcctcaagccaacctaggggcagatcaaaaagggctacacgccctcgccatcagaggactgcatgtcctcaccttcagagggttacacgccctcgccatcagaggactgcatgtcctcaccttcgtagggctacacgccctcacctttagaggactacacgtcctcgccaacagagggctgcacgccctcaccttgagaggactacacgtcctcgccaacgtagggctacacgtcctcaccatcagagggctgcacgccctcacctccagaggactacacgtcctcgccttgagagggctataa

SEQ ID NO: 446 - DNA, 288 bp, Glycine max
  Peptide Sequence Number=SeqID_92131
atgaagctactacttcaccttcctctagtgaaagtgaagaagcaaaaggggaagaatctagtgaagaaatctacccccaaagaagaaggacaacctttaatggttaaggaggagtgtaaagagacaaacattaaagaaacttcccctcttagacaacctccacatcttctcctttttaaaaagacacttgttagtactgccacaccacttgggcttgaggttattcgtcaagtaaaggagctgttggatgagggtttggtattattaggcaccaaatccctaaaatag

SEQ ID NO: 447 - DNA, 228 bp, Glycine max
  Peptide Sequence Number=SeqID_92132
attgattcaagatgttttgatgataacaaagatgataacaaaaagtccaagagaatgacttcaagattgagtcaagaacaattcaagaatcaagaatcaagtttcaagtttcaagtttcaagtttcaagtttcaagaatcaagaatcaagaatcaagaatcaagaatcaagagtaatcaagatcaagattcaagaatcaagaaaagactcaatcaagataagtactaa

SEQ ID NO: 448 - DNA, 198 bp, Glycine max
  Peptide Sequence Number=SeqID_92133
atgacattaggtgctgaattcaatgtggaaagcttaacatgtagagattggaacacatcatcgaaagtataccaaaaggtatgtgttcggttctgtgcaagaaagaaaaggactacctatataagcatgaagtttagccgcttcaagaagctgggacttggctttgatatgcttatgaaggatagggacacaggctag

SEQ ID NO: 449 - DNA, 93 bp, Glycine max
  Peptide Sequence Number=SeqID_92134
atgtcggctggaaaatatgcagtcgcggcttcacacgaccgatgtcggctagaaatgttcgatcggcgccaccaggtgatgcttcttttttaa

SEQ ID NO: 450 - DNA, 749 bp, Glycine max
  Peptide Sequence Number=SeqID_92135
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggctctctctctgcctgcggcacaacctccagcgacagcagctcacggtgaggcgcattctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 451 - DNA, 156 bp, Glycine max
  Peptide Sequence Number=SeqID_92136
atggttatcctaactcaaatatgggacatcgaaagtggagatgttggatatgttggtgtggctcaatgtttattttttggtgaacaagttcaagcaattatatttgaccattgtaataaatacaaacataagctgttgggtgacagattgcggtaa

SEQ ID NO: 452 - DNA, 657 bp, Glycine max
  Peptide Sequence Number=SeqID_92137
atggcttggcaccgtggccggacgccggctgttccacccgccgctggtgacgccgggctggtcatcaccttactgctgtccatcgccgctatcgccggcagcaccctgctcggtttactggccgcggtgcttcgcaccagccgtctgccgatcgccagagagattgccgtgctgtacaccgagctgtttcgcggcacgccggtgctgatcaccctgatgttcatttacttcggtgtggcctattttggttatgaaatcaatctgttcgccgccggcattctgggcctgagcatttatcagggcgcttacatcgcggaagtgttccgtgccggcattgaagccgtgccgaaagggcagtgggaagtgtcgtggatcctcggattatcaaaacgccagacgtttctcagcgtagtgctgccacaaacgcgcggcatcgtactgccgccgctggtgggccagtatctttcgctaatcaaagatacgtcgattgtcagcatgatcggcatgtcggagctgatgcaccaggggcaggcgattgttgatcgcattggccagccggtggtggtttacggcctggtcgccctgctctacttcgctgtctgctttccgctttcccgttgggttcaacatcatcaaaccaggagccagttatcatga

SEQ ID NO: 453 - DNA, 309 bp, Glycine max
  Peptide Sequence Number=SeqID_92138
ctgtcccctcctgttcagctactgacggggtggtgcgtaacggcaaaagcacgccggacatcagcgctggcaagtgtagcggtcccgcctgcgcgtaaccaccacaccccgccgcgcttaatgcgccgctacagggcgcgtcccattcgccattcaggctgcgcaactgttgggaagggcgatcggtgcgggcctcttccgctattacgccagctggcgaaagggggatgtgctgcaaggcgattaagttgggtaacgccagggttttcccagtcacgacgttgtaaaacgacggccagtgaattgtaa

SEQ ID NO: 454 - DNA, 539 bp, Glycine max
  Peptide Sequence Number=SeqID_92139
atggcggcgcagctaatccgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcacggtggagtggatactacccacacctacaccatatcgtctagtggagcccgttcaagtgatcgaggtaacgtcatccgaggaagaccctgaggaggacctggaggagctacctcctgagcctgctgtggatgcccttgactttctagagggtgatgaggatccacttctcgaggtggattctcccgaggaagtcatgtcggcatctgaggcagactctacggaggatagtggcccgagggagatggcgatcagcggaggctcttcgtcctaccaccgctacggacagcttgctctggatgacactgacgtggtagggatcaggaccggtgatgtccttgaccgcatcaccgctgttgctggaaactctagtgcaggaac

SEQ ID NO: 455 - DNA, 291 bp, Glycine max
  Peptide Sequence Number=SeqID_92140
atggaaaaatctgaaaagaaaaatcatagtgagaagaaactaaagaaagcatacatcacatgggatgaaaatgatttggaatcctctgatgattctgaaaatgaagagataaatctttgccttatggcaaaagttacgaaagtgatgaagagaagaggacatggcatatcaacttgttacttcaagaaaaattacagtaatattaaaatgatatgggtcccaaaaggatcctcagtttatactaacatgcaaggacccaataaaatttgggtacctaagtcaaaaacttga

SEQ ID NO: 456 - DNA, 345 bp, Glycine max
  Peptide Sequence Number=SeqID_92141
atgacgaagaacggtttaaaatcttcgcgatatcacccacggaaacgtctcggaagcgttacggaagaaaatgagggaggagcttgccacccagctcgcccaggggagctaggttgcttcctccagaaggcaccgccttctggggaacttcctggaaggcccaaaacttcacggattgtgcaacaatgcttccttttgacttccggcatgtcacagaactttgtggattgcctaacgatgggtgtcaagtaccttgaagtggtcaaacgagggttgcatcccaacaataggatggtaggaaagtttgaggttcaagagattgcaaatacccgacttgggcaatga

SEQ ID NO: 457 - DNA, 228 bp, Glycine max
  Peptide Sequence Number=SeqID_92142
atgacgaaaggtgccaattatgatgttacaaactttcattgtagcgaggacacttcttgctacaacgaggcttcatcttttgcaaatgatacttcacttgaatcttcttgctctatgaccaactttcgctatggtaagagttgtactcgttgtggcgtgtgcttgctcaatatcttagtcttcaacattcatattcgttgtggcaagtcttcacattcattcacttaa

SEQ ID NO: 458 - DNA, 496 bp, Glycine max
  Peptide Sequence Number=SeqID_92143
gccgtaatatccagctgaaccggtctggttataggtacattgagcaactgactgaaatgcctcaaaatgttcttacgatgccattgggatatatcaacggtgttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgccattggctctgggaaa

SEQ ID NO: 459 - DNA, 140 bp, Glycine max
  Peptide Sequence Number=SeqID_92144
gattttcaactttcaccggaatcgggtgcaagccattggtctatttgctcaagcgacctgtgaccattcaatcagagattactcgtcttgtacgctggtggggctgccgtaaaacaacaagtaaagttcaaaacaaataa

SEQ ID NO: 460 - DNA, 204 bp, Glycine max
  Peptide Sequence Number=SeqID_92145
atgtgggttctgtggggtttgagcgaggacaattttccgatagatttcaggcgggaggagaaagagaagagcgatttcaggaaggaggatgacaaagagaagagggagggcaaggttttcgagcacgcgtggcttttgaaatctcaatttttaacttataaacataacaacatcggttttttatggataaccaatgttaactga

SEQ ID NO: 461 - DNA, 198 bp, Glycine max
  Peptide Sequence Number=SeqID_92146
atgtcagtgaaaaacctcgtcgggcgcctaggaggagaccagtcagggtcacagtgttttgcgagaatgctccaaccatatgggatcaacataggcttaaaggagcactcaaaccgtgtgacccccaaggcctacactccgaagagtccgtcagggcctctccctcctgattcaggtccaacccagaaaatattttag

SEQ ID NO: 462 - DNA, 345 bp, Glycine max
  Peptide Sequence Number=SeqID_92147
atggcattcttgggagagacaagcagtcagacagttgtgaactccacattaggttttttttttcaaatggatccattgttcacaacgatagtggtgtttcctttcaagcttccactccagttcccattcgagtacctaacgggtaatcaatttcggtttcaatgtatgcaaatgaaagatgatgctgatgttaacacaatgttaatgtgtaatcatgaattttcgtttgttggtccgattgagttattatgtagcattgctagaaccccagatgatattttaaacttacttcaagctattatgacccctactcatgatgccctgctatattacaatgggaggtga

SEQ ID NO: 463 - DNA, 399 bp, Glycine max
  Peptide Sequence Number=SeqID_92148
atgaggatccttagcctgatgacactgtcaactctgatggtgaagagagaattaaacaaatgttttcaacatcttgaaagagagcatgaggatcttaagaaaccttatcaagctcatttagttgattttgtcctaaaaaccacttctcctggtgatgtacaagacacctttgtttgtgaggatgtcaaggcattactggacgaaaagcttagaggatatgaggtcttgaaggaactacttcctaagattgaaaaactctatgaggagatagaaaccttgagggataacctaggcaagttttttggtagtcatgaagcccttaacaaaattattaaggtgcaaaaaaacccaaagacaaatctggccatggtttcaaaggcaaaaggttgtgcatggtga

SEQ ID NO: 464 - DNA, 284 bp, Glycine max
  Peptide Sequence Number=SeqID_92149
ggagaggtaggggaggtcatcattgtcatggctggaggaggaagaggaaagagagaggcaggatgagaagatggaaaagggattcaacgtcggaggaatttgaagttagttgtggcgcatttttcgaggagagtgaaggcgatactgctgagaaggtctttccaatcgaaggagcagtggggagctttgggtcagaaaaggtaaaggtcggtggtggtggtgttaacctgatggaagcttgcttgtggggcttctatggaggctggatctttgagcttcaatag

SEQ ID NO: 465 - DNA, 423 bp, Glycine max
  Peptide Sequence Number=SeqID_92150
atgtgtgtgggatgggggtgcctttgtgtgggtgtgggtgtgcagctgcacgattgtgtgggtgggctagtggtcccttctgcaatccttgcgatactaatccacccctttacaactcattggcgtttagttcgaattgtttgggcattcagtttgtatttggaagctgtttctgttctgcctcaacttcgttttatgcagaatgcaaagatggttgaaacatttacagggtattatgtattcgctctcggtgtttcaagattcatagcactggcttactggttaattcagatctatgagactcgaggggcatatctatttttggttgggagtggctatttttggttcttagcagcttttctctcggagatggttcaatccttcatcttggctgacttttgttactactacatgaagaggtag

SEQ ID NO: 466 - DNA, 162 bp, Glycine max
  Peptide Sequence Number=SeqID_92151
atggcggtcatgatggtgattgtggtgggaggaatgacgacaattgttaggatggtggtggcagtggcagtggcggtgacgggcatgatggtgatcaagatgatgatgatagagattttaagctataacttaatattgcctcaagatacaataatgatgtaa

SEQ ID NO: 467 - DNA, 663 bp, Glycine max
  Peptide Sequence Number=SeqID_92152
atgcgctcgtgggtgagaggtcagtggattccctttgacacagatgccctcagccagttcttgggcgacccgctagttttggaggaaggccagcaatgtgagttcagccagaggaagaacaaggccaatggtttcgatgaggaagccatcgcccagctgttgtgcatactggggcaggatttcacccggaccactgtagggaagcgggtgcggatcatgcgcaccagcatgaccactttgacccagacatggatgacgttgttgctcagcaatgtcttgcctagctatcataattccgacctccctctacctaagtgccagttggtgtatgccatcctaacatggatgagcgtccatgtggcccaggtgattgctgatgccatttatttgtttgcaagtatggcgccaagtaggcaccctctggaccctgataagtccaacagggccctggggtttccggtgctgatcacgggcctctgccagtcctacgaagttcccatcacccccagtatggtaatccgaccgccgatcacccaagccttcatcgagaagtactgcacgccgaggcaggcgcagggtgatgcacatcaggccgcaggcgcaccgccaccacctcagcaggatgatccatctaggccactgggcatggagcattatctatag

SEQ ID NO: 468 - DNA, 309 bp, Glycine max
  Peptide Sequence Number=SeqID_92153
atggggaggataaccttggaaagtttgactccaaatgtgattttggaatcttacttggatactccacatgtaattaagtttactgccacgtctagtcagaaccaacctgtgtccaatccatatgtggactatcaactggaaaaggttagagaactaattgggtgcttgctaaggaaaaatcacctacagtctcatatcattggtgatcttaaggataaggtccaagcaaggaactttctcaagcacacaacgttgctttctgagatcgagccacaacacatagatgatgttatgactaatgaatactag

SEQ ID NO: 469 - DNA, 1197 bp, Glycine max
  Peptide Sequence Number=SeqID_92154
atggcggtgtcaggcgcctatgagttgaaaatcggcaagaaagaggcgcgagtgatcggtttcgatcaggccggggtgttctacgggctgcagtcgatcctgtcgttagtgccgagcgacggcagcggcaagatcgccacgctggacgccagcgatgcgccgcgcttcgagtatcgcggcattttcctcgacgtggcgcgcaacttccataagaaggacgcggtgctgcgcctgctggatcagatggcggcctacaagctcaacaaattccacttccacctgagcgatgacgaaggctggcgcatcgagatccccggtttgcctgagctgacggaagtcggcggccagcgctgccacgatctgagcgaaaccacctgcctgctgccgcagtacggccaggggccggacgtctacggcggcttcttcagccgtcaggactatatcgacatcatcaaatacgcccaggcgcgccagattgaagtgatcccggagatcgacatgccggcgcacgcccgcgccgcggtggtctcgatggaagcgcgctataaaaagctgcatgccgccgggaaagaacaggaggccaacgaattccgcctggtggatccgaccgatacctccaacaccacctccgtgcagttctttaaccgccagagctacctgaacccgtgcctggactcttcccagcgctttgtcgacaaggtgatcggcgaaattgcccagatgcataaagaagccggccagccgatcaagacctggcacttcggcggcgacgaagcgaaaaacattcgcctgggcgccggctataccgacaaggcgaaaccggagccgggcaaaggcatcatcgatcagagcaacgaagacaagccgtgggccaagtcgcaggtgtgccagacgatgatcaaagaaggcaaggtggccgacatggagcacctgccgagctacttcggccaagaggtcagcaagctggtgaaggcgcacggcatcgacagaatgcaggcctggcaggacggcctgaaagacgccgagagcgcgaaggcgttcgccacctcgcgcgtgggcgtcaacttctgggataccctgtactggggcggtttcgatagcgtcaacgactgggccaacaaagggtatgaagtggtggtttccaacccggactacgtctatatggacttcccttacgagggaacccggacgagcgcg

SEQ ID NO: 470 - DNA, 69 bp, Glycine max
  Peptide Sequence Number=SeqID_92155
atgaccgatcgaggctacggtaaggtttggatgacgccacttccggtgaaggaagataagtcagggtag

SEQ ID NO: 471 - DNA, 708 bp, Glycine max
  Peptide Sequence Number=SeqID_92156
atggagagaagtatgatagatgctgccagtggtggagcccttggagacatgactcctgctgaagccaggaatttaattgagaagatggcttctaactcccagcagtttagcgccacaaatgacgctatagtcattagaggagtgcatgaggtagctacaaactcagctgcatcacctgagactaagaagcttgaaggcaaactggatgcattggttaacttggtaacccagctggccttgaatcagaaatctgtacctgtcgcaagggtttgtggtttgtgctcctctgctgaccaccatacagacctttgcccttccatgcagcaacctggagcaattgagcagcctgaagcttatgctgcaaatatttacaatagacctcctcaacctcaacagcaaaatcaaccacagcagaacaattatgacctctccagcaacagatacaaccctggatggaggaatcaccctaatctcagatggtccagccctcagcaacaacaacagcagcctgttccttccttccaaaatgttgctggcccaagcagaccatacattcctccaccaatccaacaacagcaacaaccccagaaacaaccaacagttgaggcccctacacaaccttccctcgaagaacttgtgaggcaaatgactatgcaaaacatgcagtttcaacaagagacccagagcttccattcagagcttgactaa

SEQ ID NO: 472 - DNA, 255 bp, Glycine max
  Peptide Sequence Number=SeqID_92157
atgactactctatgttggaaaggaacatgtgcgctttggtttgggcatcccaccgttctaagacagtacatgctgagccataccacctggctggtatccaagatggacccggtcaagtacatcttgagaagcccgctcaatgattatcaacccatgcattccgagtttccagatgaggacatcatggcctcatttgaagagaagctagacaagaacagggtgatcgaggccgtacccgaatcaaataaacattaa

SEQ ID NO: 473 - DNA, 339 bp, Glycine max
  Peptide Sequence Number=SeqID_92158
atgggtgaccaagaggagacacaggaacagatgaaagccgacatgtcggctttgaaagagcaaatggcttccatgatggaggccatttcagctgccgaagcagacccaactctcccagctaccgcacaccatcctctcccaaatgcgataggacgagaagggagtaaactagggcatatcagcaacccccatttgggatacaaccaggtggcttacccttatggactaccacctaattacatgccaccagtcatgcatgatgacgcaggtcatgtccctcccctcgtccttgaaggggagcctcctcggacagtcagacgaggttcacgaggatcatag

SEQ ID NO: 474 - DNA, 315 bp, Glycine max
  Peptide Sequence Number=SeqID_92159
gtgcttccagtggcttctgtttctatcagctgtccctcctgttcagctactgacggggtggtgcgtaacggcaaaaagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttccccagtcacgacgttgtaa

SEQ ID NO: 475 - DNA, 135 bp, Glycine max
  Peptide Sequence Number=SeqID_92160
gaaaaagagggagaagcttgccacccagctcgcccaggcgagctaggttgcttcctccagaaggcaccgccttctggtggaacttcttggaaggctcaagtgggccgggttgctatttgcacccctatttactaa

SEQ ID NO: 476 - DNA, 207 bp, Glycine max
  Peptide Sequence Number=SeqID_92161
atgaccaaacttggtctctgcttgtcatcgggcccgccgcctctggatgacaaaaggggtgcggataaccgtaaggtgcggataacccgtaaggtgtcttccgcgggctaccagctctcgggtcatggtaacaaaaagcggtgcggtcgacaaaagcgaggctcttgctcctccgtatcctccaatgaggaactcagacctacgtag

SEQ ID NO: 477 - DNA, 705 bp, Glycine max
  Peptide Sequence Number=SeqID_92162
atgtatgaataccttgaagaggaaagagcccctgatcttgagagtattttggcagacttcatgagataccaagctagctctaaagggtcctattatggaatgcaacaacagggaactcaatttgaaaggaatcagtcttctgcaggctatcaatgggagtcatcctggcaaccagattattacgataaagcagaaggagttcttaatctggatgatctgctaatgcaattcaaagatacagtagattcaatgcaacaagcctttacaagaactgcaactcagattagtaagttggtggatgacatggctaacactgcggccagacaagaggaagagtgggcagagattgaaacacatgaagaaagaatttttaaagttacctcaatccatcatcagatgaccactgaagagaaaacatttgaagtctccagtactccaaaatattcctgcccagccagtgctgactatgttggaggaacagagaaaggtagattggaactcagtgaggaagaggtggaacaggaaatagtattatcagcttcaaccatgatacaacagattcctttggaaaaagaattgggtgatgagatagacagcttagtcgataatgaaaagtgtgatgatccgaaagacaattgcgttgatcatgtggtttttgaagaattggagaaaatgagaccaccagaaaagccaatcataaactag

SEQ ID NO: 478 - DNA, 120 bp, Glycine max
  Peptide Sequence Number=SeqID_92163
atggcgtttttcctaagctacttggactacaaggctcaaaatgcacaagtgagcaatgctctcgggaacggaaactttgtgcacactccatacatctcaaagatcccaacgataaaataa

SEQ ID NO: 479 - DNA, 819 bp, Glycine max
  Peptide Sequence Number=SeqID_92164
atggcgaggacttctagtcctctgaagatgaggacgtcaagtcctctgcaggcgaggacgtctagtcctctaaaggcgatggcgtgtagccctctgaaggtgagggtgtgcagccctctaaagacgaggacgtgcagtcctctaaaggcgaggatgtgtagtcctctgaaagtgagggcgtgcagccctctgatggcaaggacttctagtcctctacaggcaaggacatcaagtcctctaaaggagagggtgtgcagccttctgaaggtcaggatgtgtagccctctgaaggtgaggacgtgtagtcctctaatggcgaggacgtgtagtcctctgaaggtgagggcgtgcagccctctaatgacgaggacttctagtcctctaaagttgaggacgactagtcctctacaggcgaagacgtctagtcctctaaagcagagggcgtgcagccctctgaaggtgaggatgcgtaaccctctgaaggtgaggacgtgtagccctctaatggcgaggacgtgtagtcctcagaaggtgagggcgtgcagccctttgaagacgaggacgtgcagtcctctaaaggcgaggacatgtagtcctctgaatgcgagggcatgtagccctctgaaggtgaaggagagccgccctctgaagacgaggacgtgcagttctttaaaggcgaggacgtgtagtcctctgaaggtgagggcgtgcagccctctaatggcgaggatgtgtagtactcttaaggtgagggtgtgtcgccctttgatggcgaggacgtgcagtcctctaaaggcgtggatgtgtagtcctctgaag

SEQ ID NO: 480 - DNA, 447 bp, Glycine max
  Peptide Sequence Number=SeqID_92165
atgtctcttgctacattatttggaaagttacaggaacacgaaatggaactgttgagattaaataaacacgaagaaaatgataagaaaaagaagggaattgctcttaaagcttcatcttcaatccaagaagaaagttataaggaagatttaattgatttggatgaagatgatgatcttagcctttttgtaaaaagaaggatagaagattcatcctctactccaaaatgctatgaatgcaatcaacctgaacatctgagggttgattgcccgatcttcaagaaaagaatggagaagtctgaaaagaaaaatgttagtgaaaagaaggcaaagagagcgtacatcacatgggatgacaatgatttggaatcatctaaagattcaaaaaatgaagtcataaatttgagcctaatggccaaaagttatgaaagcgatgaaaagaatcattag

SEQ ID NO: 481 - DNA, 279 bp, Glycine max
  Peptide Sequence Number=SeqID_92166
atggagagaagtcataacttcaacaatgggaagagatcccaagaagtttctcctacacttaaatgctacaagtgtaatcaacccggtcacataaaggcaaactgccccacaaatgagttatggcccgagaagaatgagaagaaaagctataaagaaagaagatccaagaaggcgtatattgcttgggatgacaatgactcatccgatggttcggagaaggagatcaaccttctatccaaggactatgaaagcgatgagaacatctctcaagaagattaa

SEQ ID NO: 482 - DNA, 355 bp, Glycine max
  Peptide Sequence Number=SeqID_92167
atgactaggggcaatccaggtgatttacaaccctttgatcttgaaatagatacaacctttcatagattagttaggcatagtgtgcatcctggtcattctgtgcattttgagcatcctgatcattttgagcattctgttgcaggtgattctgaatattctgattttgagcatttggcaattaattttcatactaagaacatggctcaagctccacctcatgagaggactcttagggagatggctgcacctgatttcacttatgaaagcttgtgcattcaatatcctgatgaggatgttccatatgttctcaagactggactaatacatttgttgcccaagtttcatgctcttgcag

SEQ ID NO: 483 - DNA, 570 bp, Glycine max
  Peptide Sequence Number=SeqID_92168
atggagagtaacacggccaccgccgccgccactatcacagttattgaggcagacccagctctccggactgttgtgcaccatcccgttccaaacattgtgggacaagggagaagcacattgggacatgtcagcgacccccatccggggtacaaccgaggtgcttacccctacggtttaccacccaactacgcaccaccggccatgcatgaagacgcgggtcacattgctcccctcatcctcgaagggcagcctcctcggcatcctgacggggcccacgaggatcctcgagagcatgctcaggaagacgtcggttcctactccccatttcctgctgaggggccggcgcccaacgcgctacctcaacccaacatcacaggaaagcctcgaacccacccaacgcagccaatgcttatgtccgtgggagggccacccccggcagcggaaggaaaggaaaaactcgatcttctcgaagagaggttgaaggccattgaaggattcggcaattatcctttcgtagacatgactgacctgtgcttggtgccgaacatcgtcatccctccgaagttcaag

SEQ ID NO: 484 - DNA, 282 bp, Glycine max
  Peptide Sequence Number=SeqID_92169
atgtgtctattggggaagagttgcgaggcgaaaaagtcatcgacgcacaggatttttggttggcaatcaaagggagaggaccacttcaggtcgtggtttcctttctttccttatttggtggtgacaattttgtactgtttagatattgtctggtccaaagtgatgcaatcctaccccgcaagggaattggatagaaaactccaagtagattgggccaaagatgcaagagaaggccctagggttcttatgagccttagggtagatttcgggcccatgggctaa

SEQ ID NO: 485 - DNA, 849 bp, Glycine max
  Peptide Sequence Number=SeqID_92170
atggcttcgcgcctcgataatctgacggcggagaaagacaactacgacttcttcctgcagctgccggaaatcgatccggcgcagctggagcgcatcgacattcgcacttcgcagctgatcacgccgctgttcgagtactccggcgcctgctccggctgcggcgaaacgccgtacatcaagctgttgacccagctctatggcgaccgcttgctgatcgccaacgccaccggctgctcgtcgatctacggcggcaacctgccgaccacgccgtacaccaccaacgccgaagggcgcggcccggcgtgggccaactcgctgttcgaagacaacgccgaattcggcctgggcttccgtttaacggtcgatcaacatcgcgcgcgagtgctgcgcctgctgaatgctctggcgccgcagctgccggagcggttggtcaatgccctgcagatgggcgacgtggcgccggagccgcgccgtaagcagatcgccgaactgcgcacgctgttggccaatctagaaggcgaagacgcgcgccagctggcggccggcgccgactacctggtggataaatccatctggctgatcggcggtgacggctgggcctacgacatcggcttcggcggtttggatcacgtcctcagcctgacggagaacgtcaacgtgctggtgctcgacacccagtgctactcgaacaccggcggccagcagtcgaaggccacgccgctcggcgcggtgaccaagttcggcgaacacggcaagcgcaaggcgcgcaaggatttgggcgtcagcatgatgatgtacggccatgtctacgtggcgcagatctcgctgggggcgcagctcaaccaaacg

SEQ ID NO: 486 - DNA, 309 bp, Glycine max
  Peptide Sequence Number=SeqID_92171
atggcgatagtcgcggaagtgatcgccaccaccatgttgaaagcttccgagggctttacccgcctgtggccgtcgctgctggtggtgctgggctacggcgtggcattttgggggctgtcgatggtggtcaagagtatgccgctgggcatcgtgtatgcgatttggtcaggcatggggatcgtgctggtgtcggtcgccgcggtatttgtttatcagcaaaaattggattggccggcgatcgtcggcatgggattaattattgccggcgtgctggtgattaatttactgtccaaagccacggtgcactga

SEQ ID NO: 487 - DNA, 645 bp, Glycine max
  Peptide Sequence Number=SeqID_92172
atgggctatcgcctctatttgcgcctcggcctgcccggcggcaccatcacgcgcatcttttcactgagtattgccactaactggctcggctacattttgcttggcggcgtagtgtttgtcgccggcatggtgccgattccgcccggctggttcatcggcgaaggcacgctacgggtgattggtgcggtactgctggcgatggtggcggtttatctgtgggcctgtgctttcgcgaagaagcgccgctggacggtgaagggccagcatctgcaactgccctcgctgcgcatggcgctgtttcagtttgccgtttcctgcgccaactggatggtgatgggcaccataatctggctgctgctggcgcgtgaagtggattatcccatcgtgctgggcgtgctgttaatcagcagtattgccggtgtgattattcatattccggcgggcattggcgtgctggaagcagtgttcctcgcgctgctcagcggccagcatgcttcgcacggtgagattatcgccgcgctgctggcttatcgcgtgctctattttattctgccgctgctgctggcactggtgctgtatctgtggctggagagccgcgcgaagcatttacggcagaagaatgagcgcaagatggcggcgcgataa

SEQ ID NO: 488 - DNA, 712 bp, Glycine max
  Peptide Sequence Number=SeqID_92173
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggggcttggtcgtccgtccgcccgggcacacacctagtagcaccagagcaggaaacgagagagagccgacgaacggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcgccacacggacggcgggcgcacgcgtcgcccctagcccggattctgacttagaggcgttcagtcataatccaacgcacg

SEQ ID NO: 489 - DNA, 150 bp, Glycine max
  Peptide Sequence Number=SeqID_92174
atgcgtcaagctagtgatgttaaagaagtgcttattgggagtcatccactcgctcaatgtgccctgtgcgctaagcgaatcattcttcatgcgctaagcgagtactcatccgcgctaagcgtgccaaatccttacccattggctgaaggg

SEQ ID NO: 490 - DNA, 326 bp, Glycine max
  Peptide Sequence Number=SeqID_92175
gttgcactctttttgctaaaaagagtgcaacttatgttcatgttgtcttcttagacactctgcatgacctcagtcagactaggaggtatgcatggggagctgctgccctagtgcatatgtacgatcacttgaatggtgcttgtattagcagcagccgacagcttgctagttacatcaccctcttacaatgttgggtatatgagcattttccatcagttgcagagtgcatcgctgatccagactatgacgaggtgtcactacatgcatgtcggtggattgctactaagaagactgtgaagatcatatctacagagacgtacaggtag

SEQ ID NO: 491 - DNA, 402 bp, Glycine max
  Peptide Sequence Number=SeqID_92176
atgcagtttgcggatcacttactacctgtgggtcagctttgtctagtgcctgggcaggtatctgcggattacatggagtggtttttccgcatatctcatccattcatgacaccgacccaagcagctgaccagcagagggatgcaccagctgcagaccctgaggactacatacagacgcccagcccccaggttccagtggcatttgacccccctccatatgtggatgattacaagggatatgaggcgattgcacagaggttggagcgtgtgctcaaccttaggatagtcactgcaggcacagaattatatgacattatgcaggactacccgacgatcgcgagagggggacccagtgctgatgtgactgtcagggctcgtcagagacaccgcacggacttttga

SEQ ID NO: 492 - DNA, 537 bp, Glycine max
  Peptide Sequence Number=SeqID_92177
atgatagaagtctctgtcgaatccattgcatccctcactcagtattacgatcagccgctaaggtgcttcacgtttggggactttcagctagtgtcgaccatggaagtcggaataccaaggaggcatttggaggaaaaggcaaaggcgttggcggatcaaggtgaatgggcttcgttcattgatgtcttggagctattggtatttggagttgtcctctttccaaatgtggatgggctagtagacttagcggtgatcgataccttccttgcttaccaccatagaaaagaaagcttggtcattgttgtgttggtcgatgcctatgacacatttgaccgaagatgcgagaaaagcaacataaggattgtctgttgcacacccgctctttatgtacggctggtctcgcacctttttcgtcatgaaagtagacccatctgtcccctgcaaggtcaccgcatgttcgccgagaaagggaaggcaaattgggagcaactcttgcctagtatggtaagggcatctattaattggttcccccgatga

SEQ ID NO: 493 - DNA, 180 bp, Glycine max
  Peptide Sequence Number=SeqID_92178
atgtcagaggttgtgctaagcacacagtgctttgacattgcatcctttgcttcctcatactctgcattacacatccattttagaagcccattaggggcaatgtggctgaaaggggtgaaaacccctgtgtgtgtttctggaaaccacgatgaacgcgctaagcgcgccggatgcgcttag

SEQ ID NO: 494 - DNA, 288 bp, Glycine max
  Peptide Sequence Number=SeqID_92179
atgacaatcaattcatggggctccgaactaagatttgatggtggaggatgcacgaaaagcgctaggcaatcaattcgttgggctcctggactcgatggtggaggatgcatgaatggcaatcaagatgcacgaacagcgctaggcaatcaattctcgggttcttcggactctaaaatggcgaacatgcttgcaaggaatgaaaatcaattcatggggctccgaataagtttgatggtgaggatgcacgaacaactagctatggccaaaatcattcgtggggctccttag

SEQ ID NO: 495 - DNA, 453 bp, Glycine max
  Peptide Sequence Number=SeqID_92180
atggcaaccaaaggaaatcgaagaagatcaaacttcaatccaaagaagaaaggagaagaatcttcctctgttccaaaatgctatgaatgtgatcaacctggacacataagagttgattgccctatcttcaaaagaagaatggacaaatctgacaagaaaaccttcaaagataagaaaggaaagaaagattacatcacctgggaagataatgatatgaattcatcaggtgattcagaaaatgaagtcgtaaattttagtctcatggccaaaaatcatgaaagcgaagaagaggattcgttgaagaaaagttggtacattgatagcggttgctccaaacatatgactatggaagcaatgtcttccaaggttattttgatgatgccaaagaatcaagagttaagcaaatttttcaagcaaagattcaagaatcaagagaagactcaatcaagataa

SEQ ID NO: 496 - DNA, 438 bp, Glycine max
  Peptide Sequence Number=SeqID_92181
atggaagcctcaaaaagggaggaggaagagaatctgcttagaatgaagaagctaaaggttagaattgaggagctcataaagctagagctcagaatgaagacatcaacccttctgaggatcattactgatgtgttagcaaagctgaggactgttgaatccatcttagagaaggaagaagacaaattagaagagccttttgagatggaagaaaaggttgaagttgctgcagaaactgctcaaaatgtaccagaagttgcagttggtgagagaacccctattgtgtttatgaaggattacttgttcaacattgagaatgtgcaaaatcttttcaacactcccatctttcacacttatgttaaaattgtttgtcgccttggtcccttacatggtgaaccctcaaacttttctattcctttccctcaattcccttatgattaa

SEQ ID NO: 497 - DNA, 171 bp, Glycine max
  Peptide Sequence Number=SeqID_92182
atgttcattgttgcggtggttggttcgtcgtcatcgacatacgagatggatgaagatcaatggatgtatgatagtataatgtctaaagaagttgatatggatgatcaaaatgaacaagaatgtggtgtgaatgaacatgttgattgttcggatgcattcaatacttcttag

SEQ ID NO: 498 - DNA, 171 bp, Glycine max
  Peptide Sequence Number=SeqID_92183
atgatgatttggaaacaacgtgcaaaattagtcatgcatacagctaggtgggcactcaagcatccagcttatggcattatgatactaaggcttgggatttacgcaggtcgacaaaagcggggctcttgctcctacgtaccatccatcaaagagaaaatcatacctacgtag

SEQ ID NO: 499 - DNA, 309 bp, Glycine max
  Peptide Sequence Number=SeqID_92184
atgttcaagtgctattgcattgcattccttgcttcctcatactttgcacacatcaaaccctcttcttctggagggggtggagcctctgtagcccaggagcatgatactgaggagccaccaacaccaacaccagtagaggatgaggaggagactactccagatcagactccacggccatctccagcccctgcacatatacctgaggatgttgcaccaattgcggagcctgagcaacttataaaagattcatcaacaactccaacactggatttgaatgaagatcagccacaggaggagcaggacatttaa

SEQ ID NO: 500 - DNA, 537 bp, Glycine max
  Peptide Sequence Number=SeqID_92185
atggtcattgatgttgttgtgtggaaggaagtagttggtctagatatgggtggagtccacaagtttcatgaaatttctgatgggtacaacaagatgcagacctataggggaattcttcttgacccagctaggaacttgaggaatcgcttaggagttggtggactgactacaaaagatagaatgttggtttaccacattacctatattttcacttcgaggtcaagcaatcatgctctagtaatagatgatgatttacatattgtttatggtatgaaatcgggtatcaagatgaactgggtattgttgattaaggacattatactaaagagtcatcacctggtggattatgaatttctttatgttgtgcttgcttcaacattcattgactacttcaatgttgatgtctctaatgagagtatggactttaccaaagcatctagtgagatcaccgaaagacatctcaagaaacttggaatgaggtttattgatcatgaatggataatagctgaaaagccattagctggaaactttgattag

SEQ ID NO: 501 - DNA, 330 bp, Glycine max
  Peptide Sequence Number=SeqID_92186
atgacccttccgtcatattctaatttcgtctggggactatcgttcgttgatcttttgatacttgctagtcgacttacggtgttgaacgacagttacaatgtgaaacagaggatcattcagtgttctgatcaagaatgcaaaaaataccaaaaagtaggaaaaagggtcttttccttggttttcctggaccctagcttgcccagactagcctctagctcacctgggacaccaaatagcttcatggtgaagaaaccaactctcctgggcgagctcattgcttcagcactaagtttcagcttgcctgggcgagctacaactgcgccaaagtga

SEQ ID NO: 502 - DNA, 357 bp, Glycine max
  Peptide Sequence Number=SeqID_92187
atgctccgtaggccgcagatgagccgccacctcatcaggcgtggccaggctggatcgtttgatacggagcggtatttgcggcatttggttcgccagcaggcagccaaccaccgggcacatgtacagacccatgattgtctttaccagttgagcctcagcatgcagagtcagggcttcgcttctttttcatgccctactccagaccagttcagggcagaggtcgcatggcccggggattggcccgaggcccaagcaggagaggcgcccccagaggctcccggcgatggagaggaggcccacgaggacgaggagatgaccgatttgcttgacttcttgggaggaagtggagctacatga

SEQ ID NO: 503 - DNA, 230 bp, Glycine max
  Peptide Sequence Number=SeqID_92188
tggatgttgaattacttggatgttgtggaatcttggaaggattgatgggacccggcgttgagaggaacgaggataagggctacgtgggagtggtacttggagatatgtcgcgggggtcaggagaccttggggacgtcaggcgagctcctggcagtcaacagataaaaggaacaaagaccacaaagcaaggaggcttgtgtggtggctggccagctgtgaactttgattga

SEQ ID NO: 504 - DNA, 180 bp, Glycine max
  Peptide Sequence Number=SeqID_92189
atggaaaaagataacttaggaaaaattttgatgctaagtcagatgaagaaaaagatgaaggaagcaatgaggattctcaagataatggggctagagcaaataatgaacttccaagagaatggaaagcctcaagagatcatcccctcgacaacattattggtgatatctcaaaaggggtaa

SEQ ID NO: 505 - DNA, 49 bp, Glycine max
  Peptide Sequence Number=SeqID_92190
ggtgaatgctgtgaagattttcccggaagcccgaaatggactcggatga

SEQ ID NO: 506 - DNA, 300 bp, Glycine max
  Peptide Sequence Number=SeqID_92191
atggaaccaaagtcacgaatagataaatataaaatccaacagtcatctcaacctgttgtcgcaacctacccttcggcgggagggcgacgcgtgactcgcgggatgcgtgttccacgaaaggaatacgcgcgaagtcgccaccaacgtttatctgaggaaaacgtcggaaaaaccggaaaagatgcgatctacgaactcttaagtgaaaggttcgggagttgtatttacgcgcggggaagggtgtttccctttgctcctacgtattcctcaatttgggatgagaaaatcagacctacatag

SEQ ID NO: 507 - DNA, 609 bp, Glycine max
  Peptide Sequence Number=SeqID_92192
atggatacaccacccagctctcctcctcctcctcctcctagtgcagcatcacattcgacgtctaccttgaagcgaacaacaaaagccacacgcttaagatcattggcgactagaccagttggggtagagagacccctggtccatgtggatcctgcgatcgggaaagccgacagtctccacagaaaaaagttaagaacatatttggggatcgtcgctcgtgataaggtggaggtgacatacgagaattggaaacaagtccatgctgctcagaaggacttgatgggaggatattcaggatgtgcggaaaaagacacagaccatctagaaacaaaacactgccccttacgtgttgtctcgtgggggttatggatatctagaaaacaagattcattggaggagcaggcctcacaaggttcctttgtcgcccatggacgtcaggatgtactgactgctgccattgggcgaccagaacaccctgatcgtgtgtgtgctgctggaaccgatgtcatgatcaagcaatactttggatcgactcctaggacttccaacacttcttcatccatggctcccgaagacctggagcagttgacacaaaaaatcaaggactag

SEQ ID NO: 508 - DNA, 153 bp, Glycine max
  Peptide Sequence Number=SeqID_92193
atgagtgttgagatcaaaagtgaatccacagataagagctttaaggtcaatggacaccggctgaaaccattcctcacaaatccctccttctttacttttagtggtggaggagacctccttacttcatcctacttctcttccgccatgacatag

SEQ ID NO: 509 - DNA, 264 bp, Glycine max
  Peptide Sequence Number=SeqID_92194
atggtacttgcaagttgcgttagggtcacaccactttgggaaagggggttggaggacctttctgggagttaccacagccaaatggttagcgatgagggacggcaagaggttttcatacatcattgggagtggggtgaattcttgaaatggcctcggagggaagttccttgttgcgttggaattaccggccgggcgagtcgtgttcggagttggaacttggggagcttccctctgggtgggtgtcttaggctgcacgggtgttga

SEQ ID NO: 510 - DNA, 671 bp, Glycine max
  Peptide Sequence Number=SeqID_92195
atgcaatctcagggacttgcactacctcccgagcctctggttggtccctctggtcctcgagtaagcaccaaggggaattgtgttgatccctcaagaaacgatcttgagacgggtgactcagataggtgcggcttgtacatcgaagcagatcctgcccgcttggttgccctagggagagtttatgagggatccactattattcataacactcctttgttgcttggccaaggaaaggtgggtgtggaggaggttacagatgctgatgctctagttcctgtacccactgatgatattatcgatgaagagaacttcaaagctccagaagaggatgaagaacttcgagctctaaaaacagaactaggaaaagcaagacttgccaaagaaaaattcaagttggtcgctacagacattcggaaagagtgttctggtgagctcaagcttcgaagggaagagagagaccaatcacaagcacatagcatggtcttgaaagaggagttagctgcttgctcaaggtccaaaagaaacttgtctcagcgtttatgcgagacagagaccaacatgttagccatcgtcagcaagtaccaagaagagctaaatctagccacggcccacgagcataaagtggcgggcgagtatgcccgagtgtacgcagaaaaggaggctagaggaag

SEQ ID NO: 511 - DNA, 303 bp, Glycine max
  Peptide Sequence Number=SeqID_92196
atgaaaacgccccaaaatgctcaaaactcataccaacacaaccacctgaacttttcaatccgagccggaagttccctcccaactcaagtagaagggcctcccacaacagaaaaaacgcctgcacaatacgcggctccagccacaccccggctaaccaataatacgactcctggcacgagctatgacaatccacgacgctccccgagagaccagttctctcctattcccatggcgtattccgagttatggccctcattattggaaaaccatttggtggtgggcatacccggtttcataccctaa

SEQ ID NO: 512 - DNA, 399 bp, Glycine max
  Peptide Sequence Number=SeqID_92197
atggagtgcctagagggtgtttgggagaccctcgaaggcaatgagaggtgccgattccgtggcacaattcgactcactactacttcattagtacattcggaggaacccgcacgcacacttcagcatcctgtggagtggatattacctacacctactccatatcgactagtggagccagttcaagtgataaaggtgtcatcctctgaagaggatcttaaagaagacccagaggagttacctcctaaacctgatatggatgcccttgacttacctgaggatgacgaagacccactccctgatgttgattccccagaggatattatgtcagcatctgaggcagactctacagaggagagtggccctggagggacagcgaatagtgaagactcttcatcatag

SEQ ID NO: 513 - DNA, 315 bp, Glycine max
  Peptide Sequence Number=SeqID_92198
atggggcaaaatacaccaaatgattatgatgatggatggctcaaattctcacaaagtgtaataaaagcaaagaaggagataggaaaagaagaactccctaagttatggtggaggaagagtagggttgtcgcaacctacccttcggcgggagggcgaagcgtgactcgcgggatgcgtgttccacgaaaggaatgcgcgcagagtcgccaccaacgtttatttgaggaaaacgtcggaaaaaccggaaaagacgcgatctacgaacttttaagtgaaaggttcgggagttgtatttacgcacggggaaggtgttag

SEQ ID NO: 514 - DNA, 156 bp, Glycine max
  Peptide Sequence Number=SeqID_92199
gttacaggttgtaccatttgtggtggtgctcatgaattcggccactgtattcctttagaagaacaaatgcaggaagttagttacatggggaatcaacaaaggcaaggatacaaccaaggaggattctcaggtttccaggaaggacaatggagatga

SEQ ID NO: 515 - DNA, 231 bp, Glycine max
  Peptide Sequence Number=SeqID_92200
atggaggataggatcgcgaccgaccaagcgccaccccttcccggcgctaaacaagcagagaacgtcgctgcagggcagcccagttcaagtgagcaaacgctaacccataaggaaggaggggacatggttaatgttcccctaaaaaaaatggcagggaaacaacctatgggacgatttggtgtgcgcgtgtttgctgtctttggagcatgtactcagtttcataagggctag

SEQ ID NO: 516 - DNA, 660 bp, Glycine max
  Peptide Sequence Number=SeqID_92201
atggaagagccatcgaagaagagaaagggatcatcctccaccgctgctgctgctgcccatcgccgccacggaccatctgaagcatccacaacacctattcatccatctttatcatctccaagatcatccacattgttttcttccgatgatcagcatctacggtacctctctcaattttcttctaggatcatcttagaccctaagtacctagatgtagagttctttaatgatgaaacgtttgattgctatcaagtgtttcaaaattctggccttgtttatttcatgtcattaaaactgccacattatcctgaacttgtaaaggtcttctactgcaatttgaaaattcaagatggcattatttcctctgaggtgcatggtactcctatgatcattgatcagtccttattattttctttaactcatttacccagtcaaggtgcaccttttgagggcaccattgttgatgactggaaatttgattattctagtcatgatgctcgccgcatggtctggtttgtcttgatttcagggattgtcatcatcaaaaagggggagattgtagacaaaggatcaagccgatgttttgatgatgccaaaagatcacatgcgtctcaaagctttattcaagacaaagcaattaaagatattcaagatggatga

SEQ ID NO: 517 - DNA, 308 bp, Glycine max
  Peptide Sequence Number=SeqID_92202
ctgtccctccctgttcagctactgacggggtggtgcgtaacggcaaaagcaccgcccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 518 - DNA, 564 bp, Glycine max
  Peptide Sequence Number=SeqID_92203
atgaaggttacagccctcaagcaaaccagccatgacatgattgctcatgtgggtaaggctcgggctgccgtggaagagctgagaaagtttcttgtggctgattcattagaagaagtgaacaagaaactggacaagttttacatggtccttatcctgagaagcttacactcagactttgatcatgttcgtgatcaagtactcgctggggatcaggttccatccatggattctctcatcactaggcttctccgtgtgcctcacttatcgaaggatgaaaatcctactgatagtgtggagacgtcagcaatggttgcatcacgtggtagaggaggcggtcgcaacagcagaggaggccgcaatggaaggggtggacgtcctcattgcacctactgcaagaggatgggtcacacccaagagaattgttattcgttgcatgggtttcctgacaaggttgcacaggtttctagatcagagaaagcagagtctaagttctctgatgaggagtatcaggagtatttgaagctcaaatccgagagacccagcaaccaagctcaatcctcatct

SEQ ID NO: 519 - DNA, 513 bp, Glycine max
  Peptide Sequence Number=SeqID_92204
atggtgcaaaagaaggacaaggaactcagaggcagtagcaacgggcccattggcggctatcgtaggtggttgaaagcccacatgcaaggtctggattggctcccgagtttgagaacaactaaaggggtggaagttgaagcaccggagaaggacgaagaggtgcaggcccttagggcagaactcgagaaagcccaaacagtcaaagaaaggttcaaatcagcagctcttaagatccgaaagcagaatgccaaactgagagacgtaaatatagctaccaccaaggccttggaacaagagaccaaaagggctcgtagggaagaacatgactggaacaaattccgaggggctctgtggggcagtaacagtttgcctaaggtccaagagtctcagcgtttatgcgagacgaagaccaacatgttagccatcatcagaaagtacccagaagaattaaatctagctacgacccacgaacacaaagtggcagatgagtatgcccgagtgtacgcggaatag

SEQ ID NO: 520 - DNA, 128 bp, Glycine max
  Peptide Sequence Number=SeqID_92205
ggtaggttgcgacagaaggataacctcacctataaagcacaacctcagaagatcactgaccaaagaatgaagtcgttgagaggaaaggagatcgcggttgtaaaggtgcagtggggaaccggattagg

SEQ ID NO: 521 - DNA, 297 bp, Glycine max
  Peptide Sequence Number=SeqID_92206
atgcctgctcagcctggaggttcaagctgtgcgcttagcgaattgattctcgttgagcgcatcattgacaactcatatgcttccaggatcttctacgcgcttagccatgaactactgcgcttagcggatggctcgctaagccagagaattggcttaaattcaaattcatccgctcagcgggcaaactcgctcagcccaattcaaaaatatgacattccagagaagaaattgggcttagcgttaagggtcgcgcttagcgagttctgcagctctaattcgtctgcaaatcttgcttag

SEQ ID NO: 522 - DNA, 167 bp, Glycine max
  Peptide Sequence Number=SeqID_92207
atggtgcgagaatttgggtatgtccagaccattcctccacactctctgggatcaaggttatcgtttgaagatattgatgacagatggatgcatttctttgagtacctagcaccagtggggcagatttgcgttgtgcctggacaatgtgcaccggactacatgcactg

SEQ ID NO: 523 - DNA, 408 bp, Glycine max
  Peptide Sequence Number=SeqID_92208
atgtcatggggcatacgttgcactctttttgctaacaagaatgcaacacatgtgcatgtggtgttcttggatgccttccgagacctcagtcagagtggaagttatgcatggggagctgccaccctagtgtatatgtatgataatttgagtggtgcttgtaagagcggtgatcgacaacttgctagatatatcacactattgcattgttggatttatgagtattttccatctatttctaaggcttttatggacccagactatgatgaaaggtcaccacgtgcctgtcggtggacttctacgaaggcctctacgaagttaataccagcatcgacgtatcagaagcatctagatcgactgacgatcactgatgtttgttggatgccttacagtgaccatcgtgcagtttga

SEQ ID NO: 524 - DNA, 531 bp, Glycine max
  Peptide Sequence Number=SeqID_92209
atgtggttcactgatgaaaacaagaagactgacttcaagatgatctatgctgtgaagaataaagcagttgcaggactggatagcaagatgcagacatacagaggtatgctccttgacccaacaaggaatctaagaaatcgcctaggagttggtggtttaacagctgaaaataggatgttggtgtatctcattacccacactcttacaccaaggtccaacaatcatgctcaagttattgacgatgacttacaaatcgtatatgggttgaaatcatgtattcaaatgaattgggaacttctgattgaagatattatgttaaaaaattgtcgactagtggattatgaatttccatatgttgtcttagcctctagattcattgattacttcaatattgatgtttcaaaagagatagttgatttcaccaaagcctcaaatgagataaccgaaaggcatctcaagaagcttggtatgagatatatttgttggacaagtggcctcaataacttaagagaggggggggggggtgggtga

SEQ ID NO: 525 - DNA, 688 bp, Glycine max
  Peptide Sequence Number=SeqID_92210
acacttgttagcactgccacacctcttatgcttgaggttattcctcaagtaaaggagttgttggatgagggtttggttcttaagagcttaaatcctcgtgctcttttggtgcctaaaataggtattattaggcaccaaatccctaaaataggtgatatgatgaatgtgttgagtggtgcaaccctcgtttgtaaaatcactcatgcagccaacatcttcatgattcgtgtacatatggattcattagcgaggcttgtgcgcttagcgagaatcatgcgccaagagaggtacttagcccgcttagcgagttgggagaatttggaggagaatctaagaagcatttgcacgctcagtgcatcatcagctcgctcagcgagacgtttgtcttttcctgcgctacgcgtgcccagcttgctcagcggatgttcacttactcgtgctaaacgtgaaaatggcgctaagcgcaccttcgagggagcacaacttgaagctttaactgaaacattaagttgtgctatttgtggtggtgctcatgagtcaggctactgcatttccattgaggatcatgcacatgaagttaactacatgggaaaccaacctagacaaaattttaatgtaggtggattctcaggatttcagcagggccaaaattataaccaacggtatggacagtggagagctcatcctg

SEQ ID NO: 526 - DNA, 444 bp, Glycine max
  Peptide Sequence Number=SeqID_92211
atggatgacaacattgttaatgaggttatcattgatttcactaacactagtatcatggacaaggacccagaggtttccaatgtagttaaagttgatgaggttatgcacccaagtcaacaaaaggaatctgcgtccaagcaattagaaacctcacatgaagctacacccaatgaaaaggatgtgcctgatgtagtgatcatctactccacaagcttaagtcacacgcctatcaactatgcacctccaaacattgggaccaaaggtcaagttcaagagatgattggtcaagcaatggacacgtttgttgaacgccaaagacaagagaatgagaaactcaaactctatgcaaaacactatcaacactcaactcaccaatcttggtgctgcattgattcagaacttgcaacaagctcagtgtatgataacaaagatataaattcttga

SEQ ID NO: 527 - DNA, 381 bp, Glycine max
  Peptide Sequence Number=SeqID_92212
atggctttctcttcaagttcagttctttgccagtcttcgcacagcaaaagctctcaaaaatctttggaacttggacagactcaggaggagcagctgcctcatcagatccctcctattgaggtgcctgagctgcaaaccttccaccagttctcacaatcgagggttaagctccaggccaggccacctgctcaaggaactactctactgatagaatggaccttggaggagctaccatctctctgggcctctggtcctgctgatgcaaacggaggcactggagtagatggtgaagggatgtcatctgtgctcaccctggttttccttttcctcgatgccatctataatgaaaagaactcaaaattcaccttagattacatttag

SEQ ID NO: 528 - DNA, 381 bp, Glycine max
  Peptide Sequence Number=SeqID_92213
atgttgattgttctaaggcattcaatacttctcatgtgtttcctactcgagatgatgttttgtagtgggctcgatcagtcgcttatgaaattcgatttgtggcgggcaaggttggatggtgaagttaatgtgtgggagtcacaatcattagttggacatccatacgctggtcaattgactaaggataaaaagataattattgctgatatgacaagatcaatggtgaaaccaagaaacattcttctaatgttgaaggagcacaatgtcaatagttgtacaacaatcaaacaaatatacaatgcaagaagtgcataccgttcttccattagaggcagtgatactgaaatgcaacatctgatgaagcttcttgcacgggattag

SEQ ID NO: 529 - DNA, 309 bp, Glycine max
  Peptide Sequence Number=SeqID_92214
atggtcttttccttgtttttcctaggccctagctcactcaggctagcatttggctcgcctgggccaccaaataacttcaaggctaagggactagctcacctaggcaagctgaagcttgcctgggcgagctgcaaccgttccaaggggtgttttaaagggttaggaggatcagaagtggagggaattgagagaattaagaaagaaaaagaagaagaaagaagaggaaacgaaaccgaggccttaccaaatcgcaactatgatcgtccctacgtcgtttctcgttcggtgttcttcgcaccaatcggttag

SEQ ID NO: 530 - DNA, 435 bp, Glycine max
  Peptide Sequence Number=SeqID_92215
atggtgcgagaatttgggtatgtccagaccattcctccacactctctgggatcaaggttatcgtttgaagatattgatgacagatggatgcatttctttgagtacctagcaccagtggggcagatttgcgttgtgcctggacaatgtgcaccggactacatgcactggttctacatgatttcgcatccattcatgacaccgacacaagccggggatccgcccaaacatccacatgtcatgaaatatgagacatatatggaaccaaatatgcctgggtttctaatagtagcaacagctatggaggaagcacctgcacatgccccttctgatgtagagcaccctagacatgcaatggaggtttgccaagcaactgcaggaaggttggagcatttgctcaacctaaggatagtgattgagcctaaggatagtgattga

SEQ ID NO: 531 - DNA, 828 bp, Glycine max
  Peptide Sequence Number=SeqID_92216
atgggtgaagtagaggaagtgcaggaacagatcaaggccaacatgttagctctgaaagatcaaatggcttccttgatggaagccatgctaagcatgagaagattaatagaaagtaatgcggccacggctgccaccgccagcaccgccgctgaggtggatccagctcttccgtctgtagcaaatctagcacatcaactctccccagatatggtgggaagaggaggagacatattgcggaataccaacagctcgcgtcgaaggtataacagacatgcttacccctacggccttcccctaaatttctcaccacctatcgtgaacaagaacgtggaccatgtcgttccctttaccttcgaagggcagcctcctcagcctgtagggggcgcccgtgaagagcctcgggagcatgcccaaggggacgtcgattcataccctcttttcaccactgagggactgacacccaatgccttgcctcagcctaatatcgtgggagtctctcaaccctacccgatgcaaccattactcttctctgtagggggaccgcctccggcagcggagggaagagaaaagcttgacctcatcaaagagagattgagagcggttgacgggttcggtgactacccctttgccaatatgaccgacttatgtttggtgccgaacgtcatcatccgacccaaattcaaggtatcagattttgacagaagatggggacgtactcgagggatgagaaattgctcatgcacttcttccaagacagcttggtcggagccgcaatcatttggtacaccaacttggaagcatctcgcgtccgctcgtggaaagacttga

SEQ ID NO: 532 - DNA, 637 bp, Glycine max
  Peptide Sequence Number=SeqID_92217
acctcctcaacctcagcagcaaaatcaaccacagcaaaacaattatgacttctccagcaacagatacaaccctggatggaggaatcaccctaacctcagatggtccaaccctcagcaacaacaacagcagcctgctccttccttccaaaatgctgctggcccaagcagaccatacattcctccaccaatccaacaacagcaacaacctcagaaacaaccaacagttgaggcccctccacaaccttccctcgaagaacttgtgaggcaaatgactatgcagaacatgcagtttcagcaagagaccagagcctccattcagagcttaaccaatcagatgggacaattggctacccagaattctgacaagttgccttctcaagctgtccaaaatcccaaaaatgtcagtgccatttcattgaggttgggaaagcagtgtcaaggacctcaacccgtagcaccttcctcatctgcaaatgaacctgccaaacttcactctactccagaaaaaggtgatgacaaaaatttacctaacaatttctgtgcagaagcagcacattccccctcttccattccctccaagagcagtttccaacaaaaaaatggaagaggcagagaaagagatattggaaacgtttag

SEQ ID NO: 533 - DNA, 147 bp, Glycine max
  Peptide Sequence Number=SeqID_92218
atggcaataacggaagctacagggctccaaatgagtcgacgtcggccaggaaagatgactgatcgaggtctaaaaaagaagcatcatccgatgacgccgatcgaacatttcctaaccgacatcatgcaaatttcgttcacggattga

SEQ ID NO: 534 - DNA, 345 bp, Glycine max
  Peptide Sequence Number=SeqID_92219
atgcaacggtcctctcgattgccccagactttaagcgtaatatcatttaacgacatcggagttcacgagcgagggcagctcctcgccatccatgtcggtgagtatcagagcacccccaaaaaaagctcttttcaccacgaaaggtccttcataattcggggcccacttgcctcgattgtccttaacagtgtgggacatcttcttcagcacaaggtccccctcgttaaacttgcacgaacgtaccttcttgtcaaacgcgttttttatccttcgttgatacagacacccatggctcatggccgtcaaacgcttaccttcaataaggttgagttggtcatagcgtga

SEQ ID NO: 535 - DNA, 49 bp, Glycine max
  Peptide Sequence Number=SeqID_92220
ggtgaatgttgtgaaaattttcccggacgcccaaaatggactcggatga

SEQ ID NO: 536 - DNA, 399 bp, Glycine max
  Peptide Sequence Number=SeqID_92221
atgaagacgaagttggtgtttgctacccgtgatgatattttgaattggactcgagctgttgcttatgaaattggttttgtggcattcattatgaggaaaccagtggttggaggccaaagatggatggtgaagttaatgtgtgagagtcacaatcatgaatcggtcaagtcattagttggacatccatacgttgatcgattgactaaggatgataagattattattgttgatatgacaaagtcaatggtgaaactaagaaatattctgctaacacgaaaggagcacaatgtaaatagttatacaacaatcaagcaaatatacaatgcaagaaatgcatatcattcttccataagagacaatgatattgaaatgcaacaactaatgaagcttcttgaatga

SEQ ID NO: 537 - DNA, 651 bp, Glycine max
  Peptide Sequence Number=SeqID_92222
atgtcccatcttttggaatttgggatgaccggccctctcaatgagtcaatctcttgctttctcaaaagggtggacccttgggtactagtaccctcaccttccgaggactacacgtcctcaccttcagaaggctacacgccctcaccttcagagggctgcatgccctcgccttcaggggactacacgtcctcgccttcagaggactacacgtcctcgccatcagaggagaacacgttctcgccttcagaggactacacgtcatcaccatcaaaggactacacgtcctcgccatcagagggctgcacgccctcgcctttagagggctatgcagcctcaccttcagagggatacatgcacgccctcagaggactacgcgtcctcaccttcagagggctacatgccctcgccttcagagggctacacgccctcaccttcagaggactacacgtcctcacctttagaggactacacgtcctcgcctttagaggactacacatcctcgccatcagaggacaacacgtcctcgccttcagaggactacacgtcctcgccattagagggctgcacgccctcgccttcaaagggctacgcatcctaaccttcataggtctacatgcacaccctcagaggactacgcgtcctcacctttag

SEQ ID NO: 538 - DNA, 447 bp, Glycine max
  Peptide Sequence Number=SeqID_92223
atggggatcactttgacattttgtccttccgtcatctttgccttccctttagcgtttgcggtcaggtcagggggtgtgaacacgcgaccggtgtgggtcatgccgctcagccccatgatattggttactttggccgacagtgagcttatgtcggtggctccttccttcctttcgcttagagggcgtttggggagctgtgtctctggtcaaatgtatcaccaaaggataaggctttctaagaccttcctcatctgcggattgcatgcatatgtgctgcttttcacccccctcatcgctgacttccagccggccttggtttatcatttgttgcaacagggcctcgtagataaaccttctcggggtcgccacgtccttcaaaggtttggacctgcgcggtctacccaaattgacggcattaaccgctccccctccatgattgacaagcgg

SEQ ID NO: 539 - DNA, 381 bp, Glycine max
  Peptide Sequence Number=SeqID_92224
atgggatattatttctaccaaccttctaaccataaagtgtttgtggcaagaggagcaacctttttggaaagagagtttcttgtagaaggaaaccatggtaaagaaattgaacttgatgagactcaagtcactaatgataacataactcaagaacatgagatggaaactaagagacctttctttgatgttttgaaattaggacaaagctcttcaactcaaacgattattgctcaagaactagctattgttcaagaacaagtcgttgttcaggaagaagttaatgaaccaatcttagaacaattgcaacaacctttgaacccaacacaagaacctcttagaagatctactcgaatgcattgtgcacctaataaattaaactga

SEQ ID NO: 540 - DNA, 777 bp, Glycine max
  Peptide Sequence Number=SeqID_92225
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggtgcgtaacggcaaaagcaccccccggacatcagcgctggcaagtgtagcgggtcccgctgcgcgtaaccaccacacccgcccccgcttaatgcgccgctacagggcgcgtcccattcgccattcaggctgcgcaactgttgggaagggcgatcggtgcgggccctcttcgctattacgccagctggcgaaagggggatgtgctgcaaggcgattaagttgggtaacgccagggttttcccagtcacgacgttgtaaaacgacggccagaattcgatctgaggtttacgttgataccggcttcacttgtttgcaaaaagctacaccaaaagcaatcatgcggaccatgaatgtcaagggtttgactctgtttcatttgaagagtcatcttcagaaatacaggcttggtaagcaatcaagcttatcgataccgtcgacctcgagggggggcccgtcggggaaacctgtcgtgccagctgcattaatgaatcggccaacgcgcgggggagaggcggtttgcgtattgggcgctagcggagtgtatactggctttactatgttggcactgatgagggtgtcagtgaagtgcttcatgtggcaggagaaaaaagctgcaccg

SEQ ID NO: 541 - DNA, 1164 bp, Glycine max
  Peptide Sequence Number=SeqID_92226
atgctggccgatgcccgcgaaaacggcgcaggcatgacctacctgtgtgaccacagcgctggttccggcaagaccagcaccatatcctggacggcccatgacttggtgaaactgcgcgaagataacggcgatgcggtatttaacagcgtgatcattgtcaccgaccgcaatgtgctggacggccagcttcaggacgcggtgaagcagattgaccatcagtttggggtgatcgccgccattgaccggcagaagtcatccaagtccaagagcaagcaactctcggaggccttgttgtctggcacgccgattgtggtggtcacgatccagaccttcccctacgcgatggaagccatcatcactgacaaggccctgaaagggaaaaactttgctgtgatcattgatgaggcgcataactcgcagacaggctctaccgccgctaagctgcaagccgcgctggggatgagtgggcaaggcaagatgtccaccatgacggtggatgaattgctggaacaactgcaaaaatctcgggctcgcccggacaatatcagctatttcgcctttaccggtacgccgaagcactccactttgatgctgttcggtcgcccaacagacccgagccagccagcctctaacgataaccctccacaagccttccacctgtacaccatgcgccaggccattgaggagaaattcattctcgatgtgctgaaaggctatgtgccctacaaaacggccttcaacctttccaagcagcttgaagacagcaagcgggtaagcggcaaggccgccaaacgcgccctggcacagtggatgtcattgcatcccaccaatgtgacccagaaggtacagtttatcgttgagcacttcaccaaaaacgtcgcccaccggctggatggcaaggccaaggcgatggtcgtgaccagctcccgcgccgctgccattcgctacaagaaggcgtttgaccgctatatcgagcagcacagcgagtacggctttattcattcactggtggccttctccggcaagatgaccggtaagcaggtgatgcaccaggatgacagcgagttcaaggatgatgtgtttatcgtcgatgagaacgaagagttcaccgagcagagcatgaacccggatgtccaagggcaggatttgcgctttgccttttga

SEQ ID NO: 542 - DNA, 243 bp, Glycine max
  Peptide Sequence Number=SeqID_92227
atgaccggccccctcgatgggccgatcgcttgttttctcataaaggtggacccttgggtaccagtacctatcacctttagaggaccatatgtcctcgccatcagaggactgcacatccttgcctgcaaagagctgcacgccctcgcctttagagggctacgcgtcctcattttcagtgtgctccatacccacaccttagaagaatataagggatcgcgcccacaagacgcccagtgggcctga

SEQ ID NO: 543 - DNA, 1079 bp, Glycine max
  Peptide Sequence Number=SeqID_92228
ctgagagcgaagtcgccgcgccgctggcggcgctgcgcgctgaaattgaccagccgcaggccgatctcgacacgctgatcgccgcgctgtaccgctttatggatgaagatcgcaaatccaccgcactcaaggctttgcagggcatcatctggcgcagcggttaccgcgaaggggacttccgcgggcatctgtatccggaagtcgcggggcagttggctgcctggcagcggcagggggtgaaactttacgtttattcctccggttcggtggaggcgcagaagctgctgttcggccacagcgacgcgggcgatctgcagccgctgttcagcggctatttcgatacgcacgtcggcgccaagcgtgaaaccgcatcgtaccgcaacatcgcgcaggctatcggcatcgcgcccgaagagctgctgtttttgtccgacatccaccaggagctggatgcggcgcaggccgccggctggcatacctgccagctgatccgcgatgacgcggacgatcagagccggcatccgcaggttaaccgttttgatcgtatcgatttaggggacgatacagcgccgcagcagccgctgtggcagagccgcgatgcgcaggagatccagcggcagttggcgcagatcggcgtgcgctttgagcgctggcaagcggatcgcgagctgggcgacaacccgcagccggaggcggtgatcgccgcctaccagcatgagatagaccgactggtggcggaaaagggttaccagagctgggacgtgatcagcatgcggccggaccatgagcagcgccaggcactgcgtgaaaaattcctgtccgaacatacgcacggcgaagatgaagtacgctttttcgtcgaaggcgcagggctgttttgcctgcatctggacggcaagatcttccagatcctgtgcgaaaagaacgatctgatctcggtgccagccaacatccggcactggttcgatatgggatcggccccgcatttcaccgcgatccgggtgttcgacaacccggaaggctgggtggcgcatttcaccggcgacaagatcgccgatgcttatccgcgtttggactga

SEQ ID NO: 544 - DNA, 771 bp, Glycine max
  Peptide Sequence Number=SeqID_92229
atgagcaaaatcgcgctgttgtttgcgatgcttgtttctatgccgatgatcacggcctgcagcgccagcgagcaggtacccgaagcgccggtagttaaacagcaattattgggttcgccggtctatattcagatcttcaaagaggaacgcaagctggaattgtatgccaaaatgggcaatgaattccgcctggtcaacacgttcccgatctgtaatttctccggcgggctgggtcctaaacgccgtgaaggcgactttaaaagtccggaaggcttttatagcgttgacgcgcgccatctgaaacccgacagcaagtattatcgggcgatcaatatcggtttccctaatgattacgataaatcgcagggctattccggcgcttatctgatgatccacggcgaatgtaaatcgattggctgttacgcgatgaccaacacctatatggacgagatctatcgctacgtcgaagccgccttcgcctatggccaaagccgcgtcaacatcagcatttacccgttccgcatgaccgagcaaaacctcaagcgccatgcatcatccagctatatcgccttctggcgccagctgaagccgggctacgattacttcgcgaagaaccaccagccgccgacaatgggcgtggtcaatggccagtacgtcttgggtcaaccgctgatgagcagcggcggcatgatgacgcagtacgcgtcagccagcccgacgcccaacaccaatcccttcgctcagaacaagccgctcaccgaagtgaaataa

SEQ ID NO: 545 - DNA, 690 bp, Glycine max
  Peptide Sequence Number=SeqID_92230
atggccccgaggaagcttgcctcaaagaggtccaggaaggacaaggcagccgaaggaactagttccgctccggagtatgacagtcaccgctttaggagcgctgtacaccagcagcgcttcgaggccatcaagggatggtcgtttctccgggagcgacgcgtccagctcagggacgacgagtatactgatttccaggaggaaatagggcgccggcggtgggcgtcactggttactcccatggccaagtttgatccagaaatagtccttgagttttatgccaatgcttggccaacagaggagggcgtgcgtgacatgagatcctgggtaaggggtcagtggatcccgtttgatgccgacgctatcggccaactcctaggatatccgttggtgttggaagagggccaggaatgtgagtatggccagaggaggaaccggtctgacgggttcgatgaggaggccatcgcccagctactatgtataccggggcaggattttgcccggactgctgcagggaggcgagtgcgaatcatgcgcaccaacatgaccaccctgacccagatatggatgacgttgctcctcagctcgcccaggcgagccaggttgcttcctccagaagcaacagccttctggaggaatattctggagggcccaagtgggcctgggttctatttgcacccccatttttactaa

SEQ ID NO: 546 - DNA, 234 bp, Glycine max
  Peptide Sequence Number=SeqID_92231
atgggagagttgatttgcgccatcgcccgatcgccacctagtaccacatatgacggagtggtacctggagatatgtcgcgggggtcaggagaccttggggacgtcaggtggggtgctattgcccaaaaccaagcttggctaatcccgacccaacctgggcatagtcagtcagtgagaacctgtgacgtacctaaacaggcgagctcctggcagtcaaccaataaaagaacatag

SEQ ID NO: 547 - DNA, 351 bp, Glycine max
  Peptide Sequence Number=SeqID_92232
agaagtactgcacgtttagacaggcacagggtggcgcaccgcaggccccagacgcaccgctgccacctcattaggttgatccagctgggtcatttgacacggagcggtatttacggcatttggttcgccagcaggcggccaaccacagggtgcatgtgcagacccatgactgtctctaccagctcagcctcagtctgcagagccagggtttcgctccttttccgtgccctactccagattggttcagggcagaggtcgcatggcccaaagattggcctgaggcctaggccggggaggcgcccgcagtggctcccggcgatgcagatgaggcccgcatggacgaggagatga

SEQ ID NO: 548 - DNA, 261 bp, Glycine max
  Peptide Sequence Number=SeqID_92233
atgggtgaccaggaggagacacaggaacagatgaaagccgacatgtcggctttgaaagaacaaatggcttctatgatggaggccatgctaggaatgaggcaattcatggagaagaacgtggccaacactgccgctgtcagttcgactgtcgaagcagatccaactctcctagccaccgtgcaccatcctcccccaaatacgctaggacgaggaagaaacacactggggcacaacaacaacccccatttgggatacaactga

SEQ ID NO: 549 - DNA, 470 bp, Glycine max
  Peptide Sequence Number=SeqID_92234
atgactacgggaaatccaggtgatttacaaccctttgatcttgaaagagatagaacctttcatagattagttaggcatagtgtgcatcttggccattctgttgagggtgattctaaatattctaattttgagcattccactactaatttttatactgagaacatggctcaacctccaccttgtgagaggactctaagggagatggatgcacctgatttcacttatgaaagcttgtgcattcaatatcctgatgagggtgtttcatatgttctgaagactggactaatacatttactgcccaagtttcatggtcttgcaggtgaagatcctcataagcatcttaaggagtcccatattgtttgttccaccatgaagccccctgatgtccaagaagatcatatctttctaaaggcttttcctcattcttttgagggagtggcaaaagattggctctactaccttgctcccag

SEQ ID NO: 550 - DNA, 489 bp, Glycine max
  Peptide Sequence Number=SeqID_92235
atggtgcatgataaactggttcttcaacaaggtgggcaactgaatgggaagaacagggaactggttcttcaaaaagacatcgaacttcaactctttgagacatgtcactctaaattgaaggacaaagaatccaaaactgaatccattgttgagaatctgcagcaaaatgtaaagctacagcatatgaagaatgacactacagaattgaagatggaagttgcagtcactaaacttgtgttacaaaatgcagaaacaaagcttagagtaacggtggaagaaatggaagcagctaatgcagcagaggcaagtgttgttgatcagattaaggtcttatctatgagaactagtcattctcattcatcaccttctgaacctggtgcaagaattacaatttcaagggaggagtttgaatccatagttcataaggttaaggagtctgataaattagcagatatcaaagtggttgttgccgcaacacagccactttga

SEQ ID NO: 551 - DNA, 228 bp, Glycine max
  Peptide Sequence Number=SeqID_92236
atggggtgtaataattggacccaaccttggcccatgggctcagaaatctaccctaaggttcatgagaaccctagggccttcttcagcagctctagcccaatcttcttggagcctcttgctcatggttctagtgattggtcccttcctaggaaggattgcatcagaattgaacatggagatggagaacttgacaagaagttattccatctagacaaatccagctcctga

SEQ ID NO: 552 - DNA, 279 bp, Glycine max
  Peptide Sequence Number=SeqID_92237
atggcgaagaacgacggaaaatctttacggaatcatccacggaaatatttcagaagcgttacggaagcacctcggtttgaattttctttacggaaacgcccttcccctatttatagggaaaaaagggtgatgcttgctgcccagctagcctcagcgagctctgctctcccgggcaagcaggaattttacggaagcattacggaagtcctgaaggcccgttttcataaaaaagagggaggtgcttgccgcccagctcgcccaggcgagctggttgcttag

SEQ ID NO: 553 - DNA, 375 bp, Glycine max
  Peptide Sequence Number=SeqID_92238
atgggtgatcaagaggagacacaggaacagatgaaagtcgacatgtcggctctgaaagaacaaatggcttccatgatggaggccatgttaggaatgaggcaactcatggagaaaaacgtggtcaccgctgccgctgttagttcggctgccgaagcagacccaactctcctagctaccacgcaccatcctcccccaaacgcggtaggacgagaaaggagcacactggggcacaacagcaacccccatttgggatacaaccgggcagcttacccttatggattactgcctaattacacgccgccagtcatgcaagatgatgcaggtcatatctcttctcccatccttgaaggggagcctcctcgacaacccgacgag

SEQ ID NO: 554 - DNA, 210 bp, Glycine max
  Peptide Sequence Number=SeqID_92239
atgggggtgcaaatagcaatcaggcccatttgggccctccagaagattcctccagaaggcggttacttctggaggaagccaccttgctcgcctgggcgagctgagcttgcctgggggagaagtgaagaggaatttcgttcacccctcctgattttcagccgttcttctatgttcttcgttcgttcttcatcgttcttcggtcttcaaccg

SEQ ID NO: 555 - DNA, 171 bp, Glycine max
  Peptide Sequence Number=SeqID_92240
atggagcggtatctacaacacttggttcgccaacaggcagccaaccaccgggggcagatcagtttagggctgaggtcgcatggcccggagattggcccgaggactagacggaggaggcaccagcaggagctcccgatgatgcagaggacgcccgcatggatgaggagatga

SEQ ID NO: 556 - DNA, 618 bp, Glycine max
  Peptide Sequence Number=SeqID_92241
agggcacacaccttccccttcagaggactacacgtgcgcgccttcaaaggattacaggtcctcgcttttagaggactacacgtcctcaccttcagagaaacacacatcctcgccttcagaaggctacacgccctcaccttcagaggactgcacgtcctcgccttcagagagctacacgccctccccttcaaaggactacacgtcctcaccttcagaggaacgcacatcctcgccttcagactacacgtcttcgccttcagaggattgcaggtcctcacttttagaggactacacgtcctcacctttagaggactgcatgtccttgccttcagagggctacacgccctcacctttagaggactacgcgtctttgctttcagaggactgcaagtgctcgctttcagaggactacatgtcctcaccttcaaaggacctcacgtcctcgccttcagagggctacacgccctctcctttagaggactacacgtcctcgcctttaaaggactgcaggtcctcgctttaaaaggactacacgtccttaccttcagaggaccgtcgtcctcgccttcagagggttacacgcccttaccttcagaggactacacgtcatcgccttaa

SEQ ID NO: 557 - DNA, 727 bp, Glycine max
  Peptide Sequence Number=SeqID_92242
atgaggacattgtcgcctttgaaggcatgcaaagactgaagacattgtcgtcttcgaaatattaccgtatagggcatcttcgcatgctacctgacttctcacaagtcgggagacgagtcttgtgcatcatcggacttgaacatctctggatgacaaaggtaaaatctacaacaatcttcaacatgattagaagtggacgaccatcatcttcccgatatcatcggacttgttcatctctagatgataaaagggacttcgatagtctttggataggaagggtgtgggtgaccatatgttgtctccgcgcgtcattggacttgtcatctctggatgacgaaggtgcggataaccataaggtgtgtccgcgtgctactagaccctcaggtcacgatagcagaattgagactttttcgcggtctcggccggacgacgctaacatctccgagaaggataaccataaggtgtgttcgcgtgctaccggacccttgggtcacgatagcgaaattgagacttttttgcggtctcggccagaagacgctgacatctcaggaaagctgacgaaaggtgcggataaccataaggtgtgtccgcatgctaccggacccttgggtcacaatagcgaaattgatacttttttgcggtctcggccggaagacgttgacatcttcgggaaggatgcagatgaccatattggtctctgcgtgtcaacgggctcgtttgtctctgg

SEQ ID NO: 558 - DNA, 207 bp, Glycine max
  Peptide Sequence Number=SeqID_92243
atggagcttacatcagaggatacatctcttgtggatcaattcaagtggagggtacatccccctaggttgttcaaagagaacaagggagggtccatcccttgtggatctttacttgtaaaggattttacaaggttgaaagaaatctcaagaaccggtggttgcttggggactagatgtaaggcacgggttgttgccgaaccaatataa

SEQ ID NO: 559 - DNA, 49 bp, Glycine max
  Peptide Sequence Number=SeqID_92244
ggtgaatgctgtgaaagttttcctggacgcccaaaatggactcggatga

SEQ ID NO: 560 - DNA, 168 bp, Glycine max
  Peptide Sequence Number=SeqID_92245
atggaagttgctgatcccacttgcttaacttgctcatacctgctcaggaagtgtctaaaagaagatagatctcctccagcacaagccgttgcagcccagaaacgcaaattgctatataaccatggaggctgcacgagttctgtaccaagtccgggattgaagagttag

SEQ ID NO: 561 - DNA, 261 bp, Glycine max
  Peptide Sequence Number=SeqID_92246
atgaatgaaaaagtgaaggtttatctatggatgaatgctctcctagaacctaagcttttgaatcctagaaaaaccatgatttgttggcagcctaaccccattacaagcttagaaagtctttcggattcattttgtgaaaaatgtagacaaaggatcaagctgaatgttttgatgatgccaaaggatcacatgcttctcaaagctttattcaagacaaagaaattaaagatattcaagatggatgatcaagacagtctctag

SEQ ID NO: 562 - DNA, 314 bp, Glycine max
  Peptide Sequence Number=SeqID_92247
gccacacatatcttttaatactagacacctattcattgaatatagctttaccaagtaacacatgttccccgagagttcgatactcgattcttaccattttatactacttgcgcgatccagtgcacttgccgggttcgaacaacaacttatttaagcctgaaatcagaaatggaagaggagtttgggcaattctcaaagcttttgcatgtttagagatttctagagagagaaagttccaagttccagagagttttgagagcatttgttgtgcaaagactggcagagaactgagcttgaagaggaagccatcttga

SEQ ID NO: 563 - DNA, 657 bp, Glycine max
  Peptide Sequence Number=SeqID_92248
gagtccgatactagtccaaagaaacttcctgaaacaaatgaaagggggacgaatgattttgaccatgatctgttgcgtcaactgattaagagcctatatttcatgtacgacacacctgttgagtttaagtgggatggcagcaaatttgggctttcaaatgttgttgcttcattcttcttgacattctctgatgtaaatgaaatagtagctggatacaaatgtttgaacatatctatactacagttatggatgctgtttttggatgagtggggctcaactttgggtcatgcttctgtgtatggattccttgagccacaatcgatacacaatgcaaaggatcgacgtgctgaatatgttgatcatgctattattataagcagtgcaatgaagtcaacaaacacaactgcggatggtacaaataatccagcaactcctaagtggattgaagtcaagagccatgttcaaagcggagggtatgagtgtggctactacgtgatgcattggatgtggaacatcgtcagtgggggtttaaagaatgattggagcatgtggtttcttgatggaacgacgttagacaacgaaacaattacaacgattcgccagaaatgggcagcatatttccttaaagttcaaagcaatcaatgtacaaagtcttag

SEQ ID NO: 564 - DNA, 516 bp, Glycine max
  Peptide Sequence Number=SeqID_92249
atgggggatttcatcagcagactctccttccccgcatgtttgcattttagcgaagaaaacaccgagactttttcaagtctcacaagttatccagaactacgtaggtctgagttcctcattggaggatacgtaggagcaagagcctcgcttttgtcgaccacaccaccttttgttatccagaactacgtagaactacgtaggtctgagttcctcattggaggatacgtaggagcaagagcctcgcttttgtcgaccataccgccttttgtctaccatgactcaagagctggtagccgcgaagacgccttacgattatccgcacctcgtcattcagtgaccccaagtgtgattgacgagcagagaccaatatggtcatctgcgccttttccggagatgtcagcattttccgatggagacttttcaagtctcgcaagttatcaagaactacgtaggtctgagttcctcattggaggatacgtaggagcaagagccttgcttttgtcggccgccacataa

SEQ ID NO: 565 - DNA, 309 bp, Glycine max
  Peptide Sequence Number=SeqID_92250
atgaagtttatgattgggttgaaggatgtcgtaactatctttgggaagacccaaaagaaggcattatctgagacaaacatatggaagaaaaggcaagacaaaggatgttttgaaaagtcatcaagacctagttggcatgggtatacaagagcagctacatccgatatcgcaaggttggcaaacgtatttgcccccagcatgtcatacaatgtcaacaaaagagaagagaagtttttgtcaatgtctacggagtctaaaagtcccgtaaggatactcttcaaatatcaagagccttgtatccctcaatga

SEQ ID NO: 566 - DNA, 631 bp, Glycine max
  Peptide Sequence Number=SeqID_92251
atggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagtgaaaataagcgtagatccggggattcccgatataggtcaacctttcgaactgctgctgaatccacgggcaggccagagacaacctgcgaaatgggagcagctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctg

SEQ ID NO: 567 - DNA, 282 bp, Glycine max
  Peptide Sequence Number=SeqID_92252
atggataagagcttaaagaaggagaagatgaggggagggagaaggagagaaggagcacgacattttgtgcctcaaatgagctcttttttccatggcttattccctagtggatggtgcctcctttcagcttttctcctttatcttccgctgcatatccatggtgaaaaatcaccattgaaggacctcattgaagctcaaagagccagcctccatagaagcttcacaagcaagcttccatcaagtggtatcagagcacaagagcttcaagttggtgctccttaa

SEQ ID NO: 568 - DNA, 435 bp, Glycine max
  Peptide Sequence Number=SeqID_92253
atgacaccttcattattggagaatcacttggtggtggccatacccgggaaggttctccagccaccctaccccaagtggtatgatccgggtgccaagtgtgtgtaccatagtggagttcccggacacaatattgactcctgcatcccgttcaacgtgaacgccgtcgtagaggacgggccatcacggacaaagaggttgggagacgtggctacttctagacgcttcatctatcaatcactgcaagcggcgtgcatggtctcccgagatggagatgaaagggatgaatgtttgtttcacctcggggagtcgcatgacatggaaacctgtcccgtggtggaagaattgcttcagcggctcatcccttgcgggcagcttgaagtgttcataggagggaaggaagaaccacaaatttgcatgcagtcggaagagaagaag

SEQ ID NO: 569 - DNA, 261 bp, Glycine max
  Peptide Sequence Number=SeqID_92254
atggtcattctgtgccctttgtcattcagatttcgcaagtcgagtgataaacacgtagagacaaattatggtcattctgcgccctttgtcattcagggacaaggtgatcgtgctggtggcataacgcagagacaaattatggtcattctgcgccttgccatcccaggctcgattgtgtccgagggcacgcagagacaaattatggttccgctggcagggagattgacatggccaaatggtgtttcactcgaacgaaattag

SEQ ID NO: 570 - DNA, 231 bp, Glycine max
  Peptide Sequence Number=SeqID_92255
atggcagcggaatggagaaggaagagagagaggagacgccacttcaaggagaagatgagtgtagaagaagctcaccaccataggaggccatggataagagcttggaggaagaaggagatgaatgaagggagaggaagagaagagcacgaaattttgtgctctaaaagagctctgaaatctaaacccactaatccaagatcaagtccaagattctccactaagtgtgcttag

SEQ ID NO: 571 - DNA, 84 bp, Glycine max
  Peptide Sequence Number=SeqID_92256
cgattctatggaaattcttcatcgttcttcgtcgttcttcatcgttcttcatccgttcttcgttcgttcttcattctttaacgg

SEQ ID NO: 572 - DNA, 213 bp, Glycine max
  Peptide Sequence Number=SeqID_92257
atgaatcctaagagaataaaggtctttcctaagtggcccactccaccaagtgttgcgggaagaagcccagagtttcaagaaactctggatttgaggtcaaatccttttgaaggggaaggaaatgatgcaatcctaccctcccaagggcattggatagaagactccaagaaaattgggccagagatgcaagataaggccctagggttctcatga

SEQ ID NO: 573 - DNA, 348 bp, Glycine max
  Peptide Sequence Number=SeqID_92258
atggaggctgacatggaggccatgaaagagcaaatggccgcaatgatggaggccatgatgagcgtgaagaagataatggaagccaatgcggttgcaattgccgctaccagcgttgttgctaaggtgaacctgatgtccccatccggcatcaaccaaatgaatcatccaacctcagatatggccactgaagggcaagcagttggtggtatacaccctacaaaaccctttggagggccctcagtatcactctccagctacacctcttgcattccacaacaagtaaaaaccctcatgctatggcagaaatggaaagttggatcatctagaggaaaggctcagggccattaa

SEQ ID NO: 574 - DNA, 812 bp, Glycine max
  Peptide Sequence Number=SeqID_92259
gactacacatcctcgcctttagagggctgcacgccctcaccttcagaggactacacgtccttgccttcagagggctacacgccctcaccttcagaggactgcacgtcctcaccttcagaggactacacgtcctcgcctccagagggctgcacgccctcgtcttcagaggactacacgtcttcgccttcagagggctacacgtcctcgcctttagaggactgcatgtcctcgcctttagaggactgcacgtcctctccttcagaggactacacgtcctcgccatcagaggactacatgtcctcgccttcagagggttgcacgcaatcgccttcagaggactacacgtcctcgccttcagagggctacacaccctcaccttcagaggactacacatcctcaccttcagaggactacacgtcctcgccatcagaggaccacgcgtcctcgcctttagagggctgcacgccctcgccatcagaggactacacgtcctcgccatcagagggctgcacgccctcgccttcagagggctacatgccctcgccatcagaggactacacgtcctcaccttcagagggctacactccctcaccttcagaggactactcgtcctcgccttcagagggctacacgccctcgccttcagaggactacacgccctcgccttcaaagggctacacgcccttgccttcagagggctacacgccctcaccttcagaggactacacgtcctcgccttcagagggctacacgccctcgtcttcagaggactacacgtccacatggttgcgtgcatgaccagttttgtataa

SEQ ID NO: 575 - DNA, 256 bp, Glycine max
  Peptide Sequence Number=SeqID_92260
atgcatagatctcccactggcaatttagttcctctggacttagaaattgagactacattgcgaaggaacagagccgagaggagaaggaaacttctgcaagacagaacagttgcatccattcttaaggaagagattcatttctctgacttattatcacctgattcaccatcatcaagggaatccgccactcaattgcctaaagtcattaccatggcagaagagcatgaccagaggattacccttgaggattactcaa

SEQ ID NO: 576 - DNA, 429 bp, Glycine max
  Peptide Sequence Number=SeqID_92261
agtcgattgggaccaacacttcgctgggataagaggcaacacaatcaattggtttcctcgatggaaggaaggaaatgagggagttcttttctcatgtggggactaccctaacgtcccgttgatagggacgaggggttgtattaactataatcccgcacttgccataagacagctagggtaccccatgaggggagcgccaatggaggagagcctctcgcctttccttgtgagagatttcggcgcgcaaagtctcaaggttgtacaaagagtccacaaggtgtggagaagtccgttgaggaaagataaagaacttagtggcatccgtaatggcatcatcagtggttatcatgaatggctaagagttcatacgcgagggttagattggctctccaagttgaaagttatcaattggcgcttttacctcagtag

SEQ ID NO: 577 - DNA, 534 bp, Glycine max
  Peptide Sequence Number=SeqID_92262
atgtggagccctctgaaagcgaggatgtacaaccctctgaaggcgaggacgtgtagtcctttgaaggcgagggcgtgcagccctctgaaggcgaggacatgtagtcctttgaaggcgaggacatgcagtcctctgaaggcaaggacatgcagtcctctgaaggcgaggacatgtagccatctgaaggcgaggatgtgtagtcctttgaaggtgaggatttgtagtcctttgaaggtgaggacatgtagtcctcagaaggcgaggacgtgtagccctttgaaggcgagggcgtgtagccctttgaaggcgaggacgtgtagtcctttgaaggcgagggcgtggcatcctttgaatgcgagggcgtgcaaccctctgaaggtgaggacgtgtagtcctctgaaggcgagggcatacaaccctctgaaggcgaggatctgtagtcctctgaaggcaagggcgtgcatccctctgaagatgagggcatgtagccctctaaaggtgaggacgtgtagtcctcaaggcaaggacgtgtag

SEQ ID NO: 578 - DNA, 732 bp, Glycine max
  Peptide Sequence Number=SeqID_92263
atgtcttccagaaaaagaaagagcattggtgcaaggcccacaactcaatatgacacaagaaggttccattcctttgaggcctggaccagatatacggaaaatgtgctaggaagacatatactagctaagaggaaggtagaaatataccatacggagttggatgagttcatggctgaattagagaggcgtaacttccataagcgcctcatcaatttagctgacagccatcctgggaagatcctcaggaaagatctaacaactcttactcaggtttggagtgttctctcatactccaacctggctctgacttcccacaccttggatttgactgtagatagagctaggttaatctttggtctagtctctcagctggacatgaatgtaggagctctcatctctggccagatcacatctatgacccagtctaactcctctagacttgggttccctgctcttatcacaactctatgtaggtctagaggggttgcttatgacagcctggtcttcgaacgcctgagcccgatcattaacttggcctacatcaggaagaactattggaatctcgacgatctaacagtttctatccgaggggctaggagggcgagggcaaggccaattgagcttccttctacttctgcagctcctactccagcattcacttcagcatccccttctgtcccagctcagtcaaattctcagcgctttgaagccatgcttcaaagcattcattag

SEQ ID NO: 579 - DNA, 1195 bp, Glycine max
  Peptide Sequence Number=SeqID_92264
atgacgaagaggagtgctgaaacgtctcgagctgacatgagacccaagaaacccactagggtgaaaatccaagaagggaaacaagaagagaaggaagaagaggagagacctcttataagaaaaagaaaattacctacgacttcgaccaagtttgctgaacaaacagagacaggcaattcccaggctcaagtgcctaagaagaaaaagaaagtgaagcaggtcgagcctgaaccttctgtggctgtcgagggtggtgagccagccaagaagaaaaagaaaaagaccaaatcttcaaaagaacaaggtgaccatcaacctgttgacgtccaaccaccttcgaccgatattgacggcactgaggtagaagctgctccttctattgctgagatgggcaaccctgtcgagcaaccgaactcaccacaagaacaacctaccgtcgaggtgcaacaaaatgtttctgcagaagaaataccctcatgtgcgcgaacatctcccactcctgaggcggatgcagtgaatgttgagaaatggggtgaaggtcaaggcattggatccagtagtcctcatggttgggcagaggtcgatgaccctcatgagccgaaccagtcagataataccattcctcatgaatcgagtcagaaaagttcatccgaagaaaactttttcgatgaagacgccataaaagaggctgaagctggaggctcagacatttacccggtgtcctcaacatctaaactttccgctagcatagggatcgcagaagatacattcattcaaatgcaaaatggagaccctgctgcagcccttcgactcctgctgaacacaagtcaagccaacacctcaagtgaaaagattcctggtgcttcgtcctcatctgatgctgaaataaactcttcagtacgccaagattctctgctcttgaagttatcaacggaatacgcacggaaagatgtgcttaaatccattgaagagaacccctctgctgcctttgggcacctgaactttttgaagaaattgcacaacccccttacctctgatgagactctaggcaaagttatccaaatcgaggccatcattgaccaatttgcaagtactgtgcagagaaaacgcgaaaatggcacaagactagatgcccagaaacaggcacatatccttctgctcgagaaagcccgagctgctcaacatgaagtcgaac

SEQ ID NO: 580 - DNA, 525 bp, Glycine max
  Peptide Sequence Number=SeqID_92265
atgagtgatgcaaatggtgagatagaacctagtacgaatagagtggagtgggagttgcgggtccttgtttgtagggactgttacgacaattcagtggcggtttcaaggcccggctaccctgggcaattgcccaggctctggctccgccactggtctgaggaccaagcagggcaagaactgaagcttccagacttgttgaacagtgatgctgttagagaaatccatgctaatatcgaaaaagaatgggattttcttcaaaggtcagcttgccaaaccgctgcgggaagggctctgtggaagcatgccatccatgatccactggctgacttgctggcaggggagacttacttgagaaacctccatgaaaagatcaagaaagacattctcaacaatgctcgcgaaacttccggagtcattcttgccgttcgaaccctttggtttgattctagactagaagatgcccttaattccactaatagcagagaagcacaggttgttctccttggtgcaggtagggggatctag

SEQ ID NO: 581 - DNA, 378 bp, Glycine max
  Peptide Sequence Number=SeqID_92266
atgcgaggtgccgattccgtggcacgattcgattcacggctacttcattggtacatccaaaggaacccgcatgcatgcatgcttcagcgaactgtggagtggatattacctacacctactccatatcgactagtggagccagtccaagtgatagaggtgtcgtcatttgaagaagaccctgaggaggacccagaagagttacctcccgagcctgctgtggacgctcttgactttccagagggtgatgaggacccactccctgttgtggattcttcggaggacgtcatgtcagcatctgaggcagactctatggaggagagcgaccctggagggatagcgactagtggagactcttcatcatggcagacggctccttag

SEQ ID NO: 582 - DNA, 255 bp, Glycine max
  Peptide Sequence Number=SeqID_92267
atgaaagcaccgatgaagataacccacatcctcttcaagttgggtgatgcgtgtatccataccatcaaagcgaccatccaaggaatcaaatcattcaccaacatagggctgaggaatcatcttgttgaggaggaggagaaggagtacgctcatcttgtggaggtagagtgtccttcttcagccattgccaatcacgatccttacgataaccaaatgaagttattgcaccagcacctatggaaaaacatctcttga

SEQ ID NO: 583 - DNA, 2481 bp, Glycine max
  Peptide Sequence Number=SeqID_92268
atggacgagttcgccggattgagatccaacctcgccgacgttggaggaactgaagaaaggttgaatcaatggaatgagatcaaattgaagaaagaggaagaggataaggtggagcttgtttgtccggcaacaagtctcaccaaggcaacaagcctctacaagcttagacgcagtctcaccaaggcagcaagcctctacaagtcttccttaaagaagacgcctgcatgcgtcagtatcttcaagacctttgatcacttggagctagaagagtatggagttctaagtgaatcggttcaatcatggaaagatttttgtggcttgcatatgccactggtttgtccagatggcgctgtgatcgcttatgcgtggaagaaagctggagttgctgcatatgatgtccaacgttatgtcaaggaatcagattgggctgcacaatgcacaaggcaagataaaatgtcaaatgaagaattgaagctgcaggatccacgatttttgggacttgagtgttttgtgagccaccttgatgttaccctaacatcaagtgttggacctgagtgtgtagagttgatctctatagtttgtgtagagttgatctctatagtttgtgtggagttgatctctattgttcagagagcaatctctgagtggctcttaggtagagattgcacgggtagtgatgtaggtgacgttgcaccgaactgggttaacaattctcttgtgttatttacttgtttaatctgttcatacggtcatatacaagctgcatgttctgaagcgcgatgtcgtgacatcctgacgctaccagatgttctgaagtccttggagaaggatgttccaaatttaaaaattttaacttttgaacgattggattggttgaaaagagcttccacacttacctcatcaacaaatgagagttctttggaacataactatcatggttctaataagctcaggctaggatcagtgggaactgttgctgcagagaaggttgcaatgatagaattgttattcccatctatcttcagagctgttttatcctggcatcctgttggttccatggatcctgatgctgtagctttctttgctctagatgaggttctatcaagtcaaaatcaagagcttagaggtcgccaatttgtgagaattggggcaattgatgggtcaactccaacgtcaagccttccgcaaggcctatgggaagatttgggacctagctatgatagaaatctctgcggaagcaattgcatcccttacccattagtgccgactgtggaagagtttgaagaaatcctgggatgtccgctcggagagagaaagccatatctctttttggggttctatccctccatggcaagagtagcaaaggcagttaaaatctcgatgcaagagttggatcgtgtgaagcaaaataggaacgaggtagtcggaataccaaggaaacatttggagggaaaggcgaaggcattggccaatcaaggagaatgggttctgtttattgacacctttgcattgttgatatttggagtcgtcctctttccaaatttggaagggttagtggacctagtagctattgatgctttccttgcttatcaccatagcaaggaaagcccgaccatctctattttggccgatctctatgacacgttcgaccgaagatgcgaaaagagcagtgcttgctgtacaccagctctctatggaaaggcaaactgggagcaactcttggctagtgtggcaggggcatcaatcaattggttcccccgttggaaggaaggaagagctggagttttgttctcatgcgagggatttccaaatgttcccttaatgggaacaaggggttgtattaattataatcccgccctcgccttaagacagcttggctaccccatgaggggagcaccatcggagggaagcatcatgcctttcatcgcacagggttttagtgaccccaatccgagggataaagagcttagaggaattagtaatggggtcatcggcagctatcataagtggatgagagtctggacacaagagttggattggctcccaaagccaacggctgcaagagaggaaggggctgcagctccggaagaaagagctttatggggcagcaacaacgagcttaagctccgaagagctgaaagggatcagtcgtgggtcgaaggaatgatcttgaaagatgagttaaaagcttgccataggtcgaaaagaagcttgtcccagcagttgagcaagaccaaagggaatatgtgggccaccatcgacgagtacaaagaaaagctatacctagcagtgactcatgagcaaaagcaagaggaggagtacgccaaggtatcagtcttgcaagtgaaaagggaagcaaaggaaagggtgatcgattcattgcacagagaagcaatgatgtggatggacaaattcgcctttactttgaatgggagtcaagatcttccccgactactagccaaggccaaggcaatggcggat

SEQ ID NO: 584 - DNA, 240 bp, Glycine max
  Peptide Sequence Number=SeqID_92269
atgtgtcaactatgcacaggtggccttgttggggtttgtgcgcttagcgcaactctggctcacttagcatgcattagtgaattttggcttatcgcacgtcttttcgctcaggggatggactcaagcggtgcacttagagggattagccctcgctcagtgaacatgcatagctcatccttcttccagattcttcctcacgctcagctgcaagagtggtgcgctcagcggatggctcgctga

SEQ ID NO: 585 - DNA, 216 bp, Glycine max
  Peptide Sequence Number=SeqID_92270
ttgaaccaatctcagacttatcaaggtaatccttgtggcgtctgtccagacttatcttccttcaccggaagtggcgtctaccctaacttatcttccttcactggaagtggcgtctacccagacttatcttccttcaccggaagtggcgtctaccctgacttatcttccttcactggaagtggcatcatccaaatcttcgtagcctgtatcaagtga

SEQ ID NO: 586 - DNA, 618 bp, Glycine max
  Peptide Sequence Number=SeqID_92271
atgaatgcatggagccaagctggattcttggaaaaatgcaaggaaatctacaataacatgttaaaatctggtgtgaagccggatggacatgcttatagtattcttgctaaaggttatgtgcgagcacaagaaatggaaaaggctgaagaactgcttactgtcatgactaaatcaggtgtccaaccaaatgttgttatatttacaactgtgatgagtggatggtgcagtgttggcagaatggacaatgccatgagggtttttgacaagatgggtgaatttggggtttctccaaatttgaagacttttgagacactaatctggggatatgcagaagcaaaacaaccctggaaagcagaaggaatgttgcaaataatggaagagtttcatgttcaacccaagaaatcgaccattttgcttgttgcagaagcttggtgttttgctggattgaaagaaggggcaaagacactactgattactgtaaaaactgagaagatgatcaattcaatagatggagacaacaatataactgctaaaatgtcagagaaaatttgccaaaagccacatactaatgctcctttttgtagtctcttaaaagacttcatctatatcttccactga

SEQ ID NO: 587 - DNA, 312 bp, Glycine max
  Peptide Sequence Number=SeqID_92272
atgctgactgatgagttggaactaagggtagagcctttagctgtcaaggctgtcaaaaacgaccctgcaggcacaaccgaagtgctcatccaatggaaagatttactttactttgaaactacatgggaatcggttgatgttatgaagcagcaatttcctgcatttcaccttgaggacaaggtggctctcttggggggaagtattgttaggttaccaattaagcaagtgtatgaaggaaggacacatgacaagtataagaggaagtcagagcagcatctaaagcagccagaaccaggattagtagctgactaa

SEQ ID NO: 588 - DNA, 129 bp, Glycine max
  Peptide Sequence Number=SeqID_92273
atggataagagcttgaaggtaggagaagatgagtggatggagagggagagaaagagcacaaaattttgtgcctcaaatgagcccactaatccaagatcaagtccaagattctccactaagtgtgcttag

SEQ ID NO: 589 - DNA, 339 bp, Glycine max
  Peptide Sequence Number=SeqID_92274
atgtttgcacattcgattaaaggctgtcgtcccttgggacgggcgtgtggggtgctaataccttccccatcgcgtcttttccggtttttccgacgttttcctcaaataaacgttggtggcgactccgcgcgtattcctttcgtggaacacgcatcccgcgagtcacgcgtcgccctcccgccgaaggattgtcttcttcgagggtggataattggaacactctctgaggaagcacttggactcgttgttggcttagacactgcccatcctatttggactacacttaaatatttatatgcggaagactcgcaagaacgtggattcacactccgtcaatag

SEQ ID NO: 590 - DNA, 261 bp, Glycine max
  Peptide Sequence Number=SeqID_92275
atgagtgaccaagaggaaaaacaggaacagatgaaagccgacatgtcgtctttgaaagagcaaatggcttccatgatggatgccatgctaggaatgaggcaactaatggagaatagcgtggccgccgctgccgctgttagttcggctatcgaagcagacccaactctgccatctaccgtgcaccatcctatcccaaacgtggaagtgatcctaggtcgtttcccaacgagtaatcatacaccaaatgttcataacaaatag

SEQ ID NO: 591 - DNA, 608 bp, Glycine max
  Peptide Sequence Number=SeqID_92276
atggttaagactagaggattaggccatgcgttaggtagggttgttgctagaggtctggggaaaggggatgatgatgattctgacgatgctccccagcgacgagtacctgtcattgttgacgatgttgtgcctgcagtacctgcggactcgcctgcggacaccggtccagagactgacgcacaggatattggtgcacaggatgctacagatgagcctgagggatttcctggtggacccagggacccatcagtgcttacggaatatcttgaccatgttgcagccagtgtatggtctggacaggaatgtcctaagttgaagttatcctcccatgggaggaaggtgcataacttgggcaggcctgttcctgcaattgaggacatggttgttgggataggattaagtcctttgatcgcatgttcgatagacactggcgatcggggacttatatcctcctttatcgagaggtggcaccgggagacttctagtttccatcttcctatgggggaggtttcgatcacgctggacgatgtcgcgtctcttccccatttgcctatcgttgttgcattccatgactttcagcctctacgcaccgatggggcgatggtgct

SEQ ID NO: 592 - DNA, 184 bp, Glycine max
  Peptide Sequence Number=SeqID_92277
gagcagtgcaaatagcttggtgacaggagatgaagcaatcaccaatgatcaaacacagcaaattgagcccaaagaaattcgattttcacctgagcaatacaaagctctacttgccttaatccagcaaccaagtgaagggaattcagacagatgcactcactcaagccaagattggtatagttga

SEQ ID NO: 593 - DNA, 414 bp, Glycine max
  Peptide Sequence Number=SeqID_92278
atgctgatctgcccttgtggaaggatcgtgcctacaagacacccagtggacttgaaggagtccaacaaggccctggggtttccagctttggttacgggcctttgtcagtcctaccgggtgcccgtccccccagcaaggtcatgtcgtcatgacatagggatcgcacccgcaagacccccagtggacccagagaagtccaacagggtcctggggtttctagctctgattacgggcctttgtcagttctatggagtgcccgtcgcccctaccaagggcgagacaccacagcagcctggggatggccggcagcgggcaatagacgcaccaccgccacctccagagcccctcagttcatctacaaaggctagagcgttgcctacgacccgtggccgaccagcaagagaccaagtctaa

SEQ ID NO: 594 - DNA, 384 bp, Glycine max
  Peptide Sequence Number=SeqID_92279
atgtacaactattatgagaaaggaagagctccttatcttgaaagtgtattggcagacttcatgacgtaccaagctagctctaaagaaggattgtctaatctggatgacctgctaatgcaattcaaagatattgtggattcaatgcaacaagcttttaaaagaactgaaactcagcttggcaagttggtagatgaaatgactaaagttgtggacaaaagagaagaagagtatgcaaagattgaagcacatcaagaaagtattcttcaagttaccacaatccatcatcaattgattaacgaagaagaaaaggatgaagcctccagtactccagataatccttgcatggcaactactggctatgttgtaggtacagataaaggttga

SEQ ID NO: 595 - DNA, 270 bp, Glycine max
  Peptide Sequence Number=SeqID_92280
ctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggaacttgtaaaaggaatttacaagatagtggaactctcaagcgggttgcttgggactggacgtaggcacaagg

SEQ ID NO: 596 - DNA, 1102 bp, Glycine max
  Peptide Sequence Number=SeqID_92281
atgtgggcatgggaacgctgcacgactttggctccaaagagaactcctcctataatggaaaacaaaccactcggacacaggtggctgcgacgtggaaaccaacatattggcaatgatgatctaatagttttccgtcgcaaattggatatcatgaaacgacatgagtttctgtgggagccttacacaacaactgttatgtcgatgttgcctcccatttgtttggttggcagtatggcgtggtgcgcagtggtgccactcatttgtttccatgttgtagagtggcaccaaccggatagagtgttgcgacaatttggaatgcaacaacctattccggagtctccttcgcaaccatggaatgtccacgggctaacactgaaaggcaaaatggatgaaaattggttccagctgttggccccatttatcagtcagtggaataatcaagctgagtttagggtcgacgtttatgctcgacaagagggcctattgagttttaactcggattacatggtgtggtataggcgcaaaacaaaaatgtttatcgacccaaacaatgcaaacacggctacattgggtgaagttaccgagacattgcagtatatggtgtcaccacaagggcgaaacacatggacagttgatgatctcgtgccatatgtggaaaagttagcgattttatcccaagagcaagagaggatcactgagcctgtggcacatggtccagcatcagagcgtcgatttcccccacaacagtttcacatgcttcagtcaagtgttgaaactcgaggttttgacaaacgaagggagattgttcaagcggaagatttttcccaacatatggagcagtgtggccatggaatgtattacacgccaccaacatttgctcagtatccttcgcagatgtatcagtatcctttcgaaggccatgacactgatatgtctgcaagcgaacattcgtttggtggtgttgcggaaacacaacctaatttttcatggccgaccatgaccccttcgcagcaacatgatgccccaatggcaacacctaatgccccattaggtcagcaatgggatgtacccggagcaatccctgcaatgggtgacttattag

SEQ ID NO: 597 - DNA, 507 bp, Glycine max
  Peptide Sequence Number=SeqID_92282
atgtttccaagatctccttctctgcctcttccatttttttgttggaaattgctcttggagggaatagaagagggatatgctgcttctagtgaagttgggcaggttcatttgcagatgaggaagatgctactggttgaggtccttgatactgcttttccgacctcaatccaattgtcccatctgattagtcaagctctgaatggaggctctggtctcttgttgaagctgcatgttttgcatagtcatttgcctcacaagttcttcaagggaaggaggaatgtatggtctacttggaccaacaacattttggaaggaaggagcaggctgctgttgttgttgttgttgagggcaagaccatctgagattagggtgattcctccatccgggattgtatctgttgctgcagaggtcataattgttctgctgtggttgattttgctactgaggttgaggaggttgctgcatagaagggcaaaggtctgtatggtggtcggcaaaggagcataa

SEQ ID NO: 598 - DNA, 468 bp, Glycine max
  Peptide Sequence Number=SeqID_92283
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcggctccctcgtgcgctctcctgttcctgcctttcgggtttaccggtgtcattccgctgttatggccgcgtttgtctcaatccacgccagacgctcaatttccgg

SEQ ID NO: 599 - DNA, 111 bp, Glycine max
  Peptide Sequence Number=SeqID_92284
gctcatgagaaccctagggccttctcttgcatctttggcccaatcttcttagagtcttctatccaatgtccttgcggggtaggattgcatcagcaagcgttcaggaaataa

SEQ ID NO: 600 - DNA, 276 bp, Glycine max
  Peptide Sequence Number=SeqID_92285
atgtcggtatttacatgcgattctcctcaaatttcagccagcccgcatcaattagaccttgcaccttacgcttcagagccctacaatgctcaatggaacgccccggggcttctccgtgacaagcacacgttgcgttcgagtcgtattctcgaagaaatggaggttgatgaaccttggctagggttatggctaccattgaattatcaaatagatatgggagcaagtcagcataggacactggaattggggtggtgtttgtcattggaagtgcggtag

SEQ ID NO: 601 - DNA, 243 bp, Glycine max
  Peptide Sequence Number=SeqID_92286
atggaaaaaatagcggaaaaccgaacaattatacaatatttgccttatgtaacacgttgggactatttagctactatgttcacagaagcaataactgtaaatggaccagaacagttgggaaatattcaagacccatgcttcgggcttccggaatacaatgggatctccgtaaagtggataattatgaatgttacgaagaatttgattgggaagttcaatggcaaaaagaaggagattccttag

SEQ ID NO: 602 - DNA, 399 bp, Glycine max
  Peptide Sequence Number=SeqID_92287
atgcaaatctcgtttagcgagcttgtctcgctaagcaggaatccacttttctcgctcagcatgcaaattcttgctcagtgcaacttcctctgcactatggctcgctcagcgggccaattcttgctcaacgcaattccctctcgggttgaaaatgtgcttagtgctcccttcgcgcttagcaagacatcaaaagttgttattttcaaaatcttaacagtccggctgtggagaaatgtcttaggaagctccagaaaaactttgaagacgatccaacggttaatgaatcctggatcacgattttactggaataggtttaggtgcaagtatcaacctaatgccctgtccatgatcaagcagataggagaagttgaaatcagaccaagaaggatggctttgtag

SEQ ID NO: 603 - DNA, 198 bp, Glycine max
  Peptide Sequence Number=SeqID_92288
atgggggtgcaaatagcacccaggcccacttgggccctccagaagattcctccagaaggcggggaggaagtgaagaaggaaagggccgaggcgcttccgaaacgtttccgtaacgttttccgtgaggaatctcgcaaaggtttcaaccgttcttcgacgttcttcattcgttcttcatcgttcttcgatcttcaacgg

SEQ ID NO: 604 - DNA, 768 bp, Glycine max
  Peptide Sequence Number=SeqID_92289
tgtcctctcgtactccaacttggcccctacatcacatactctgatctgacagtggacagagctaggctgatctttggcctaatctctcacttggatatgaacataggagtgctgatctctggccagatgacctttatagcccagtctaacacttctagacttgggttccttgctctgataactgcattatgtagggccagaggggttgtctctgacagccttacctttgagtgcctaagcccggtcattaacttggcctacactaggaagaactgttggaatcccgacgatccaacagtttctatccgaggggctagaagggcaagggcaaggccagctgagcttccttctacttttgcagctcctactccagcatccacctcaatagccccttctgtcccaatggtggcacctctagactttatccctacagtagagcagtttgataagatggtagcttggcccgggacccaaccttctcttcacagagaagacgaaggtcccacagcccaggtacctcagcatatggaggataagtcatctgaggccaccatcctagagccatttgatataggagaagaggcagaggagacacatatcagacagcggaatgaagaaaggaagagagagaggagacgccacttcaaggagaagatgagtctagaagaagctcaccatcataggaggccatggataagagcttggaggaagaaggagatgaatgaagggagagggagagaagagcacgaaattttgtgctctaaatga

SEQ ID NO: 605 - DNA, 614 bp, Glycine max
  Peptide Sequence Number=SeqID_92290
cgctggctggagcgctatcgcgagatggatttcattcagaacgtgctgaatgggatggcgagccgtcgcccgcgcctggaggcgctgcgggattcctggagaatcatatggttctggtaactcgtccggctccggattttacagctgcagcagttctgggcaacggtgaaatcgttgaaaacttcaacttcaaacagcacaccaacgaagcgtggcgtgaagtggttggcgtctccttcgactctgagtttgtacacaacgcatggcgtaacacccctgtcgacaaaggcggcatcggtgcggtgaaatacgcaatggttgcggacatcaaacgcgaaatccagcaggcttacggtatcgaacatccggacgctggcgttgcactgcgtggttctttcctgatcgacgcaaacggcatcgtgcgtcaccaggttgtgaacgatctgccgctgggtcgtaacatcgacgaaatgctgcgtatggttgacgcgctgcagttccacgaagagcacggtgaagtgtgcccggctcagtgggaaaaaggaaaagaaggtatggctgcttctccagacggcgtagcaaaatacctgtccgagaacgtatccagcctgtaa

SEQ ID NO: 606 - DNA, 405 bp, Glycine max
  Peptide Sequence Number=SeqID_92291
atgagatcgagtttcctcttttcttctactgccgggggtggccctcctgcggacaaagcccctcgacggggaccggggagtagaaatatatgtctccttgggcatgctctcgacgatcctcgtgaacctcgtccgactgtcgaggaggctccccttcaaggatggggggagggatatgacccgcgtcatcatgataggatggtacgcggtagctgggagagtgcttcggcagccgaactaacagctaccgcggtggccgcattattctccattagtggtctcattcctagcatggcatccatcatggaagccatttgctctttcaaagccgacatgttggctttcatctattcctgtacttcctcttggtcacccatcatcctagatttggatctcgtgcgatag

SEQ ID NO: 607 - DNA, 351 bp, Glycine max
  Peptide Sequence Number=SeqID_92292
atggtgtttttgaggtgctccagtggcttctgtttctatcagctgtcccctcctgttcagctactgacggggtggtgcgtaacggcaaaaagcacccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 608 - DNA, 513 bp, Glycine max
  Peptide Sequence Number=SeqID_92293
atggacatgaatctgggttacctcatctcccaccagatttctatcattgcccagcatgactcctctaggcttggatttctagcctttattgcagctttgtgtaaagctagaaaagtcacatcagattccagatctttggagagccttagccctgccattaacttggcatatataaagaagaaatgttggaatctagatgatccaacagtgacattcagagggccaaggaaggccaggggtaagagatctgaggcttcccctacttcagtagcaccaaatacttttgctccttctttacccgatccttctacagctcattccactactattccatcttcttctattgcagctcccttaccagctccatcactttctccttctggagggggtgaggccttagcagcccaagagcttatgccagtagaggagcctatgccagatgcagaggatgagcctgttcctcctgagccatttatctttgagactgatcagtcgctcaggaggaagcaatag

SEQ ID NO: 609 - DNA, 123 bp, Glycine max
  Peptide Sequence Number=SeqID_92294
atggcctccatcattgcggccatttgctctttcatggcctccatgtcggcctccatctactcttgtacctcctccactttaccctttactctagctctagcacgggtttggacatggggttga

SEQ ID NO: 610 - DNA, 1797 bp, Glycine max
  Peptide Sequence Number=SeqID_92295
atggagagtgcaatgagcaattaccctcacctgctggcgccgctggatctcggcttcactaccctgaaaaaccgggtgctgatgggatcgatgcataccggcctggaagagctgcccgacggcccgcagcgcctggccgcgttctatgccgagcgcgccgccgctggcgtggcgctgatcgtcaccggcggcatcgccccgaacgaacagggcgtggtttttcgcggcggttcgatcctcaacagcgaggagcaattgcctcaccatcggccggtcaccgaggccgttcatcgcgcgggcggcaagatagcgctgcagatcctgcatgccggccgctacagctatcagccgcacccggtgggcccttccgcgctacaggcgccgatcaatcccttcgcgccaagcgcgctgagtgaagcggagatcgagcagaccatcgccgacttcgcccgctgcgcggcgctggcgcaacaggcctgctacgacggcgttgaggtgatgggttccgaaggctacctgatcaaccaatttttggcggcgcgcaccaaccagcgcgacgatcgctggggcggcagcttcaccaaccgcatgcgcttcgccgtcgagaccgtgcgggcggtgcgccaggcggtgggcgcggaattcattctgatctaccggctgtcgatgctcgatctggtggaagacggctccagttggcaggagatcgaacagctggcgctggcggttgaacaggcgggcgccacgatcatcaataccggcatcggctggcacgaagcgcgtattccgactatcgccaccatggtgccgcgcgccgggttcagctgggtgacccgcaagctgatgggcaaggtcggcatcccgctgatcaccaccaaccgcatcaacgatccagcggtggccgagcaggtgctggcggatggctgcgccgacatggtgtcgatggcgcgtccgttcctcgccgacgccgcctttgtgcagaaagccgccgaggggcgcgccgacgagatcaatacctgcatcggctgcaaccaggcctgtctcgaccagatttttgaaggcaagctgacttcctgcctggtcaacccgcgcgcctgccgcgaaaccgaaatgccgctgacaatggcggagaaaccgaaaaaactggcggtgatcggcgccggccccgccgggctggccttcgccaccaccgccgccagccgaggccatcaggtgacgctgttcgacgccgccgagcagatcggcggccagttcaacatcgccaagcagatccccggcaaggaagaattccatgaaaccctgcgttacttccgtcgccagctggcgctgcgcgaagtgacggtcaggctgggcgtcaaggtcgaggcggcggatttaagcgaattcgacgaagtgatcctcgcctgcggcatcgtgccgcgcaccccggacatccccggcatcggccacgccaaggtgctgagctatctggacgtgctgcgcgataaaaaaccggtcggccagcgggtggcgatcgtcggcgccggcggcatcggcttcgacaccgccgagtacctcagccagcatggcgtgtccagcagcctggatcaggcggaattcaaccgcgaatggggcatcgacggccgccttgagcagcgcggcgggctggtggcgcaagggccacaggcaccgcgcgccgcgcggcaaatctacctgttgcagcgcaaaactagcaaagtgggtgaaggcctggggaaaccaccggttggatccatcgcgccagcctggcgatgcgcaggcgtgaagatgctcaacagc

SEQ ID NO: 611 - DNA, 186 bp, Glycine max
  Peptide Sequence Number=SeqID_92296
atggctggtgctggcagcttgaacatacgaacttgtaaaaattattgggaattggtcactacaaattttgagctgaaatttttactgaattttctagacatctggaaaagaattaggaaacgagaaccaagtgatttggatataaggaaaaaggaattgaaaaggaggattggtgccatcgattga

SEQ ID NO: 612 - DNA, 417 bp, Glycine max
  Peptide Sequence Number=SeqID_92297
atgcagaggatgaaaagccatgcatatcaggacaactacacaggacgatctcagatcttcctaggaaattgtaatatactgctccctaggcagtgcactgaatgggaaagaactggaagaaaggaaatcttacattcaaagcttttgatgcaaaacataagaggggaggtggtggtttcatctgtgtggaaggttaccatgatgttctcagagatcaaacattcaaacttgcataacagaagtttgagcaccttagtgcaaaatactgatcttccagggcaaaaggaggaggaagcgagggcatggtctgatgatggcagagtgctttggataaggggagagggaaaagacgaaaaactcaacagaataagattgatccatgacatgctcaggagcatagtacaggccttaagctag

SEQ ID NO: 613 - DNA, 300 bp, Glycine max
  Peptide Sequence Number=SeqID_92298
atgcaacaggtgcacttgtctatacataagaaacttaatcttgctaataacctctattacagaaaattgataatcttcaaaaatcagcttgttcctagacagccaaatgcagtagactgtaattgctatagccagacaatcccaccaaaccagtctcagaaaaacgacgatctcgaacctgttcaccgttggatcgtcgtaaaatttgagtatcatgttcgcaacaaaattccgagcattctcaccgttgggaatttcgatatcatgtctgaactgagagaaacacccttcgcattgtag

SEQ ID NO: 614 - DNA, 450 bp, Glycine max
  Peptide Sequence Number=SeqID_92299
atgtttgtcaagcttcagcacttctgtagggtttcagggctttccatcagctctgataaattttccatatactcagctgatattaggcctcatgagctttctcatattcagcagcttactggatttagcttaggtgacttcccttttagatacttgggtgttccccttttatcatctagattaaatgtatgtcactatgctcccttgctttccaacattactggcctgattcagggatggaacatgaagtctttatcttatgcagactttattatctccaaagagctaagtacggaagaggccaaaaagaggattcaatcttggagcaccaatgaacaattgcttgttggcaaagtctatgaatacattagaggtgccaagcctactcttagttggtgttctattatatggatcccaataattcctcctaagatgtctttcattctatga

SEQ ID NO: 615 - DNA, 307 bp, Glycine max
  Peptide Sequence Number=SeqID_92300
atgaacgataaagtcattgatgaaacaacatatggacatacaatgcaaatttttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgg

SEQ ID NO: 616 - DNA, 165 bp, Glycine max
  Peptide Sequence Number=SeqID_92301
atgtctctggccaatggaatttacatcttttctgacattgagatgtttgatttagacaatggaaggtggatctctgcacttttcatgctagacaaggtatttggtattgctgctgcggaattctatagtttgttttatattacttgtggaaatggaattaattaa

SEQ ID NO: 617 - DNA, 96 bp, Glycine max
  Peptide Sequence Number=SeqID_92302
atggccaaagaatttgtgaatggctttgttcactttcgtctgttcttcagctcggttccggtcgtgattggttttgttgttgtgcatgttggacaa

SEQ ID NO: 618 - DNA, 1443 bp, Glycine max
  Peptide Sequence Number=SeqID_92303
atggtggcgacaaaacggagagtttccggtgccatgtgtcctgcaagagaatttaaactcaactgggccgggtataggtcgtgggtagcgggtgagtcaggaaccgagtcaggaaccgagtccgggtcaaggcccaaaggtgttataagagatgggtcagggggttcgtcttcctcagcaagcaaaaggaaaaccctagacgcgcatttgtgcccgcggtggtacttctcgtcacaactgaagcaaagatctcgttcacggcgcgaggctatttcctcggaggtgagtcgcttgaaggatggtgggggtggtctgggagaaggaatggcggtcgaaattgggcgaggagccatggagggtgaaggtggagggaggctgagacgaggtgggccagatggggaaagggaaggtgggggtcgagacggtcggggaaagggtactggtggtcacaatctgagtgagggtgaggggttggtgagcacggactttccaacaaatctccggggaaaggcccgagataaagcagctgaggaggaagggtgtcggaacaccgatgattcggttggccacatcttcaaactctgcgagggtcccgatgggatcctcatattgagaaggtgcaaaccgtgtttgcaatgcctgcaaaaacactggccaagaggtgaattgaccgttactggtcatccactgaaaccaggccaagaactgattaatcttgaaaatccaacccatgggatccgtgccgtcaaaacgaggcacctcaagcttgaggcggtggtgtgctgcgaggttggggggaagacgagaaacggaggagaaaaaggggttgggttgtggtggtatcggggagacatggtggatgaggccatcgattttatgagtgagggagagatgctgtttggtgagttgaatgaggagatcctcaattcgttcagcattggaggaactcacaggattgaacatggtgacaacgagagcaccatgttgacaagcgccaagcaagaagataacgaaggattgcatgctgaattccctatctcaccctcagacgaagtccctgaggataatgagaatgagaaggaccttatgtatgaggaactaaaggaattgactcttggccatgaaagtccatacctctctatgtcatgcgatgtaaatgacactccagatgagaatatatgcaccatggaaaatgattttctgaatgtgacagcaaattcagaaaaaaaggaagagagttcaagtcctccagttgagcaccacaacaccattgaccagagcaaaggaaacttggcagtgatttctctggccaatggaattgacatcttttctgacattgagatgtttgatttagacaatggaaggtggatctctgcactttccatgctaggcaagggcatgattgagaggcataattatggatataatatgttttgcctttaa

SEQ ID NO: 619 - DNA, 243 bp, Glycine max
  Peptide Sequence Number=SeqID_92304
atgcgtcttccattgaaggaaaatgagcggagtccccaccaacgtttatccaaggaaaacgtcggaaaaatcaaaatggaaaaggtcgagggtctgcgtattttgaaaatgagggttcgggagtcatttatgcacggggaagcaaaatggagaagaagaagagttgagcggagacgccacttcaagaagaagatgagtctagaagaagctcaccaccataggaagccacggataagagcttga

SEQ ID NO: 620 - DNA, 684 bp, Glycine max
  Peptide Sequence Number=SeqID_92305
atggttagtctcgcaccttttcgccaagaagtgaggcatgcttgcccattagaaagccaccgttcatgcacagagaaaggaagggagaattgggatcaactcttagcaatcaaagaaggagcatctgtcaactgtttccctcgatggatggaaggaagaaccaaagttcttatttcatgcagaggatttccaaatgttcccttgatggggacaaggggtagcatcagctacaatcccgttcttgctataagacaactgggctatcctatgagaggagcaccactagaggaagagattgtgcctaaggtccgcaaggcatgggaggtgttgcaaaagaaagacaaggaactcagaggcagtaacaatgggcccatcggtggctaccgtgagtggttgaaagcccacgtgcaaggttcggattggctcccaagtctgagagccactaaaagggaggaagatgaggcaccggaggaagacgaaggggtgcaggctcttaggacagaactcaagcaagctcaaacagtcaaagaaaggttcaaatctgcagctcttaagatccgaaaagagaatgccgaactgagagatgtaaatatagctaccaccaaggctttggaacaagagaccaaaagggcccgtagggaagaacatggcccggaacaagttccgaggggctctgtggagtag

SEQ ID NO: 621 - DNA, 534 bp, Glycine max
  Peptide Sequence Number=SeqID_92306
atggcatcgtttagccagatgcagtcccagtttcagtcccagatgcaatctcagggacttgcactaccttcggagcttctggttggtccctcaggaaatgatcctaagacgggtgactcagacaggtgcagcttgtacattgaagcaaatcctgcccgcttggttatcctgggaagagtttatgagggatccactgttgttcataacactcctttgttgcctggccaagtaaaggtgggtgtggaggaggttaaagatccagatgctcctgttcctgtacccattgatgaggcagttgtgtctccgacaaaaccacctcaaatgccgaatccagaggtcgatgatccgctttatctgatgacattgaccatcctagagattttcttgaggctttaccagattacatgggatgccactgtgttcggggtctttaatccatatttcccgctctacataaagcacgaagacctctccgaaatcgcacacggtggtcaatgtctcagcatatcagtgttacagttgtggattctgtaa

SEQ ID NO: 622 - DNA, 207 bp, Glycine max
  Peptide Sequence Number=SeqID_92307
atggaggagatacatagagaagatgatgaagaacaaggaattaaactccatgtagagcttgtaggccatggatcttcttcatcaatggagtcatttacttcttcaagatcaatggcaatggaatggagaaggaggaaaggtgattgtagatgccacttcaaggagaatatgagtcaagaacaagctcaccactattggaagccatga

SEQ ID NO: 623 - DNA, 375 bp, Glycine max
  Peptide Sequence Number=SeqID_92308
atgaagcacttcactgacacctcatcagtgccaacatacggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacaagttgcgcagcctgaatggcgaatgggacgcgccctgtagcggcgcattaagcgcggcgggtgtggtggttacgcgcaccgtgaccgctacacttgccagcgctgatgtccggcggtgcttttgccgttacgcaccaccccggcagtag

SEQ ID NO: 624 - DNA, 431 bp, Glycine max
  Peptide Sequence Number=SeqID_92309
actctgccagtcgtttgggcgtccccgtcacacctagcaaggtgattcggccgcccatcacccgagcttttattgagaagtactgcacgcagagacaggtccagggtgatgcaccacaggccgcggacgcgccgccacctcatcaggctggtccagccggatcatttgacacggagcagtatttgcggcatttggttcgccagcaggcggccaaccaccgggcacatagccagggctttacttctttttcgtgccctactccggaccagttcagggcagaggtcgcatggcctggagattggcttgaggcccaggcaggagaggcaccagcaggggcaccagcagaggctcccgacgaggcagatgaggcccgcgaggatgaagagatgaccgatttacttgatttcttaggagggagcggtgccacatga

SEQ ID NO: 625 - DNA, 261 bp, Glycine max
  Peptide Sequence Number=SeqID_92310
atggcctcagcaaattccttatttccagaagggaattctatcaatagacctccaatctttaatggagagggttatcactactggaaaacccgaagatccattgattttgatacgggcttgtgctgccaaccatgtcgaagatccattgattttgatactttgctgagctgcacaagagaggaagcatcgaagtatcagcaattgattcttgggttatatgcacgagaagtcttgtctaatgggaaaagtagtaatgagtga

SEQ ID NO: 626 - DNA, 339 bp, Glycine max
  Peptide Sequence Number=SeqID_92311
atggatataacggacatgggagatgtcattgcatcaagatataacgtaatcgttgtatacttgtctaaacaacaaagcacggcattctttcctcttagaagtcaacctctggcaaattcttcattgcatcgtataatttgtatcggtcatgtgtatgacaatcattttgttgaggtttatttaaaagaatgttgtcccttatcgcctgtagcattgtcatggtctaacaattgtcatcctcaggcaaagccgtggccaaattcatatattagcagaatgcagcattacaagagcttcgtgatgttcaagagagactatgttgacataaatgatgattga

SEQ ID NO: 627 - DNA, 645 bp, Glycine max
  Peptide Sequence Number=SeqID_92312
atggtggaagaatttgaagagatcctaggatgtcctctaaggggaaggaaaccatacctcttctcagggttctacccctcattggccagaatttctaaaaaagtccaaatctcggcgcaggaattagaccgccaaaggcaagtcgaaaatggggtggtcggaataccgagaaaatatttggaggtaaaagcaagaatcttggcagataaaggcgagtggaccccattcatagatattctcacactgttgattttcgagggagtcctctttccaaatgtggatgggttggtggacctggcagcgatcgacgtttttctcgcctatcataaccacaaggaaagtccggttgtcgctatgctagccgacctatatgacaccttcgaccgacgatgtgaagaaagcaatgcaaggattgtttgctgtactccagctctctatgtggggctggtttcacacctttttctccaagaaggtaggcccgtctatccgctacaaggttaccgctcgtgcatcgaaaaaggaaaggcgaattgggaccaactcttggctagcatgggggggcgtctgttaattggttccctcgctagaaggaaggaagaatcaagattctatcttcatgcgaaggatgtccaaatgttcccttga

SEQ ID NO: 628 - DNA, 336 bp, Glycine max
  Peptide Sequence Number=SeqID_92313
atgaccaaacttggtctctgcgtgccatcggacacgactgtgtctgaatggcaaaggggtgcggataaccgtaaggtatctccgcgtatcataatgaccaaacttggtctctgcgtgccatcggacacgactgtgtctgaatggcaaaggggtgcggataaccgtaaggtatctccgcgtatcataatgaccaaacttggtctctgcgtgccatcggacacgactgtgtctgaatgggcaaaaggggtgcggataaccgtaaggtatctccgcgtatcatgggtgcagaatgaccaaacttggtctctgcttgtcatcggacacgactgtgtctga

SEQ ID NO: 629 - DNA, 327 bp, Glycine max
  Peptide Sequence Number=SeqID_92314
atggcaacgcaattaatccatgaccgagtggagatggagtgcctagagggagtttgggagaccctcgaaggcaatgcaaggtgtcgattctggggcacgattcgattcacggttacttcattggtacatccagaggaaccagcatgcacgcttcagcatactgtggagtggatattacctacacctactccatatcgactagtggagccagtccaagtgatagaggtgacgtcatcggaggaagaccctgaggaggacccagatgagctacctcctgagcctactgtggatgctcttgactttccagagggtgatgagggcccatga

SEQ ID NO: 630 - DNA, 427 bp, Glycine max
  Peptide Sequence Number=SeqID_92315
gcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgttccgggcccccgggagtcgcacttaacagatttgagttccttggcgcacgaagcgccggggtttgtgtttgtcgcgaggacgaggaggccgggcgcacggggcgccgtggtcatcccctccctcccgacggacgcgagcttttcccggatcgactcgcgcttactaaggaattcctcgttaagcaacaattatcttttcccctcacgattgatatgcttaaactcaaagataccgg

SEQ ID NO: 631 - DNA, 675 bp, Glycine max
  misc_feature (533)..(533): n is a, c, g, or t
  Peptide Sequence Number=SeqID_92316
atggatgaagtccctaaggatgcccatgtccatatcgtgggttctccacctgcctccactcctactcctcctcctcctcctacttcggacgcattggcttcgacgtctgccgtgaagcggacacgcaaagcctcacgtctacgatcgttgtccactagaccacctggtgttgagagaccagtggtgcatgctgatcctgttaccgggaaggccgaaggtccccataggaagaaattaagaacatatttggggattgtggcacgtgataaggtggacatcacctacgagaactggaaggaggttcctactgctcagaaggacctgatttgggaggatattcggaccgtgggggagagatggaggcagtttaaatcagacctcacgaagaaatgggcccttgcagccgatcaggatggtgtcgaggacactgtctgtgacaaatacgacatcagcaaggaaaagtgggcccagttttgccagactcgcagagacccttcttgggaggcagaggccatccaaaagcagaatactgncccccacgttttgtctcgtgggggttatgattgtttgaagcagaagctcctggctgagaagacaaagaagaagctgcaggaagctgcacagtcaggaagcgttgatggcgtcatcgaccctccatccccggtcagatgccac

SEQ ID NO: 632 - DNA, 460 bp, Glycine max
  Peptide Sequence Number=SeqID_92317
atggggacaaatcaaaacggcaaaatgttttatcaagtcaaggttaaaagtctagatgtcactagcctcaaggaattgggacgattgatgggacctctccaaaggcaagccttccgcaaagtgtacgggaagattctagatttggccgcaacggaggtatttacggaagttgtcgtatccctcgcccaatactatgaccagccgttgaggtgtttcacgtttggggacttccaaatggtaccaactattgaagagtttgaggagatattaggatgccctcttggggggagaaaaccgtatcttttctccggctttcttccttccttgagcaagattgcagttgtgattggagattcagcaaaagagttgggatcacatgaaacaaactcgcaatggaatagtgggcctgccacggaaatacttgggaaggcaaggcaagggatattgcgagccaagagaa

SEQ ID NO: 633 - DNA, 313 bp, Glycine max
  Peptide Sequence Number=SeqID_92318
atggtgggaatcgattttggaagtccattgtggatcgccttaagactcccagggcattcttcttttttctccttctgcctgagttcgtctttgtcgcaaactgggttgtgcttccatgacttcaaccacattgtggagttcatctttgtggagttcgtgtctgccacttatcgattgagcttgaagaaaactaggaaaggaaagagtcccggaaaaggtgggaatcaattttgggagtccattgtggttggctttaagactcccagggaagcgatcgaaggtgatttcttcatcttctttagtcgctgtcaag

SEQ ID NO: 634 - DNA, 219 bp, Glycine max
  Peptide Sequence Number=SeqID_92319
atgtgtctcccccacggtttaagagacatgtgcatgatgaggttgtcggctctcaatgagtatggaagcggagttattgacatcctctttgggaatgtatgccacattgggtggtgtacagttgggaggcaggccatatggcaggaaggcgtgcttgttttgaatttgcacatcatgggggccgtccctacttcccaaatctttgcctaccatatttga

SEQ ID NO: 635 - DNA, 354 bp, Glycine max
  Peptide Sequence Number=SeqID_92320
atgactcactataatccttaccctcggaagcaaaaaaggaaagaaggaaaatttccaatcaaagagaaagcaaaaagaaaagaaaggaaattcccaatcaaagagtgggagaaagcaaaaagaaaagaaaggaaattcccaatcaaagagtgggagaaagcaaaaagaaaagaaagaaaattcccaaccaaagaatgggagaaaaaacgaaatgctaacatccaagatctcatttatgggttatggggggatcccatcagcagactctcctttccctgggtaggcgcattgtttgtcactcaaaaaagcatatgctgctctaaacagtttggaaatatttgtctctttggctaa

SEQ ID NO: 636 - DNA, 507 bp, Glycine max
  Peptide Sequence Number=SeqID_92321
atgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtggggagggacgaatcaaagcgacaaggggctgaatctcagtggatcgtgggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgccttttggggggccgaggccccctactgctggtcggcaaacggacggcgggcgcacgcgtcgcttctag

SEQ ID NO: 637 - DNA, 195 bp, Glycine max
  Peptide Sequence Number=SeqID_92322
atggtttttcacttaaggcttgtaatgagcttcaaaacaaagaaaggggaacataggctcaaaggggctatcaaaggaattaattcaaggaagcatcaacaagaatcaagccaaggctattgtgcaagcaatcaatggctcaaaacacaccaaaagattatgatgatagatggctcaaattgtgggatcctctag

SEQ ID NO: 638 - DNA, 222 bp, Glycine max
  Peptide Sequence Number=SeqID_92323
atgtctcctccacctcaagaacctcacaatcactcacaaactcatctcaagttctcaggacggcttcctcttcaagctcagttctctacaggtcttcacacagcaaaatctgtcaaactctttggaacttggacctttctctctctagaaaaccctgaacatgcagaagcttcaagaaaaggcccaaactccactccaaaatctgatttcaggcttaaatag

SEQ ID NO: 639 - DNA, 258 bp, Glycine max
  Peptide Sequence Number=SeqID_92324
atgggtgccaagcacctcacaaggaccaaacaaaagttgcatgccaccaagcaaaggtccccggatgaaattagggcctttcgtcttacagatagcaaaaagaatgtttatacggataaccactcgggtatttctgtccgtcagcgtgactcaaatgtcagtatgacagatcatgtgagcgcggaagatgacgtaaatctccgcgtgtcaacgggcttgtcggccgcgattgacgaaggatacagaagacgacgttag

SEQ ID NO: 640 - DNA, 339 bp, Glycine max
  Peptide Sequence Number=SeqID_92325
atgtcttctgatcataaccaattggctcaatcttctccacaggttcggcataaccaattggctcaatcttctccacaggttcgacttaactctttagaggtaccttatgatcctatctctgataatactaatgtagatgaaactgatcatgaaattgtttctcttgatcctacccttgataatactaatttaggtgaaaccgatcatgaaattgatccttgtctgtgtgagaccaccagcacaccaaacaccgagtctactattgtccaatataatcttccaccccgctctaatcgtggtcaacctccagctaaatatgaactagacctccaagccaaa

SEQ ID NO: 641 - DNA, 245 bp, Glycine max
  Peptide Sequence Number=SeqID_92326
ttccttgttgaaccaatctcagacttatcaaggtaatccttgtggcgtctaccctgacttatcttccttcactggaagtggcgtctaccctgacttatcttccttcactagaagtggcgtctaccctgacttatcttccttctttggaagtggcgtcatccaaaaatctctgttacctgtatcaagtgatccgctcctactcaggttcacatcatctggtatcagagcttcatctcttgatacag

SEQ ID NO: 642 - DNA, 578 bp, Glycine max
  Peptide Sequence Number=SeqID_92327
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 643 - DNA, 117 bp, Glycine max
  Peptide Sequence Number=SeqID_92328
atggtgtctgaaatctctaaggaagatggcacgccactgtcgctaggctccagcttggcctgctgctgcagcatggtagtgttgagggtgttggattggaaattgagaagtgttgat

SEQ ID NO: 644 - DNA, 216 bp, Glycine max
  Peptide Sequence Number=SeqID_92329
atggaagcaaaaagttttgagaaaattttgaaatacagcaaccatttggagcatttggtcgtctttggggcaatccctggtgcgggcactgctcttgacgaactggacgtccttgattcgggaattgtcggcgtagggtctgacgacgatgttggagccgggaaagatcgtggagtcgtcgacctcgtcgggttcaatgctcggagggatgaatag

SEQ ID NO: 645 - DNA, 219 bp, Glycine max
  Peptide Sequence Number=SeqID_92330
atgcccttggggggtaggattgcatcaccaggcgagccagaggctagcttggattgcgtggcaactggtgttaagcagctcaattcggctggcaagaattcaaatagagcagaagacattgatagtcctcgcaagacaacagactttgatagccttgaaaaagtaaagaagactgtggtagtcttgaaacaaaagactcggatagtcttggaaatgtaa

SEQ ID NO: 646 - DNA, 318 bp, Glycine max
  Peptide Sequence Number=SeqID_92331
atggaccctagcttgcctgggccctcagaagacttcagtcagaaggaaccagctcgcctgggtgagccaattactttagcagtaagtctcagctcgcctgggcgagctgccatggtcccagatgccactttttctataaataggcgtgaaggggagctgaggaaggggttccagcatcgagcattgagagaaattgagagaaaaaagggagaagaagataaaagaagagaaaatgaagccgaggcgctgccaaatcgcgactgtgatcaacctctacatcattctttgtttggtgttctttatgcgaccatcatttag

SEQ ID NO: 647 - DNA, 687 bp, Glycine max
  Peptide Sequence Number=SeqID_92332
atggtagaagaaaatgaattcattactgactattttgagtcaggctttaaagattctattgaaacgatttaccaaattgtatcaaccatacctgctgacatcactaaagagtatcaagctcgccatctaagaagagattacacacggaatgagtgttttgaagatccatctttgagtcccaaagctgtatgggtgacacaagtttcttgctttactcttctacataatgttgctattttttatcctttgaaagatgaaatgaaatctcacatgaagcctctaaatttgactaccaagttggaggattggatcattagcaaaactatggtagatggagtagcatctatcaacattttacccaaatctatgctaaggaggtttgatggtaagttagaagtttccaaagcagatcagacttcttatgctatctatgcttcctttgttgatgaaactgatcaaatattggcagtcactgcaccttttgatattgaagattcatattatatgaataagaagactggggaagatgcaaacaagtttttctgttgcaatcctaagaaaggatttatattgattaacaagattgtcgaaaaaaatgtgcaccatagaagaagtatgagtacttcaacaacaaatttgagctttgttcgcttccggcaagtgcaccagatcgcacaagtagtataa

SEQ ID NO: 648 - DNA, 204 bp, Glycine max
  Peptide Sequence Number=SeqID_92333
atggagctagcgggagtcgcggtagttcatagcgatatgcgcggagatggagagagactccactacgtcaaagaaaaacaagttagtctaggaaatgctgagtgcgaagatgagggagagagggttcagaaaaagcccagaacaatgcaaatgcaagtgggaaggggatggtgggggaggcacaagaggtttttgatgaaatga

SEQ ID NO: 649 - DNA, 342 bp, Glycine max
  Peptide Sequence Number=SeqID_92334
atgatgagaatcatgaaacaggccaaatacagtctaaaggcccaagtggagaaggacgaaggcccaagtggagaaggacaaagcccccgaacttatcaaggtaatccttgtggcgtctacccagacttatcttccttcactggaagtggcgtctacccagacttatcttccttcaccggaagtggcgtctacccagacttatcttccttcactggaagtggcgtctaccctgacttatcttccttcactggaagtggcgtcatccaaatctctgtaacctgtatcaaacgatccgttcctagtcaggttcacatcatctggtatcagagcttcggctcttga

SEQ ID NO: 650 - DNA, 288 bp, Glycine max
  Peptide Sequence Number=SeqID_92335
atgggtgtcgaagtattgatcagcagagtttttcactctagcaaacgtgggatcgaatcaagcaccctttttaagaaaaggttctatcatgtcaaaatcaagagcctagaagtagccaattttcaaaagttaggacagcaaatggatcaattccaacgtcaagccttccacaagacatatggaaaaatatgggatttggctatgatagaagtgtctgttgaagccattgcatccctcgctcaatactatgaccagccgctaaggtgcttcacatttggggacttttag

SEQ ID NO: 651 - DNA, 729 bp, Glycine max
  Peptide Sequence Number=SeqID_92336
atggatctagcggcgattgatgctttcgttgcttatcaccacaacaaggaaagtccggtcattactgtttcagctgatgcttatgacacatttgactggagatgcgagaagaacatcgcaaggattgtctattgcacacctgctctttatgtatggctgaggcatcagttaattggttcccccaatggaagaaggagggccgaagttctgtgctcatgtgaagggttcccgaacatccccttgatgggaatgaggggttgtatcaattataatcccatacttgccataagacaactagactatcctatgagaggggcgccatcagaagagagtatcacgtttttcatcgcacgaggcttcagtgaccccaatgataaggagcttagaggaagcaacaatggtgttattggcatatatcataaatggttgagggcttggacgcaaaggataacttggctcctgaagctaaagatttcaagtgagggagaggctgaggtccccgaggagaacgaagaagtgaaagccttgaaagtggaacttgaaagaaccaacaatgaactcaagcttcaaagggctgtgagcgatgagtcgagggtggaaagtatgatgttacaggacaagttgaaggcttgtcaaaggtcgaagaggagcttgactgaacaattgagtaggacggaagaaaacatgtgggcaatcattgaccaatataaagagaagctaaatctagct

SEQ ID NO: 652 - DNA, 474 bp, Glycine max
  Peptide Sequence Number=SeqID_92337
atgacgttcctacttagcaacattctgcccaacgactgcaatgccgatctccccatgtggaagtatcagttggtctgtgccgtttcgacacagggatcatgcccacaagacatccagtggacccggagaagtccaacagggccctggggtttccagctctggttacgggcctctatcagtcctacagggtgcccgtaccccccggcaaggtcatgccatcgcgacatagggatcgcgcccgcaggacacccagtggactcaaagaagtccaacagggtcctggggtttccagctctgattacgggcctctgtcagttctacggagtgcccgtcacccccaataaggtcattaggccccctattaatcgggctttcctcaagaggtactgcgcccccaggcaggcacagggcgaaacaccacagcagcctggggatggctggcagcggcaacaaacgcaccgccaccacctttag

SEQ ID NO: 653 - DNA, 860 bp, Glycine max
  Peptide Sequence Number=SeqID_92338
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcttaccaccagaggcagccagtagcgagcacgttcagtctcatgatcagtgatggcatgagcaactcggttaggaaaggcactgtaggcgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 654 - DNA, 513 bp, Glycine max
  Peptide Sequence Number=SeqID_92339
atgaccatgattacgccaagctcgaaattaaccctcactaaagggaacaaaagctgtgcctttcctaaccgagttgctcatgccatcactgatcatgagactgaacgtgctcgctactggctgcctctggtggtaagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 655 - DNA, 639 bp, Glycine max
  Peptide Sequence Number=SeqID_92340
atggcttctagaaagagaaagagcattgatgcttggaccagatacacagataatgttttggggaaaaatattttacctgagaggaaggtagagctctatcacactgagctagatggctttaaggctgaattggaaaggcataatttccataaacgcctcaccaatttagccgatgggagcatagacttggctttggtgaaagagttctatgcaaatttatacagttctgaggaccgtccaccaaagcagtctagagtcagaggtcatttggtgaagattgatgctaacagtctcaacgcattcctggagacaccagtggtattagctgagggagagactttacccgcatactccagatactacaggttgcctacggacttcagagagatagaggctgccttatgcatacctggtcgagggttcatcttgaactctaagggccatcctgggaagattcttaggaaggatttgactagactggctcaggtgtggagtgtcctctcatactccaacttggcccttacatcacagacctctaatttgacaatggatagagctaggttgatctttggcctagtctctcacttggaaatgaacataggagcgttgatctctggccagatgacctctatagcctag

SEQ ID NO: 656 - DNA, 252 bp, Glycine max
  Peptide Sequence Number=SeqID_92341
atgttaggattcacaagcgattctcatcaaattttagccagcccgcatcaattagactttgcaccttacgctttagggccttacaatgctcagtggaatgccccggggctcctccatgataagcacacattgcattcgagtcgtattcttggagaaatggaggttgatgaaccttggctggggttatggctaccattgaattatcaagtagatatgggagcaagtcagcataggacaccagaattggggtga

SEQ ID NO: 657 - DNA, 432 bp, Glycine max
  Peptide Sequence Number=SeqID_92342
atggaagcgcagttgatccatgattgcgtggtgatggagtgcctagagggtgtttgggagaccctcgaaggcaatgagaggtgccgattccgtggcacaattcgactcactgctacttcattagtacatccggaggaacccgcacgcacacttcagcagcctgtggagtggatactacctacacctactctatatcgactagttgagccggttcaagtgatagaggtgtcatcttctaaaaaagatcttgaagaggatccagaggagttacctcctgaacctgctatggacgcccttgacttacctgaggatgatgaagacccactccctgacgttgattctccagaggatattatgtcagcatttgaggcagactctatagaggagagtggccctggtgggacatcgaatagtgacgactcttcatcatag

SEQ ID NO: 658 - DNA, 366 bp, Glycine max
  Peptide Sequence Number=SeqID_92343
atgtactcccatcgaagaaaacactcaagaaattcattatatgggaaatcaatagcgacaagggtatactcaagatttttaggcttccagcagggtccatataatcaacaaggacagtggaggagacaccctagaaatcagttcaacaaagaccagagtgggccttcaaacatgccaatccaacaaggacctaacatattccagagaactactaagctggaggagaccttgactcagtttatgcagaatcccaaggaggaatgcaaaactgtgatgacaaggagtaaaaggtttgtggaggttgagaatgaggatagtgttgtacatgagaagaaaaatgctgataagaaaaagaggaacaaataa

SEQ ID NO: 659 - DNA, 222 bp, Glycine max
  Peptide Sequence Number=SeqID_92344
atgggagggcgacgtaaggctcacaggtgcgtcttccaagaaaggaaaaacgcgcgaagtcgccaccaacgtttattcgaggaaaatgtcagaaaaacaaaaacgtgtggtctacgaactttaatcgtgaaaggttcgggagttgtttttatgcacgggaaagggtgtttccctcactcctacgtattcctcaattacaatgaggaaatcagacctacgtag

SEQ ID NO: 660 - DNA, 531 bp, Glycine max
  Peptide Sequence Number=SeqID_92345
atggcgcctaccaggcactctttggatccagataagtccaacagggccctgggatttccctcgctgatcacaagactctgccagtcgtttggagtccccgttgcacctaccaaggtaattcggccgcccatcacccgggcttttattgagaagtactgtacccagagacaggctcagggtgatgctccacaggctgcaggcgcgccaccaccacctcatcaggctgggtcatttgacatggagcagtatttacgacatttggttcgccagcaggcggccaaccaccgggcacatgtacagaccgatgattgtctgtaccagatgagcctcagcatgcagagccagggcttcgcttctttttcatgccctactccagaccagttcaggacaaaggtcgcatggcccggagattggcccgaggcccaagcaggagaggcgcccccagaagctcccggcgatggcgaggaggcccacgaggacgaggagatggccgatttgcttgacttcttgggagggagtggagctacatga

SEQ ID NO: 661 - DNA, 519 bp, Glycine max
  Peptide Sequence Number=SeqID_92346
atggaggagaagagcaagcgtggacatgaggaacattcgtgtactgaaagcccaacactcaacgtcgacccaccatccctagttgcaagacacttgaagtggaagatcgcccgcactaagcggcatggccaaatgacgtctgaagtggcacaagaaattgcagacaaaattgattcattacaggaacaagcaacacaggggagttttgttctgcatgggcgacaggacatactcaacacggcccttgaccgacctgagcatccaggccgtgttcgcgtcgcagggacaggtgtcacaataagccaatactttggccaagcctcacgtgcttctagcacatcgtcaccatcgatcaaccaacaacaattggctgatatcatcggtgtaattaaggatgacataagaaagcagctacaagatgagataagaaaggaggtacaggatgagataagaaaggaggtacaacaagaacaaaagcagcaacaagaggcttggatgagggcggttgaagaaaaatag

SEQ ID NO: 662 - DNA, 150 bp, Glycine max
  Peptide Sequence Number=SeqID_92347
atggtaaacaatcctagtgagttcaacatacataggaaggttgaaaggaattggaaaggaggattggtgccatcccttgaagaatttgagtcaagaagcaaggggccaaccaccttaagagctattggactaagaagcaatccaaattga

SEQ ID NO: 663 - DNA, 234 bp, Glycine max
  Peptide Sequence Number=SeqID_92348
gtcatcatcgttgattgggcattctccggttggataggcgttggggtagggggggagatccgatattggctgagtaattgtatcggtgctgaggatattggtacatgggttgtgaggggtttgttgggaactggccatgtgggtgctatggttacgacatgggtgtctaccttctttttctttgctccacctgttccggtcctcctattgctagcacttgttaaagcaacataa

SEQ ID NO: 664 - DNA, 168 bp, Glycine max
  Peptide Sequence Number=SeqID_92349
atgggggtgcaaatagcacctaggcccatttgggccctccagaagattcctccagaaggcgccgaggcgcttccgaaacgtttccgtaacgttttccgtgaggaatctcgcaaagctttcaaccgttcttcgacgttcttcattcgttcttcgatcttcaacgggtaa

SEQ ID NO: 665 - DNA, 637 bp, Glycine max
  Peptide Sequence Number=SeqID_92350
atggcggtggtgaaccccgagaagatctaccaatctcccttccctcgatggtacaaccccaatgcaacatgtgcctatcatgggggtgacagttcgaatgtaaggacgaatcctcttgctagtcatgggggatcgacagttaatgcggtggaggagtgtggaccttgggggccgaaacggatggaagacatgttaacctctaggaggttcatattggaagcgttgcgtgaagcgggcatgatttgcctttatggaaacaagggagattcttgtttgatacatccaggggcatcacatgacgtggagatatgcccgtcggccgaggagcagctacaggggatgatggacaaaggcctaattgaagtttgtggcgcaagaaagggggaagaagatcctgtcccagttgagaagcttgtccttttctcctacaagagtgacaaggtggtgccatggaggtatgccacacaagggcccaacgggaagaagcatgtgtttgttgtgcatgttaaagatgatttgtcctccgctaaggtcactaacatctctggcacgagcgacatgactcacagtgggtggatcttcacagcacctgagccaccaatgcgatccaaggatccaaaggggaaggcaaaggcgg

SEQ ID NO: 666 - DNA, 84 bp, Glycine max
  Peptide Sequence Number=SeqID_92351
atggggcctgtaaagcgtggaggacatgcacaaaggggggctactcacacccctccaatagctaagctcatcctcatgccataa

SEQ ID NO: 667 - DNA, 204 bp, Glycine max
  Peptide Sequence Number=SeqID_92352
atgcctacatctccggaaagggcgcagatgaccatattggcctccacttatcaaatcacactcgaggtgcggataaccgtaaggtgtctccgcgggctaccagttcttgggtcatggaaacactgggttcgacaaatagaagaaaatcactcaaagtgtatcaatctcgcacagtgcggggcgaaaaagtcgctagcgcactga

SEQ ID NO: 668 - DNA, 696 bp, Glycine max
  Peptide Sequence Number=SeqID_92353
atgaaactttgcttctacactttccttgtgagagattttggcgcgcaaaatttcaaggttatacaaagagtccatacggtgtgggaaagcccgttaaggaaagataaagaacttaggggcatttgtaatggcatcattggtggttatcatgaatggctgaaagttcgtacacgaggtttagattggctcgccaagttaaagattatcaacgaagaaaactttgaagctccggaagaggatgaagaagtccgagctttgaaaaccgaactaggaaaagcgagacttgccaaagaaaaattcaagttggtcgctacagacgtccggaaagagtgtgccgggttacgagaagaaaatgcagctaccgcaaaagcccttgaacaagaaaccaagagggctcgcaaggaagagcatggctgtgacaaattccgtggagcattgtggggtagcaacagtgagctcaagcttggaagggaagagagagaccgatcacgagcacatagcatggttttaaaagaagagttagtcgtttgctcaaggtccaaaagaaacttgtctcagcgtttatgcgagacagagaccaacatgttagctatcatcaccaagtaccaagaagaactaagtatagctacgacccacgagcatagggtggcagacgagtatgcccaagtgtacgcgaaaaaagaggctagaggaagg

SEQ ID NO: 669 - DNA, 246 bp, Glycine max
  Peptide Sequence Number=SeqID_92354
atggttttcttaagttgtggtggtggaactaccattgcagtggttctgttcgattttggtggtggtggtggcagtaaagaaactactattacagcagttttattttgtctagatggcagtggtggtaggatttgtttgttgttggggctgctgcgacacttgaacattaaccctaacactgttgctgcctgtgctctcggcaaagggagcagtgataaaatgggaggaattgaagggttcagatga

SEQ ID NO: 670 - DNA, 789 bp, Glycine max
  Peptide Sequence Number=SeqID_92355
atgaattcaatttctttaggttccttcatcctcacaccatgcaagttccgcccttttcttcaaaccaaacaccaacccatattccgcactctctccccaattcccctgacacaaaaacccacttttcttcgagccacagactcgaacatcgacgcccccatttccctccccgagggcgcgtccttcgtttccatcccagaaatcatcgagaaggactggtccgtgcttgattgcgccgaacaccgaaccactgaccgcattatagcttccggaaacatcgaacagagttcgagggttttggtctcaactgggtcagaagactttgttgattccttagcgggtttaactccctctgtgtttgttgttcatgactcgcttctgacactggcttgcattaaagaaaaatatgacagggttaagtgttggcaaggggagattatttatgttccggaaaagtgggctccttttgatgctgtgtttctttatttccttcccgcgttgcccttcaagctccaccaaattttggagtctttggctgggaaatgtgcaccggcttctgatgatgttgatttgcctatgactggaaaatatgcttcagaggagagctgtgaatgctacatcaaggctagagatgagatggagaacttgaaactgatgaggtcattaggcgtaggcttattgagaaatcgaaaaggcgaatttgggaaagatgaatcaaggaagattaaggttatggaggaacgtggaagagattttatactccctttcccccaaaacattgttccataa

SEQ ID NO: 671 - DNA, 2754 bp, Glycine max
  Peptide Sequence Number=SeqID_92356
atggaggaagaagaagaccagcagaagcttccagatctggtgaaggaactagtccaccgcctcctctcccaaaacctccccccaaattcccctcccctaaaccctaactcccccgaattccgcaactccctccgctacgccctccgcatcctctccagccgcctcaccccctccgtcgcccccgacgccgccgccatcgccgactccatcaagcgccgcctcgctacccacggccactcctccgaagccctctccttcgccgacctcttctccaaattctcctccaaagcccaaagcgtcaacaacaaattcgccgtcatctacctcctcaaaatcgtctccgaagatcgccacaccaccaccgcaaccaccacccctctcctccccaacctcagtttctccgaacctacctccaacaaaaaaccctggaacgacaacggcgccctcctcatctccaaggaccccgagaaccgccgcgacgtcgcgtttcgcgagttcgtcgatctagtcaaggaagaaaacgaggtgtcggaagaggttctcgtccaagacgtgctctatgcttgccaaggagtggatggtaagttcgtgaaatttgacggcgagagtaagcgttatgtgatacctgattcaattagggttccccgagccactaggagtatggtttacaatctctgtgaattgggggttttgtttagaaacgttagcggttacatttcgctgagtatggatcggtttcccaatgaagatgtgggaactgtgggccaggctttttgctccgctttgcaggacgagcttagtgagtattataagctgctggcggttcttgaggctcaggcttccaacccgattcctttggtttcggaatccgcgagctccgggaactacctttcgctcaggaggcttgcggtctgggttgctgagcccttggtgaagatgaggctgatggctgatttagttgagaagtgcagggttttgcgcggcggggcgatggcgggggcgattcatttgcacgcgcagcatggtgatccgttggttcatgagttcatgaggaggttgctgcagagggtgtgttcttcgctgtttgagatggtgaggaggtgggttttggaaggggagttggaggatatctttgcggagtttttcattgttggacagcctgtgaaggctgagtccctctggagagaagggtataggctccatgattccatgcttcctttgtttatctcaccttcgcttgcacagaggatattgaggaccgggaaatccattaattttcttcgcgtttgttgtgaggatcatggttgggctgatgctgcgaccgaggttgttgctgatcatggagcaacggcgagaagaggtggttttggatatggagaaacggatacccttgagtttttggtggatgaagcttcaaagaggattgataagcatttgttggatgtgattttcaagaggtacaagttcaaagaacactgtcttgcaattaagcagtatttgttgcttgggcaaggtgattttgtgcagtatctgatggatatcgttgggcctgaactttctgagccggctaacactataagctcttttaaactttcgggattgctggaaactgcaattcgggcatctaatgctcagtatgatgatcctgaaattttggataggctcagggttaaaatgatgccacatgaaagcggtgataggggctgggatgtattttcactagaatacgatgctagagttccacttgatacggtgttcacggaatctgtgatggcaaggtatttaagaatttttaattttctgtggaagcttagacgagtggaacatgcgcttactggagcctggaagaccatgaagccaaactgcattacctctaattccttcaccagattgcaacatgcagtaaagatgcagttagtttcgacattgaggcgctgtcaggttctgtgggttgaaatcaatcacttcatttcaaacttgcaatattatataatgtttgaagtgttggaggtatcatggtcaaattttttggctgagatggaagtagccaaggatcttgatgatctacttgctgctcatgaaaaatatctgcattctattgtagagaaatctctccttggagagctttcccagtctctttacaagtcactatttgtaatttttgatcttatattacgttttcggagccgtgcggatcggttgtatgaaggtattcatgagttgcaagcaagattcacagaatcctccctatcctctcgagacaagaatcaatcacgatctcgaaagcaactaagtgataaatctgcagaacaaggatcctggattgctgatgggagaaaagccctaacacaacgagctggtgaatttctacgaaatatggagcaagatctggatgcaattgctaaggagtattcatcattgcaagagggattcatttctcaattgcctgtacagcagcatgttgatctaaagaaatttgtgaataaggctgagggtcaggctgaagcattgtttcttcaaaaagacaaggcattaaaagcgttgcacccagctaacttccattatatgaagctattaatattcaattggatgcccgatatgagtagtacagacgaaattgctggtttggctgaaaatgttggagcggttcaagcaactttaggtttttggaaatgttgtgagaaggaggtggtgatacaggttgaatttttaactaagatagatggggatgaggcaatccctttccccctctag

SEQ ID NO: 672 - DNA, 1140 bp, Glycine max
  Peptide Sequence Number=SeqID_92357
atgggatcagcacacaaggacccgaatgtcttccactttagccatccacatcctttggaatgtaccaccccaccctccaccggaaacaacgtaattatctgctttggatgcaagctaaaagttaagcatggtgaggactattacgagtgcaaaacatgtgccttttctcttcacaatgtgtgctacaagatgcccttgatcacaaaccacccttcacatgcaagccacaacctagtcctccttgctataccttccaccaaagccaccctcaactgcgtggcatgtgggaaccatgtcacgggcttctgctaccactgtgccgaatgcagcatattctttcattctttgtgtcttgcacttcctgtttccctcgctatcacttatcatccccacaaaatcaagcttgagttttcagcaccatatcatttcttctgtgacttgtgcaacaaacccagttacaataataacgggtggctatataggtgcaacatgtgtgaattcgatacacatatagcttgtgcagttgaaaacttagagccccattcgttcaaaaacgaatctttccatcaatcaagccccttgttaaggcaactcacgagtgatcaccgagtggaacacaaaagggttagtgcaagtgtaggtgatagttgcaaagggtatgatgagtatgagatcatgcgtttggtggcacaacaaataattggtgggggaatcagagaaaattctgatagtgcagttgctggatgggacaagagattatatagtattccatggaaaaagcttaacaaaactgggagtgggaagatgaagattattagtgaacttgaattacaagaaaaagaactaagtcctgctcaacttctattaaagttagaagaaagaacaccacttagggataaatccacaccattttctgatcatttgggcacaccgtatagtaaccaatatagtgactcatatttttcaatagatttggcaaagtcatattcaaaccaacatggacatagaagtcaggtaccaagagaaggtggtagtgaccagataactcgagatgttactatgccagagagagttgtgagcaattctggacaacgtgaagaaccattcggtctagttaattggccattcaatgattcatag

SEQ ID NO: 673 - DNA, 300 bp, Glycine max
  Peptide Sequence Number=SeqID_92358
atgagcaggagagttaacaacgaggcagaatttgtctatggttctggtcaattgaacccaagaagaagtttgagccctggtttggcctattatgttgatgactttggccaagatgctatcaactacccccacgatgcaatttggcttggaaagcaacaaagacataagagtatgatttttcaaaagaagagtgaccaattgaagcctactagcctcattttctctaaaaccctgcagaagatgagcttcaaaaagttcaaagtagttgtgattgtgaaagacacatttattgcaaagtaa

SEQ ID NO: 674 - DNA, 1281 bp, Glycine max
  Peptide Sequence Number=SeqID_92359
atgggaatggagcgagtgcagtgtgcctatgcctctctggacgaagcgttcgaaatagggaaagaggcgtatcaggggcagcagtacagccagatttacttcgcgcgccttcatttgatgcgaacacttttatattccctcgttcctcattggaaacccaattttcccgtgctgggattggaagaggggaaggagtgtgtcattgttggaaccctctataaacacatgaagctcaaaccttgcattcttgatgagtattccaaggagagatcagtggttccacttgtcaagccacataacttcatacacccggatgatcacctagttttggaagatgaaagcgggcgggttaagctcagtgggagtatcattttgccatctgaatatgtaacaggaattgtggttgctttacttggaaaggaaacgggggcaggtgactttttggttcaggatgtcctggatgctggcttaccaccacagatagaattcccccttaaaccaagggaagacaagtatgttgttcttgtgtcagggttaagtgttgggagcagcagctctaatcctcttcagtttcagcttctcattgatcatattacagggcatttaggagatgagaaggagcaaagtatcgcatcacaaattgttcgagttgtctttgctggaaatttagtcgagatacctcgcagacttcttaatggacagaatttggcgtctaaggatctctcaaggatggctgagccaataaaggagctagatattctgttgagtcagatagctgctggcttgcctttggatatcatgccaggacccagtgaccctgctaatttctcactaccacagcaggtaaataggctactttcaatattactgcctttgatgctcaatctattataccttgaacatgatccccacactgcttccagatttcttgggacatcgggtcaaaatgtagatgatcttgagaagtattcagaggcaaaagataaacttgaattcatggaaaggacattaagatggaggcatttggcacccactgctcctaatactcttggatgctatccttatactgataaggatcctttcttcattgagagctgtcctcatgtttactttgttggaaatcaagataaatttgaaactcgtgtcataaagggatcagaagggcagttggtgagactcatatgtgttcctaaattcagtgaaactggagttgctgttatgctaaatctgagggaccttgattgtcatgctctcagttttggaacgcaattcagctcataa

SEQ ID NO: 675 - DNA, 237 bp, Glycine max
  Peptide Sequence Number=SeqID_92360
atgaggggatcctctaaagctcgacctgcaggcatgcaagcttggcactggccgtcgttttacaacgtcgtgactgggaaaaccctggcgttacccaacttaatcgccttgcagcacatccccctttcgccagctggccctgaatggcgaatggcgcctgatgcggtattttctccttacgcatctgtgcggtatttcacaccgcatatggtgcactctcagtacaatctgctctga

SEQ ID NO: 676 - DNA, 1272 bp, Glycine max
  Peptide Sequence Number=SeqID_92361
atgaatgagaacaaaattgattggggaggattgattcaacaaagtcatgtactaagtggggattttaattctgagtttggcaatcgttactgtcaatattttgatatcagacaagcttggaatatgggaccacttgccatggttggaggagaagccatagataatgagttacaaaacataggccatgccaaatcatctggcaccattatgagccgttttgagtcaccagcttctgccttttatgctgcagaaaactgcatggagtttgcagaatatgattgccaagttggtattcactctttgagctctcagttatgcaagattaatgatttggagttccccttgtatcaatctccaagggaaaaccttttcttggattcagcaaaccaatctgaaaccaactttgatttatcaaacactttgcaatccatagtgaaatctcaactgaatagtgctaatcaatgcagtagatcccctgaaaagtccaataaaatttcatgtgggaattttcacagcaccaagttccttccggttgaacaacagaagttgttcattgatggtcttatcagtggctcatcatttcctaacaaaggaaatcaagaccatatgctgagattctcttctcagattgagaggttgtctccaacactttcagcaggaagtgtgtccactattggaaactctgcttctaatgtggcggccgtagtgtcaagtaaaacacgtataagatggactaaggatcttcatgagaagtttgttgagtgtgtgaatcgccttggaggcgctgagcaggcaacaccaaaagctatattaaagatgatgaacactgatggtttgactatcttccatgtcaaaagtcatttgcagaaatatagaattgctaaattcattccagaacccagtcacgggaaatctgacaaaagaacccacacaaaggatgtgcatcatcttgatgtcaaaactggcatacaaattagagaggcacttaagctgcaattagatgctcaaaggtgtcttcatgaacaactagagattttcaattatcatacttttttggtccagattcagagaaaattacagttgcgaatcgaggaacaaggcaggcaactaaagaaaatgttcgaccagcaacagaagacaagtaatgacgtctctaatactcagaattcaaccattgaagagacatcaattagtcataaagacggtgaaaatgcttccgaaggggctaacaacaattccttcttcccttccaagacctctccaagccaataa

SEQ ID NO: 677 - DNA, 927 bp, Glycine max
  Peptide Sequence Number=SeqID_92362
atggcttcagacgcaaaactctcatcttctgagtccctcaacggtttgaaattcggccaaaaaatctattttgaggatgtgggttttgctactcccgctacctctcttacttcttctgctactactgctaccactgttacttcttcttcttcttcctcttcaagaaaaggaagaggtggttctgttcaaccagctcaacctccaaggtgtcaagttgaagggtgcgaagtagatctgagtaatgcaaaaacttactattctagacacaaagtttgtggcatgcactctaaatcccctacagtcattgttgctggtcttcaacaaaggttttgtcaacagtgtagcagaggtggcaactttctgatggaattggcttcatacccaaaacttagtctgagaaattcacttccaactcctaggtcatccgagctagcgcctggaaatcaaacctccaccctcagctggcacgggaactcggagacatcatctgaccttttcttgcaaggttcggtgggtgggacaagcttcgccggcccgggacatcctccaggggaaagttacactggggtcaccacctcgagctgtgctctctctcttctgtcaaatcaaacatggggttctagaaacccagcaccaagtcttgggttgaataacatggtaaatttccacgggacgcccatgacacagcctgctgcatcatctcatggtgcatcaatccatcaacttccaaataccccgtggtgtttcaagggcattgattctggtaactgttcgcccgagggggtccctgatctaggtctcggtcagatttcgcagcctctcagtagccaacttcacggtgagctggacctgtcccaacaaggcaggagacattatatggatctagaacagtccagggcatatgaatctgctcattggtcactttaa

SEQ ID NO: 678 - DNA, 3078 bp, Glycine max
  Peptide Sequence Number=SeqID_92363
atgacggaaccaacggagccatgcacgtcatcttccttggcaagggacccaaccaccgtgatccacccaaggcgcgagcccttcgagcacggcctcttgccgatcccgcgcctcatcttctccgacccggcgcaaaccctaattccgttgaagcagaagcttctcgagtcttcctccaaccagcgagtcgactcagcggcaatctccgagtcacttcagatctccattgagcaagccaggctcgtcctcgatactcttgcctcggttctgcactccgacgccgaacctctcgtcgccgccaagctcggagaaatcgattccgtcggcgtcgacgtccatgatctggttttgttcctctacattcaatcctacaagaggctcctcccgcgcacgcacaaggactccgccgccgtcgccgatgtctggccttccacctccgccttcgacggctacttgtccgcactctcgccgcttcagcttgtgcgcagcaacagccgaaggggtatgccatcgcaggttgatgaagaggcgcatcagctgtcgtatctgcaaaaacatttagctaacattgtatctcttgtagcacagcctgtggagggagaaggcgaagaatctctgaatcggtctggattgccgatgaagatcatggaaacattggattgtgcatttcaagtgagcggggatgttcatgggtttgcgggttgggttttaaccatggatagatttgagcaccttgggtttctaattcagtttggtgataagggatctgaaggaaattcttttagtcaatcttctcccttttttgcaaactcagaccctgatatgcctgctgttcctgttcctgctgctcaagttcatgattggcttctacagaatatagctgctgctttggaatatatttctgaacgaacttcttctaaggagaatggcccagctagtgcctctgatcaggatgttgctatgactgatgcatgcactacctcagttaacaaggtctcaacaagtactagaagtgcaagtttcattgaagggatctccaaatcgtcatatgtgaagcatgcatctgacattaaaggttcctctgttaaggttctaaattgccatgagtctgccatatacatcttagcacctttgagatatgcaactgtctatggatgttcagatgcaacagtagttattggagcagttggcaaggctgtgagagtagaacactgcgaacgagttcatgtaatcgtagccgcaaagcgtatttgtattgctaattgtcgtgaatgtgttttctttttgggagtgaaccagcaacctcttattcttggtgataaccataaactgcaggtggctccctataatacattttactcccaattggaagagcatatgaatgaagttggaattgtgcccacagttaaccgatgggatgagcctctagcattgggcatggttgatccccatgattcattatctcatccagcgggtgtctctgatgttcaagctgagtctgctacacgtgtggaccctgatcagttcactaattttgtgattccaaattggtttggagcagagtccacaggggctacaaaaggcaacccattcatgttaccagatgcctatatggcatctcagcataaaaatcaaaaaaatttaggggagataaggcaactcttacgagaagcacctttagaagaaagtcgcaaacgagaattgtcatctgcacttcatgtctacttcaaggactggttatatgttaaccaattgcccattgttcagactcaacaaatcaaagcacgccacgtcaccataaagccatacggtaaactccaccagaacgcacccgcatgtctctcttctccctctactttgttcccgaatcaaagatctgcaactctctctcatgatttttctctcggtgttgccatgacggaaccgacagagccatccacgtcatcttcattggcgagggacccaaccaccgtggttcacccaaggcgcgagccattcgagcacggcctcttgccaatcccgcgcctcatcttctccgacccgacgcaaaccctaatctcgttgaagcagaagcttctcgagttatcctctaaccagcgagtcgactcggcggcaatctccgagtcactgcagatccccattgagcacgccaggctcgtccttgataccctcgcctcgattctgcactccgactccgaacctctcgtcgccgccaagctcgaagaaatcgattccgtcggcgtcgacgtccatgatctggttttgttcctctacattcaatcctacaagaggctcctcccgcgcacgcacaaggactccgccgccgtcgccgatgtctggccttccacctccgccttcgacggctacttgtccgctctctcgccgcttcaggctgatgaagaggcacatcaattgtcgtatctgcaaaagcacttggctaacattgtgtctcttctagcagagcctgtggagggagaaggcgaagagtccctggttttaaccatggatagatttgagcatcttgggttcctaattcagtttggtgataagggatcagaaggaaattcttttagtcaatgttctcctttttttgcaaactcagaccctgacatgcctgctgttcccgttcctgccgcacaagttcatgattggcttctgcagaatatagtgtctgctttggaatatatttctgaacggacttcttcaaaggaaaatggcccagctagtgcctctgatcaggatgttgccatgactgacgcaagcactgtctcagttaaggtctcaacaggtactagaggggcaagtttcattgaagggatctctaaatcgtcatatgctaagcatgcatctgacattaaaggttcctccgttaaggttctaaattgccacgagtctgccatctacatcttagcaccattgagatatgctactgtctatggatgttcagatgcaacaatagttctaggagcagttggcaaggaagatgatactgatatgatgatagctgtcaagtgggcatgccttcaagtgactgagatttccttaggatttatagttctattgggccaatttggataa

SEQ ID NO: 679 - DNA, 486 bp, Glycine max
  Peptide Sequence Number=SeqID_92364
atggtggctccctataatactttttatgcccaattggaggagcatatgaatgaagttagaattgtgccctcagtgaaccgatggaatgaacccctagcattgggcatggttgatccccatgattcattatctcatccagctggtgtctctgatgttcaaactgagtctgctacacaggtggaccctgagcagttcactaattttgtgtcacatgctttgtttttggtccatgctgttggcacacagattccaagctggcttggaggagagtccactgggtttaaaaaagacaatccattcacgttacctgatgcttatatggcatctcagcataaaaatcacaaaaatttagaggagataaggaaactcttacgagaagcatctttagaagaaagtcgcaaacgagaattgtcatctgccctccatgtctacttcaaggactggttatatgttgaaacttggactaattctctaccaggcatatga

SEQ ID NO: 680 - DNA, 231 bp, Glycine max
  Peptide Sequence Number=SeqID_92365
atggaaaagattcttcaagagtctcaggttccaaaagtgcatgataaatatcgccaaagcccaatactgcagaggaaattaagtgaaactctgctttacgtaaagttgtcagatcttagtaagagggggagggttaaagatttacccggtgtgagatatcacattgttcgaggaaccctagatgttgtcgaagtaaaggatcgtcaacaagggcgttctagtgcgttgtag

SEQ ID NO: 681 - DNA, 1203 bp, Glycine max
  Peptide Sequence Number=SeqID_92366
atgtacaaggggattaacgacatagaggccagacatacaatgtttatatacactgcagaggatgcagccagagcttatgatatcatatcaataaagttgaatggatgggatgcgcttacaaacttccatttgaattgctatgatgttaggtgcattatggagagtgatttaactcagaccacggaaggaatagctacattaagaaaagtagacagcagtggcagtactgaaggataccctcaacaactgaacaactcatctttttctgagttttctcatggcttcaaaaaccctaatctgattccaagcaacccttatactcttggtggatttacagctggtgccggaagcagtagcgatggcaacttatttggaggagagtttccaaatatgagtgctatactgcagcaatcacttcagcctcagagccaagtgaattttaacaatgttttcaataatcagaaccttttcatcaacaccaccaacaacaacatcaaccagtttctgcctcagagttctaactttacagctggtgctggaagtagtagtactgccaatttcaatccaattggaggagagtttccaaatcagagtgctacattgcaacagccacttcagactccgagccaagagaatgttaatactgttttcaatcagagtattctgaacgacggcgacgaggataacaacaacaacagacagtttctggctctgatttctaactttcctttgcttgctcgtggcaccaaaaatcttgatttagaaagctgtctccgtttcaccaattggccagctgagtttggaaaaaagttgctaggtgggaacttggaattggatttggaaccttcttcaagcaatctgaacgtgccatctccaacacatgacatggtgaatgaaactgcagaagctgcaaatgctgttggttcacttgggcaacagatccaaccagtggaaccatctaatcaggaatttggagccacacagccacagttacctgcactgaaccaaagtcttgaacctgatcacaactataatgccaatattttgaaccagataccacctcaaaacttaaaccccagcttctctgatacttttcagattaatcctagttctgaaccaaacaacattattggttcccaaagtcagaccgatcaaggaatgaggataggcaaggcccctaatactgcaaggcaccaggtttaa

SEQ ID NO: 682 - DNA, 273 bp, Glycine max
  Peptide Sequence Number=SeqID_92367
atggctttctttggtagaattgggaatttgttacgacagacagcgagcagacaggctatacgttgtatgttatctgctccaagcacaaaactgtttattggagggggagtcaatgaaattatgttgacatattttatgtttcccttgaatgtcacgctctttgtagctaggataattatggatcgtgaaactggtagatccagaggatttggctttgttacatacacttcggatgaggaggcatcaagtaccattcaggccttggatggttag

SEQ ID NO: 683 - DNA, 930 bp, Glycine max
  Peptide Sequence Number=SeqID_92368
atgaaggggcatattggtaaaagacagcacaaccgactatgcgaaaagcgcatgttggctggtataaacgttcagagagagggaacagtacaagagtgtgaggatcggttaacccaactgcacagaattgattttgatttgttaaacatgattgagattttgtgtcatactggtatagagttccaagagttttgcttgcattcatttaactgtggtcgtgatttcattgcactccttggtgttgtgggagatgcggttgcaattatgattgtggtcatggagactccaaaaaaccttgacgttgcagctgaaatcgcagttccagatcattattttggtagaattgattttgaaatgttaaacatgattgagatgtgtcgctactggtgtaaacaggcaagggtagtcactaaaataatggagtctcacgatgagactggatgccaggctcctgaacgccccattctttgcattaataattgtggcttctttggaagagcagctaccatgaacatgtgttccaagtgttacaaggacatgctgttgaagcaggagcaggacaattttgcagcatcgtcggttgaaaacattgtgaatggcagttccaatggcaatggggctgtgactactggtgctgttgatgtacaagttgaagctgtggaggtcaagactgtctctgctcagagttctgtagattcatcctccggtgagagtttggagatgaaagccaagaacagtcccagtagatgcgctacatgccggaaacgtgttgggttaactggtttcagctgcaaatgtggcaacctcttctgtgcaatgcatcgctattctgataaacatgaatgcccttttgattataggactgttggtcaggatgccatagctaaagccaacccgatagttaaggcagataagcttgacaaaatctag

SEQ ID NO: 684 - DNA, 321 bp, Glycine max
  Peptide Sequence Number=SeqID_92369
atgagtaagtgcaaccttgcaatcacacctattgagataggaattagacttcagctagtaggagatgaaaacatatttgtgagaaagccaaggatacctcacttccaagtagctaaaaggatcctgagatacttgaaaggtactctggattttggaattttctattctatcctcatagtcagaagaatgcagaaggagaagtctatggctatagcaactcagattggtgtggagataaaggagataggaaaactactactggttatgtcttcaaatttgagtcagcaacaatttcttggagttcaaggaagcaaggagtag

SEQ ID NO: 685 - DNA, 852 bp, Glycine max
  Peptide Sequence Number=SeqID_92370
atgggggaaaggtgtatgttagttggtgttctatcaactcgtattagagctccgatcttggaacgtagaatcattaatggtgacgaaggcaaacacgagaatggagatatgcatggaagccatggagaaaggatgatacaaaggttggcagcagcatgggagaaaaaatctcctactacaaacgttcacacagctgacatgagcggaggaaatgagggcattgcggcgcatgacgacaatcgatggaggaatttggaaatgcccatattcgatggcaagctagaggctgtaatggttgcgatggacggggaagctctgggttggttccaatggtgggaatcttggaatccaaaccactcttgggatggattcaagattgctgtcacccaaaggtttcaagctcctagcctgggaaatccttttcaagtgttgatggcattggaacaagaagagacagtgcaaggattcataggccaatttgagaagtgcgtcggaatggtgaagaggttggaggagccatttctggtggaagtgttcctcaaggggttaaaggaagaaattagcactgaggtaaggcttcatgaaccaaagaatttgatggaagctatggttaaggatcaaagagtggaggataagaacagagttttagggaagttactcttgagtaatagccaggggtataatctgcagaaacccaattattcgggtcagaaatttgtaagggattggcaacgagcaaatagtaaggtagctgatcctactaatgttgctaaaacaggatccagtggatggcaaggctattttcctcaacttgaccttgaggacaaggtccatcttgaaggggagtattga

SEQ ID NO: 686 - DNA, 855 bp, Glycine max
  Peptide Sequence Number=SeqID_92371
atggatacttgcaagaagttccccttgaagccatggaagaaagggccaacaagggggaaaggcggcccccagaacgcctcgtgtgagtaccgaggcgttcggcagagaacttggggcaaatgggttgctgagataagagagccaaagaagagaactaggctctggcttggttcttttgccacagctgaagaagctgccatggcttatgatgaggctgcaaggagactctatggtccagatgcataccttaatctcccccaccttcaaccaaggtccacttcaactactatcacatcatcagggaagttcaaatggttcccttccaagaacttcatttcaatgttcccttcctgtggattactcaatgtaaatgctcaacctagtgttcatttaatccaccagaggctacaggagcttaagagaaattcagttgtcagtcaatcgccgcctaattcatccaatgaaccaaaggaagaaactcagactgtaggcagcaaaaaagatggagaaaatccaccaaaagatgatcaaatgttgtcagaggaggttcttggagatcttcaggagaaaccccagatagacctccatgagtttcttcaacagatgggaatccttaaagaagaaagagagtcagagagaactgatagctcaggaagttcatcaacaatgcctgaagctctgttgagagatgacaatgatcatcatttgggagtgttttctgacaatagtgttaactgggaggcattgattgatatgcatggaattgcaggtattcaggaatcagaagtcactcagcttgaagcatatgacccaaatgatgatcttactttctcaacttccatttggaacttttaa

SEQ ID NO: 687 - DNA, 2043 bp, Glycine max
  Peptide Sequence Number=SeqID_92372
atgaatcacttatctcttgacaccgaagattattctctgtcaagcttgctggagcttgcagccaacaacgatgtttcgggtttcaaaagactaatcgagtgcgatccttcctccatagacgaggttgggttgtggtatatccgtcacaaagagtcaaagaagatggtcaatgagcaaagaactcctttgatggttgctgctacctatggcagcattgatgtcatgaagctgattctttctctatcagaagccgatgtgaacctctcttgtggccttgacaaaagcactgcacttcactgcgcagcttcaggtgggtctgaaaatgccgttgatgctgtgaaactgcttctggaagcaggtgctgatgtgaattccgttgatgtcaatgctcaccgacccggtgatgttattgttttccctacaaagcttgaacatgtgaaaaaaaccagtcttgaagagcttcttcaaaaaaccgatgattggagtctccttagggtgatcacaacaacaacctcatgcaatgcttgttcacctcctttatcgacctcacccgagattgagattgagattgagatcgagtctccttgttctgcccgagattcgaagatgaagtcagatgaagtcactgaaaagaaagagtacccagttgctccgtcccttccggacatcaagaacagcatatactcaaccgatgaattccgaatgtattcgttcaaggttcgaccttgttcgcgcgcttattcgcacgattggactgaatgcccctttgttcatccaggggagaatgccagaagaagggacccgagaaagtttcattatagctgtgtcccttgtcctgaatttcgaaagggttcttgcaggagaggggatttgtgtgagtatgctcatggggtttttgaatgctggttgcatcctgcacaatatcgaaccaggctttgcaaggatgggactaattgtgcaagaagagtttgcttctttgcccacaccaatgaagagcttagacctctgtatgtttctactggctctgctgttccttctcctcgttcgggcgcgccttcttctgctatggattttgttacagccatgaccatgtcgccttccagtccttcaattgcttggtctcagcctaacatcccagcattgcatcttcctggaagtaattttcattccagtagattgagatcttcactcaatgctagagatatttctatggatgattttgatttgttattacctgattatgatcagcatcagcagcagcaacagttccttaatgagttatcatgcctctctccacatgctatgaattctaatcccatgaaccgctctggtcgaatgaaactcttgactccttcaaatcttgatgatctgttttcagctgagagttcttctcctagatatgctgatccagcattggcttcagctgtgttttctccaactcacaaatcagctgtcttcaatcaatttcagcagcaccagcaaagcttgttggcaccggtgaatactaattttgcttctaaaaatgttgagcatcctttgttgcaggcctcattggtaatgtctccccgaaacatggaacctatttctccaatgggatctaggatttctatgctagcgcaacgtgagaagcaacaatttcgcagcttaagcttccgggaactcggctccaattctgctgcttctgctgcctctactacctctgccaattcttggtcaaaatgggggtcacctaatggtaattttgattggccagttggtgcttctgatgaaataggtaagctaagaaggtcatcatcatttgagcttgggaacaatggtgaggagcctgatttatcttgggtgcagtcacttgttaaggaatcaccagctgacgttaaaggtaaatttgcaaccactgtctcaaatgtttcagcagcagcagctggatcctccagtgagggatcaaacatgagcacacaaatggagtctgttgttgatcatgctgtgctgggagcatggcttgaacagatgcagcttgatcatcttgtggctcagcaaaactga

SEQ ID NO: 688 - DNA, 240 bp, Glycine max
  Peptide Sequence Number=SeqID_92373
atgtttttactatcatgtcctttacttgcctcgtggaacttgtgggattatacacacacaaaaagcaattggtactggaggagagagaagagttcattcattcaacatttcgagctctcggcatatctttgctgcccattctgccagcctaaggtctttgaacgtcttgctatcactggtaatggcggttttgtcggggcttttggcaacgctctatgtcgtagctggggattgcaatga

SEQ ID NO: 689 - DNA, 162 bp, Glycine max
  Peptide Sequence Number=SeqID_92374
atgtctgatccttcaaaacggcgtcaaacatcaagcaggccgaccactactcggatacataatgagatggatgaaccaattccaaataggcctaagaaatactcattatgtagaattgaaggacataatcggagtaactgtccatacaaacaaattatttaa

SEQ ID NO: 690 - DNA, 432 bp, Glycine max
  Peptide Sequence Number=SeqID_92375
atgttgatcattcaccttctatatattgatgatggtgggacattcaagaacatgatcaagcaaagcgcaaatgttttgagcttaaacaagtttgattataagttgggtaatactccttttcttgaaaaggctttcaacaaggcttggcaagtagtatgctctactggggaagcaattcttgtggtgcctcaagggaattacctgctcaaaccaatcagattctctggtccttgcaaacctaactttgcagtccagatttccggaacccttgaagcatcagatgatccatcagattatagcggagacaacagacactggcttgtatttgacaatattcagaaattatttgtttatggtggtggaaccatcaatggaaacggcaacatttcgtggcaaaattcatgcaaaaggaacaaaaagctaaaatgctaa

SEQ ID NO: 691 - DNA, 2349 bp, Glycine max
  Peptide Sequence Number=SeqID_92376
attgtttctgctgtcttggaaaactatgaagttcctaagaaaaattcagcaaacctggatcatgaggaacaagatgtgatggccaatgagggtcaaatctctcctttgctggatgtcaaaaggagaaacccttcctggagaaaagttgttaacgataaaggcgaaataaatgtagcaatggaagatgacatgaatccctctttttggtctggagtttgcctacataatatggccaatttagccaaggaggggactaccatacgtcgtgtaatggaatctttattccggtactttgataatggaaacttatggtctataaaccatggccttgccttttctgttttaaaggatatgctatttttgatggatgactctgagaaaaacacacatgttttgctgtcgacgttaattaagcatctggatcataaaattgtccttaaagaacctcaaatgcagcttgacattgttgaggttgccacttcacttgccccatatgcaaaagtccaaccttctgtatcaatagttggtgcagtaagtgacatgatgagacatttgcggaagtgcatacactgttccctggatgactcaaatctggcccctgatgtaatcaattggaacaagaatttcaaaaaagttgtggataggtgccttgtacagttgtcaaataagcctccttaccaaatgtgtcctatcagaataaggcaaggagtggatattcctggttttgttctttcctctatggttcactactttgactttttatggataaatttgagactaaaaccctacatttctccccaggcattccctgagaccttgtttcatcaactactcctggctatggtccatccagatcacgaaacacgagtggtatctcaccacatcttttccagtattcttgtgccaacatctgttttccctcatccaagcttgtctgcttctgaccccaaggcatcaaatgttccacgaactctctctcgagctgtctctgttttctcttcttcagctgtcttatttgagaagctaagactggagaaacgttcttcaagtgaaaaattaattcaacacaacaaaggcaatatttctggagagattgaaccagttagtagcaatgttgggattgtaaacagattaaagtcaacctatggtcggttgcctagtgtgaataaccctcctctacaattggaactggatgaaattgctgcaaacaaagataatcggaactcggttgatgttatcatggtcaatattactgatcagcttttcacttgtatacaggaggctgctgctctcaggctgactaagcttcagataaatcgattgctctcgtcaatttgggcacagtctttatctcctggaaatatgcctgcaaattatgaagcaattgcctattcatacactttggtgttgcttgtttctagagaaaaggtgggttacagcatgttgtgtgagctggttattgatggtgttaaggtactagttcggagttttcagcttgctttttctttatggaatatttcccttaaagaagggccattgccaccatctcgtcggagatcactctttacgctggcaacgtcaatgattgtgttttcttcaaaagaatacaacattgaccatcttgtccagagtgccaaggcagtgcttacggagaaggttgatccctaccttcagttaattgaagatcacaagttgcaagctgtcagctttgctcctgataatctaagcatcaactatggatctaaagaagacgatgatagggccttagacatgctttcagatttattgacttatatacacaaaacacgggacctctttgcttctgaaatcattaagagcttggaaatgtttgcaaaagcggaattatcatcaataaaggaacaactgctagaagaattcgcaccagatgctatgtgtgaacttggatctcaattgaccatgaacatggctgcaaaggctttggacacatctcatccagctgggaggatttctgtatcaaatgcatttaatatgccatacaaggatatggctgataagtgtgaggtacttctgctggaaaagcaaaagatgtccagattgatgagtacccaacagaagcaagaatgttcagtggactccctttcaccaaatcatggcaatgaattgaaaaatatggattcctcttcgcatgtggattttcaaaaggtggggaatcctcccttcgacgagaatgctgcttttgatttccacggaccaacttttagccctcttccaatggtgtctggaactgaatatcagaatcagcctcaccctttcaaacttccagcagcaagcccctatgataactttatgaaagctgctggttgttga

SEQ ID NO: 692 - DNA, 414 bp, Glycine max
  Peptide Sequence Number=SeqID_92377
atgatagccaatgcattggataaggatggtaaattcactactgcccaagtctctcgaaaacttaagcagcttggtttgtctcttcctctgaagagttctggaggaaaaatgcacccaaagggtgtagatctcatggatcgttcaaatgaaaggatggatgaatctgatgatgagacattggtatcactggtaaaaaggaagaaaatggagagtggcaaattatcaaggggacagttacatgggcaaaccagtgaggataaattgtcaaaaggcgattttgatgatgaaatgctcaactctgttctcaaagacaagcttgatgatgttattaaaggctttgcacctacctctggaagtaacagtgacaaagatgatcataagtacgtttacaacttgacatcaaattttacttga

SEQ ID NO: 693 - DNA, 561 bp, Glycine max
  Peptide Sequence Number=SeqID_92378
atggcagagtcggcatgggtgacgaagtcagcgtgggcagtagagtcgacaaggtcggcatgggcgatggaggtagcagtggtgactgcacagaggaagaagggtagtggtggctggttctcggaggcagttttaggagaagggcatccagtgtggatccgaggcggcattgagttgcagcaagtttggtcaaggcagcctcgaggcagtcctcgcaagcgacagaaagtttggtgtccgtcattcgaggtggtgtgggttgtggtagtcgaagttggtatgacagccatggaaggcaaccatgagagctttgtgtggcaggtggtgtgggttgcggtagtcaaagctgacactactaaaaaaaagaccttctacatcggttctaatgacttttctacatcggttatgacgcgtggtggtaacccgaggtcgttgaatcacaacatcggttttatgaccatctttgaaggccggcttttctacatcggttgtctagctacaatcgatgtagaatgggtagctttctacagcggttctaaggctgaaacagatgttgaatga

SEQ ID NO: 694 - DNA, 297 bp, Glycine max
  Peptide Sequence Number=SeqID_92379
atgcaggagcagaaccaggagctgcggaaatgtctgaggcggctcaaacgtgtcttctcctatgcagaagatatgctggatgaatttgagtgcaagagacaacgaaagcaagttgtcaaagctcatggtaccaccaaagacaagatggctcaacaaatcaaagatatcagcaagaggctagacaaggttgcagcagataggcataagtttggtcttcaaccaatcgatgttgatagacgtgttgtgcataagagagacatgacaccaaattggtttctttactgtcattttttttaa

SEQ ID NO: 695 - DNA, 2799 bp, Glycine max
  Peptide Sequence Number=SeqID_92380
atgtctagtgctacaaaagtgttggatccagcattccagggagttggtcaaaaaccagttccattgcccagacctgattatgggaaattctacatgggagattcttacatcatcttgcagacaacacaaggcaaaggaagtgcttatttgtatgatattcacttctggattggaaaggatacaagtcaggatgaggctggaacagcagccattaaaactgttgaactcgatgcgtctcttggaggacgtgcagtgcaacacagggaaattcaagggcatgaatccgacaagtttttgtcatactttaagccatgtataataccattagagggaggtgttgcatcgggatttaaaaaacctgaagaagaggagtttgaaacacgtttgtatgtatgcagaggaaaaagagttgttccttttgcacggtcttcactgaatcatgatgatgtattcatcctagacactcagaataagatttatcaattcaatggtgcaaactccaatatccaggaaagagccaaggctctggaagttattcagttgttgaaggaaaagtatcatgagggaaaatgcgacgttgcaattgttgatgatggaaagctggatactgagtcagactcaggtgaattttgggttctctttggtggttttgctcccattgggaagaagataattagtgaggatgatattgttccagagaccattcctgctcaactctatagtattgctgatggtgaggccaagcctgtggaaggtgaactttcaaaatcactgctggagaactacaaatgctatctattggactgtggagctgaggtatttgtctgggttggccgggtaacacaagttgaagaacgaaaagcagcatgtcaagcagctgaggagtttctcacaagtcaaaaaaggccgaaatctacaaggattaccagaattattcaaggttatgagacacattcgtttaagtccaactttgattcttggccatcaggatctgctactactggtgctgatgaaggaagaggaaaagttgcagctttgcttaagcaacaaggtatgggtgtgaaaggggtgacaaaaactacctcagttgttgaggaaattccacctctacttgaaggaggtggaaagatggaggtatggcaaatcaatggaagtgctaagactccattacctaaggaggatatcggtaaattttatagtggagattgttacatagtactgtacacttatcactctagtgagaggaaggaggactactacttgtgttgttggtttggaaaagacagcactgaggaggaccaaagaatggctattcgattggctaacacaatgttcaactcattaaagggtagacctgttcagggtcgcatatttgatggtaaagagccaccacagtttattgttcttttccatccaatggtggtcctcaagggaggcttgagctctggttacaaaaaattgatagcagataaaggtttgccagatgagacatacacagcagagagtgttgcatttattcgaatttctggaacatccactcataataataaagtggtgcaagtagatgcagtggcagcattgctgaattctaccgagtgttttgtcctgcaatctggctcagctgtttttacatggcatgggaatcaatgttcccttgagcagcagcagcttgctgcaaaagttgctgaatttttaagggtagaggaggtttacaacttttcccaagatgatttgttaacagaggatatcctgatccttgacacacacgcagaagtgtttgtatggattggtcagtgtgtggacccaaaagaaaagcaaaatgcttttgaaattgcccagaaatacatagataaggctgcatctctggagggactatctcctcatgtaccactatacaaagtaacagaagggaatgaaccttgctttttcacaacatacttttcttgggatcatacaaaagctatggttccaggaaactcattccagaaaaaggtgacattactctttggaattggccatcctgtagaggaaaagtctaatgggtcaagtcaaggagggggaccaagacaaagagcagaagctttggctgccttaaataatgcattcaattcatctcctgaggcaacatccagtgcgtcactgaacttcaaatcattagtagattctcctgataagaaaggagggcatagggataagtcgaatgggctaagtcgaggaggaccaagacaaagggctgaagccttagcagccttaaactctgcatttaattcatcatctggaaccaaagtttatactcctaggccatctggaagaggtcaaggatcacaaagagccgccgcagtagctgctctctcttcagttcttactgctgaaaagaagaaaacttcacctgaaacttctcctgtggctagcactagtcctgtagtggagaatagcaactttgatactaaaagtgaaagtgccccttctgaaaaggaaattgttgaagaagttacagaagtcaaggagacagaagttgttgcccttgaaactggtaccaatggggattcagaacaaccaaaacaagaaaatgtggaggatggaggaaatgacagtgaaaataataatcaaaatttcttcagttatgagcagttaaagaccaaatctggtagtgttgtgtctggaattgatcttaaacggagagaggcctatctgtcagacaaagagttccaagctgtatttggaatggccaaagatgcattctccaagttgccaagatggaagcaagacatgctgaaaagaaaagtggatttgttctag

SEQ ID NO: 696 - DNA, 345 bp, Glycine max
  Peptide Sequence Number=SeqID_92381
atggaaggaaaaatactgaacaagtttgacatgaggtcccataatcaaacccttgaactctatggtaaactctaccgtgaaaggacaaataagtatatggttattgagaacgatagtggggcgcatatgaggccaatgccaatgatgataagtttttcgacttctggacccagtgaaaaaaaagctccaactaaaccaacggatatgaagagaacaagaagagaccatggaaagatagaagagattgtgttcgagctatttgaacgacaaccaaattggagtttaagaaaactcatacaagaaaccaaccaacctgaagtaggtctctacaagcacaccatatga

SEQ ID NO: 697 - DNA, 648 bp, Glycine max
  Peptide Sequence Number=SeqID_92382
atggatgcaagtatgcaagcaagactgcaagaacaatggaggaggctagagatacccacatttggtggagatgaagatgtcaaggtttgggttcatgaggtggagtgttatttcaggatatgggcggcaatggaggatgaaaagctagaaatgctccagcaaatggttgattcgttcataatattaatagcgcagcagtctgacttcaatttcaatgctgaaaatctagagcttcctcttccaggcttctatgacaataatttctcattgaaaaatccttggactcagtttaaccctgcacgcatacgaatagctccatttcccactcgagagtacactgatgatcagttccagtcaatcataaagagagtcatgggaatattgtacttattggggtttctctatccaatttctcgcctaatcagttattctgtgtatgagaaggaacagaagattaaagaaggactctatatgatgggcctgaacgatgtcttacactctgtcaggattaatgagttagatgggtggggagccaaaatggacggaaaggatgaaaacattggatggaaaaaaaagtctggggatgctgatttgttgccgaagagtttaaggaccaaaaccataaatgttaaaaagtttgggaactaa

SEQ ID NO: 698 - DNA, 369 bp, Glycine max
  Peptide Sequence Number=SeqID_92383
atgacagacattagcagtgtgccacctctagtagaatatgggataggttgcagtctggatcagtttgttggaggggtttctttgttaccaacaatcctcatgcttttggaatatggacttgcaatcgcatcatcaacttattgccttacatttttcttttttgaccataccatggcgcagaatgtggttctcttgatccactttttctctggattgatactgatggttatctcattcattatgggactcatgccatcaacaatgagtgccaattcttttcttaagcatgagtacttcgcccttacttgggctaattctttttcctgtaaaaccaaaaacaggaaaaaaggttttagggcactaatttaa

SEQ ID NO: 699 - DNA, 327 bp, Glycine max
  Peptide Sequence Number=SeqID_92384
atgactagggggcttaggtgggaatccatgtgctggattcaggctataggacctttctcagctgatcctgctaaccactttatccaattctgtgatggatttggtgcagggagaaatcttagtaggaggggcgggtggtggattgccttatctattacaatctggcagcataggaattcctttctgtttcatggcattccttttgaacctcagaaggtgctggatgatgcattaattctagcttggtcctggcttaaatgtggagagaaaggtttcaatacatcatttaaccattggtctaccaatcttatgatggcctttggttaa

SEQ ID NO: 700 - DNA, 423 bp, Glycine max
  Peptide Sequence Number=SeqID_92385
atggggacttttcatcacataagctggctcaggttttccttgggaccgcacttggggttttcctcgacgaggtttgacttgcgcttcaccactaccgccaccaaaatcaaggccactcccgacggcgagtacatcattgcttccggcatctatccgccgcaagtcaaggtctacaaggtcaaggagctaggcttgaagttcgaacaccacttggatttcgagatcgttgattttcaacttcatgtattagttgcctgtggtggtgaagatggtgttgtggaatgctttgacatgcgagtgagatcttcaattggaagaattgatgttgttggacctagtggtgatgttaaccaggagatcactgcattggagtttgatgaagatggtggtttcttaatggtcgttggaagtagtgcaggaaag

SEQ ID NO: 701 - DNA, 999 bp, Glycine max
  Peptide Sequence Number=SeqID_92386
atgaggcttccttctaaaatgaccaaagaagagatagacaaagtggtggaagaaaccatagtggaaatgggtctggaagattgtgcagatactaggattggaaattggcattgtaggggtattagtaatggtgaaaagaaaagacttagcattggccttgagattctgacacaaccatatgtcttacttcttgatgaacctactactggacttgatagtgcctcagctttctatgtgattcaatctctgtgccacaatgctcacaatggaaagatagttatctgttccattcaccagccaagtagtgaaacttttaatatatttgatgatttgcttttgctttcaagtggggaaactgtttattttggagaagccaatatggctctaaagctatcttcatctaattcagcactgggagcgaaaaaagccgagattagagagacactcattcgaagttatgaaggttcaaggctaatgatcaatgcgagaagaagaattcaacaactgaaagctaatgaagagcaagaaattaaggccaagataggtagcagtgccacgtggtggaagcagatgtgcacattgaccaagcgatctttcctaaacatgactagggacattggttactactggctgaggatagtattctacatactggtgttctatggtgaaaggtccaaagggcattatggagaggctgcattcgtagtatcaaacatcatatcatcatttcctttcattgttctaacatcgctctcctccggattaatcatttacttcatggtgcaacttcatccggcctcagtggtccccaatgtgctgatgggcttaggaacaggaactggtgtaattcttttcatgatgatgtcctcccaattagtcagaccactgcatgacattccaaagatcttttggcgctaccccatgtcatacctcagttttactacatgggcagtgcaggttccatcaaatagttatgttaccacagattccatcaaatag

SEQ ID NO: 702 - DNA, 213 bp, Glycine max
  Peptide Sequence Number=SeqID_92387
atggcgggaactgattcacacacaactatgattgatggtcttggtgttgctagatggggagttggtggaataaaagcagaagctgcaatgcttggccagagtggtggtggcgcaagaaaagttgatttgcagaagcggcttagcgctacggaacaagaggaagacttgagctgggacattgaagatgatgatgatgagactcttaatgcttga

SEQ ID NO: 703 - DNA, 1704 bp, Glycine max
  Peptide Sequence Number=SeqID_92388
atggaggatggttcaagaaataggactcatttcaacatggcttcaagaaaagctgaagaatctgcttggagacgctatgaggctactcagtggctagaaagccaagtgggtcctcttggtataccaaaccagcctacagagacagaactcatttcttgcttgagaaatggtttgattctttgcaatgccattaacaagattcatccaggagcagtgcctaaggttgtcgttgtggataatcaagtgccttcacaatcacttgcctgggattctcagcctttgcctgcctatcagtattttgaaaatgtacgcaattttctgtttgtgatggaagaattaaagcttccggcttttgaagtttctgatcttgaaagggataatctagagatgggatcggcagcaaaactcgttgattgcattttggcacttaaatcatttcaagagttgaagcagatgaacaaacagaatggatacaacaaacacataaaatctcctttgcctatgagaatgcattcaagagcagctgcattctcctttgatgcttctaggcacttggatttgtctgccacattgactttgataaactgtccttgtattctcatgtgcacttgtataattgcatttttcttgctactacctttgctggatccagcagagattgtggaattacttgccaagcaactggttgaccttatgtttgatgccaaagaaaatatcgatggaaacatcattgcttctctccataaagaacacctggtagcggatccaataaaggtatttaatcagataatggcatgttgtaatggggaacagccacctacaaatttcaacgagttgccattgcttctaaaggattctgtaaaagaaaagggtaacttaccacctcattccatttcaacacctacgcaatcagatgctttatctgctcctgacagttctaagcatggcgaagcttgcctcagaaagtgcaagtgcaatcaggtgcatcttttagacatgcaggaaaaagaacttctggatctcaaggctttgaagttgaaaattaagaaagagtttcaagagatacagtcacagtttcaagggagtcaaatacaggagatgtcaactaaagctcttggatatcacaaagtagtagaagagaataggaaactatacaacatggtccaagatttgaaaggtaatattcgagtttactgcagaatcaggccctcattccgggctgaatccaagaatgttgttgatttcattggggaagatggttctctattcattttagatccaacaaaaacactaaaagatggaaggaaactttttcagtttaatcaggtttttggtccaatagctggccaagatgatgtttataaggatactcaaccattaattagatctgtgatggatgggtacaatgtttgtatttttgcttatggtcaaactggatcggggaagacttacaccatgagtggtccttcaggtggagggacatcaaaggatatgggaatcaattatctggcacttaatgatctgtttcaaatgtctaatgaaaggaaggacatcataagctatgacatttatgttcaaatggttgagatttacaatgaacaagttagagacctacttgcagaggacaaaacagacaacaaatatccttttcatattcattattccatagggtccaacattttcacacttctccgaagagattag

SEQ ID NO: 704 - DNA, 1614 bp, Glycine max
  Peptide Sequence Number=SeqID_92389
atggtccactatcaccgctcccatcaacccagaaaggccaacaacacagactccatcatcaaagacgaagagtcacagaacaacatcacgttggattgttcatcctctgcttactacaagagaacaaggcccaagttgttgtcttttctcttcctcatcaccttcctctcttgctgctatgtttttgctcctcttttccttggcccttctttccctctatctctcttgtactctcccgcaactgaaaatgatttgaaacaagatggggttggtgctaatgattctccatgctcttctgtttctactggaactatatgttgtgatagaagtggttatcgttctgatgtctgtgtgatgaaaggtgatataagaacacactctgcttcctcttcggtcttcctctacaattcaaggagcaacaacaatgtttcgagaaattttgaagaagaactccaacatgaaaagatcaagccgtatactagaaaatgggagacaagtgttatggacaccattgatgaattaaacctcatctcgaagaaagtgaattcaggtagtgttggaggttgtgatgtccaacatgatgttccagcagtgttcttctcaaatgggggctacactggcaatgtttatcacgaattcaatgatggaatcgtacccttatacattacttctcagcatttcaagaagaaggttgtgtttgtgattcttgagtatcataattggtggatcatgaagtatggagatatcctttctcgcctatcggattttccgccaatcgattttcaaggagacaatagaactcattgcttcacagaagcaatagttggtctcagaatccatgatgagctaactgtggattcttcattgatgaggggtaacaagagcattgctgattttagaaaccttttggataaagcttattggccaaggatcaaggggctgattcgagacgaagaaaggaaagcacaagagaaattgagagaacaagtctcttcatctgaatcatcagaagcctcacaacaacagtatataactattaggcaacaagtgcaagaaaatccaatgaagaagcctaagttggttattctttctagaagtggttcaagagctataactaatgagaatttgcttgtgaagatggcaaaggaaattgggtttttggtgcaagttttgaagcccgacagaacaacagaaatggcaaagatttataggactctcaatgcaagtgatgtcatgattggtgttcatggagcagctatgacacattttctgttcctgagacctggttctgtgtttattcaagtggttcctcttggtaccacatgggctgcagaaacttattatggggaaccagcaaggaagcttggattgaaatacattggctatcaaattttgcctagagagagcactttgtatgagaaatatgataaaaatgatcctattctgagagaccctacaagcattaacaagaaggggtgggaatacacaaagaagatctatcttgacagccaaaatgtcatgttagacctcagaagattcagaaaaaggttgcatcgagcgtatgagtatacactctccaaatcaaaactgagtctccaacatcaaccaatgtga

SEQ ID NO: 705 - DNA, 207 bp, Glycine max
  Peptide Sequence Number=SeqID_92390
atggagaaaactctcctcaaggatttcgagctccagcacaaaaatccctccgtcgaagccctccgccgatggagatccgccgtcactctcgtcaaaaaccaccgccgccgcttccgcatggtcgccgatctcgacaagcgcgtccaagccgagcagattaagcaggggatcaagtgcatcgtaatatccgtaaccgccatagcatag

SEQ ID NO: 706 - DNA, 369 bp, Glycine max
  Peptide Sequence Number=SeqID_92391
atgggaccttgcgggacgaggggtgtgatcccctaccccgcccccaccatgcccgtggggaaccatccctgtccttgtgggaaaatattcccgtctgcgggattccatacagggcagtccccgcggggatcccgtttgcgattcaaattgacacccctagtttcactatttctagtcatagctgttggggattggatgatgaggccttgtcgggtactacagttggtgtcgcttcattggtgggcatacaaggaaatattgcttcctaagagaaataggaggaagaagctcaatgaaaggctttttgtgcttggatcggtggttcctaacattagcaaggctttgattattaaggatgctattgagtaa

SEQ ID NO: 707 - DNA, 4608 bp, Glycine max
  Peptide Sequence Number=SeqID_92392
atggatcacagaccgaaatccaaggagtcactctcttactccactctcttcaatctcgagtctttgatgaactttcaacttccagaacaagataatgattttgattattacggaaatagtagtcaggatgagagcagagacagccaaggtgtggggattgcaaatcacagtaatgggaatgtgcatgaaaaggaggtgaatttgttcaagaagaggaggtggtctctaaacagtgacaacgaggagaagagcagtttttacgggacacacatgacggaggagcgatatcgatcaatgctgggagagcatattcagaaatacaagaggaggtttaagggtaccttgaatagtcctgcccaaaatcaggctgctgttccacttgtgaaaagcaacacgggattaaaagctcacaagtcagggaatgagcgcaggggaggaggattacatgtggcggagagtacatcggaatggatgaatgattctggttctcaaaaacctggaaactaccgcaatgcagatttctcgccgcaatatggcactgataggattatgtatgaacctgcatctttggatatcggggatggaatcatttacaagatccctccagtctatgataagttggctggagctctaaacctcccaagctgctcagatatccatgttgaggatttatacttaaagggtactttggatttgggctccttggctgaaatgatggctgctgataaaagatttgggaacagaaaccgagcaggcatgggagaagcaataccacaatttgaatcactgcaggcacgactgaaggtcatgtcagcttctaattcggctcgtaagttcagtctgaaaatgtctgatgttgatttgaattcctccattccggagggggcagcgggaagcataaggcgatctattttgtctgagggtggagtattgcaggtttattatgtgaaggttttggagaaaggtgacacctatgagctttgtcacattggactgcttcagatcattgaaagaagcctacctaagaagcaaaaggtgaagaaagaccctgctttgatagagaaggaggaaatggaaagatgtggaaaagtttgggcaaatattgtcagaatgaaagttagtagatcccttaaatggacaaggactgccagtatgcgcacccgtaaactagctagagacatgttactgttctggaaacgaatagacaaggagatgacagaagtgaggaagagggaggaaaaagaagctgctgaagctttgaggcgtgaacaggagcttcgagaggcaaagagacagcagcaaaggcttaattttcttatacaacaaactgagctgtacagtcactttatgcagaacaagtcaaacttactatcttcagaaactttacccaaggaagatgaagatgcagatgatcaagatgcactgatcgactcttcagatgctgtgcccgatgaggaggaagatcctgaagaggctgaattgaagaaggaagctttgaaggctgcacaagaagcagtttctaagcagaaaatgttgacaagtgcttttgacactgaatgcttgaggctgcgccaagctggtgaaactgattcacttccaccagatgttgctggagcgagtaatattgatttgcaaacgccctccaccatgccagtggcatccacagttcggacacctgaattatttaaaggtgttcttaaagaatatcagctaaaaggtcttcagtggctcgttaattgttatgagcagggtttaaatggtattctagcggatgagatgggacttggaaagaccattcaagccatggcttttttggcccatttagctgaggtagctattcatccacatgttttggaaaaaaatatatggggaccttttctggttgttgcacctgcttctgtattaaataattggaatgaggaacttgagcgcttctgccctgaactgaaaagacttccatattggggtgggctttcagagcggacagtacttaggaaaagtattaacccaaaggatctttatcgtagggaagctaaatttcacattctcatcacaagctaccagctattagtatccgatgagaagtattttcgtcgcgtgaaatggcagtatatggttttagatgaagcccaggcaatcaaaagtgcaaccagtataagatggaagacactcctcagttttaattgtcggaatcgcctactgctgactggtacacccattcagaataatatggctgagttatgggctcttcttcacttcatcatgccaactttatttgacagccatgagcagtttaatgagtggttttctaaaggaattgagaaccatgcagaacatgggggtactttaaatgagcaccaacttaatcgattgcattcaattctaaagcctttcatgctgcggcgtgttaaaaaggatgtgatttctgagcttactacaaaaactgaggttactgtgcattgtaagctgagttctcggcagcaggctttctatcaagcaattaagaacaagatatctcttgctgagttgtttgatagtaatcgtgggcagctcaacgagaagagaattctgaatttaatgaacatcgttattcaactaaggaaggtttgcaaccatccagagttgttcgaaaggagtgagggaagcacgtacctttactttggagagattccgaattcccttccacctcctccatttggggagatggaggatgtatattattccggtggtcacaaccccatatcatatgagtttttatggtctgaaaatgggtccattgtaaacggccgttataaagaggatttttcaatgataccaaaacttgtctatcaagaaattatacaaagttctgaaactctcagttcagctgttggtcgtggtgtctccagagaatcttttcataaacattttaatatttttagaccggaaaatgtttatcggtctgtcttctcagaagatatgtgcagtaaaagtggaaattttggttttacccatatgatgaatttgtctccacatgaagtgacatttctagctactggttcttttatggagcgactattattttctatgatgagatgggaacaaaaattcattgatgaagctgtagactttctaatggagaccatagatgatgatccagaatgtagttaccttgagaaagaaaaagtgagagcagttacgcgaatgttattggtgccatcaagatctgagacccagtttcttcaaaaaaaatggcaaactggacccagccatgctccttttgaggccttggttgtcccccatcaagatagggtgttatcaaatgccaggcttcttcactctgcttacacatatatcccacaaagtagagctcccccaattggtgctcactgctcagatagaaacttctactataaaatgattgaagaattacatgatccctgggttaagaggttgcttgtggggtttgcacgtacatctgataataatgtgcctagaaagccagatagtcctcatcatttaattcaagagatagattctgaactacctgtttctcagcctgctcttcagttaacgtacagtatttttgggtcttctccaccgatgcggaattttgaccctgcgaaattgctcactgactctggaaagctccaaacacttgatatattattgaaacgcttacgagcagaaaatcatcgtgttctcttgtttgctcagatgaccaagatgttgaatattttggaggactacatgaactatagaaaatataggtattttagacttgatggatcatccactattcaggaccgcagagacatggtcaaagactttcagcataggagtgatatttttgtgttcttactgagtacaagagctggtggattgggtatcaacttgacagctgctgacacagtcatattttatgagagtgattggaatccaacattggatctacaggcaatggacagagctcatcgtttgggtcagacaaaagatgttactgtttaccgacttatatgtaaagagacagttgaagagaagattcttcttagagctagtcagaaaagtactgtgcagaaccttgtcatgactggtggttctgtcggtggtgatcttttagctcctgaggatgttgtatcattgcttctagatgatgttcaattggagcagaaattaaaggaaatccctctccaggtaaaggataagcaaaagaaaaaacaacctatgagaggtattcgggtaaatgaagacggtgatgcatcaatggaagatctaacaagctctgtagcccagggtacctcagataatgatctttccatggatccagagggttcaaagtctagtaataaaaagagaaaagctttctcagataagccaacttcaaggccaatgaattcccaaaagatgagtgaatttagtactacgcctatggacgatgaattggatgttgttgatccagtgggtcagaaacccaagagacccaagaggataaagaagaatgtgaatgaaaagtttgaagatgcttttactgggattgctgccctgatcccagagcagacccaatttccacctccaccaagcgattttagtgccgggggttctaaagcagaatcaggccaagacaactga

SEQ ID NO: 708 - DNA, 1017 bp, Glycine max
  Peptide Sequence Number=SeqID_92393
atggataggattccggttacgcgacttcggtggctggatgatcggtggtttctgagtggttattcggcaacggtggatagtgggcaggttggtggaaagaacctttggatattgaggttgctgtttgggcaaaggcacaaagacgggactttaggttctgctgaccagatgcagaaacctttaaagaacaaacaaggtggctctagataccatattgaagagactaaagatacacgtatcaatgttcaatcaggcattgaactccccagttttctattactgatagttgctaattcagagcacccaaatctaaattctgttctttacaatgtcaatatcagaggaatcaaatcagctgatacagcaacagatatcaagaaggcataccacaaggcagctctcagacatcatccagacaaggctggtcagttgttggctagaagtgaagttggagatgaaggccaactttggaaggaaatttcacaggaggtgtacaaggatgctgataagcttttcaaaatgatcggagaagcatatgctgtgctttcagacccagccaagcgctcggagtatgatttggaagaggagataaggaaagcttctaagttatatcttcagatgcgtatgggtgtggaagaccgtttgatgattacagatctacctctgacagaacttctaacagacgaaatggacgggatcattggaagacccatggacattcgtattctcgatggcattgatgctatactaatccttcccttaatcccatacttgctgctggacgagtttttcgaagggaaagggattgttcatacagaaaatcaggcaggaaaaacactgacaagggagccaatgcagctgttgttgggtttgcatactttctcgaatggtatgtatctctggctgtataaggatagtgtaatgtgtattcaaggttatcaaactcaagagtttacgcagatccgtgagagttccatagattggattcgtagactcgtaagagtttacttcatataa

SEQ ID NO: 709 - DNA, 1638 bp, Glycine max
  Peptide Sequence Number=SeqID_92394
atggtgtcatcaaaacctagtggcttctatgaacaaaggagctttccatcaatcaaaatcctcatacttatactccttaattctatacttcacaaagccaactcaggctgcagcaactctgtttccaactccttagttccatttctatctcatgagatactctcatcattgcaaacactacctctagatggccactttagcctaagggacaatgaggatgctgccaaggactttggcaacatacaccattttcctcccctagcagtgctgtatccaaaaacagtttctgacatatcactcaccatcaagcatgtttttgaaatggggtttgccgcacagctgaagattgctgctagaggccatggccattcacttcaaggccaagcacaagtacatggaggcctagtcattaacatggagtctttacagggtcctgaaatgaaagttcacaatggagaattgccttatgtggatgtctcaggaggtgagttgtggataaacattctgcatgagactcttaaacttgggttggcaccaaagtcatggacagattaccttcacctcactgttgggggtactctttcaaatgctggcataagtgggcaagccttcaaacatggacctcagatcaataacatctttcagcttgaagtgatcacaggaaaaggagaggtggttacctgctcagggaaccgaaacgctgaccttttttatggtgttcttggagggcttggtcaatttggcatcattacaagggctagaatttctcttgaaccagcacctaagatggttaaatggattagggtgctctactcagagttctctacatttactagggatcaagagtatttggtatcacttaacaacacatttgattatattgaagggtttgtgatcataaacagaactggcatccttaacaattggagatcatcctttgatcccaaaaaccaacttcaagccagccaattcagttctgatgggaaaaccttctactgtctagagatggcaaaatatttcaaccctggtgaagctgaagccatgaatcagagtgtagcttacctactgtcaaagttgagttacattccatccacactcttcctatcagaagtttcttacgtggaattcttagacagagtgcatgtttctgagaaaaagctaagagcacaaggcttgtgggaagttccccatccttggctgaaccttctgatcccaaggagtgagattcataactttgctgaagaagtatttggcaatattcttaaagacacaaacaatggacccatactcatttaccccgtcaaccaaacacggtggaacagcaaaacatcattgattaccccagaggaagatattttttacctagtagcattcctatccttagctctcccaaattctaccggtgcagacagtttagaacacattctagcccaaaacaaaagagtcatagatttctacactggtgccaaaatgagagtgaagcaataccttccccattacagcacacaggaagaatggcaagtccattttgggtcacgatgggagacattcgtggaaagaaaaagggcctatgacccactagcactgctagcccctggccacaaaatctttcaaaaggctgtctcctcttcgtgttag

SEQ ID NO: 710 - DNA, 495 bp, Glycine max
  Peptide Sequence Number=SeqID_92395
atgtcttgtctagcgcttttcctgcaacctgcaaatggacccaacatccttctccaaacgcgcgagtggttccctccctcatgcgccctcagcgccctctccgccttccgccagacacgccgtgccttcgctgtcaacaagcactccacgcccgacgatgcctatgccggggagtccatcggcgaccaacgaccaggtcatcatcggtgtcgagagtcgctaccgcgccatgtattgcctcgtgaacggcatttacgtgctcggcatcaccgtcgccgaccacgacaactcggtgaacttgttcgagtgcatccacatcgtcaatcaggccgtgagcatcgtggtaacagtgtgctgcggcatcgacgtcacgccgtagaaactcagtcgcaagtgtgtgcagtgtgcaatgatgaatcttttgcattcatgctggttttttcagcacaacgtaagtgggatttgacgtattgggaatgttgtttgaaattttag

SEQ ID NO: 711 - DNA, 99 bp, Glycine max
  Peptide Sequence Number=SeqID_92396
atggtagaggcgttgtgtcttgaagacaaccattactggacctgcaagcacatgcatcttgttcttcttgttgttattgctgctgcccatgctgcttaa

SEQ ID NO: 712 - DNA, 192 bp, Glycine max
  Peptide Sequence Number=SeqID_92397
atggcgggatgggaggggataggagagagagaagtgtcccgcccttggagatggcgggataggagagagggggtggtcccgcccttgaagctggcaggacagggtgcaggcggtaccgccactggcggttgcgggacagggggagagaggatccgccagctcgaaaggcgggataggcttgcattcatatag

SEQ ID NO: 713 - DNA, 1950 bp, Glycine max
  Peptide Sequence Number=SeqID_92398
atggcgccaaaacgaaaaccttcgtctccaatctccattggtaactgcgagattacggtcgaggctaaccgcttcacctgcaactccgattcaaacggcgtcgtaatctctcttccccgaagcgggaagatcaaagtgtcagcagtggctccaaaccgtggaagcgcttctgaggatttgaggtctggcgataaagaacacgagttcgtgctagttaatcctaaagatgttgatgctattagcaaatcttaccttcaggaagtattacagatgtatacgacagagctacctggaatgaattatgccgcgaatacaggaaagcaatcaaagtttcttgagagatgtgtgactaatgggaaatatcgtacactacttatcaaatccacttctgttggaaattcaggaaaggttatagctgcaattacataccaaatcatccctgcagatacagaatatgcagagatcccacttgcagctgtcaatgcaatctatcaacggaagggttttggccatctaatgtttctagagctaaggaagagacttcaaagtgttggtgttcgttctattttatgctggggggacaaagaatcagaaggattttggcttaaacagggttttgtagaaatagcacaggtgggtaccaaaggaagggcccgcaggttacccataaaagctgatattcaaaaatcattatgctttcttggtggttcgactctcatggtttgccacctagggaaagaattattagctgacgatgctaacactgtgaagtatctcccctcacagtttcatcagaattcctttacatctgccattgctgaagatgagcagcttgaattttcgggaaagttacatgtggatttgaaatttccagataaatcttcccatagaacagaatcaagtaaaaatcaacatgaagctttggtgaaagaaggatcttcaacagaatatgacaaactcagtggatttgacagtcacaatgctaaggaatgctgcactggcatttctccttttgccaaagtaaatgatgatagacaggccagtccagaaagttcacaggatggaattgatgctaatgtgaagtattcttctcaatctacaaaaggtgcaaagagggcctgggaagcctctttgtcctcattgaagtcaaaaagggtgaaggggagccagatggttgactatcaaccagattctagctgcggttttatcttcgagactgataaggccaatccttgttttgatgaagtccctcatgatccttcaattacaaaaagttctgaaaaatgtatcggggattatttgcatttagaagctcccatcaacatagactttccatcaactaaacaatgctttagaattatgttgatgaatattgctgatgatgctaagaaaacacagctcacgaaggtgattgaagaccttggtggaagtatatcacatgatggaagtatgaccacacacgttgtcacaggaaaagtgaggaagactctgaatttctgtaccgccctctgttcaggtgcttgggtgatttcatcaagttggttaaaagaaagttatcgtcaaggaagatttgtagatgaactgcctcacatactgaatgatacagattatctgctgaagtacaaatctgatttaaaaaatgcagttctccgggcaaaagctagccctgatgctttgtttaagggttataatatatgtattgcggctcatgttcaaactcctaaaacattgtctgcaattgtcaggtctgcaggtggtaatgttatcagtggactagaaacggtaaacgaaacatcaacaacaatctttgtggcatgcgaagaagacacagaagaagcaatgatagctgcacagaaaggtatatggactttcagtagcgagtggtttatgaactgtgtcatgagacaagagcttgacttggaggcctcacagtttgcagagtccttataa

SEQ ID NO: 714 - DNA, 846 bp, Glycine max
  Peptide Sequence Number=SeqID_92399
atggggtcagaacccgaattgaagctgccaactattgacttctccattgaggacttggagttcaatgttgctaagtgggaattagtgaaatcccaagttcacaaagcacttgtagagtatggttgctttgaggctttgtttgataaagtccctttggaccttcgaaaagccatttttcttcaagtggaagagatgttcgatctccctttacaaaccaagcaacgagttgtgtctagtaggccataccatggttatgttgggcctcttcaactctatgagaacatggaaaaatatatggacgagcacatgaactcaacaaattaccttgcacggcttatcaagtgccaaggccctcaaactaatgaagcaaaagttggcataggagagcacacagacaagaacatattgaccacattgtgtcaaaatcaaattgatggtttagaggcatggacaaatgggagggtgcatacgcctaatcaccgagtgatgatgagtggaaacgagacaaggttcactattggattatttacagttccaaaaccagggttcataataaaggcccctgaggagcttgtgacagaggaacaccctttgctctttaagccctttgtccagagtgagttcatgaagtttcttcactcttctgagagtacaaagaatgctctgaagggaaaccaccaccagtgcgccactaccatcgatcacgctgcaccaccaccatggttgaccgcgtcgtccaaccccttctgcgaagaagagaaaaagggttcagttgtggatggcgtgcgtgcagtgcaagggatgctatgggagggtcgtaagggagaaggggaaggggttggatag

SEQ ID NO: 715 - DNA, 756 bp, Glycine max
  Peptide Sequence Number=SeqID_92400
atggcaaatgaaaatgttaatgatatccccgataacgaaagcaccggtagcaacgacgacgacgctgtcacttctcccaccacggagtgccaaatatgctcaaatcccataccccgaaaccctaataaacaaacgtcaagtaaacacccactgcaaggtcccaaaccaccaaccctagtatcaccaccaccgcaatcactttcaattaaccctaacaatagctttgcaagggtgattccttcgcgatctcaaccaattaacgctaatagaacccatgcagatgtggttcgctcaaccccgccaccgaaaacaagcagaaccacaccacaagatccgacactagcagcgttatggatgaacagtaacgctgctcgtggttgtgcaacctcacaagcagcagcgttatggaccttcgatgacgctgctgaaaatggagaaatcctacaccatcgttttcatccatacctaaggccggtgggtcagcagccaccgagaacggtggattttctgtctaggatggagaatggtggatctccatctctttatccgagtcagattgatgagcaaatgccactgagaacagtggattttctttctggggtgaataatcacccgtggagaatggtggattttctgtctcagatggaggcagccagttcggcacggccggagcaagttccgagggcaaaccctccgattgaaatggttgtagaatgggcgtcatcccttagagtcggagacggaaaaaggcggaag

SEQ ID NO: 716 - DNA, 342 bp, Glycine max
  Peptide Sequence Number=SeqID_92401
atgggttcacttagtgtggaaaaggataaagtggtcattggggatacctctggtggtgcaaccttggatcatgtggtggttacaaaaaagcatttgggtcaaaaaatggaaaacatggataattataacaaaagaagacttaatgccatggaaaagactaacacaacaatgctcaaggccatgtgcaacttggttaaacaagactacaatcagtcaaccatagatgttgtcgaggatgtggcaatgagtgggactcagaatacttctctctatgatcaaacattacattgtcgaaatcctaataagcctgatgcaatcccaccctgcaagggtattggatag

SEQ ID NO: 717 - DNA, 1008 bp, Glycine max
  Peptide Sequence Number=SeqID_92402
atggcttcctttcacgatttggagcagaaatggtgtgcaaaggttggagctttgatggagcttcaatgtttgcgtgtcgtttctctggttccagtccctcgcgtttctctgcacccgtcggggccagtttttgaaataacatgtatatatgtggaagcattggaagcaaaggaccattggaagcactggaccagcaataccattggaagcactggccatcatggtattgttcatggtgagtatgttgttatgggtatggatgatcaaagaggttccctttttggtagtcctattcatgctggtgcattagatatctttaaggaagatgtttatggctttggtgtgattctacttgaattgcttactgttcctcatattaccacaacttacaagaaagtagtagggacatttaaggtccagagcaaaaaatcccaagttcagagcaaaaaacctgatttggtgacatggaatagtttagttttaggttattcaatgacctaccgcagtgaggaagcattggttgtgttcaatcggatcgagagtttgggattaactcctaatgtggtgtcttggactcctcatattaccacaacttacaagaaagtagtggggacatttaaggttcagagcaaaaaacctgatttggtgacatggaatagtttagttttaggttattcaatgacctaccgcagtgaggaagcattggttgtgttcaatcggatcgagagtttgggattaactcctaatgtggtgtcttggactgctatgatatcaggctgttgtgaaaatgaaaactacatggatgccctacagtttttcagccaaaaggcagatactagtatttggggtgttgttcttgcagcttgcagacttcacaaattcattaagatagcggagattgccgctaggaatctcttaaggttggagccatataattctgctaactatgtgttgatgattaatcttgggggtgaaaatcccaaatgtttggagttggatacaagttaa

SEQ ID NO: 718 - DNA, 258 bp, Glycine max
  Peptide Sequence Number=SeqID_92403
atgacgttgaaacctctgacacatgcagctcccggagacggtcacagcttgtctgtaagcggattgccgggagcagacaagcccatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 719 - DNA, 282 bp, Glycine max
  Peptide Sequence Number=SeqID_92404
atgtctcctccacctctagatcctcacaatcactcacagactcatctcatgctcttaggatggcttcctcttgtcgctcagttctctgccagtcttttcacagcaaaagctctcaaaactctcttgaacttggacctttctcttctcacagcaacagactgctcacttaaaggccatatggaggtcattagacctccagaggatcaacatgttgcactattctatagagatgtagagtcaaaggaatcaatgatgcatgttgcagcccttaaatcaaggtaa

SEQ ID NO: 720 - DNA, 480 bp, Glycine max
  Peptide Sequence Number=SeqID_92405
atgtggaccatcattgaccaatacaaagagaagctaagtctagcggcaacccatgaacaaaggctagaggatgaatatgcaaagatggataggttcgctttcaccttgaatgggagtcaagagcttctgagattgctagctaaagccaaggcaatgatggatgtatactcggcccccgaggaagttcatgggcttctcgattatcgagaaaacaccataactaagcgcgctctaagacacccctatcgaactcgttctaagactagagtcatgggtgacatagaagaggtgcaagaacagataaaggccggtatggtggccttgaaagatcaaatggcttccatgatggaagccatgctaagcatgaagagactaatagaatgtaacgcggccacggttgttgccgccagcgccgctgccaaggtagatcctactcattcgttcgccacgaatcaagcacatcaactcgcctcagacatg

SEQ ID NO: 721 - DNA, 603 bp, Glycine max
  Peptide Sequence Number=SeqID_92406
atgaagaagatccaaggcctacaagctctacatggagctacatcagaccaagcagaagctagtgggcatatgctaacgagggaggggagtggtagtcgatgcacaagagatatggcactgacaaggagcgactcctgcaacaggggcattatgagaggtattagagctaacctctgtcctagtacagtgtggttcaggatgaaccaagggaaagcttgcgggcatgtaacattccgaatactaaaaagggcgactaaaagaacttgtgaatggatgatttttagagaacaaccccatggttgggctggaaataccaaagagtggaagagtaaagagtccaaaggagaatttagaggttatcaacacattacatggtcaagcctaaaatggaagaaaatagtccatggtggtgcatgtggaagaagtttagctaccaatcttattagaagaggcgtgttgtctaagaattctagccttgaatctaagaacacccaagtattatttaacacgaagcaactcccggctttcacaaacaaaagtttgaatgaatacaacaattcaacaacactcaatgagtggatagacaataaagctcaaatataa

SEQ ID NO: 722 - DNA, 756 bp, Glycine max
  Peptide Sequence Number=SeqID_92407
tggcatctcctctctcttcctttctccattccgctgtcattcatcttccaagaagccaaggaatcaattgatgaagaagatcataggcctacaagctccaatagagcttacatcaaagccggtgtccaacccgattatgaggtgcaccagaaaggaagcgtatgggaaattaaggcaaatatgaagaataaagaaaccatctttatcccgggggacgataatgatgactttccaatgccgatacatacaggaatgaaggcgaaattcctgggtggggaaaacaataccagatactcctctcccaaaacaatgaacatgtcaggacccaatgatgtgaagaccacagatgactcatcccgacaacagccatttatgagcaactatgttagaggagtgaaaacaaaggatatgccctgtagcttcaagccaactattgacatgaatcttacttttgaagagacacaggtttatgcatatgtcttcaatcctaatgtggacccgaggttgcttacagtcaactctactgcacaaggagtgtttggtgtatgcccccaacttttgcgtgttctccaaactgtgtttgaaacacaagatttggtttttggatttgatggaatggatagttgggatattgtggaagctagaggaattcctaattgtggatccagtgaaaaatcagcattatgggtcctagagtggatgcaaatggaggagtcatttgtgagtttgttgtatggagtggtaagaatattgtag

SEQ ID NO: 723 - DNA, 1137 bp, Glycine max
  Peptide Sequence Number=SeqID_92408
atggatagacacaagtgcaagctttgcttcagaagcttcgccaatggaagagcattggggggtcacatgaggtctcacatgatgaaccttcctatctcaaagcccgaagaattagcctcatcgcgaacgatccaactcagcttcgaagctgagtcagcttcatcatcgtcatcgtcttcttcagacgaagaggatgaggatgatgaaaagactctatgttatgatctcagagagaatcccaagcgaagcattcgcctcgtggatcctgaattttcgttcgcaacagcagcagacactggctccgtgatcctccacgacagagagagcgagtccgagtcatcaaaaaacaacccaactcgtagaatatccaaaaggccttggaataataatgacaattattataataatgataccaccaacagcagcgtaagaaagaaaggtctcggattcgaacatgaatccacaaagaagtgcaagacagaatcgtgggtggaccacgaccctgcgagctctgtctccgatgccaccaccgaggaagacgtggcattttgtctcatgatgctgtcgagggacaaatggaagcgacagagggatcaagatcaaccctgccgatttgcggaaagggaaaatcaatacgaggtggaggatcaagaagaagaagatgatgaagaagacgaggaagacgaagacgacgaagaagccttcgaggagagcgaggagtctcaagaaacatcgaaacagtgcaagaaccgtgtacgaggacggtacaaatgcgacacctgcaacaaggtgttccgatcctaccaagcattggggggtcaccgagccagtcacaagaagatcaaagtgaacggtggtggtagagaacaagaacttgaacacaacaagaagaagagtggaacatgtgttgttgtggaaaagaaaactcacgagtgccccgtttgtttcagagtctttgcttcgggtcaagcgcttgggggacacaagagaacccatgttactggctcagcagcaactgcagctgcaatcgcaacaacacttccgtcaagttccgcaaagtttggaaacagtttcatagatctcaacctccctgctcctattgacgaagacgatgctagccaaatcgagaactctgct

SEQ ID NO: 724 - DNA, 354 bp, Glycine max
  Peptide Sequence Number=SeqID_92409
atgatgcatgcacctgacctcaactctcagatgcaatgtggtacataccgtatccaataccaaggaaatatccttaagcgtgtctacacgacacctcacttaggaaaccatgcaatatttgtcgaggccacccagtcctgcaccgtaactccccccctaggtgatcaacctggggccacaaggagttgcctactaggtgacacaccccctagtacaaagtacatactgccacagtttatactatttcccgtgtcatatgagggacatccgacaaggtcaatgcacccccccatggacatacacaacatacgacgtatgaacgtgggcaccatcaagtacaatgaccatggatga

SEQ ID NO: 725 - DNA, 1077 bp, Glycine max
  Peptide Sequence Number=SeqID_92410
atgaccaatgaaaatgctcgttcacgcggtccgaccgtcgcgacgtcgcccgcgccgccaatgtttccaaagctcaggcggcacgcgcgctgggcgggtatggttcccgtcagtgaagacgtgcagacgcgggtgaatcaggctgctgaagcgctgggataccgaccgaacgagctggcgcgcagcatgaacaccggccgctccaatactatcggggtgattgtcggcgacattgaaaacccgcactttggcctcgcgctgcgcggcatggccgacgtcgcgcgccaggcgggttttcacctgctgctgagtaacagcgatgaaacgctggacgaggaacgggaagccgtgcgcgtgatgctggataagcgcgtcgatggcatcatcgtcgcgccgtgcagctcattgtttgaggataacgagcatcttcgccaggtgctggcagaagggcgttcattaatgatgttcgaccgggcagtgcaggggatggaggtagagaccatccaggcgaactttgtcgcagtggccaaacaggcgacggagctgttactggcggccggacatcagcgtattgcttatctctcgagcatgcgcagcgctgcaccttattcgccggcaatcacgctgggccccacgccggtggcgcaacgtgttagcggaatgattgatgcctaccgggccgcaggtaaggaactggatccagcgctgattcggcttaatgcgctcagcgaagccatcattgagcagatcctgactgaactgctggcgctcgccgaaccacccagcgcgctgattgcctccgataacctgattgcgatgggcatcctgcgcggtctggccaaacgcggcctgcgcgtacccgaagatatctcttttgtaatgtacgacgattttccctggaccgagttgatgtcaccgccgctgaccgtggtcgcccagccggtgtatgaaatggggcgcgaagccgcgcgccggttgatttgccatatccgccagcaatcccccggcgtcttacccgcgtttgacagctggatggtggtgcgcggttcggtgggggaaaatccgtcggcccggtga

SEQ ID NO: 726 - DNA, 438 bp, Glycine max
  Peptide Sequence Number=SeqID_92411
atgctttatgtacaagggaaagtcttcattaaacaggccaaacaaggtagcatcccacataacctgcaatggcttcagaaaaagttgtgggatggtcaatgtcataagatagaagggatcattgacttcatgatccggcctatctgctggttttgcagggatatccaacaaggtcactgcaccacccatgtacatacacaacacacaatgtatgaaacatgggcaccatcaatgcacttaccgtggataataagcgcaattccctcttgggttggaattgcgcttagcgcgcccttggcgcttagggacacatcaaaagttgttattttcaaaatcccaatggtcagactgtggaagaatgtcttaggaagctctaggcaaaatctgaagatgatccaacggttaaagaatccaggaatcactattttattgaaatag

SEQ ID NO: 727 - DNA, 1088 bp, Glycine max
  Peptide Sequence Number=SeqID_92412
atgggaacaaatcaaaccggcaagaggttttaccaagtcaaggttaaaagcctagataccaccagcatcaaggaattagggcggttgatggaacctctccaaatgcaagccttccgcaagacttacggaaagatcttagagttgaccatagcagaggtatccatagaagccattgcatcactcacccaatactacgaccagcctttgagatgcttcacattcggagacttccaattgaattgcaactgtggtcaaggattcagcaagaggtttggaccacataaaacagactcggaacggtatagcgggcctaccacggaggtacctagaagacaaggcgaggggtatggccaatcaagggagattggggtcccgtttatggatgtgttagctttgctaatttttggggtcgtcctctttccaaacgtgggatgggtttggtgggacctagcagcaatcgacgctttccttgcctaccaccatagcaaaggaaagtccggtggtgcgaaaagagtagcgcacggatcatctgttgcttgcccgccctctgtgtttgattgggaccagcttttggccgggataggaggtagaacaatcagttggttcccccgatggaaggaaggaaaagaaggagttcttttctcatgtggaggatacccaaacattcccctggtaggaacgaggggttgtattaactacaatcccgcgctcgctataagacaactagggtaccccatgaggggagcaccgacggaagaaagcatgtctcctttccttgtgagggatttcggcgcacaaaattccaagactatacaaagaatccataaggcatgggaaaccccgttaaggaaagatcaagaacttagaggcattcgtaatggcatcattggtggctaccatgaatggctgaaagttcatatacgaggtttagattggctagccaagttaaaagtcgtcagcgaagagagttttgaagcaccggaagaggtcgaagaagtccaagctctcaaaagcgagttaggaaaggcgaaacttgccaaggagaagttcaagctggccgcaacacacattcggaaggagtgtgccgg

SEQ ID NO: 728 - DNA, 294 bp, Glycine max
  Peptide Sequence Number=SeqID_92413
atggagcggtatctacagcacttggttcgccaacaggcggccaaccaccgggggcaggtgcagatacatgactgtctctaccagctcaacctcagtcagcagggtcagggtttcgctccttttgcatgccctgctccagatcagtttagggctgaggtcgcatggcccggagattggcccgaggaccagacggaggaggcacctgcaggagctcccgacaatgcagaggatgcccgcatggatgaggagatgacagacttgctcggcttcttgggaggaagcggagccacgtga

SEQ ID NO: 729 - DNA, 453 bp, Glycine max
  Peptide Sequence Number=SeqID_92414
atggtgaaagttggaacctcttacgtgccgatcaacgtctcattttcgccaaaagttggcccagagcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatatcaatttgtgcattcctccaagtccatttcgggcgtccggggaaattttcacagcattcacccttcaggtgtag

SEQ ID NO: 730 - DNA, 669 bp, Glycine max
  Peptide Sequence Number=SeqID_92415
atgaagaatggcagcaaatcggtggaatatttttcgataaaattcacggggaaattgaaaatgcttggggatggaaatgaaggaatgtctacactacctggattgaatcagatacaatttgaagggttttgtaggttcattgatcggggcttaccagaagggctttttaagtttccaaaaattgaggatacagatcaagaaattgaatttcaattatttgtagaaacatatcaattattagaacccttgataaacgaaaaagatgctgtatatgaatcgcttacatattctgctgaattatatgtatctgcgggattaatttggaaaagtagtagggacatacaagaacaaactatttttgttggaaacattcctttaatgaattctctgggaacttctatagtaaatggaatatacagaattgtaatcaatcaaatattgcaaagccctggtatttattaccgttcagaattggaccctagcggaatttcggtctatactggcaccataatatcagactgggggggtagattagaattagagattgatagaaaagcaaggatatgggctcgtggtcaaaagaaaatgccattttggagttttatcgacaatttgcttgtgttggtggagatccagtattttctgaatctttatgtggggatcctctag

SEQ ID NO: 731 - DNA, 484 bp, Glycine max
  Peptide Sequence Number=SeqID_92416
atggcttcgaaaaagctttccgcgaagagatctaggagggacgccgcagttgaagggaccagtgccgcccccaagtttgatagccaccatttcaggagcgctgagcaccagcagcgtttcgaggtcatcaaaggatggtcattccacagagagagacgcgtccaactcagggacgatgagtacacagattttcaggaagagatagctcgtcgacattggacgtctctggtcactcccatggctaagtttgacccagatatagtcatagagttctatgctaatgcttggcccatagaagagggagtgcgggacatgcggtcatgggtgaggggtcagtggattccctttgacgcagatgccctcagccagttcctgggtgacccgctagtgttagaggaaggtcaggagtgcgagtttagtcagaggaggaatagggccgatgggtttgaggaagaggccattgtccagctattatgcataccgg

SEQ ID NO: 732 - DNA, 606 bp, Glycine max
  Peptide Sequence Number=SeqID_92417
atggttgccttcgttaggcaatttttcgctgacgaaaggatcaaagtgggtctgaaaagaggtaaatttaatcatcctgcttggacgaatgagaaaattggggcaaatgaagagggtgagaatgaaggagaaacccatgctgtgactgccgttcctatatggaaactcccccaccagctcaacaaacatcattactcagccaatatcagcccttctcattacccaccacccagtcatccacaaaggccatccctaaatcaaccacaaaacctgtctaccgcatttccaatgacgaacaccacctttagcacaaaccaaaacaccaaccaagaaatgaattttgcagcgaaaaagcctatagaattcaccctaattctggtgtcctatgctgacttgctcccatatctacttgataatgcaatggtagccataaccgctgccagggttcctcaacctccatttttccaaggatacgactcaaacgcaacatgtgcatatcatggaggagttctgggacattccattgagcactgtataacctcgaagcgtaaggtgcaaagtctaattaatgcaggctggctgaaagttgaggagaatcacttgtga

SEQ ID NO: 733 - DNA, 376 bp, Glycine max
  Peptide Sequence Number=SeqID_92418
caccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcagctccctctccggaatcgaaccctaattctccgtcacccgtcaccaccatggtaggccactatcctaccatcgaaagttga

SEQ ID NO: 734 - DNA, 333 bp, Glycine max
  Peptide Sequence Number=SeqID_92419
atgcatatgacagaattcatgcgtaaagaaatgcatatgacacagatgcaatttatgaatacgggagcccgggaaattgtctccatatttaagaaggtggcacagaccctccgttggtttgccaaagagaggggatcaaaccagaatccgtgcgtgatgcatatgcgaaagccgcaacatgggagtgtcaagtatgacaatattcacaaaatcgtctccccttcgtgcccctattcaagggacctatatgggagagagctaaaagggttttcagtgataatccccaaggtggtcatatctgatgcaatcctaccccgcaagggcattggatag

SEQ ID NO: 735 - DNA, 443 bp, Glycine max
  Peptide Sequence Number=SeqID_92420
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatcccggtaactatcgtcttgagtccaacccgggaaacatgcaaaagcaccactggcagcagccactg

SEQ ID NO: 736 - DNA, 510 bp, Glycine max
  Peptide Sequence Number=SeqID_92421
atggcctctggtttccatgttcagaagctgtgtaactcgagtttgggcactgctaatcgattacatactgtgatcgtgatggcagcgcaattaatccatgatcgcgtggagatggagtgcctagagggagtttgggagaccctcgaaggcaatgcgaggtgccgattccgtggcacgatccgactcactgctacttcattggtacatccagaggaacccgcatgcacgcttcagcgaattgtggagtggatactacctacacctactccatatcgactagtggagcctgtccaagtgatagaggtgtcgtcctctgaagaagaccctgaggaggacccagaggagttacctcctgagcctgctgtggatgctcttgactttccagagggtgatgaggacccactccctgatgtggattctctagaggacgtcatgtcagcatctgaggcagactctacggaggagagcggccctggagggacaacgactagtggagactcttcatcatag

SEQ ID NO: 737 - DNA, 219 bp, Glycine max
  Peptide Sequence Number=SeqID_92422
atgagtctagaagaagttcaccaccataagaggccatggataagagcttggaggaagaagatgatgaatgaagggagaggaagagaagagcacgaaattttatgttctaaaagagctctgaaatctgaacccatcaagtccaagattctgcaccaagtgtgcttaggtgtcatgagacatgtaaagcatgaaggacatgcacaaagtgtgactaaatga

SEQ ID NO: 738 - DNA, 156 bp, Glycine max
  Peptide Sequence Number=SeqID_92423
atggcacaacctccaccccgtgagaggactctaagggaaatggctgcacctgatttcacgtacgaaagcttgtgcatccaataccctgatgaggatgtcccatatgttcttaaaactggactgattcatttgcttccaaagtttcatccctcgcag

SEQ ID NO: 739 - DNA, 147 bp, Glycine max
  Peptide Sequence Number=SeqID_92424
atgaagaaacaacaatggaagagaagattcagcagaagacaaaggagaagaggtgagaggagacgcaccccactagggaataagccatggaagaaggagcttggttcgaggccgtacccgaatcaaataaacatgaaaatgcagtaa

SEQ ID NO: 740 - DNA, 327 bp, Glycine max
  Peptide Sequence Number=SeqID_92425
atggaggccataaaagagcaaatggccacaatgatgaagaccatgatgagcatgaagaggataatggaagccaatgcggttataatcgccgctattagcgctgtcactaaggtgaacccgatgctcccatctggcctcaagcaaatgaatcatccaacctcaaatatgggcaagcagttggtggtataccctttgaaaacactttggagggccctcaaattcgcccacaaccacaaccattgcattttgcgggtgggaagagcccctcctgctatggccgaaaaggggaaaggcggatcatctaaaggaaagggctcaggccattga

SEQ ID NO: 741 - DNA, 495 bp, Glycine max
  Peptide Sequence Number=SeqID_92426
ttaaaagctcgtagtttggaccttgggttgggtcgatcggtccgctccggtgtgcaccggtctgctcgtcccttctgccggcgatgcgctcctgtccttaactggccgggtcgtgcctccggtgctgttactttgaagaaattagagtgctcaaagcaagcctacgctctgtatacattagcatgggataacaccacaggatctgatcctattgtgttggccttcgggatcggagtaatgattaacagggacagtcgggggcattcgtatttcatagtcagagaacgaaagttgggggctcgaagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 742 - DNA, 312 bp, Glycine max
  Peptide Sequence Number=SeqID_92427
atgcatagatctcttactggcactttagttcctttgggcttagaaatagaagctacactaagaaggaacagggctgagaggagaaggaaactgttgcaagacagagtagttgcgtccattcttgaggaggagactcatttttctgattcattatcacctgattcaccatcatctagggaatccgctaatcaacattttgaagctgttaccatggaagaagagcatgatcagaggactacccttgaggactattcaagtggctctgtaccacaatttttcactagcattgcgcgtccagaagtgcaagcgtag

SEQ ID NO: 743 - DNA, 279 bp, Glycine max
  Peptide Sequence Number=SeqID_92428
gggatcgtgcccgcaagacacccagtggacccgaagaagtccaacaggttcttggagttgccagctctgattacgggtctctatcagttctacggagtgcttgtcgcccccagcaaggtcatcaggccccctactaatcgagctttcatcaagaagtactgcgctcccaggcgggcgcagggcgaaacaccacagcagcctggggatggccgacagcgggcaacagacgcaccgccaccacctctagagttcacctcagctcatccacaaaaaggttag

SEQ ID NO: 744 - DNA, 453 bp, Glycine max
  Peptide Sequence Number=SeqID_92429
atggtttatggcataaacttgaaaatcctgatgagtcataataacagcttccagaattgccccatgtatggtgttgcttgtcaatgttatgattcaacaagcgattctcctcaaatttcagccagcccgtatcaattagacttcacactttatgcttcggggtcatacaatgctcaatggaatgccccagggctcctccacgataagcacacgttgcgttcgagtcgtatcctcagaaaaatggaggttgaggaaccttggttggggctttttgctgcaaaattcctttttgttggtgtttttttggtttgtgctaaaggtggtcttcgtcattggaataatgacattgttgggtttggtgggaaacttggccgtataggaatggcagtcacagcatgggtttctccctctttctcaccctcttcatttgccccagttttctcagtcgtccta

SEQ ID NO: 745 - DNA, 637 bp, Glycine max
  Peptide Sequence Number=SeqID_92430
gttgagatataccacacagagtttgatgacttcaagacagagttggagaggcgtaatcttcacaaacgcctcaccaacttggctgatgggactattgatgttgctttcgtgaaagaattctatgctaatctctacagctctgaggatccttcaccaaagcaagccagagttagaggccacttggtgaagatagacgtcgatagcctcaacacatttctagagactccggctgctctttgcataccagggagggggttcattgtgaatgtcgagggccatccgaggagaattctcaggaaggatctgactaccttggtccaggtgtggagtgttctctcttactccaacttggcccctacatctcatacatcagatcttaccgcggatagagccagcctcacatttgagcgcctgagcccgaccattaacttggcctacatcaggaagaactgttggaacattgatgatctaacaattgcttttcggggggctaggagggcaagggcgaggccagctgatattccatcttcttctgcagctccaacacctactctaacatctacttctgcagctccttcagttccagctcatgttgactcgcagcgctttgaagccatgcttcaaagtatccatcagg

SEQ ID NO: 746 - DNA, 270 bp, Glycine max
  Peptide Sequence Number=SeqID_92431
atgcaagaagaaaacgaagaagaagattcagatgatgaagaagatttttcattctttgtgaagaaatttcagaaatttatcaagaaaagaagaattgacaggcgtcagaacttcaacaatggaagaacatcacaagaagattctcaagtccttaggaccaagaaagcctacattgcatgggatgacaatgattcatccgatggttcagaaaaggagattaatcttgtaaccaaggattatgaaagtgatgagaacatttctcaagaatga

SEQ ID NO: 747 - DNA, 1237 bp, Glycine max
  Peptide Sequence Number=SeqID_92432
atggctacctcaccaaaagaaacttccgcttctggttcacccgctgtaccatcatctccgcaccaggaacaaccagaattcaacatccaacccatacaagtaattcctggtcaagcttctgtccctgagaaactggttcccagaagacaacagggagtgaagattgctgaaaaccctagccttgcaacaagtcctagggaagtagacacggagatggacaagaaaatccgcagtatggtgagtagcattttgaaagaagcctctgtgcctgaagctgatgaagatgttccaacatcttccaccccgaatgtttctatgcctgatgttgagaaagatgttccaacatcttccggcccaaatgatgaagtactctcttcccccagcaaagagagatcaacagaggaagatgatcaagccgcagaggagacccctgcaccaagggcaccagaacctgctccaggttggcacctggcattgcagaaaggttacaaaagccgaaagggaaaaactcccatcaagaggtctggacgaatcaagactatggcccagaagaagagcactccagtcactcctgccacatccagaagaagcaaggttgctatcccctccaagaaaaggaaagaaatttcctcatccgagtctgatgatgatgtcgaactagatgtctcgacatctaagagggccaagaaatctggaagaaaggtgcctggaaatgttcctgatgcaccattggacaacatctctttccactccattggcaatgttgaaaagtggaaatatgtatatcaacgtagacttgccttggaaagagaactgggaagagctgccatggattgcaaggagatcgtggatctcatcaaggctgctggactgctgaagactgtcagcaagttgggagagtgctatgaaggcttagtcagggaattcattgtcaacattccctctgacatatcaaacagaaaaagtgatgattatcaaagagtgtttgtcagaggaaagtgtattagattctcccctgctgtgatcaacaaatatctgggcagacccactgatggagtaatagatattgatgtttctgagcatcaaattgccaaggaaatcactgcaaaacgagtccagcactggccgaagaaagggaagctttcagcagggaagctaagtgtgaagtatgcaattctacacaggattggtgctgcaaactgggtacccaccaatcatacttccactgttgccacag

SEQ ID NO: 748 - DNA, 150 bp, Glycine max
  Peptide Sequence Number=SeqID_92433
atgttgttcgaaattcaattccgcacactttcaccgttgggatttttgagaatagagcagtcggaggaagaactggaggaatctcagggaaccgctagagatgccgctgtcgttggaagacacgtgagcccgcttagaggtaagggatga

SEQ ID NO: 749 - DNA, 944 bp, Glycine max
  Peptide Sequence Number=SeqID_92434
tacatgtcctcgccttcagaggactacacgtcctcggcttcagaggactacacgtccttgccttcagaggactacccgacctcaccttcagaggactaaacgacttcgccttcagagggcttcacgtcctctccttcagaggactacacgtccctgcctttagagggctacaagccctcgcctttagaggactacatgtcctcactttcagaggactacacgccctcaccttgagtgggctaaagaccctcaccttcagaggactacacgtcctcgtcttcagagggttacacgccatcgccttcaaaggagaacattttcatgccttcagagggctacatgccctcgccttcagaggactgcacaccctcgccttcagagggctacataggactgcatgtcctcaccttcagaggactacatgtcctcaccttaagagggctacacgtgctcgccttcaaaggactgcacgtcctcgccttctgagaggaatacatgtcctcaccttcagaagtctgcacgccctagccttcggagggatacacaccctcgcactcaaaggactgcacgtcctcgccttcatagggcttcacgtcctcgccttcagaggactacacgtccttacctttagaggactacatgtcctcatcttcataggactacacgtcctcaccttaagagggctacacgccctcgccttcaaagggttgcacgccctcgcctgcatagggctacacaccctcaccttcagaggactacacgtcctcgccttcagagggctacacgccctcaccttcagaggactacacgttctcaactttagaggactacacgttctcaccttcagaggactacatgtcctcacctttagaggactacatgtcctcaccttgagaggactacacgccctcaccttaagaggactacacgtcctcgccttctga

SEQ ID NO: 750 - DNA, 177 bp, Glycine max
  Peptide Sequence Number=SeqID_92435
atggccatcatcatggccatttgctctttcatggcctccatgtcggccttcatcttctcttgtatctcctctacttcacccattactctagctctagcacaagttcgaaatgggtttatgatcccaacatggttggctcatggggaaaacgcaagggtcacgcatgagcaaacatga

SEQ ID NO: 751 - DNA, 195 bp, Glycine max
  Peptide Sequence Number=SeqID_92436
atgggtgaagggatgaagacccctgtggctaagcgcaactattgcactaagcccttgttgtgtgttgaggaggttgaggctaagcgcgccctatgcgctaagcttgagtgtcattctgatgaggctgagctaagcgcggcatgctgcgctaagcttaaactctcttctgttttgaaaattgtagactcaggctaa

SEQ ID NO: 752 - DNA, 216 bp, Glycine max
  Peptide Sequence Number=SeqID_92437
atgttctattttcttgtatgcaaggaagatctactgcaggatatagaagcagtagcaactccagaagaagaacctcgatcttccgaggcatcttctagttttcctattgcagggcattctcatatagaacctattgaagactctaattcatggctgagagccagaagagtaaccctggagatattcaagttctactgtgccataatttttcactag

SEQ ID NO: 753 - DNA, 159 bp, Glycine max
  Peptide Sequence Number=SeqID_92438
atggagcttgacttgatggggcgagttcttgttaactccaaggtcttcctctttgtagaatcatcatggcgaggctcagaagcaagcttcatgatgatgaatcaagttgattcaagtagttttgatgatgacaaaaagcccaagagaatgatttcatga

SEQ ID NO: 754 - DNA, 1554 bp, Glycine max
  Peptide Sequence Number=SeqID_92439
atgaccataaattggagaactatacaggctttggaaaatgatttctatacaaaagatgatatagaagaagaagttggcttcattgcctatgtggaagttttttctagggaagagcataagaaaaagttggatgaagatgcaaggttgggtgccttggtaggaaaggtttctaaagaaattccaaaagttgttattttagagtctttgaagaccttgtctattgaggaggttcataagaaagcggcaaacaaggccatcatggttgatggtgagctagtgtttgaggaacatggagctaaattgatttttgcagatgttgttgcaaggcaagtagaagttgaaatggatatcattcttgaagacttggacccagaaaagaaaaaagctcttgaagaagctatggtctggtctattatagaagcttccctcaatgaaattgaggatagcatcattgagacaaaccttggtgttgcacctgttagacccataccattgtctaaaactgatgaaaggaagaagtacaagctagatcaacaacatgccattaagtggttacttccctcaagatctttacctccaccatcacctctaagagttgttcctattgagcctgatgtgaatgtcagatactacccttgctttaaaggatataaagtgttggagtggcacacttgcaacagagtttggaaagaaaatgtggatattgggactcactcttcatccagagatgcaacaattggagttagaaaaactcaatctcaccaagctctggaagacagtcacaatgaagaaggagagaaaatagagagggtggcacgcacctctaatgccgcgtttgaggacagcccaacaaccacacttcttcttctcgttctccatgctcacaacaataactttcatattcatgggctccttccagtgagtgagaagaacaacaagtcaaccatggctgaatgggatgagatgaaagatgatgagaaaagaaacgtgcaagatgatcaaaaagctaaaaatattttaacttctggtttatcttctgatgaatttttctgtactgcaaggtgtaaaagtgcaaaggaaatatggaaaatgcttgaagtcactcatgaaagcactacggatgctagttcctcaaaggaagaccacaaagaaggctctattgatgatgaagatgcagagaatttgaatttgattgtcaagaagattggcaaattcctcaaaaggtcgaaagacaaaaaaatctctaaaccttcaaagaaggtggaaaccaacaacaacaccttcaaatgcttcgaatgcaggaagcaaggtgatgcaagctccattggagcttgtaggcctaggatcttcttcatcaatggattcctttgcttcttggaagatgaatggcagcggaatggagaaaggaagagagagaggaggtgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 755 - DNA, 93 bp, Glycine max
  Peptide Sequence Number=SeqID_92440
atgacggctcgaagttgtcgaagcgctcgccgtgcctcattacgacgacgttttgaaagagcacttgaaaaaaaatacagtcgtggagtgtag

SEQ ID NO: 756 - DNA, 225 bp, Glycine max
  Peptide Sequence Number=SeqID_92441
atgcatcaccaaaagaggaaaactctagatgtgacttcattgttatcaagcgagtcagagacccaacatgaccacagatcaacctccattccctatggctcacacagacccggggagaaaatgagtggagttgccaccaacgtttatttaagggaaaacattagaaaaaccaaaaagaggtctgggaattatgaaaataagggtttgagagttgtttacgcatag

SEQ ID NO: 757 - DNA, 111 bp, Glycine max
  Peptide Sequence Number=SeqID_92442
atgccagaagttaaaaggaagcattgttgcacaattcgtgaggggggtgcaaatagcaaccaggcccacttgggccttccaggaagttctccagaaggcggtgccttctag

SEQ ID NO: 758 - DNA, 129 bp, Glycine max
  Peptide Sequence Number=SeqID_92443
atggccactcctatgagcactgctcgctatctgaataaagatgaaactgatcagtcaatagatattaagaaatatagagatgccaagcaaatcccaaagaatctcaccttaacgcagttaaaagaataa

SEQ ID NO: 759 - DNA, 417 bp, Glycine max
  Peptide Sequence Number=SeqID_92444
tgccagtcgttcggagtctccgttgcacctaccaaggtaattcggccgcccatcacccgggcttttattgagaagtactgtacccagagacaggctcagggtgatgctccacaggccgcaggcgcgccaccaccgcctcatcaggctggccaggctggggcatttgacatggagcagtatttacggcatttggttcgccagcaggcggccaaccaccgagcacatagccaaggcttcgtttctttttcatgccctactccagaccagttcagggcagaggttgcatggcccggagattggcccgaggcccaagtgggagaggcgcccccaaaagctcccggcgatggagaagaggcccacgaggacgaggagatggccgatttgcttgaattcttgggagggagtggagatacatga

SEQ ID NO: 760 - DNA, 75 bp, Glycine max
  Peptide Sequence Number=SeqID_92445
atgggtgttaagtacctcgaagtggtcaagcataggttacaggccatcaaatattggtccccagatgaaattagg

SEQ ID NO: 761 - DNA, 465 bp, Glycine max
  Peptide Sequence Number=SeqID_92446
atggggacgaggggttgcatcagctacaatcccgttcttgctataagacaacttggctaccctatgagaggggcaccactagaggaagagttcgcgcctgacaaagaactcaggggcagtaacaatgggcccattggtggctaccgtaagtggttcatagcccacgtgcaaggtttggattggctctcgagtttgagaaccgctaaaagggaggaagttgaggcaccggaggaagatgaagaggtgcaggcccttaggacggaactcaagcaagctcaaacagtcaaagaaaggttcaaatcagcagctcttaaaatccgaaaggagaatgccgaactgagagatataaatatagctaccaccaaggctttggaacaagagaccaagagggctcgtagggaagaacacgactggaacaagttccgaagggctctgtggggtagcaacagcgagcttaaactctga

SEQ ID NO: 762 - DNA, 252 bp, Glycine max
  Peptide Sequence Number=SeqID_92447
atggcctctaataatcgattaccaattgtgtgtaatcgattacacaaaatcgcgatggcagcgcagttaatccatgatcgcatggtgatggagtgtctagagggagtttgggagacccttgaaggcaatgagaggtgccgattccgtggcataattcgactcactgctacttcattagtacatccgaaggaatccacacgcacgcttcagcaacctgttgagtggatactacctacacctactccatattga

SEQ ID NO: 763 - DNA, 516 bp, Glycine max
  Peptide Sequence Number=SeqID_92448
atggatatctctgaagatattgacatccctgtaatattgggaaggccattcatgttgaccgcaagctgcatagttgatatggggaagaggaagctggagctaggttttgaagatcagaaaattgattttgatttgtttgttgaaaacaagcctgctccagaacacaatgtctgcttacaggtaatggaagaaggtcaagaggttctgaaagtaagaaccaaaacatatgatcacccagtgagtcctttcactaagcgcatctctgttcatgcgctaagccgagagtctcaagcgcttagcgcccaacccttgcatctgaggctgattcattctgctaagctagccaaggccaagctgagcctaattgaattcgatctaaattcggctaagcgacaaccaaaccgccaagcgacaccttatccttggctaagcgcgactcagtgtcgccaagcacaattccttacggccagatctgaggttcatgaagctaagcgccagtcatggcagctaagctga

SEQ ID NO: 764 - DNA, 234 bp, Glycine max
  Peptide Sequence Number=SeqID_92449
atgacttggaaggttgggagtggggaaagaatcaaattttggacagataggtggctaggggcaaattacactcttgagcagaagtataatcaactttttcagattagtagacaacaaagctccttcatctcaagcatgggtaaagactgtatggtgtggttagctgaaccccatggtcattacactactaaatcagcttacaatttctacactattcccagtacagcaaactga

SEQ ID NO: 765 - DNA, 216 bp, Glycine max
  Peptide Sequence Number=SeqID_92450
caatggtttctgaaagtgatagtgatccaccttctcctagttccgctaagataatggcttcattggctaagcaaatggataagttgcaaagaaatgtagagaggaggatgggagagagattttatgagatacaaataggcactcaagagttgagtgggagaatggaagacatagagaggaggaggcatcatcagtcaccttattcttctcaaggga

SEQ ID NO: 766 - DNA, 339 bp, Glycine max
  Peptide Sequence Number=SeqID_92451
atgcaaagaagatctactgcaggtggtttgatccctattgatttggagattaacgctacttgtaggaggcgcaacacagatagaattagaaaaattttgcaggacttagaagcagcaacaactccagaagaagaacctcgatctttcgaggtgtcttctagctttcctattccagggaaatctcatacagatttaattgaagaagttattatagctgaagagtcaaggagagtgaccctagaagattactcaagttcaagtgtgccgcaatttttcaccagcattccacaaccagaggttcaggcacaaataattacatatcctccttcttcgatatag

SEQ ID NO: 767 - DNA, 432 bp, Glycine max
  Peptide Sequence Number=SeqID_92452
tcgcataaatcggctaaaccgtttcgattcaaggtgcttcaaaattgggatgatatagtggatttgtgtgctaaagatagatccaccgatttagaagaaccaagctctaatacaaaaggaaaaagacaaggttcgacttcttctggcacacatcctcacaagagaaagatgggagaaaaagaaggaatagcagcttcttcggataaaatggcgaactcttttaaccgaatggtggaaaaaatggatggtaaagttgataatgaagatattcaagaagtattacgtgaggcagctttgataccagatcttagtagacaacaatgggctaaagctattaaatggttagctgacgatccaaagcagctagctattgtgaaagcccttccaattcaccaaaagacagattatgttttaacacatcttggagaatga

SEQ ID NO: 768 - DNA, 333 bp, Glycine max
  Peptide Sequence Number=SeqID_92453
atgacattgctacttagcaacattctgcccagtgaccacaatgccaatctccccctgcaaaagtatcagttggtctgtgtcgtctcgacatggggatcgtacccacaaagacacccagtggacctaaagaagtccaacaggccctggggtttccagctctggttacgggtctctgtcgggcgcccattccccccagcaagttcatgtcgtcgtggcataggggattgtgcccgcaagacacctagtggacccgaagaaggccaacagggtcttggagttgccggctctaaatacgggtctctgtcagttctagggagtgcctgtcgcccttag

SEQ ID NO: 769 - DNA, 438 bp, Glycine max
  Peptide Sequence Number=SeqID_92454
atggaaacaattctccagaatccacaattgaattctgccgaattctatgttattactgaccttattcctcaaccacaaccatcgtctccacaaccctcatgtccacaactacaactatcgcctcccaaacagttaccgtacaacaacatagacctcaataatccagtatcttcatacaacaaccttgaatcacaagacccctttgacatttatacttcatacacacaaatattatccgagaacgattctttttttcatggccaactgtcgcaacgtgcccttcgcgggcgagcgagggcgaggctcacgggtgcgctttccaaaggaggaaagatgcgcggagtcgccaccaacgtttatttgtggaaaacatcgggagggggcggaggaaccggtcaaaatgaaaattctaagttcgggagttgtatttacgcttga

SEQ ID NO: 770 - DNA, 516 bp, Glycine max
  Peptide Sequence Number=SeqID_92455
atgaggggcaccgtgcatgagcctcaagtgaacataggggccgatcaaaaaggactacacgtccacgccaacagagggctgcacgccctcaccttaagaggactgtgtgtcctcactttcagaggactgcatgtcctcaccttcagagggctacacgccctcgccattagaggactgcgtgtcctcaccttcagagggctacacgccctcgccatcagaggactgcatgtcctcaccttcagagggttacacgccctcgccatcagaggactgcatgtcctcaccttcgtagggctacacgccctcacctttagaggactacactttctcgccaacagagggctgcacgccctcaccttgagaggactacacgtcctcgccaacgtagggctacacgccctcacctttagaggactacacgtcctcgccttcagaggactccatgtcctcaccatcagagggctgcacgccctcacctccagaggactacacgtcctcgccttgagaggactacat

SEQ ID NO: 771 - DNA, 246 bp, Glycine max
  Peptide Sequence Number=SeqID_92456
atgacccctactcatgatgccctgctatattacaatgggaggtggaacatgtcacgccaaaatgagtttgttggttactcgttcacaggaaaaaatcccaaaaagttagacattccttctggatgtaccatggatgaattgaaggatttgatcaagcaagttgtgcctcctgggattcccccttatggtattcatgaaacacaaaatggtaaggcgattgttttttcaaaaaccaagtcaccatga

SEQ ID NO: 772 - DNA, 375 bp, Glycine max
  Peptide Sequence Number=SeqID_92457
ccatttgccccatctgatttgtttgactctgaatggaagctcttgtcttttgctgaaattgcatattctggatggtcatttgcctcactaactcttctaaggaaggttgaggaggagcctcagctgcttgttgtctttgtcgtgactgttgctgctattgctgcattggaggaggaacatatggcttgcttggaccagcaacattctagaaaggagggacaggctgttgttgttgtagaggtcttgtccatctcagatttggatgattcctccaacctggattatatctgttgcttgaaaggtcataattattcagctattgttggttttgctgctgaggaggtctattataaatgtttgcagcataagctttag

SEQ ID NO: 773 - DNA, 234 bp, Glycine max
  Peptide Sequence Number=SeqID_92458
atggatatctctgaagatactgacatccctgtaatattgggaaggccattcatgttgaccacaagcctactccagaatacaatgtttgcttacagtcctttcgctaagcgcaagcctcgcgctaaacgcatctctgttcatgcgctaaactgcgagtctcaagcgcttagcgcccaacccttgcatctgaagctgatttggtccgctaagctagccaaggttgagctaagctaa

SEQ ID NO: 774 - DNA, 4566 bp, Glycine max
  Peptide Sequence Number=SeqID_92459
atgaattatttgaacaaagtaggggaaaaagcatttggttgcgtgttggacctgggtattcggcatgtggcttacatcttcagttacgggaagaaagttgatgaactaaacaatagtattaaggatcttgggcatgcaaaagagagggtagatcatctacgtgatgaagctaagaagaatctacacaacattgaaggtcaggttacagaatggtttcggaaagtagaagaatgtaagactgaagtggaggagtttgggaacgatgaaggccacagaaagacacggttgctccatgatttatttccttacttgtggaatagatacaggctaggcaaacaagcagtggagatgacagaggatgtcaagaacttaatagatgagtgctccaagtttaaagaagttgcctacagggagaacataacatctaatgatgtcactttgtctaatgctggctatgtagaatttggttctagaaaatctatattggaaggcgtaatggcgcaacttgaagattccactgtcagaatgattggactgcatgggcctggtggtgtgggtaagagcactttaatcaaagacattgcgaagaaatctctagacaagaagctgtttgatgtggtagttaaactagaaataacagccaatcccaatctacaaaaaatccaggaagaaattgcttacgtgttaggattgagattggaaggggaaggtgagaatgtgagagctgattgtctacgaaggaggttaaagcaagagaaggagagcatccttgtaatcttggatgacctttgggacagattagacttgaataagttgggggttccacttgatggtgatgttgatcataatgatttaagcaagaagacacttgatggtgatgttgatcataatgatttaagcaagaagacaagcaaggctaaaatgggtcccaaagaggcgaataaagaaaaatctcttggtgattgtaagggctgcaaaattttgctaacttcaagggataaaaacgtattaaccgataaaatggaagttaagtcaactttctgtgtagaggaattagatgacgatgatgctctgagattgtttcagaaggaggctagaatacagggtgaaatgtccaagtggaaacaagaaattgttaagaagtactgtgcagggttacctatggcaatagttacagttggaagggcattaagagacaagagcgactcagagtgggaaaaacttaaaaatcaagacctggtgggagttcagaattctatggagatttctgtaaaaatgagttatgaccgtctagaaaatgaggagctcaagtccattttctttctttgtgctcaaatgggtcatcaacccctaattatggacttggtgaagtattgctttggtttgggaatacttgagggggtctactcacttggggaagctcggagcagaatatctacattaatccaaaagctgaaaaactcaggtttggtgttggatggaagttctagtattcatttcaatatgcatgatctggttcgagatgctgctttatctatagcacagaaggagcaaaatgtatttactttgagaaatgccaaacttgatgattggcctcaactcgagaggtgcacttctatttctatatgcaacagtgatatcattgatgagcttccagaagaaataaattgtcctcaacttaaatttttccaaattgacagcgatgatccatccttaaaaatacctgacagtttttttaaaggaatgaaaaagctcaaagtattaatgttgactggtattcaactatcaagattaccatcttcaattgaaagcctatcagacctcagattgctttgtttggagcgatgcactttagatcacaacttatccatcatagggaagctgaaaaaattaagaattctcagtttttctggatctcgaattgaaaatttgccagctaagttaaaggacttggataaactacaattactagacatcagcaattgttcaatggtcaagatgattccgcctaatcttatatcaaaattgactttgttggaagagctgtatgttagaaagagcttcatcgaagtgttggaggaaggagaaagaaaccatagtcaaatttcatttctttctgaactaaagcatttgcatcaattgcaagtggtggatttaagcattccatgtgctgaagcttttcccgatgaattgttctttgacaacttaactgattacaagattgagattgggaacttcaaaacactttcagttggagatttcaggatgcctaataagtatgaaaagttcaaatctttggcattgaagctgaaggatgacactgacaatattcactctcagaaaggaataaagttgttgtttaaaagagttgaaaatttgttgttgggagagctgaatgattgctcattcaccaacttgaaaaccatcaaggtcgagatgtgtgaccaattgaagaatcttttctcctcttgcatggttaaattgcttgtgagtcttgaaacaattggtgtttcccattgtttttctttagaagagatggttaaaatacctgacaattctgataagattgagtttcttaagttgaagtctttgtcacttcaatcattatcatcattcactagtttttataccacagtagaggggtcttccacaaacaggaatcacatacaaattactgttatagagacggagcatagtgagatggctcctcctctttttggtgaactggttgaaataccaaacttagagaacttgaatttaatctcaatgaacaagatccagaagatatggagtgaccagcccccgtcaaatttctgctttcaagacttaataaaattagttgtgaaagattgtcataatttgagatatttgtgttcattgtccgttgctagcagtttgaggaaactgaaaggcctctttgtaagcaactgtaaaatgatggaaaagatttttagcacagaaggaaatagtgcagacaaggtttgcatctttcctaagttggaggaaatccacctcgaccaaatgattgagttaacagacatatggcaagctgaagtgagtgttgattccttttctagtctcacttctgtgtacatttttcgttgcgataaactaaacaaaatttttccaagtcacatggaaggatggtttgcgagtttgaacagcttgaaggttcattattgtgagtcagtggaagtgatttttgaaatcaaagattctctgcaagtagatgcatctggtgggatagacacaaatttgcaggttgttgatgtatgcaatctcccaaagttggagcatgtgtggagcagggatccaggaggaattcttaacttcaaaaatctgcagagtatagaagtgtctggttgtaatagactgaggaatgtatttctagcttctgtggccaaagatgttccaaagcttgaatacatgtcggtacaaagttatggaattgtggaaattgttgcctgtgaagatggatccgaaaaaaacactgaacaattagtgtttcctgaactaacctacatgaccttatataacctatcaagcatccaacatttctacagggggagacatcctatagagtgtccaaaattgaagaagttggaagtaaacaaatgcaacaaggagctaaaaacattccaaacaagagaatgcagcaatgaagaagatgaagtagttttgtcagctgaaaatatattccccaacttggagtatttggatattgactttgacgaagcacaggagtggttattgagcaacactgtgaagcatcgaatgcacaatttaaaagagcttaggttgtgctatgttaatgatggtgaacgtctctgtcagattctgtacagaatgccaaatctagaaaagttatatttgtttaactctgaacatttgcttaaagagtcatcggagtcacgtttgggaaccgtaatacagctgaaagaattggttttgtggtcttcgaagataaaggatataggatttgaacgagaaccagttctacagagactagagcttttgagcttacattggtgccacaaattgaggaatttggctcctccctcggtatcattggcttacttgacaaatttggaagtaaggaattgtggtagattaaggaatttaatggcatcctcaacggcaaaaagcttggttcaacttaagtccatgaagataagcgaatgcgatgaattagaggaaatagtaagcaatgagggaaatgaagaagaagagcaaatagtgtttggcaaattgattactatagaacttgagtacctactgaatctgaaaagtttttgcagttacaataactgtgaattcaaattcccgtcattggaaatattgattgtgagagaatgccgaatgatgcaaacattcacggagggtggtgcaagagcaccaaagttacaaaatataggtggtggtgttgaaaaaggtaaagaggaagccatgtggcagtgggaaggagacttgaatgccaccatacaaaaaggtttctaccaggagttaggaagaaggatttcaaggaaaaaggatgaaagaggttttgagttagaatactatcactaa

SEQ ID NO: 775 - DNA, 7149 bp, Glycine max
  Peptide Sequence Number=SeqID_92460
atggagtctgtgttgtccccgatagtggaacgaacgtttaattttgcggtggaccccattattcggcagttggcctacatcctccgttgcaggcaaaatgttgatgaactcttgactagttttgagagtcttgaacttgaaaaagagtccatagatcgtcgatgtgaccaagctcagaataatttacaaaacattgaagccaaagtcaaagaatggtcaaggaaagtagatgagttcaagactgaactagagaagtttaggaacgatgaaggccacagaaagacagggttgtccaatgttttatttttatttccttacttttggaataggcatagacttggcagacaagctaagaagatggcagagattgtcaagaatctaatagatgagtcggccaagttcaatgatgtttcctacacagacaacttaacatctaatgatttcactttgtctaatccgggctacatgggatttgcttctagacattctacagtggaaaaaataattgcaaaacttgaagattcctctgtaagaatgattgggctgcatgggagtggtggcatgggtaagaccactttaatcaaagcaattgctaagaaagctatggagaagaagctgtttaatgtggtggctatatcagaaatcacagccaatcccaatccacaaaaaatccaggaagacattgcttctgcgttaagattgagattggaaggggagggtgagaattctagagctcatcgtctgatgacgagattaaagcaagagaaggagaacacccttataatcttggatgacctttgggacagattagacttgaataagttagggattccacttgatggtgatgttgatgataatgatttaaacacgaagacaagcaatgctaaacagggtcccaaagaggcgactaaagaaaaatctcttggtgattatatgggctgcaaaattttgctaacttcaagggataaaaacgtattaactgataaaatggaagttaagtcaactttctatgtagaggaattagatgacgatgatgctctgaggttgtttcggaaggaggctagaatacagggtgaaatgtccgagtggaaacaagaaattgttaagaagtattgtgctgggttgcctatggcaatagttacagttggaagggcattaagagaaaagagcgactcggagtgggaaaaacttaaaaaccaagacctggtgggtgttcagaattctatggagatttctgtaaaaatgagttatgaccgtctagaaaatgaggagctcaagtccattttctttctttgtgctcaaatgggtcatcaacccctaattatggacttggtgaagtattgctttggtttgggaatacttaaaggggtctactcgcttggggaagctcgtggcagaatatctacatcaatccaacagctgaaaaactcaggtttggtgttggatggaagttctagtattcatttcaatatgcatgatctggttcgagatgctgctttgtctatagcacagaaggagcaaaatgtatttactttgagagatgggaaacttgatgattggcctgaactcgagaggtgcacttctatttctatatgcaacagtgatatcattgatgagcttccagaagaaataaattgtcctcaacttaaattttttcaaattgacagcgatgcttcatctttaaaaatacccgacagtttttttaaaggaatgaaaaagctcaaagtattaatgttgactggtattcaactatcaagcttaccatcttcaattgaaagcctatcagacctcagattgctttgtttggagagatgcactttagatcacaacttatccatcatagggaagctgaaaaaattaagaattctcagcttttctggatctcgaattgaaaatttgccagctgagttaaaggacttggataaactacaattactagacatcagcaattgttcagtagtcaaaagaattccgcctaagtttatgtcaaggttgacttcgttggaagagttgtatgtaagaaagagcttcatcgaagtgtcggtggaaggagagagaaaccattgtcaaatttcgtttctttctcaactaaagcatttgcatcaattgcatgtggtggacttaagtattccatgtgcccaattttttcccaaggaattgttctttgacaagttaaatgattacaagattgagattgggaacttcaaaacgctttcagttggagatttcaggatgcctaataagtatgaaaagttcaaatctttggcattggagctgaaggatgacactgacaatattcactctcagaaaggaataaagttgttgtttaaaagagttgaaaatttgttgttgggagagctgaatggtgttcaagatgttattaatgagttgaatttggatggatttccacatctgaaacacttatccatcataaacaaccctagcatcaaatatatcatcaactcaaaggatttgttttatcctcaggatgtttttcccaagttggaatctctatgtctctacgaactaagaaagatagagatgatatactttagttcaggtacagagatgatatgttttagtccatttacagattgctcattcaccaaattaaaaaccatcaaggtcgagaagtgtgaccaattgaagaatcttttctccttttgcatggttaaattgcttgcgagtcttgaaacaattggtgtctccaattgtggttctttagaggagatcattaaaatacctgacaattctgataagattgagtttcttaagttgatgtctttgtcacttgaatcattatcatcattcactagtttttataccacagtagaggggtcttctacaaacagggatcagatacaaattactgttatgactcctcctctttttggtgaactggttgaaataccaaacttagagaacttgaatttaatctcaatgaacaagatccagaagatatggagcgaccagccccccaatttgaggaaactgaaaggcctgtttgtaagcaagtgtaaaatgatggagaagatttttagcacagaaggaaatagtgcagacaaggtctacgtctttcctaagttggaggaaatccacctcaacgaaatggatgagttaacagacatatggcaagctgaagtgagtgctgattccttttctagtgtcacttctgtgaacattgatagttgcaataaactagacaaaatttttccgagtcacatggaaggatggtttgcgagtttgaacagcttgaaggtttattcttgtgagtcagtggaagtgatttttgaaatcaaagattctcagcaagtagatgcatctggtgggatagacacaaatttgcaggttgttgatgtaaggagactcccaaagttggagcaggtgtggagcagggatccgggaggaattcttaacttcaaaaaactgcagagtatagagatggatgattgtaaaagactgaggaatgtatttccagcttctgtggccaaagatgttccaaagcttgaatacatgtcggtagaaagttgtgatggaattgtggaaattgttgcctctgaagatggatccgaaacaaacactgaacaattagtgtttcctgaactaacctacatgtatttaggttacctatcaagcatccagcatttctacagggggagacatcctatagagtgtccaaaattgaagaagttggcagtagagaaatgtaacaagaagctaaaaacattcggaaccggagaaaggagcaatgaagaagatgaagcagttatgtcagctgaaaagatattccccaacttggagtatttgcatattgactttgacgaagcacagaagtggttattgagcaacactgtgaagcatccaatgcaccgtttaaaagtgctttcgttatgcaaagttaatgatggtgaacgtctctgtcaaattctgtacagaatgccaaatctagaaaagttacgcttgacggaagctgaacatttgcttcaagagtcgtcggagtcacgtttgggaaccgtattacagctgaaggaattgtatttgtggttgtcgaagataaagggtataggatttgaacgagaatcagttctacagagactagagcttttgagcttatctgagtgccatatattgaggaatttggctcctccctcggtatcattggcttacttgacaaatttgaaagtagaggattgtaaaggattaaggaatttaatggcatcctcaacggcaaaaagcttggttcaacttaagtccatgaagataagcgaatgtcatgaattagaggaaatagtaagcaatgagggaaatgaagaagcagagcaaatagtgtttggcaaattgattactatagaacttgaggggctaaaaaagctgaaaagtttttgcagttacaagaactatgaattcaaattcccgtcattggaagtattgattgtgagagaatgcccattgatgcaaagattcacggagggtggcgcaagagcagcaaagttacaaaacatagttactgctgatgaagaaggaaaagaggaagccaaatggcagtgtgaaggagacttgaatgccaccatacaagaaggtttcaacaagtctgcaagtactgaatcatctcttagtctcagagatagcccactacaagtgatatggcttgactcacggtggatcccaaagtcgtgcttcagtaacttgaactctttgactgtggatggatgccaatttttaaccgatgttgtcatacccttctatttacttcctttgttaactaatttggaagaattaaaagtccgaaagtgtggttctgtgaaaagcatatttgacgtgaaaacaactacgggattgggagcagcagccttccctagacctctccctttttccctcaagaaattgactttagagaggctgccaaaactggagaatgtctggaatgaagatcctcatggaattctaaccatgcaacttctacaacatgttattgttgcagaggataatgcagatccaagagaagcaaatctggagcttacgttcccttgtccctgtgtgagctcattgaaactacaaggtttgcccaagttcaagtatttttactactgctcactgcagtgtcacatgttccagacacctaccgaggatgaaatgcctacatccaacttacagtgcctgtcactcggtgaaataggactggagatgatcaagcgtggagaatttcagacaaacttcttacacaagttacaagttcttactctgtgctttcatattgggtcgaatgtatttccatatgaaattctacaactggcgcccaatatagagaagcttgtggtgtatgatggttccttcaaggagattttctgctttgatagtcttaatgtggatgaggctggactcctattacagctcaaagtcttatgcttggagtcccttccagagcttgtttccattgggttagagaactcttggattcagcccttactgggaaatctagaaaccttggaagtaataggttgttctagtttaaaagacttggtaccatctacagtgtctttttccaatctgacacatttgcaagtacaagattgcgacagcctgctatatttgttcacatcctccacagcaagaagtttgggtcaactcaaaacaatgaagataagttgctgttattcaattgaagaggtagtagtctctaaggacggggatgaatcacatgaggaggagattatatttccgcagctcaattgtttgaaacttgaatatttatcaaagctgagaagcttctataaaggaagtttattaagtttcccatcattggaggaattgtcagtaatctattgcgagtggatggaaacattatgtccaggtaccctaaaagcagacaagttggttcaagttcaacttgaaccaacttggaggcactcagatcctatcaaattggaaaatgacctgaactctaccatgcgggaggcattttggaaaaagttatggcactctgcaagttggccatgggaatcagatcttgacctcaaagatagcccagtacaagagatatggcttaggcttcactcactgcatatccccccacacttccgcttcacttacttagacaccttgattgtggacggctgccattttttatcagatgcggtcttacccttgtctttacttcctttattacctaatttggaaacattgaaagttcgaaactgtgattttgtgaaaatcatatttgatgtgacaactatggaaccactcccttttgccctgaagacattgattttagagcggctgccaaatctggagaatgtttggaattcaaatgttgagcttacgttcccccaagtcaagtcattggcactctgtgatctgccaaagttaaagtatgacatcttgaagccatttacacatctagaaccacatgctctaaatcaacttacacccaacatagagcacctgacactcggtcaacatgaactcaacatgattttgagtggagaattccagggaaaccacttaaacgagttaaaagttcttgctctgttctttcattttgagtccgatgtatttctacaacgggtgcccaatatagagaagcttgaggtgtgtgatggttccttcaaagagattttctgctttgatagtcttaatgtggatgaggatggattggtttcacagctgaaagtgatatgcccggactcccttccagagcttgtttccattgggccagagaactctgggattgtgccctttctcagaaatctagaaacattgcaaagtctgctctatttgttcacatcctcaacagcaagaagtttgggtcaactcaaaacaatggagataggttggtgtgattcaattgaagagatagtgtcttcaacagaggaaggggatgaatcagatgagaatgagataatatttcagcagctcaattgtttgaaacttgaagtattaagaaagctgagaaggttctacaaagggagtttaagtttcccgtccttggaggaattcacagtattgtattgcgagaggatggaaagtttgtgtgcaggtacaatcaaaacagacaagctgttactagtcaatcttgtggcacctctgcttaactttggatatgatatcccattggaaactgatctcaactctgccatgcaaaatcgatag

SEQ ID NO: 776 - DNA, 141 bp, Glycine max
  Peptide Sequence Number=SeqID_92461
atggtggcccaggtgatgttggggaatggttacgagcccggaatgggtttaggcaagaacaacggcggtagaaccagaggaaaccgtgggaagtttgggttaggctataaacccacacaggcggacataagaaaaagtgtt

SEQ ID NO: 777 - DNA, 451 bp, Glycine max
  Peptide Sequence Number=SeqID_92462
atgcagattccctcctccatttcctcttcctcattgttctcatcagaagaacaacggatatggtacacaaatcttttctcttcttgttccattattgatccaaaattcattgacatggatttcttttccaatgagagttttgaatgcattcaggcatttgagaactccaatctcattcctttcatgtctttaaaattgcctgtttattctgaattagttaaagctttctattctaacctcgaaattcaagaaagcactttgatttctaatgtttatgggataaaaatggtcattgaccaatccctattctatgacttgacccaattatctagtgagggtgtaccatttgaaggtgcactgaataatgattggaaatttgatttctctgtacatgatgcccgccgattggtttgcactaaccaagcggatatgaccggaaggcttcttgccg

SEQ ID NO: 778 - DNA, 327 bp, Glycine max
  Peptide Sequence Number=SeqID_92463
atgaagtcttgcgttgccagtttccagaattttgccttgaggacaaggcatcatctaaggagatctcccacaggcaatttacttcctctggacttagaaattgaagctacattgcgaaggaacagggtcgagaggagaaggaaacttctgcaagacagaacagttgcatccattcttgaggaggagactcatttctacgacttattatcacctaattcaccatcatcaagggaatctgccactcaattacctgaagccattaccatggcagaagagtatgaccagaggattacccttgaggattattcaagtagttcagtaccataa

SEQ ID NO: 779 - DNA, 726 bp, Glycine max
  Peptide Sequence Number=SeqID_92464
gtagttgtgtctccgccaaaaccacctccgaagcccgatccggaggtcgatgatccgctttatctgatgacattgaccatcccagagcttttcttgaggccttatcaggttagatgggatgccaccgtgtgtgaggtagttaatccagatttccccctgtacataaagcacgaagacctctctgaaatcgcacacggtggtcaatgtctcaacatatcagtgttacagttgtggattctgcatctcactgaaacatgtatgcgagcggggaattgtgatatctatggattcctcgagcctcagtccattcagaggtctgggcaatcgcaatttgaatctaaaagttacataaagagttggatgcagagttcacaacgcgatgtgtatcttggagcctacctaaatgggttccactacagcggacattggcagatggtggttatcctgcccaaggaagtactgagtgctttaaaaggtgttgatgatgctccacagcctaaatcaaaggcttctgctaggtggattgtcgtcaagtgtaatagacaaaaaggaagtactgagtgcggctactatgtgatgcactggatgtccacaatcattttaggaactttgaggaataattgggaagcgtatttgtacgatcctagaccattggagccagagagattaaaggcattgcggatccagtgggcacagttttatctccaagttagagatcaggcctag

SEQ ID NO: 780 - DNA, 405 bp, Glycine max
  Peptide Sequence Number=SeqID_92465
atgagtccgttgctaccttgtctttctaatgcgaccataatggtagaacgggtgatgctcaagcacggttatgagcccggaatgggtctgggcaaggacagccttgggaatgccgatgtggtcgacattaggagaaacccgtacaaatatgggttggggtatgaactcgggaagccgggaagaaggaatgcgccgtcaagactctgggcagatagggcatggcccgaccatgttagccagtgtttcacgagtgccgggataatgtttgaggaagaggtggcggcaataggagaggagtctccaccagatccgccaattttcgtgcgaccatgccatcctgattcccaagtggggaactggcgtgtgataagccagttagaggtctatacccctgattcaatgtaa

SEQ ID NO: 781 - DNA, 174 bp, Glycine max
  Peptide Sequence Number=SeqID_92466
atgacctgtatggtggcacaggaaatctttgataaaattgactccttacaagaagagacgacacaaggcaactttgttccccatggtcgtgaggatatactcaatattgccattgggcgaccggagcacccaggtcgtattcgagctacaggaaatgatgttacaatcgactaa

SEQ ID NO: 782 - DNA, 282 bp, Glycine max
  Peptide Sequence Number=SeqID_92467
atgaataccgtcagttccatcgagtattttggactttcgatcaatgtaaagaggcttttcaagtattgcaagccaatcatacaagtcgacgataaaaatggtatatgtctcgtttctgatcatcatgcaagtataaagtcaattgttgctaatgaaacacttgggtggcaacctccctatgcttatcatgtttactgtgtgcgacatattgcaaaaaatttcaaccataagttcaagaatgagaaacaaaaagaaatgttgaaaaaattaggcaagatttga

SEQ ID NO: 783 - DNA, 144 bp, Glycine max
  Peptide Sequence Number=SeqID_92468
atgacttgggctaagcgcacatccaccgctaagcgcaacttcagtgcgcttagcgcgacagaagaatttggtagagcatcattatcaaggccacgcgctaagcgcgagattagtgcgctaagcgcagtagttgtctttagctag

SEQ ID NO: 784 - DNA, 153 bp, Glycine max
  Peptide Sequence Number=SeqID_92469
atgaagttggatattccatctttgttcaatgatttcgaacacacaagtatcatggttaggactagagaattaggtcgtgccttaggtcaggtcactggcagaggtgtgggcagaggagatcgtgatgattccgatgatgctccgcagcattga

SEQ ID NO: 785 - DNA, 496 bp, Glycine max
  Peptide Sequence Number=SeqID_92470
ttttccgcaggccagtatagtgcgttatccctccagccaggcggcgctggcggcagtggccagtggcgaagcggactatgcgctcggcagcctgctggcggcagcatttctgattgagcgcagctatgtcaatcagctggcgctggccgcgattttgccgcaggacgccctctatggcagccgtctggtggtgaaagccgataatcagccgttgttgcaagcactgaatgccgccatcgccgccattcccggcgaacagcagcggctgatttcgcggcagtggacgcagcggccggacgtctggcgcctgcaggagaccgctcagcctgacgccgcgcgagcagcagtggctgcagcagcatgcgcagcagctggagcagcatcaggtagcgatgctggcggcggtggcgcaggatggcggccatcaggaggcagtgcgctttacccgaccttacctgaaggtgtcgctggtgctgctggtgccggaccagcctga

SEQ ID NO: 786 - DNA, 384 bp, Glycine max
  Peptide Sequence Number=SeqID_92471
atgactaaagcacgtcaaaaggggggtacggaaagaaaaggaaggagatgcttgccaaccagctcgcccaggtgtgctcagctcgcccaggcgagctcagctatcccaggcgagctaggttgcttcctccagaagcaaccgccttctagaggaacatcctctttcggaatgttacggaaactcacggattgcgtaacaatacttccttttgatttccgacatgtcacggaacttcacgaattgtgctacaacgctttttttttggcttccgacatgtctcggaacttcacaaattgcctaacgatgggtgccaaatacctcgaagtggccgaacgagggtcgcatcccaacaatggatggtccccgaacgaaattagggtatga

SEQ ID NO: 787 - DNA, 432 bp, Glycine max
  Peptide Sequence Number=SeqID_92472
atgaaggttacagccctcaagcaaattagccatgacatgattgctcatgtgggtaaggctcgggttgtcgtggaagagctgagaaagttccttgtggctgactcattggaaaaagtgaacagaaaattggacaagttctacatggtcctcatcttgagaagcttacattcagactttgatcatgtgcgtgatcaagtacttgctggggaccaggttccatcaatggattccctcatcactagacttctccgcgtgcctcatgtatcgaaggatgaaaatcctactgatggtgtggaaacgtcagccatggttgcatctcgtggtagaggaggcggccgcaacattagaagaggtcgcagtggaagggatggacgtcctcattgcacctattgcaagaggatgggtcacacccaagaaaattgctattcgtag

SEQ ID NO: 788 - DNA, 282 bp, Glycine max
  Peptide Sequence Number=SeqID_92473
atgaaactggccaaatacaggctaaaggccaagtggagaaggacgaaggcccaaacttatcaaggtaatccttgtggcgtctacccagacttatcttccttcattggaagtggcgtctacccagacttatcttccttaaccggaagtggcgtctacccagacttatcttccttcactggaagtggcgtctaccctgacttatcttccttcaccggaagtggcgtctaccctgacttatcttccttcaccggaagtggcgtcatccaaaccttcgtagcctga

SEQ ID NO: 789 - DNA, 196 bp, Glycine max
  Peptide Sequence Number=SeqID_92474
atgggggtgcaaatagcacccaggcccacttgggccctccggaatattcctccagaaggcggggaggaagtgaagaagaaagggccgaggcgcttccgaaacatttccgtaacgttttccgtgaagaatttcgcaaaggttcaaccgttcttcgacgttcttcattcgttcttcatcgttcttcgatcttcaacgg

SEQ ID NO: 790 - DNA, 78 bp, Glycine max
  Peptide Sequence Number=SeqID_92475
atgttccctcatgggaagatgcccaggaaatgggtgtggaaggaagatgcccaaagtttcaagaacctcaacatttga

SEQ ID NO: 791 - DNA, 270 bp, Glycine max
  Peptide Sequence Number=SeqID_92476
atgtcatttcctgctttcagttacttagggacgagcacgagtggaggctgggtccacgatcaacggatcgtcatcccatatccagctccggacaagcgagaagcgctgctgggaggcaacctagtatcctttaaattcctagttattattactgttgtgtctttaaggagatggtttagctcgcctgggcaagcaccccctgcacgaaatggtttaaaaaagagagggggagtgcagttttcacccaagaaacttctccccctcacctaa

SEQ ID NO: 792 - DNA, 921 bp, Glycine max
  Peptide Sequence Number=SeqID_92477
atgaagaccctaagcgcttgttgcgctaagcgtcactacttttgtattcaggctaagtgcacttatgcgctaagcctgaggtttatttttgttaaggctgagctaagcgcgccttgttgcgctaagcccaagccctttacgatggcatctaagaaaaggaagtctactgcttcttcatcttcccaggtcagatttgacaggtccagattccattcacaagaggcctgggatagatataatgactttgtgatcaccaggaagatcctcccagagaggaatgaggtggtctatcacacaaaatttgatgaatttaaagaagaactgatgcgaaagaaatgggatgagaagcttaccactttcatagagggcagcattgatgttgccatagtcagagagttctatgcaaacctatatgaccctgaagacaaatcacctaagcaggggaccaaggctaagaggtctgaagcttctacatcttctattcctcctacttctacagcaccagacattcctgctccttcatcagcttctctaccagattcttcagcaccatctacttcagcaccacagattccacaacttccgacatcagttttagatccctctgctacagatttttcttttactcctcagatgcttcactccatgatgcagagtctacaccgagggcaggagcctgaggcagcagaggaggagcctattgtggaggaagatgagctcattccttctgagcctactgcagacattgctcaggaggaggcacatgcatcagagaccattccagagtcatctcctccactcatctttgaggatgcattgccatctacaatagtcatggagccagagcagccacaggatgcaccagctactccagtgctggatcttaatgaagagcagccttatgatgatcaggacttttag

SEQ ID NO: 793 - DNA, 111 bp, Glycine max
  Peptide Sequence Number=SeqID_92478
atggcgctaagtgagccttcgaggagctttagcattgaaaaatgtattgcatccttagaactggatagagcagggctagattttcgtatgtctagacacagagtgcgataa

SEQ ID NO: 794 - DNA, 252 bp, Glycine max
  Peptide Sequence Number=SeqID_92479
atggttcaaaaggcaatagatgaaggaagactggaattggaagagaaacccataaagatagatattgatttgttccatattgaagctaattatatcgagcccatccagatcatgatagtgggaaccttgatagggtcgtcaaagaagcaaaaggttgaaaaagaggtgatgttgtgtcctcgttatagtgttgtttttgacaaatctaccgctaaagctttcaaggcttcacaaattcaaaagaactactag

SEQ ID NO: 795 - DNA, 1521 bp, Glycine max
  Peptide Sequence Number=SeqID_92480
atggcttgcgtttacaagaatcccgaagagcaaattgaagctcgtgtgaaggaccttctttctcgcatgactctgagggagaagattggtcagatgacccaaattgagcgcactgttgccacctcttctgccattagagatctctccattgggtttgaacttgttggaggttggaatgaatttgatgagagacccccattgagagtgtgtcttgaaaattgttacaggagcatactcagttctggtggcagtgcaccatttgaaaatgcactgtcgtctgattgggctgatatggtggatggctttcaaaaatcagctcttcagtcgcgactgggaatacctctcatctatgggattgatgcagttcatggtaataatagtgtctatggcactaccatatttcctcacaatattggccttggagctactagggacagcgatttagttcaaagaattggagctgctacagcacttgaagttaaagcttgcggaattcactataattttgctccgtgtgtggcggtcttgaatgatcctagatggggaagatgctatgagtgttatagcgaggatactgaaatagtcagaaagatgacttccattgtttcaggtttgcaaggccagcctccacaaggacatgaacatggatacccttttgtagctggaaggaacaatgtcattgcctgtgccaagcattttgttggagatggaggtacttacaaaggtgtgaatgagggaaatactatattatcttatgaagacttagagataatccacatggcaccttacttagactgcatttcccagggagtttcaaccattatggcctcctattctagctggaatggacgccaactccatgctgaccattttcttataactgaaatcttgaaagataagctaggttttaagggttttgtgatttctgactgggaaggacttgaccgactgtgcctgcctcatggatcagattatcggtactgcatctcctctgctgtcaatgcgggaattgacatggtgatggtggcttttagattcaaagttttcattgaagagttgacctccctagttgaatcaggggaagtacctatcagcagaattgatgatgctgttgagcgaattttgagagtaaagttcgctgctggtcttttcgaatttcctttaagtgacagatctttgttagatatagttggttgcaagccacatagagatctagcacgtgaagcagttcagaagtccttggttttgttgaaaaatggaaaagatcctagcaaaccttttcttccattgactaagaatgctaagaaaatccttgttgctggaacacacgccaatgatcttggatatcaatgtggaggttggactaaaacttggtatggaatgagtgggcagatcacagttgcctatagcccatctctgttctcgcctattctagtaggtcctcctgttttggcaagcatcttcgttctcgcctattacaaggaagaaatactagcaatagagattatactagtactctaa

SEQ ID NO: 796 - DNA, 393 bp, Glycine max
  Peptide Sequence Number=SeqID_92481
atgttaatgtgtaatcatgaattttcgtttgttggtccgattgagttattatgtagcattgctagaaccccatatggcattttaaacttacttgaagctactatgatcactactcatgatgccctgctatattacaatgggaggtggaacatgtcacgccaaaatgagtttgttggttactcattcataggaaaaaatcccaaaaactttgacattcccaccggatgtaccatggatgaactgaaggatttgatcaagcaagttgcgcctcgtggtattcccccttatggtattgatgaaacacaaatgaaatggaagacccctcgagtcaagatatggaggaatttcagtcaaaatacacatatgaaagacatatacaacattccttattag

SEQ ID NO: 797 - DNA, 372 bp, Glycine max
  Peptide Sequence Number=SeqID_92482
atggttaggaccagaggattaggtcgtgccttaggtcacgttactggaagaggtgtggaccgaggagatcgtgatgattttgatgatgctccgcagcatcgatggcctaccgcatccgcacggaggcagcgagtccctgtgactgcggcgcattatgagccagtggtccctatgccagatgttgaggctgacgtatttccggatgacctgatggcaccagctgatgtagaggacattgtggcagacattcttgcagacacaggcacgcaggctgctgaggatgagcatgagggatttctgggtggtccgagcgacccatccgtgctgacccagtatgtggatcacgttgcttgcagcgtatggacgagagag

SEQ ID NO: 798 - DNA, 312 bp, Glycine max
  Peptide Sequence Number=SeqID_92483
atgccaaatctctatgaccgaaccacgaagctggaagagactcttactcagttcatgcaagtgtcaatgtctagtcaaaagagtacaaagtctgctatcaagaatctggaagttcaggtgggccagctcgcaaagcaattagcagaaaaatcatccagcagttttacaacaaacacggagaagaatctgaaggaagagtgcaaggctgtgatgactagaagcaaaatggcaatccaagctgaggaaagaagagctgatcagaaggtggaggcatttaaacaacagttggctactcagccggcactggaccca

SEQ ID NO: 799 - DNA, 267 bp, Glycine max
  Peptide Sequence Number=SeqID_92484
atgagctctaagcctcatcgagctttgctagtaaaagtcttgaatgaagctcatgtagctcaagacatctttgtacaaggctttgggggactcgtcaataacatcacagccaacaactacctcgccttcgctgaagaggaaatccatgtgtcgcaacctacccttcgatgggagggcgaagccaggctcacgggtgcgtcttccaagaaaggaaaatgcgcgaagtcgccaccaatgtttattcgaggaaaacatcgaaaaaactag

SEQ ID NO: 800 - DNA, 141 bp, Glycine max
  Peptide Sequence Number=SeqID_92485
atggagaattggcgaacatcgctaggcaatgactttcgtggggctccagactcgaaggcaatcatgaagcatagctccaaacttgaaggtggaggacacatgaacagcgctaggcaaggacattcatggggctccgaataa

SEQ ID NO: 801 - DNA, 279 bp, Glycine max
  Peptide Sequence Number=SeqID_92486
atgtacatcaagtatggcccaaaatacatcatgaagcatggccaacaaaacaagttgtccaatgaaacaaaaaccccccacacttattcccaaaacaattccaaagctccaaaattccttaaggatatggacgcatcaacaaagaatcaagccaagggctattgtgcaagcaatcaatggggcaaaacatacccaaatgattataatgatggatgggctcaaattctcacaaaggtaaaatcatcacttttcaaattgagcttttcaaaactatcatga

SEQ ID NO: 802 - DNA, 381 bp, Glycine max
  Peptide Sequence Number=SeqID_92487
atgaagaggaaagagcccccgatcttaacattgtgtttgcagaatttatggcatatcttgttagctctaaagctaatcataatgcaatacaaaagtaggagattcaatgtgccaaagttttttttttttgaagattatcaaggggaactagagtcacaattctactatcaaaatgaagcagaaaggagtttcaatttggacattttgttaatgcaattcaaggatacaattggatctattcaacgagcatttaaaagtgtagaaattcaggttggtaagctggtagaagaagtgactcaagctatgagcagaagaaaagaagagattgtagaggttgacactcaagaggagagccctgtgattgagcatgatttagaataa

SEQ ID NO: 803 - DNA, 609 bp, Glycine max
  Peptide Sequence Number=SeqID_92488
atgtctggacctgccttgcgaccatactccccccggaacccaaagactttgatttctcataaaggtgccagcggagtcctaaaagcaacatccgctgatccctggtcggcatcgtttatggttgagactaggacgttgttcgtctttcataaatccaagaatttcacctctgactatgaaatacgaatgcccccgactgtccctgttaatcattactccgatcccgaaggccaacacaataggatcagaatcctgtggtgttatcccatgctaatgtatacagagcgtaggcttgctttgagcactctaatttcttcaaagagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 804 - DNA, 594 bp, Glycine max
  Peptide Sequence Number=SeqID_92489
atggagagaaatatgatagatgctgccagtagtggagcccttggagacatgacccctgctgaagccaggaatttaattgagaagatggcttccaactcccaacagtttagtgccagaaatgatgctattgtcattagaggagtgcatgaagtagccacgaattcacttcatcatatgaaactaagaagcttgaggaacaattatgacctctctagcaacaggtacaatcctgggtggaggaatcatcccaaccttagatggtcgagtccttcacaacagcagcaacaacaacagccttattttcagaatgctgctagcccaagcagaccatgcgttcctccaccattccagcaacaacaacaacaacaacaacaacagccccagaaacaacaaacagttgagactcctccgcaaccttcctttgaagaacttgtgaggcaaatgactatgcaaaacatgaagtttcaacaagagaccagagcctccattcagagcttaactaataagatgggacaattgactacacagttaaatcaacaacagtcccagaattcagacaaattaccttctcaatctgtccagaatccaaaaaat

SEQ ID NO: 805 - DNA, 405 bp, Glycine max
  Peptide Sequence Number=SeqID_92490
atgaggtcctttaatggtgattttccaccatggagatgcagcggaagacaaaggagaagaggtgagaggaggcgcgatccactagggaataagccatggaagaaggagcttcaccaccaagatgagccttggataagaagcttggagagggcccaaaagaaggaaaaacctattctaatatttacaaagaagagtggatccaaccttgatccatgggctcaaaaatctaccctaaggttcatgagaaccctagggccttctttagtagctctagcccaagcctcttggagtcttctatccaataaccttggggggaagcctggggcaaatggagagaataaaaaggagggagcaacccatcctgtgattgccattcctatatggccaaatttcccaccagcttaa

SEQ ID NO: 806 - DNA, 231 bp, Glycine max
  Peptide Sequence Number=SeqID_92491
atggagctccgaaaaaagtggagtatggagaattggcgaacagcgctacgcaataacttcgtggggctccagactcgaagactcgatggtggaggacacatgaacagcactagacaatacattcatggggctccgaaaaaaaagtggagaatggagaattggcgaacagcgctacgcaataacttcgcggggctccagactcgaaggtggaggacacatgaacagcgctag

SEQ ID NO: 807 - DNA, 270 bp, Glycine max
  Peptide Sequence Number=SeqID_92492
atggattcactcggtgggagtcgtcccctcaacgctccaccaaaaactgaaattcgtggtggaggggcacttagtcattgttttaggggggaaggatgttttgggcatggttatgagcccgggatgggcttaggaaaaaataatgacaacatgaccagcttagtggacatcaaggaaaactacggaaagtttgggctaggctataagcccacgcggactgatgtgagaaaaagcatcgtagaaaggaggaacaggggcgtgggcccgtaa

SEQ ID NO: 808 - DNA, 136 bp, Glycine max
  Peptide Sequence Number=SeqID_92493
atgggtgaccaagaggagacacaagaacagatgaaagccgacatgtcggctttgaaagaacaaatggcttctatgatggaggccatgctaggaatgaggcaactcatggagagatgtggccgccgctgcgctgtca

SEQ ID NO: 809 - DNA, 729 bp, Glycine max
  Peptide Sequence Number=SeqID_92494
atggtcattgaccaatcccttttcaatgacttaaccaaattacccagtgacggtgtaccatttgaaggtacactgaatgacgactggaaatttgatttctctgcccatgatgcccgccagttggtttgcaccaacaatgcggatatgaccggacgtcttcttgccgggtcattggcttttgaaagccgcatccttcactatttaattgtgcgtattttgcttccacggtcttccaaccttgcccaggcctttcatacagggcgtcaacttgactgggcacacttagtcagatatcgcatgcataaggcattgcgattaaatgctccactaccatatccacagcttgtcactctctttttccgctattttcaaattcctcttgattctgaaccttacgttccaatcaagagatcctttttaattggtgctgctgtgattgcttcttttggttaccgcaaagagcatgatggctcttgggtcaaaaagggagctccacccgctgatgatgaaggcaaccaaccagttgaagataattcctctcttcttcgaaagcttttggaaaagttcgatggtcttcaaacttttgttggtgacaagtttgatactatggaattgcaagtcgacatgcggtttgatgccatggaatcaaggatcaccaaagttgaagaagatgtctccttcatccgtacttgctttgatccaccaccaccgcctccatcatcctcttag

SEQ ID NO: 810 - DNA, 459 bp, Glycine max
  Peptide Sequence Number=SeqID_92495
atggaacatacgaatttggggatcccacggtcatgtagctccgcatgccaccggactcttgggtcacgcatttcgcttctaaacgaccatttagaggaaacactaggtccaacaaagataggagaaaatcactcaaagtgtatcaatctcacacagatattgtctggttcaaagacctttctggatgtttcttctgttttctcccgatccttgatcgggaattttctttcctttttttgctttctcccactctttgattgggaattttccttttctttttgtgtcttcttccgagggcaaggattgacattctcaccttgggtcaaggtttatgataagttgggattttggctcaaggcttgtagaacggctggtcacgatatatgtcagggtttggccagcggttcggggataaaggggatgtcctacattatttccatgatacacatgcagcaatga

SEQ ID NO: 811 - DNA, 808 bp, Glycine max
  Peptide Sequence Number=SeqID_92496
atgtgccgacagcggcgcggtcggcatcgggctgtcagcgtcgcccagggtggctaccgacggcagtcggagttggacctgtgctgcacgcggatcacccgaccagcagatacaggcaggcaccggccacgcccagtgcgagatgcacgccgtacctgcagcagcgccgctggtgctgcaggggcggcatcgggtgccaggcctgcggcttcgcgggcgatggagatctgcgcctgcagcgcctgcgcggcgccggcaagccgtggcagcaggccgctccacacatccgcggcctcggccggttctttcgcgctggccagcggcgatgcccagcagccagctggcgcgctcggcatcgggtgcctgtgcacgcgcctgctgcaaccaggtgacacatcgcggtgtcatcgaactgcttgccggcatcggcctgcgcacgtgcctgcgccgcttccaccagcacgccggggtcttccggggcgagagcggcggcacgtgcgaaggctccgccgcggctgcggcgttgcccagttcggcctgcgaccggcccagcagcgcccagccatcggcccgctgtgggtcacgctccagtgcatcctgcagggcctgcacgccatcgcgtgcagggtggctagcggatcggttggacctgtgctgcacgcggaccgaccagcagcatcagaagcagcaacgccagcagccagcgcatgggctcagggcgccgtgtgcagcgtgctgccggcattgccctgggccttctcgatcttttccagcgccgggatcagcttcctcgtcgactacgcgctgg

SEQ ID NO: 812 - DNA, 486 bp, Glycine max
  Peptide Sequence Number=SeqID_92497
atggaaacccatatgcccttgaggacaaagaacttgactgagggaagcattgatgtggcaattgttaaagaattctatggaaacccatatgttcctgaggacaaagaactaaagcaagttagggttcgagggcacttgataaaatttgatgttgattccctcaacacctttttggagactctagtggtcgtggagcaaggggaaagcttgccctcttactccaggtttactagactaaggcctgatcctcaggagcttgtatccctgggaggggatttgtacttaatgccgaagggccaggttagtctacgggcttgtaatgaagatgaacatgaacttaggatcacttatttctggttagatttgactcattgctcagtccaactcctcgcggcttggatttccagccctggttattgccttgtgcaaggcccgaggagtcacctcagattctcttaccttcgagtcactcagcccagccattaa

SEQ ID NO: 813 - DNA, 278 bp, Glycine max
  Peptide Sequence Number=SeqID_92498
ataatttactttgtcttaacaacaataggcatatgagtgagccaagtatgcgagtggggaattcttatgtatatggattcctcgagccacagtccatccagagatctgggcaatcgcaatttgaatcagaaagttacatgaagaactggatgcagaattcaaaacaggatgtctacctaggaacctacctgaatggtgctttgaaaggacttgacgatactccacaacctaaatccaaggctggtgctaggtggattgttgttaaaactaatttgtag

SEQ ID NO: 814 - DNA, 249 bp, Glycine max
  Peptide Sequence Number=SeqID_92499
atgacagtcgcaacgtgctcttttgcgggcgagcgaggcgaggctcacgggtgcactttccaaaggaggaaagatgcgcgaagtcgccaccaacgtttatttgtggaaaacttcggaaaaaccgatggaaaccggtcaaaaatgaaaattctaagttcgggagttgtatttacgcttgaggaaggtcgacaaaagcggggtttttgctcctacgtaccctacatcaaagaggaaatcagacctacgtag

SEQ ID NO: 815 - DNA, 210 bp, Glycine max
  Peptide Sequence Number=SeqID_92500
atgaggtgcaggggtgctcgcccaggtgagctcaactcgcccagacataagcatggccctctacgagtcggcgttcacttactcgaactcactcaagggatactaggctgccttacagcggcgctttccgtttgtcccgggctaggcaaaggatggcgacttattggtcatgaccctagcctcaccttgcgtccgtccctaagtacctga

SEQ ID NO: 816 - DNA, 516 bp, Glycine max
  Peptide Sequence Number=SeqID_92501
atgaagccaaggtacgatggttcatccaacgaagcaccttccttcaataaggagttgaagagaagcttcacaagtgagagaaccacactagtgggaaagaaaagtcatgaagaaaataaatccaagcaaggcacattgtttagaaataacaagttcatggggcatgcaagcatgcctcttgtgtcacagccagctgagaaagaaagccttcttgtggaatctaacgatgatgatgacgacgatgacacagaaactgaggaccaagacgttgaaggaggaagaaccgttgctcagaacaatgacaggggaaagggtccacctgttattggtggagaaagttcaaaaacagatggtgatgaaggaccagatgtggataagaaggctgatgagttcattgctaagagaatcgagtcaatcaagaggagtagaaggagtgcaagaaactctttaagcacaccctgcatttcaaagatacctttaggggaggactattcacagatactcattagatgttag

SEQ ID NO: 817 - DNA, 153 bp, Glycine max
  Peptide Sequence Number=SeqID_92502
atgacagaccaaatgttcataatatacttgcgcagtaacagtaacgattggggggggaaaactgccaggaaaccacattataaacgaaacctcaaagagagctgggcttcatcctcaaaaggaaacaacaccaaaatatttagccttccatag

SEQ ID NO: 818 - DNA, 624 bp, Glycine max
  Peptide Sequence Number=SeqID_92503
atggcctcaccacagcccacgacttgtgcacaacttttaatacagaatgtccaattgcaaatccttgacggcgagaatgaagaagtcgagtttgtcatcattggcgtcagtgttcggcttccagcaagtgcaccggatcgcacaagtagtataaaacggatctcacaatcagtcacaaacttatctcaagctctcaagccggctcctgtttcaagctctggttttgatagttgtttgttagatccaaaaacaaccaaggaagggcaaaatagtctttccatgaagccatggaggggaagagaagaaacatataccagcagcctgaaattagtagaaaaatgtagaagaaggagaaaaggaaaagtggagttgaggcgctacagagttgtgaccgtggatcacttcctttgtcatttctctttaactcaagtccctgtggaaacaaactcttttataaatgtgaaacccacaacaacaatttgtatgcttgccaaaagtcttaacaaagagggaggcaacagaggaagtggtggtggaggggagaatggagtgagggttggaagtgaggaggaagcaggaaggaaagagatgtggagtgagatggagacaaggtacgagatgtga

SEQ ID NO: 819 - DNA, 318 bp, Glycine max
  Peptide Sequence Number=SeqID_92504
atggaaaagtgtcttgtaaagtttcaaaccaaatgtagagaagatccaacggttaacgaagtctgggcagcgtttttaccgagacagcttcatgtagttttctctagaagcttcattaagaggcgtctagcacactccagatatcttctcaaagatcccaacggtcagatcatggacaagtgtcttgtgaagttgcagaccaaatttcgagaagattcaacggttaacgaagacttggcagcatttttaccgaggcagcttcatgtaactttctctagaagcttcattaagaggcttcctccagaagcttcctcgtga

SEQ ID NO: 820 - DNA, 763 bp, Glycine max
  Peptide Sequence Number=SeqID_92505
atggctgaagatgtttgtccagtgcaacttgaggataggaccagaggccagagcactaaagttggtcaacccacaatcactttctccttagacgaaagattcgaagcctgcgtgcccaagacatgtgggaatgggcagaacataagctacccgttttacatccaaggcaagcaaaaacccttttgcgggcagccaggcttcgagctaacgtgcggtcacaacggcttcccaattctgactctcatgtacaccccatacacaatccaccaaattttctaccacaacaactccctccgactctccaaccccatcttttcacaaccaaacgcttcttcttgtattggccccactcaaaacctcacggtcggaaggtacatattccgactggctccaaaccagagggatctgttcgtcctatacggctgcgacccagcggtgcttcccgaaagggtgcgggagcggatgatcgggtgttctgcggcggggaacgaaaccacgttggttgtcggtttggataaggatgatctggatttggttacggcgcgggagagttgtaacggcggtgcggtgaatgcgacggtggaagatttgaaaggaggggttcgagaggcgctgtggagagggtttatgttgatttggaatgcgactagctgcagggagtgcgagaacagtgaagggaggtgcggcttcgacctcgaccctctcgtctatgcttttcggtgttactgtcctgataggcctcatgttgtgaaatgtaatccag

SEQ ID NO: 821 - DNA, 1089 bp, Glycine max
  Peptide Sequence Number=SeqID_92506
atggttaagactagaggattaggccgtgcattaggtagggctgttggcagaggtctgaggagaggggatggtgatgattctgacgtacttgtcattgttgtcgatgatgtgcctgcggtacctatggactcgccagcggataccggtgcagaggatgctgcagatgaggctgagggatttcctggagatggttgctgggataggattaagttctttgatcgcgtgttcagtagacaccggcgatcgtcgtttatcgagaggtggcactgggagacgagtactttccatcttctagtgggggaggtatccatcacgctggacgacgtcgcgtctcttcttcatctgccgatcattggcgacttccatgacttccaccagaggtatccatcacgctggacgacgatcattggcgacttccatcttctagtgggggaggtatccatcacgctggacgacgaggcgatgctgaagttggttgagttactgatggtctcaccagagcactggacagttgcagctcgtgcttatcttctgcatcttctgggttgcactctttttgctaataagagtgaaacccatgttcatgttgttcacttagacgccctgcgtgacctcactcagactaggaggtatgcatggggagctgttggcctcgtctatatgtacgatcaccttaatgatgccagtatcagcaccaatcgacaggttggtggttacatcacgttgttacagtgttggatatatgagcactttccgtctgttgcggagtgcaatgctgatccagactacgacgaggcagcgcctggatcgtctcaggattccagatgtctgctggatgccatatgcggagcactgactggtccaggagtttcatccgattacatgtttctcaggacagctccggtgtcatttgatgacatagacgataggtgggtgcactactctgaccatctagcgccagcaggtgacatatgtattgtgccaggtcagtgtgcgcccgactgcatcgactggttcttcgtgatatcgcatccattcatgactgcgccacagacatcagatcctcctcgagatgcatctgcaacatag

SEQ ID NO: 822 - DNA, 489 bp, Glycine max
  Peptide Sequence Number=SeqID_92507
atgtggacttttcatacaggccgacaaattgattgggcacacttagtccgatatcgcattcataaggcattgcgattaaatgctccattgccatatccacacttagtcactctcttccttcaacactttaacatccctcttgattataaaccttatgttccaatcaagagatccttcttaattggtgccactgtgattgcatcttttggtcatcgtaaagagcatgatggctcttgggtgaaaaaaggtgcacaacccattgatgaagaaggacacttaccagttggagaagattcctctcttcttcaaaggattttggacaggttcgatggtcttcaaacctttgttggtgaaaggtttaatgctctggagttacaagtggacatgcgattcgatgagatggattcaaggatcaccaaggtcgaaggagatgtctctcacatccacacatgctttgatctaccaccaccacaacgaccatcatcttag

SEQ ID NO: 823 - DNA, 420 bp, Glycine max
  misc_feature (7)..(7): n is a, c, g, or t
  Peptide Sequence Number=SeqID_92508
atggaanggaagtttcagaaatttgggaggcctactcctaaaatcgaagggccgatcgctgccacaggattaagtcttttaatcgcatgtttagtggacactggcgatcggggacttatatccgcttttgtggagaggtggcataaggaaacgagtagtttccatcttcctattgatgaggtgaccatcaccctggatgatgtggcctctctgcttcatcttcttattataggttgcactctgtttgctaacaagtgtgcaacatttgttcatgtggtttttttagacgcttttcgagacttgagtcacagtggaagctacgcatggggagttgccgccctagtgcatatgtatgataatttgaatgatgcttgtaagagcgacagtcgacagcttgctggatacatcacactattatag

SEQ ID NO: 824 - DNA, 744 bp, Glycine max
  Peptide Sequence Number=SeqID_92509
atgccaggctaccatctagtcggttcatgtaatgagttgcactgtggggttagcgaaataccaaaaggatactgtgtttgtttctggaacaaggcgacaagggtgatatccagagaatcgccaacgctgtcttttttcccgggcattggtcgtagaacaatgtttgggtttggctatgatccgtcaagtgaaaaatacaaggttgtagcaattgcgttgactatgctctcacttgacgtatctgaaaagactgagatgaaaggaaaagaaaccattcattctgaaatcgtaattatttctattgacctggagaaggagacttgcagatcactgtttcttcccgacgatttttgcttttttgatacaaatattggagttttcagagactcgctgtgcgtttggcaagatagcaacaccaatcttggcttgtggcagatgaggaagtttggagatgacaagtcttggattcaattaataaattttagttatttacatcttaatattcgtccttatgaagaaaaatcgatgattttaccattgtgcatgtctaacaacagagacttcttcatgctgaaattcactagaaatgctgatgatgaataccaaacaattctgtataaccagagggatggtaagtctcaagtttctgtcgttcccttaggtagtttcagaactttgttgtggtgcaacttcaagatttttaccaaaactttggtcatctcgaacgctttgtcagatgtttga

SEQ ID NO: 825 - DNA, 324 bp, Glycine max
  Peptide Sequence Number=SeqID_92510
atgatacgcggagataccttacggttatccgcacccttttgtcatccagaggcggcgggcccgatgacaagcagagaccaagtttggtcattttgcacccttgtatcatccagaggcggcgggcccgatgatacgcggagataccttacggttatctgcacccttttgtcatccagaggcggcgggcccgatgacaagcagagaccaagtttggtcattctgcacccttcgtcaatcgcggccgacaagcccgttgacacgcggagatttacatcatcttccgcacttacaagatctgtcatactgacttttgagtcatgctga

SEQ ID NO: 826 - DNA, 261 bp, Glycine max
  Peptide Sequence Number=SeqID_92511
atgggtgccaagtacctcgaagtggtcaaacgagggtcgcatcccaacaacggatggtccccggacgaaattaagacacagaatgaccataatttgtctctgcgttttgttggacacgatggagcctgggtggcgagacacagaatgaccataatttgtctctgtgtgccaccgaacacggctgcctctggacggcgaaaaggtgtgcggaatgaccataatttgtctccgctcacctctcaacttgttgtttttgaatga

SEQ ID NO: 827 - DNA, 288 bp, Glycine max
  Peptide Sequence Number=SeqID_92512
atggccaagttcgatccagacatagtcctcgaattttatgccaatgcttggcctacggaggagggcgtgcgagatatgagatgctatcagccagttcctgggataccctttagtgctggaaagggccaggagtgcgagtatggccagaggaggaaccggtccgatgggttcgatgaggaggccatcgcccatttgctatgtataccggggcaggattttgcccggactgtagctgggggacgggtgcggatcatgcgcaccaacatgaccaccctgactcagatctag

SEQ ID NO: 828 - DNA, 249 bp, Glycine max
  Peptide Sequence Number=SeqID_92513
atggataagagcttgaaggtaggagaagatgagtggagggagaaggagagaaggagcacgaaattttgtgcctcaaatgagggtttcacgatgttacagaaagaaatgagcaagatactcagattgggggcaatttttgtcaacatggggattttttccagccgagttgagctaattaacagtgatcactatgcgatccatagggtttcgcgatgtttcagaaagaaatgggaaaagaactcaatgtag

SEQ ID NO: 829 - DNA, 291 bp, Glycine max
  Peptide Sequence Number=SeqID_92514
atggcttacacccacattccggtgaaagttgaaaatcctggatttacacacgattctcctcaaatttcagccagcccacatcaattagaccttgcaccttacacttcagagccctaccatgctcaatggaacccccggggcgtctccgtgacaagcacacgttgcgttcgagtcgtatcctcggaaaaatggaggttgatgaacccttggttgggggttatggctaccattgaattattgagtgggatatggggatcaagtttagcatatgacaacggaatttgggggtga

SEQ ID NO: 830 - DNA, 286 bp, Glycine max
  Peptide Sequence Number=SeqID_92515
attgagtttgttggctttcaatgagtatgggagtggagttattgacattctcatcgagagtgtgcgccacattgggtggtgtataattgggcaagccatatggcgggaagggatgcttgttttgaacttgcacaaaacggggggaaacgatgtaactcaatccatcttctgcactgatgcaatcctccctaggaagggaccagtcactagaaccatgagcaagaggctccaagaggattgggctagagctgctgaagaaggccctagggttctcatgaacctcatg

SEQ ID NO: 831 - DNA, 321 bp, Glycine max
  Peptide Sequence Number=SeqID_92516
atgtcaggatttacacgtgattctcctcaaatttcagccagcctgcatcaattagaccttgcaccttatgcttcaggcccctacaatgctcaatggaatgccccagggcttctccatgacaagcacatgttgcgttcgagtcgtattctcggagaaatgaaggttgatgaaccttggctagggttatggctaccattgaattatcaagtagatatgggagcaagctttctcactgcaaaattcatttcttggttggtgttttcgtttatgctaaaggtggtgtttgtcattggaagtgcggtaggtaggctttgtggttga

SEQ ID NO: 832 - DNA, 438 bp, Glycine max
  Peptide Sequence Number=SeqID_92517
atggcagcctgccgtgggcaggctgagtaccctgagcatcctgagcattctgttattagtgagtctgagcattctgtggttggtaatcttgaacatcctgattttgagcattttgactttgagcattctgattttgaacattctgaaaatatggctcaacccctacctcgtgagaggattctaagggaaatggttgcacctgatttcacttatgaaagcttgtgcattcaataccctgatgaggatgtcccatacgttcttaaaactggactgatccacttgttgcccaagtttcatggtcttgtaggtgaagaccctcataaacatctgaaagaattccatattgtctgctccaccatgaaacctccagatgtccaagaagatcacatctttctgaaggccttccctcattctttagagggagtggcaaaggactga

SEQ ID NO: 833 - DNA, 156 bp, Glycine max
  Peptide Sequence Number=SeqID_92518
atggaaggtaaaggaaatttaaagtcccaactggctcttcacttagtctacacagtttacactaagctattacacacaaatagaggtttgggtggtctcttggagactcccaatacacctctgaagaatgtccaaatacaaggaattgtaacataa

SEQ ID NO: 834 - DNA, 387 bp, Glycine max
  Peptide Sequence Number=SeqID_92519
atgtttatttccttgttacgcttaaaacgatacagatctgacgacgagtcccaaataagtactaataccggggacccgaccgtcgatttcgagcaagaagcaagtcggacggagaatgaagaggacgaggatgtggggcttcccccagagctggagaggataatcgctcaggaggaccaagagatgaggccgcatcaagaagagacagaactcgtagacttaggaaccagcagtggaaaaaaggaagtaaaagtaggcacgggtatgaccacacccgcccttgccttcggaggctccaaatttgcgccttcagagaaggattgcacccacaaaacacccagtggacccagagaattccaacagggtcctgggggtttccagatctga

SEQ ID NO: 835 - DNA, 180 bp, Glycine max
  Peptide Sequence Number=SeqID_92520
atgccttttagaggcttgaaaagtgcgggaaaacaagctgtgttttttgtgttttctaaaaaacgtgatgcactcgctaagcgagcttgctgcgctaagcgagttcatcaatactcattgtatccgcgcgctaagccgagcgttcctgagccaagcgcaattggttgcggcatccgctga

SEQ ID NO: 836 - DNA, 309 bp, Glycine max
  Peptide Sequence Number=SeqID_92521
ttggaagtagttattggaagttgaaagttaaaaatggaagttggaagttggaagtggaagttactggaagttggaagttggaagttggaaatgaaagttattggaagttgaaagttgaaaatggaggttggaagttggaaggggaagtggttgtcatcatcaaaaagggggagaatgtaaatcatgaagattttgatgatatcaagaagaatttgcttgagaaagagggagatgtaaatcatgcaagctttgatggtgtcgagaagaaatcacatgtttgtcatcatcaaaaagggggagaatgtgaat

SEQ ID NO: 837 - DNA, 431 bp, Glycine max
  Peptide Sequence Number=SeqID_92522
atgcctttcttcgttcatggttcgatattctggtgtcctaggcgtagaggaaccacaccaatccatcccgaacttggtggatactccggggaacagatatccagtggagatgacggggtggggcctgtagctcagaggattagagcacgtggctacgaaccacggtgtcgggggttcgaatccctctcgccacaaccggccaaaaaagggaagatttttccctctggggtagaaatcatgatcgggctagcggaccaaagctatggaacttccccggactgtggaacaaaggagtatcccgaacctacaccgagtcagttaacagccgaccgctctaccactgagctactgaggaacaacgggaaattcgagctcatagagttcaattcccgttctcaacccatgaccaatatgagctcgaagtttccttc

SEQ ID NO: 838 - DNA, 705 bp, Glycine max
  Peptide Sequence Number=SeqID_92523
atgtcggctggctatcattccaagaggagggtcccaacgttaaaaccaatccactggcccagtcatggaggggctagcgtaaatgccatcgaaaaggatgggccgtcaggggcaaagagattagaagatgtggctacatctagacggttcatctaccagtcgctgcaagcggcatgcatggtctcttgtggcggagacgaaagggacgaatgtttgtttcatctcggggaatcacacgacatggaaacctgtcccgtggtggaagaattgcttcaatggctcatggattgggggcagttcgaagtgtccaaaggaggtagggaagaaccacagatttgcatgcagtcggaagaaaagaaggttcccccaacccccaaagccctagtaatatgtttcactaggaaagggaccggctccaggcccatgtaccctctgacagcgcccaagccaacgccgtttgcatatcaaagcaataaggtcgttccgtggaagtatacccctcccgcttttggagaaagagttgcaaccgaagttgactccttgtcagccaaggtgaccaacatcaccggcttcagtggcgtaagccgtagtggccgggtgttcactccccctcactcggcagaattgccctccaaggggaaagcgcccatgatccaagagcccacaaacgtagccaccccctcaaaagaagtggatcctctggtg

SEQ ID NO: 839 - DNA, 512 bp, Glycine max
  Peptide Sequence Number=SeqID_92524
agggctacgtgccctcaccatcaaaggactacacgtcctcgactttagagggctacacgtcctcaccttcagaggattgcaggtcctcgtttttagagggctacacatcttcaccttcagaggactacacatcctcgactttagagggctacacgtcctcgccttcaaagggctacatgccctcgccttcagagggttgcacgctctctccttcagagggctgcacaccctcgccttcagaggactacacgtcctttccttcagaggactatacattctctccttcaaaggactacaagtcctcaccttcagaggactacacatcctcaccttcagagggctacacgccctcaccttctaggggctacagaccctcaccttcagaggactgcacatcctcgccttcagaggactatacgtccttagcttcagtggactacacgtcctctccttcagaggactacacgtcctcaccttcagagggctacactcatttgccttcaaagggttga

SEQ ID NO: 840 - DNA, 306 bp, Glycine max
  Peptide Sequence Number=SeqID_92525
atggttgtcatgaggggaattatggagaatggcctctattctgtagatggtgaagttgtaattggctctgcagccactgcaaccagaagagttttatcaaaaactgagttatggcacatgaggagcttctatgtggggatagaatggaaagataaaagttctgtgaacattgtgtctatggcaaagcctgtagagccaaattcaatgttggacagtagagaacaaaaggtacccttgattatgtttatgctgatctttggggtccaaccaagactccctctcattctggagcaaggtttttcttga

SEQ ID NO: 841 - DNA, 141 bp, Glycine max
  Peptide Sequence Number=SeqID_92526
atggagtgcagagaaagaaaagggaatgaagaaggaggaggaggaggagaaggtgaattgagggaaatctttaacacacttgcaagaatgtgttcgccactcctgattgaagagcgtgtccgtaacgcgaccttaagttga

SEQ ID NO: 842 - DNA, 489 bp, Glycine max
  Peptide Sequence Number=SeqID_92527
atggcgggacaggaaatgccgctattggcagcagcgggacagggggatgaaagcacagcaacaacaagcactaaatttgaaagaaatttgaaccacgagcacaataagctctcacactcaagaagaaagaaagagaaagaaaactcagtaagaactgaaaaccctaaacactgcaagcctgagcctagctatgttctaaacactgcaagcctgcaacgtgcagacctggaagccttcaacgtgagccttcaacgtgttccgcagaagccagtggcgggactgcccacgttggcatgtcccgccagtaccagtggcagcatggctccctctctcctagtcagccatgtcccgccaggacgaatggcggtatgggtgcgcctctctcctagtcaccatgtcccgtcaggaggaatggcggtatgcactgaggccgttgttgtcaatggcggtacaagctctcccgccggcagcaatggcgacaccccgtaa

SEQ ID NO: 843 - DNA, 489 bp, Glycine max
  Peptide Sequence Number=SeqID_92528
atgtgtagaaactgccggaatcgtcgtggtattcactcccagagcgatgaaaacgtttcagttcgctcatggaaaaccggtgtaacaagggtgaacactatcccatatcaccagctcaccgtctttcattgcccatacgaaattccggatgagcattcatcaggcgggcaagaatctgaacggtctggttataggtacattgagcaactgactgaaatgcctcaaaatgttctttacgatgccattgggatatatcaacggtgttggaacctcttacgtgccgatcaacgtctcattttcgccaaaagttggcccagggcttcccggtatcaacagggacaccaggatttatttattctgcgaagtgatcttccgtcacaggtgctccagtggcttccgtttctatcagctgtccctcctgttcagctactgacggggtggtgcgtaacggcaaaagcaccgccggacatcagcgctggcaagtgttag

SEQ ID NO: 844 - DNA, 87 bp, Glycine max
  Peptide Sequence Number=SeqID_92529
atggactccattgaggaagaagatccatggcctacaagcttcctatatggagctacatcatgcggttctatcatttttcagtcataa

SEQ ID NO: 845 - DNA, 564 bp, Glycine max
  Peptide Sequence Number=SeqID_92530
atgcctgcatttggtttctttatggtggtggtctttgctcctttgacggaagaacttatctttagagggatgttggcacgctatctctttcctaagcaggacaagagcaaacaggttctgtttcttctggtatctagtgttctgtttgccttgattcatttcccaggtgatgtgcaacaatttttagtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 846 - DNA, 384 bp, Glycine max
  Peptide Sequence Number=SeqID_92531
atgtcgggatttacacgcaattctcctcaaatttcagccagcccgcatcaattagaccttgcaccttatgcttcagagccctaccatgctcaatggaacgccccggggcttctccgtgacaagcacacgttgcgttcgagtcgtattctcggagaaatggaggttgatgaaccttggctagggttatggctaccattgaattatcaagtagatatgggatcaagtttagcatatgacaacggaatttggggtgaaccctacaggctttttgctgcaaaattcctttttgttggtgtttttggaattacagtcacagcatgggtttctccctcatcctcaccctctttatttgccccagttttctcaatcgtcctagtaggatga

SEQ ID NO: 847 - DNA, 267 bp, Glycine max
  Peptide Sequence Number=SeqID_92532
atggtagcaataaccccaaccaaggttcctcaacctctatattttttaggatacgactcgaacgcaacatgtgcttatcatggaggaggcccggggcattccattaagcattgtaggaccccgatacataaggtcacgatgaaagacaacgataggcacctcagagccctacactggggcaatgagaggcaccttcaccatcctcaagcaaacctaggggcacataagaaattctcacccggtaggttccctgctacatggtcatag

SEQ ID NO: 848 - DNA, 231 bp, Glycine max
  Peptide Sequence Number=SeqID_92533
atggcagcggaatggagaaggaagagagagaggagacgccacttcaaggagaagatgagtctagaagaagctcactaccataggaggccatggataagagcttggaggaagaaggagatgaatgaagggagagggagagaagagcacggaattttgtgctctaaaagagcactgaaatatgaacccactaatccaagatcaattccaagattctccactaagtgtgcttag

SEQ ID NO: 849 - DNA, 1733 bp, Glycine max
  misc_feature (1018)..(1018): n is a, c, g, or t
  Peptide Sequence Number=SeqID_92534
tgcgctgaacgaggttctggcgccgctggtgttcccgaagcgcgaggatggttccgatccgcgcatctgtcaggtttgcggcaccggcaatctgtcgctgaagctcggcaaatacggtgcctttgtgggttgctcgaactaccctgagtgcaactatacccgccagctgacctccgatggcgcggaagccgaagccgctgctctcaacgagccgaaggcgctgggcgctgatcccatgaccggcgaggagctgacgcttcgctccggccgtttcgggccctatatccagcggggtgacggcaaggaagccaagcgctcctcgctgccgaagggctggaagcctgaggatatcgatcacgaaaaggcgttggcgctcatcaacctgccgcgcgatataggcaagcacccggaaaccggcaagatgatctcggctggtctcggccgttacggacctttcctgctgcatgatggttcctatgcgaacttggagagtatcgaggacgtgttctcgatcggcctcaaccgcgccgtgaccgtgattgctgaaaagcagagcaagggtccgggacgcggccgtagcggcacgccagctgctctcaaggagttgggcgaccaccctgatggcggcccgatcaccgttcccgaaggcgaccaaggccaaggcggcgacaaagagcaagacggccgccaagccgaaggcagcggccaaacccaagaaggcagcagagtgagcaaagcgccgcgtcagagacagggttccgccagcgacggtttcggacgcaccgggcgcggcaagcgggtgagcgaaggtgaaggcatcatccacggcgaggtgccttcgcgtgaagtgctgctgaaattcatcgcagaccatccgcaacaggcctccaaacgcgaaattgccaaggctttcgggctgaagggtgaaaaccgcgttgtcctcaaggcgctgctgaaggaacttgaagtcgacggcatggtgcacaagagccgcaagtcgctgacgcgaccgggcggnctggcgcctgtgacggttctcgacatcacgacccgcgacaaggacggcgagctgatcggccgcccggcggaatggcctgaggatttgggcgcagcgccggccgtgctgatccgccagtcctcgcaggaccgtggcaagaaggccccggccgccggtctcggcgaccgtattctcgcgaaaatcttcccctcgaaggaaagcaccggtcccgcctacaccgcccgcgtcgtcaagctgatcgaccgccgccagaatgcactgctcggcgtgttcaaggagacgcccggcggcggcggacggctgatgccaatcgatcgccgcggcgaggaaatggtcatcgatcctgatggcgtcggcgatgccaaggatggcgatctgatcgaggtcgaaacctcgcgcaacagcggtcgttacggcctgacgcgtgccaaggttctctcggtcatcggctccgtggcctcggaaaaggcgatctccatgatcgcaatccacgcccacggcatcccgcatatattcccgcagaatgttcttgccgaagcggatgcggccaaggcagcgacgatgtcccaccgcgaggactggcgcgacctgccgctcatcacgatcgatccggccgacgccaaggatcacgacgatgcggtctatgccgaaccggacacatcgcccgacaatctcgatggtgtcatcgtcaccgtcgccatgccgatgtctcctg

SEQ ID NO: 850 - DNA, 297 bp, Glycine max
  Peptide Sequence Number=SeqID_92535
atggctcaacctccaccccgtgagaggactctaagggaaatagctgcacctaatttcacctacgaaagtttgtgcatccaataccctgatgaggatgtcccatatgttcttaaaactggactgatccatttgcttccaaagtttcatgggccttgcagttgccctcactaccagatttctgagcagcttctcctccaatatttttatgaaggactcagtaacatggagagaagtatgatagatgctgccagtggtggagcccttggagacatgaccctgctgaagccagaaatttaa

SEQ ID NO: 851 - DNA, 585 bp, Glycine max
  Peptide Sequence Number=SeqID_92536
atgattgatacaccatggagttatgatagttgtccatactgtactaccacttttgatccattaaaaataggtgcagcctgccgttcgtgtcagaatcatgttactcacactattccaaggtataagttagttgtcaagatggaacagaatggggagaaggcgaacttccatttttgggatgcagtatgtatcaaaatatttggtaaaactgtagatgaatgtcgtcaagagttgattgcgagtggtgatgagatcaaggtgttccctgcgtgtgttgatcaattgttgggtaaaacttgggttgtcagattcaaacaccgtatacagatgcaccaatcatccgtgttggattttagtgaacaagaacatcatatacagtcactgatatccacgctaggtctacaggatgaacaatgtataagcaacaagtcagccgctgttggtgctgcatcttcatcacaacaagattaccatcctacatcatctgaatatgatcctggaaatgttgcctttgtaactcctgcaaaaagaacgtacgatcaacaaggaagtagtcagtttgatagtgacgacttcacaacataa

SEQ ID NO: 852 - DNA, 622 bp, Glycine max
  Peptide Sequence Number=SeqID_92537
ttggcccagggcttccccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtgagtgttgcgattaacgcatggtatggtccattctatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 853 - DNA, 288 bp, Glycine max
  Peptide Sequence Number=SeqID_92538
atgaacaaagaggaaaagaccaaacacccagcttcctctccaaaaacgctgacctcgagaaaatcctattggtctgtgatcctagaagttgacatcctatccttcattctcggttacaaggaagattacccttggcacaagtatattgtttctctaagatgtggtgctttcgcgaatgatttatttttctttgcaaaaagcatgttatcctttaaggtggaaaaacccggtggatcgttcggtcccgccaacatccttttccggagccgcatgaatgttattgcttag

SEQ ID NO: 854 - DNA, 413 bp, Glycine max
  Peptide Sequence Number=SeqID_92539
atgatgtgcaaaattcaaaacgagcacgccttcccgccatatggcttgcctctcaactatacgccgcccaatgtggcgtacactcccaatgaggatacacatgaaattccccaccacaatctagccgacttcgagccttgcctcggatatgccactgaagggcaagcagttggtggtatacccctacaaaaccttttggagggccctcagtatcatccccagctacacctcttgcattccacaacaagtaaaaaacctcatgctatggcagaaatgggaaagttggatcatctagaggaaaggctcagggccattgaaggaggtgaagattatgcctttgctaacctagaagagttgttcctagtacccaatatcatcacccctcccaagttcaaggtgctggactttgacaa

SEQ ID NO: 855 - DNA, 213 bp, Glycine max
  Peptide Sequence Number=SeqID_92540
atggttatgggagatttcatcagcagactctccttccccggatacgtaggagcaagagcctcgcttttgtcgaccacaccgccttttgttgccatgactcaagagctggtagtacgcggagataccttacggttatccgcaccctttttgtcatccagaggcggcgggcccgatgacaagcagagaccaagtttggtcattctgcacccatga

SEQ ID NO: 856 - DNA, 228 bp, Glycine max
  Peptide Sequence Number=SeqID_92541
atggataagagcttgaaggtcggagaagatgagtggtgggaaagggagaaaaggagcacgaaattttgtgcctcaaatgagcccatgggcccgaagtctaccctaaggctcatgagaaccttatggccttctcttgtatctctagctcaatcttcttggagtcctctatacaatgcccttgggggggtaggattgcatcattcaccaccaagagaatgccttggataa

SEQ ID NO: 857 - DNA, 45 bp, Glycine max
  Peptide Sequence Number=SeqID_92542
atggaatttttgaactacgaatgctttacgatgtcaatgattttg

SEQ ID NO: 858 - DNA, 498 bp, Glycine max
  Peptide Sequence Number=SeqID_92543
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgcagttcgctccaagctggactgtatgcacgaaccccccgttcagtccgaccgctgcgccttatccggtaactatcgtcttgagtccaacccggaaagacatgcaaaagcaccactggcagcagccactggctaaactgaaaggacaagttttggtgactgcgctcctccaagccagttacctcggttcaagagttggtagctcagagaaccttcgaaaaaccgccctgcaaggcgggtttttcgtttcagagcaagagattacgcgcagaccaaacgatctcaagatcatctattaa

SEQ ID NO: 859 - DNA, 557 bp, Glycine max
  Peptide Sequence Number=SeqID_92544
ggagctgtgagacccgcgaaacctgcagataggccggatgatgaggtcgatgatccgctatatctaatgacattgaccattccacagctttttctgaagccattgcagcatgaagatctgtctgaaattgcacatggtggtcaatgtctcagcatatctgttatacagttgtggattcttgcacattggcaaatggtcgtcattttgcctaaggaaaatgttgtcatttggttttgttcgttgcataataagccagacaactacctcaaaggcatgattaataggtcagtgttgttttttaatatatttgcattagcattagtcagtgctttgaaaggacttgacgatactcaacaaagtaaatccaagactcctgctaggtggattgttgttaaatgtaatagacaaaaaggaagcactgagtgtgggtattacgtcatgcattggatgtcaactataatcttaggaaatttccagaataattgggaaatgtatttcactgatcctagaccattggaaccagaaagattgaaggcacttcgcatccagtgggcaaa

SEQ ID NO: 860 - DNA, 177 bp, Glycine max
  Peptide Sequence Number=SeqID_92545
atggggcaaggtggttgcttggttggttgcatagtggttggggctatagtggtgattaaggggtcttgtttgggtgacctcgcgacaatgaaggtggcggcttcgaggacaagggaggtggttgttgttatttctaaagtttgttggggtttgaagaagggggctaaaaaatttgtg

SEQ ID NO: 861 - DNA, 1884 bp, Glycine max
  Peptide Sequence Number=SeqID_92546
atgaagaaatttatggtcttgcaccttctgacatggatttggctatgtggtgttgctcacagcggaaggcctgccagtgtgaacattggtgcggttttttctttcgattctatcataggtagagctgcgaagacggctatggaaatggccgtttctgatgtcaatgaggaccccacagttctcatgggaaccaaactcaacttgattatgaaggatgccatgtgcaatgcttttcttggatcaattggagcttttcaggtacttgagaaaggggttgcagccataattggtccgcagtcatctgccgtagctcacacggtttctcaaattgctgatgctctccaagttcctcttgtttcatatgctgccactgatccaaccctgtcctccctccagtttccattcttcattcgaactacgcaaagtgacttggcacaaatgactgcaatggctgatataattgactttcatggatggaaagaggtcattgttgtattcttggatgatgattatggaagaaatggactatctgctttgagtgatgagcttgaaaaaaggaaattgaaaatttcttataaactgcctttaagtattaagtttgatttggatgaaatcactaacttgctcaatcaatccaaggtggttggtcctcgtgtgtatgttgttcatgtcaaccctgatccgagattgagaattttttttattgcccataaacttcaaatgatggccaaggattatgtctggcttgtcacagattggctctcagctacactagattcattatctccagtgaatcagacctctttcagtgttctccaaggggttgttggtctacgtcaacacattccggactccagcaaaaagagagcttttgtttctcgatggataaaaatgcaaaaagaaggattagcaaatactggtttgaactcttatggaatttatgcttatgacacagtttgggcagttgcacgtgcaattgatatattcatcaaagtacataataatattaccttctcgcttcctgataactataacttatctcatacggtaggaattggtattctgcttgacaagctcaaaatctttgctggtggatctgatcttgtcgacatattgttacaatcaaattttactggtgtgagtggccaacttcattttaattctgacagaagtattgtaagtggtggttatgatattatcaatgtcaatcagatgggaatttctggtgttggtttttggtctaataattcaggattttcagttgtaccccctacagctcttaaaaaaagaaaatataacaggttttcccaagatcagaagctcggcaaagtgatttggccaggtggagtgacagatcaacctcgtggctgggtaattgctgataataccaagccactgagaattggagtgccaaaaagagcaagttttgttgaattcgtaactgaactgccagatagtcatcaaattcaggggtactgcatcgatgtcttcaaaaaagccctagaatttatcccatatgaagttccttttgtattcaagccttttgggaatggcaaagaaaatcccaattatgacgcacttgtgaaaatggttgatgaaaatgtatatgatgcagttgttggagacattgcaattgtgacaaatcgtacaatgattgtggatttttctcagccttttgcatcctctagccttgtcatagtagctcctatcaacaaagcaagatcaaatgcttgggtgttcctccaaccatttacggcagatatgtggtgtgctactgctgcatcatttttggtggttggagttgttatatggattcttgagcaccgagtcaataatgacttccgtggtcctcctaagaagcaacttttgacaatgttaatgtaa

SEQ ID NO: 862 - DNA, 96 bp, Glycine max
  Peptide Sequence Number=SeqID_92547
atggagattttgaagaatgaccccgtttctgcggcaccaagcccaataactgaaggactgtggggcaaatggacctcactcagttcacgggtctag

SEQ ID NO: 863 - DNA, 1095 bp, Glycine max
  Peptide Sequence Number=SeqID_92548
atgggtgatcatgaagaggtgagaagcttggttgtggaagaggaaatgagggtggtggaaagcaaagaatggtacttggtatcttatgctccacacggtgttccaaccaccgatcatctgaaactccgcaaagttcgtctatcgattgcacctgaatcaatccctgatggccatgttgccattgagatgctgcttttctctatagatccatatcttcgcggaagattaaatggaaccttagatggcctttattttccgcagtttgaactcaatcaggtgatcacaatatatgggattggaagagtaaagcgatcaaatgacagtgaatacaaagagggagatatcgttttgagcgcaaattttcctgctgctgagtattgtgtgatgccttcctgtgagatcgttagaaaaattgatgctgcctgtgggatttcattgccggattatctaagcactctaggagtgcctgggtttgcagcatggttggggatagaggttctggcagaccccaaacctggctcaaatgtgtttatatctgcagcttccggtggtgtaggaatgattgctggtcaattggctaagatcagagattgtagggtcatcggaagcactggatctgatgaaaaagtgaggctaatcaaagaggaatttgggtatgatgatggattcaactacaaaaacgaagaggaccttgatgcagttctaagcaagttctttcctaatggtattgatgtttactttgacaatgttggcgggaagatgcttgaatctgtactgaatcatgtcaacaggtatgccaggataccactttgcgggatgatatctcaatataaccaggcttggacagaaagagaaggagtcaggaatcttctgaatatggtgggcaaggaagtaaggatggaaggttttttgctgaatacacatttcgatcgttttggagagtttgcaaaagagatggagggccacataaaagaagggaggcttaagcccaagactaaaataaacattggaattgagagctttttggatagtctgaactccttattttctagcactaatattggaaaagtagttgttcaagttaataaggattaa

SEQ ID NO: 864 - DNA, 660 bp, Glycine max
  Peptide Sequence Number=SeqID_92549
atggctaagtttgaccctgaggtagtcctggagttttatgctaatgcttggcccacagaggagggagtgcgagacatgcgttcatgggtgaggagtcagtggattccctttgacgcaaaggccctcagccagttcctgggtgacctgctagtgttggggaaggcgaggagtgtgagttcagtcagaggaggaatagggccgacgggttcgacaaggaggccattgcccagctattatgcacaccggggcaggattttgcccggaccgctgcagggaggcggcgatcataactctgatctccttctgctgaagtgtcagttggtgtatgccatcctgacacggatgagcgtccacgtggcccaggtgattgctgacgccatctatttgtttgcaggtatgccacccaccaggcaccctctagacccggataagtctaacagggccctagggttttcggcattgatcacgggcctctgcctttcattcggggttcccgtcacccctagtaaggtgatccgactaccgatcacccgggccttcatcgagaagtattgcacgcctaggcaagtgcagggtgatgcacctcaggccacaggcgcaccgccaccacctcatcaggccgatcccgctggatcactaggcatggagtgttatctatag

SEQ ID NO: 865 - DNA, 204 bp, Glycine max
  Peptide Sequence Number=SeqID_92550
atgcgaagggtatttctcttagctccgaaatgtctttttgcaattcacaatggtgagaatgctcggaattgggttgcgaatatggtgctcaaatttcacgacgatccaacggagtccgagatcgtcgtttttctgagacagatttggtgggctgcgggaaaaagaaagagtttttgggaaaaaggaaagggaaaacgaaattga

SEQ ID NO: 866 - DNA, 570 bp, Glycine max
  Peptide Sequence Number=SeqID_92551
atggatgaattggcacaatgctacaatgtgctcccccaacttgatattaataacactatagaccaccgccccgaaggggacgaaaaatggtttttagagaacgagaagacggttacgcagttttgccgcaagctggctgctgaacgccctcttaaggatattcgcgatgagtataattaccccaaaaagaaaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 867 - DNA, 213 bp, Glycine max
  Peptide Sequence Number=SeqID_92552
atgcgtatttacgccgccgagatgggccaccgcatgccgctgcgccacgagatccaccagctgatcctggcgggctaccgcgagcacggcatcacgctgccgtacccgccgttccaggtgcgcaccgagacgctgtcgcggctgaccaacaacggccgtacgccgccgtccacgccggcgccgaacaccaagcgcgacgccggggggctgtaa

SEQ ID NO: 868 - DNA, 366 bp, Glycine max
  Peptide Sequence Number=SeqID_92553
atggcggcgcgtttcaacaaattggcaatgggtgcgctcggctgccagcttgccgtttcgctcatggtgatgactccttatacagacaaggggaggaagtctacccgtattgctgacggcaaacaacggcaccgccgtcgcggcaggcagtttcagaaatcacaggtgctggcaggacaacaggaggaagagaaagccggtacgaaagcaggtttcgcaccggttttagttactgcgcgctgcgctgaattgcctgaccgcctgcttcaacatcttcgcctacgccacgcgtggtgttacaggctgaaagcagcgaggaaagcaccagtaccgagaaaatcgcgacaatacttttctttaacatag

SEQ ID NO: 869 - DNA, 615 bp, Glycine max
  Peptide Sequence Number=SeqID_92554
atgatccgtcagcagatcgaagaagcgacgtctgactacgacaaagagaaactgcaggagcgcgttgcaaaactggcaggcggtgtagccgtactgaaagtaggcgcagcgactgaagttgaaatgaaagagaagaaagcacgcgttgaagatgccctgcacgctacccgtgctgcggttgaagaagccgcggttgccggtggtggtgttgcgctggtgcgtgttgcggcgaaaatcgcagcatctggcctgaaaggtcagaacgaagaccagaacgtcggtatcaaggttgctctgcgtgcgatggaagcgccactgcgtcagatcgtttctaacgccggtgaagagccatctgtggttgctaacaacgtgaaagcgggcgacggtaactacggttacaacgcgcagaccgaagagtacggcaacatgatcgacttcggtatcctggatccaaccaaagtgacccgttctgcgctgcagtacgcgtcttctgtggccggtctgatgatcaccaccgaagcgatggtcaccgacctgccgaaaggcgacgcacctgacttaggtgctggcgctggcggcatgggtggcatgggcggtatgggcggcatgatgtaa

SEQ ID NO: 870 - DNA, 243 bp, Glycine max
  Peptide Sequence Number=SeqID_92555
atgaagaacgtcgaagaacagttgaaacctttgcgaaattcttcacggaaaacgttacggaaacgtttcggaagtgatgaggacatgaccaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttagtgtttag

SEQ ID NO: 871 - DNA, 195 bp, Glycine max
  Peptide Sequence Number=SeqID_92556
atgcgtggagtcgccaccaacatttattcgaggaaaatgtcagaaaaaccaaaatggaaaagtcgaaggtctgcgtattttgaaaatgagggttcgggagttgtttacacatggggaaggcatgcaatgactgaagacattgtcgtctttgaaatgcaaatgatggtcattgtcacctttgaaggcaggcaatga

SEQ ID NO: 872 - DNA, 240 bp, Glycine max
  Peptide Sequence Number=SeqID_92557
atgcaatgtggtatcatatcagtgaaaaacctcgtcgaacgcctaggagtacataacaacacaaaccacacattagcaagtcaattagggtcacagtgttttgcgagaatgctccaaccatatggaatcaacataggcttaaatgagcactcaaaccgtgtgacccccaaggcctacactccgaagagtccatcagggcctctccttcctgattcaggtccaacccagaaaacattctag

SEQ ID NO: 873 - DNA, 432 bp, Glycine max
  Peptide Sequence Number=SeqID_92558
atgaagaaaatgataagaagaagaagggaattgctcttaaagtatcatcttcaatccaagaagaaagtgatatggaagattcaattgacttggatgatgatgaaaaacttagtctttgtcaaaagattcaacaaatttcttaggatgagagaaactcaaagaagacaaaacttcaaacctaaaagaaggattgaggaatcatctcaaactccaagatgctatgagtgcaatcaactcggacatctgagggtttattgtccaatctttaagaaaagaatggagaaattcgaaaacaagaacattggagaaaagaaggcaaagaaggcctacatcacatgggatgataacgacttagaatcgtctgatgattctgaaaaagaagtgattaatctatgtctaatgggcaaaaactatgaaagtgacgaagagtga

SEQ ID NO: 874 - DNA, 300 bp, Glycine max
  Peptide Sequence Number=SeqID_92559
cagaattttgcacaagtgcagaaaaatgctatgcatttgctggttgtggaaagagcagtgcaggatgagttctggcttggcaggattgatggggacccgatgttgagagaaacgaggatatgggctacgtgggagtacgtgagctcagttggaggtgggcaacaggggatgagtggtaccgggagatatgtcgcatgggtcaggagaccttggggacgtcaggcgagctcctggcagtcaacagataaaaggaacaaagtccacaaagcaaggaggcttgtggtggctggccagctgtga

SEQ ID NO: 875 - DNA, 354 bp, Glycine max
  Peptide Sequence Number=SeqID_92560
atgcccggggaaaatgacagcgctgacgattctctggatatcacccttgtcgccttgttccagaaacaaacatggtatccttctggtatttcgctaaccccacagtgcaacccattacatgaaccgaccagatgggatggattcgaggcagacattttttatcaattgaaggtgttccaaatcgtccttcgcagcagatttgcaaagaggagtgacgaccatggtttcttctctggtcgcatgtttctgtggctttcagcgaagcgcctaaacactctgaatccaaattctgtacctatcaagacatggagcttcgtgaacagtgcatatatatatatgtcccaatgtttctag

SEQ ID NO: 876 - DNA, 405 bp, Glycine max
  Peptide Sequence Number=SeqID_92561
atgtcttcacttggaggctcctcaaggacaggctccccactaagggaggaagtaggtcatctcctctttaattgtaaaaggacaataggcctgtggtgggaatccatgagatggattcaggctgtaggacctcttccagcttccccagcaagccattttgcccaattttgtgatgggtttggtgcagacataaatcatagcagatggtgtgggtggtgggttgctctaactagtgctatatggcagcataggaacctcctgatctttcaaggaaatccttttgattcctctaaagtcatggaaaaggctatgtttctagtttggtcttggctaaaagctagagacaaaggcttcaacactagttttaaccaccggtcttccaacatatcggactcctttggttaa

SEQ ID NO: 877 - DNA, 914 bp, Glycine max
  Peptide Sequence Number=SeqID_92562
cagctgactcagtagatcagggaccagctagaggaggccatcacagagaaagtgacgaggcaggtcatggcatcttcaaccagcttcagtcacagatgcaatctcagggatctcttgagcctctggttggtcctggaaacgatcctgagacgggtgactctgacaggtgcggcttgtacatagaagcagatcctgcccgcctggttgccgtggggagagtttatgagggatccactcttgttcataacactcctttgtttcctggccaagtaaaggtgagtgtggacgaggttaaagatgcagatgcttcagttcctgtacccactgatgaggtttccttagtggggcaggcacttcacaccttccttgcttggctgacacatctggtcaagtctttatcacaccaggtacttattgtccttactatatctgtgtctccaccaaaaccacctctgaagcccgatccagaggtcgatgatccgctttatctgatgacattgaccatcccagagcttttcttgaggccttatcaggttagatgggatgccaccgtgttcggggttgttaatccagatttccccctgtacataaagcacaaagacctttccgaaatcgcacacggtggtcaatgtctcagcatatcagtgttacagttgtggattctgcatctcactgaaacatgtatgcgagcggggaattatgatatctatggattcctcgagcctcagtccattcggagcggacattggcggatggtggtcatcctgcccaaggaacacttagttgtctggttttgttcattgcataataagccagacaactaccttaaggggattattaatagtgctatcaagggtcttgatgatgctccacagcctaaatcaaaggctcctgctaggtggattgtcgtcaag

SEQ ID NO: 878 - DNA, 156 bp, Glycine max
  Peptide Sequence Number=SeqID_92563
atggaccctaagagaataaaggtcattcctgagtggcccactccaccatgtgttgaggaaagaatccctgagtttcaagaacctatggatttgaggtcaaatccttttcaagggggagggaatgatgcaatcctaccccccaagagcattggatag

SEQ ID NO: 879 - DNA, 804 bp, Glycine max
  Peptide Sequence Number=SeqID_92564
gtcttggcaagccgttggttgaaattttgccccccggtcaacttcgtggttttgcccgttgttggcttggctagggtcggcggtgctgggttaaggccccgtgctaagtttcggattggttggccccctcctcccccccgtgatcagttttgttgccaggattttgccaactttgggcttgcgccccgttggctaagtctgtgcctcggtggtggatcatcatgtcataacatggcaaagacacaaggtcacacgcacacacacacacacacactcacgcaggcacaagggggaggaggggcttggtcgtccgtccgcccgggcacacacctagttagcaccaggcaggcaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 880 - DNA, 175 bp, Glycine max
  Peptide Sequence Number=SeqID_92565
ccctctgatggtgaggacgtgtagtcctctcaaggcgaggacgtgtagtcctctgacggtgaggtcctctcatggtgataggtacaagtacccaagggtccacccttatgagaaagcaagagatcgactcatcgagagggctggtcatcccaaatccacaagatttggacattag

SEQ ID NO: 881 - DNA, 522 bp, Glycine max
  Peptide Sequence Number=SeqID_92566
atggataatgaagagggcatgcaagaacagatgaaggccgacctatcggccttaaaagatcaaatggcttttatcatggaggccatgctaaaacttcagaaaactatagaagataatgtcacggcggctgcctccaatacagctagggaaatggaaccggtgctacagcccgcaataaacttgggccgaaacatgacggtgttaggtcggaggtatagtcctcaagcctacccttatggtttgcctccggacttcactccccgtaccgctccggatgatttgagccaagcccctaccttcgaggggcaactccctccttatgtcgactatcccctgcaagaagatgatgaaggagatgcccatctaggccctctgcttcccctcaaagatccgaccccccatgaattgccccaaccaaacatagtccgccatgtcccgtcttcacccgcacccgtaaaagaatctgttccctttgcaaaagataagggaaagattgattcacttgaagagaggctaagagcg

SEQ ID NO: 882 - DNA, 732 bp, Glycine max
  Peptide Sequence Number=SeqID_92567
atgaattgtaatttttgtggaggagagcattacaatgacaactgtcatttctactccatgaaaaactcttggtggggacaggagttatacccttacaatcaatatgaagaagaaagaactcctaatcttgagagtgtgtttacggaattcatggcataccatgctagctctaaacctaatcaaaactcaatgcaaaatcaggaaattcatgttggcaagagctactccatggaaaattgtcagtgggagcaagagttacaaccctacaatcaatataaagaagaaagaatgtctaatcttgataatttgttgatgcaattcaaggaatcatttgaatctactcaacaagcatttaaaagtctagaaattcaagttggtaagctagcaaaagaagtggctaaatatgtggccacaagggaagaaaactttttagaggttgaagctcatgaggaaagccttatagaagagcatgattcaagagaaaaagacaaagaaaaaagtgaggagaaagcacaacaatgggagaagtgcttacaagtagaaattcacaagaaagaagaaaggcatggagaacatgagaaagccttaagtgtcattctttccttgatcactagcacttctcttgcaatgatttggaaggtgtttctggaatacatgagtttcatggagtctctagctaagaggcaaaaatgcaaggaagatgtgttttatgtgaccttcatgccaccttga

SEQ ID NO: 883 - DNA, 420 bp, Glycine max
  Peptide Sequence Number=SeqID_92568
atgaatgtcagcaaatatctgatcctacagtcaagtatggccttgatccagaaacatgggcggaatttgcaaaaagccgcaaaacccctaattgtacaagcttgtctttttaagggtatacgaaagaaggcccaagaaattcaaaaatttaatgactgcccacacgtactgtctcgtggggggtatgaactgcttgacaagaaacttatggaggagaagagcaagcgtggacatgaggaacattcgtgtactgaaagcccaacactcaacgtcgacccaccatccccagttgcaagacacttgaagtggaagatcgcccgcacaaagcggcatggccaaatgacgtctgaagtggcacaagaaattgcagacaaaatttgtgagttcatatgttttttggttactgtcattgccaaataa

SEQ ID NO: 884 - DNA, 177 bp, Glycine max
  Peptide Sequence Number=SeqID_92569
atggcatatcaacttgctactcaagaaaaattacagtacattagaaatatagcccaaaaggaattgcctcagtttaaagcatcatcctcaattcaagaagaaagtgatcaggaaaatgatccagatgatgatgatgatctaagtctttttgtaaaaagattcaacaagtttcttaaa

SEQ ID NO: 885 - DNA, 1191 bp, Glycine max
  Peptide Sequence Number=SeqID_92570
atggccccgaggaagcttgcctcaaagaggtccaggaaggacaaggcagccgaaggaactagttccgctccggagtatgatagtcaccgctttaggagtgctgtacaccagcagcgcttcgaggccatcaagggatggtcgtttctccgggagcgacgcgtccagctcagggacgacgagtatactgatttccaggaggaaatagggcgccggcggtgggcatcactggttactcccatggccaagtttgatccagaaatagtccttgagttttatgccaatgcttggccaacagaggagggcgtgcgtgacatgagatcctgggtaaggggtcagtggatcccgtttgatgccgacgctatcggccaactcctaggatatccgttggtgttggaagagggccaggaatgtgagtatggccagaggaggaaccggtctgacgggttcgatgaggaggccatcgcccagctgctatgtataccgggacagggttttgcccggactgctgcagggaggcaagtgcgaatcatgcgcaccaacatgaccaccctgacccagatatggatgacgttgctgctcagcaacatcctgcccaccgatcataattccgacctccccatgccgaagtgtcagctggtgtacgccatcctaacacggatgagtattgacgtggctcagttgatcgctgatgccatttatctatttgcaggtatggcgccgaccaggcaccctatggacccagataagtccaaccgggccctgggatttcccacactgatcacaggactctgccagtcgttcggagtccccgtggcacctaccaaggtgattcggccgcccatcacccgggcttttattgagaagtactgcacccagagacaggctcagggtgatgctccacaggccgcaggcgcaccaccaccacctcatcaggctggctcggttgggtcatttgacatggagcagtatttacggcatttgctgagcctcagcatgcagagccagggcttcgcttctttttcatgccctactccagaccagttcagggcagaggtcgcatggcccggggattggcccgaggcccaagcaggagaggcacccccagaggttcccgacgatggagaggaggcccacgaggacgaggagatggccgatttgcttgacttcttgggagggagtggagctacatga

SEQ ID NO: 886 - DNA, 234 bp, Glycine max
  Peptide Sequence Number=SeqID_92571
atgcagaattcaaaacgggatgtgtacctaggagcctacctgaatgggccagacaactacctcaaaggaataattaacagtgctttgaaaggacttgacgatactccacaaagtaaatccaaggctgctgctaggtggattattgttaaatatttcaatgatgctagaccattggaaccagagagattgaaggcactttgtaattgtagtttactttacattttttacaaatga

SEQ ID NO: 887 - DNA, 165 bp, Glycine max
  Peptide Sequence Number=SeqID_92572
atgtgctcagatgctttaggctcttcgctatacgaaggtatgggggagggatattgtacgcagccttacccttgcatatgcaaagaggctgtttccggattcgaacccatgaccaacaagtcaccaaggcacaactttaccgctgcaccagggctcgccctctaa

SEQ ID NO: 888 - DNA, 318 bp, Glycine max
  Peptide Sequence Number=SeqID_92573
atgtctcttgccactctttttggaaaacttcaagaacatgaaatggaacttatgagactccatcaacacgaagagaatgatataaagagaaaaggaatagcagtcagtgcctcatcatcttctattcaagaagaaagtgacaaagaggacttgactggaatagaagaagatgatgatttcagattctttatgaagaggttcaataaatttctggaaaacaaaagaaataaaagggaatcaaacatcaatccaaagaagaaagaaaaagattcctcgttagccccaaaattctatgaaagcgatcaacctgggccatga

SEQ ID NO: 889 - DNA, 1348 bp, Glycine max
  Peptide Sequence Number=SeqID_92574
atggcccaggacaaggcgaccaacctggacaagatcaccgtcaccggttcgctgatcccgcagacccaggttgaaacccagaccccggtgatgtccatcaccgccgaagacatccagacccgcggcttcagcagtgttgctgaagtgctgcagcagtcgtcgctgaccactggcggcctgcagggcggccagacctcgggttcgttcacccagggcgccgaagccgccggcatgttcggcctgaatccgggctacaccaagtacctgatcaacggccgcccgatgctctcgtatccggcgctgtacaacggcagcgaaaccttcaacaacatcagcggcattccgatcgacatcgtcgagcgcatcgaagtgctgccgggcggccagtcctcgctgtacggctcggacgcgatcgccggtgtggtcaacatcatcctgaaggagcgcatggacggcggcaccatgaccctccgtggcggcacctacaccgaaggcggcggcagcaacatccgcttcagcgctgccaagggcatcaacgccttcgacgaccgcttccacgcgctgttcaacgtgcagatcgagaacggcagcccgatctggggctaccagcgcgacatcacccgccagaacaacccggtcggctacaccgcccaggttccgtcgaacgacttcgccgtcatcaccaacgctgacaacaagctgctgatgatggacccgagccgttgcgccaacgtcgccgggctgtatgacggcaccaccgtggtcggccagcgcgcgtcgggcgagtcctgcggttcggtgtacagcgccggctacaagaccctgaagaacggcaagaacagcggccagttctactcgtcgatgaccttcgacgtgaacgacaacttccagctgttcgccgacgtgctgtacagcaaggaaaagaccgagttcacctccggctcgagcgccctgtggtggggcaccaagtcgagcctgggcagcttctacgatcagggcctgggcaaggtcgtgaacctgcagcgcgccttcgcgccggaagaaatcggcccgggccactacaacaacatcatgaactccgacgaaagccgtgcctaccaggtcaccctgggcggcaagggcatggtcggcgactgggactacagcgccagcttcacccgtggtgagtaccgcctggaccagaaccgcttcgtgcgctggaaagacaagatcgatggcttcttcgtcgacaacgtgctgggcacctcgctgggcaccaccgctgatggcttcgacatctacaacccggactacgcggccttctactcgccgatcaccccggaccagttcgccagcttcaccggctacg

SEQ ID NO: 890 - DNA, 171 bp, Glycine max
  Peptide Sequence Number=SeqID_92575
atgggaatcagaggcaagtatcaggagttaggcatggcaatggggagtcgagggcaggggcgaggactatccatggaggaagagtttggtttaggtgggctcgaaacatggatggaccaatcacttgagcaagaagtaagagaattcaagaagagcttgacaagagactaa

SEQ ID NO: 891 - DNA, 378 bp, Glycine max
  Peptide Sequence Number=SeqID_92576
atgtcattgcctagcgctgttcatgtgttctccattatcaagcgcgaagcctctggtgactgggaaacacgttattctgttgttttccagatcggttccttcgccaagtataagaaaaaagaaggagtagagacaagagtcgtcatcacggaaagggtaagtaaagaggggcaactgtcataccctaatttcgtccggggattattatttgatgatatacaacctttgattggccgcttcgagacacttggcgtccttggttgcacaatgaatgaagtcccgagacgtgtcagaaatcaaaaggaatcaagagttaagcaaattcaaaagattcaagaatcaagattcaagattcaaagaatcaagattcaagaataa

SEQ ID NO: 892 - DNA, 123 bp, Glycine max
  Peptide Sequence Number=SeqID_92577
atggcgtttatggtactctccagagctcctcctccggttgctctgttagggttcttgagagtcagagaaaaaagaacagaaatgcttttacaaagctgctcgtggtttaagttcctttatata

SEQ ID NO: 893 - DNA, 439 bp, Glycine max
  Peptide Sequence Number=SeqID_92578
ggctcaccctggacaggcggtggaaactaccaagctggagtacgagacgaaagctaggggagcgaatgggattagataccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccactgccggtgataagccggaggaaggtgaggatgacgtcaagtcatcatgccccttatgccctgggcgacacacgtgctacaatggacgggacaaaggatcgcgatcccgcgagggtgagctaactccaaaaacccgtcctcagttcggattgtag

SEQ ID NO: 894 - DNA, 237 bp, Glycine max
  Peptide Sequence Number=SeqID_92579
atgtgtgctcatcatggaggagccccggggcattccattgagcattgtatgaccctgaagcgtaaggatttccaagtttatgccattattgtaaaccccagttacaatgctaaaatggaggaatttgacatccctgtttttttcatcctttcacatacacatcttggattattcaactttcacgggaatgggggtgcaagccatcggtctgtttgctcaagtgacctgcgctcttga

SEQ ID NO: 895 - DNA, 479 bp, Glycine max
  Peptide Sequence Number=SeqID_92580
tccatttggctagaagcttataagaacaaaattgccttaatcatttccaaatatgcatgcgaattaggacgcatcaacaagaatcaagccaaggctattgtttcatatgaggtggacccttgggtactagtacctatcacctttagaggactgtatgtcctcgccatcagaggactgcacatcctcgcctgcagagggctgcacgccctcgcctttagaaggctacgcgtcctcgttttcatccctgggccaccccctgatattggagggcgaccaactgtgcgagcacatccagagaggaaggctatcacgcgtttactatgcataccggggcaagatttcacccgtgtcgctgcaaaaagacgagtttggatcatgcgcaccaacatgacaacttttacatggatatggatgacgttgctatttagtaacattctgcccagcgaccacaatgccaatctccccctgcagatgtaccg

SEQ ID NO: 896 - DNA, 411 bp, Glycine max
  Peptide Sequence Number=SeqID_92581
atgcgagcagggaattctgatctgtatggattcctcgagccacgttccattcagaggtctgggcaatcgcagtttgagactgaaagttacataaagagttggatgcagagttcaaaatgcgatgtccaccttggagcctacctaaatgccggacactggcagatggtggtcatcgtgcccaaggaacacctagttgtctggttttgttcattgcataacaggccatacaactaccttaaggggataattaacagtgctttaaaaggtcttgatgatgctccacaacctaaatcaaaggctccaactaggtggattgttgtcaagtgtaatagacaaaaaggaaccagctattatgtcatgcactggatgaccaccatcattttaggaagtttcaggaataactgggaagca

SEQ ID NO: 897 - DNA, 710 bp, Glycine max
  Peptide Sequence Number=SeqID_92582
gtccgcaaggcatgggaggtggtacaaaaggaggacaaagagttcagaggcagtaacaatgggcccattggtggctaccatgagtggttgaaagcccacgtgcaagctttggattggctcccaagtctgagaaccgctaaaagggaggaagttgaggcaccgaaggaagacgaagaggtggctcgtagggaagaacatggctggaacaagttccgaggggctctgtggggcagtaacagcgagcttaagctctggaaggaggaaagggaccaatcgcgagaagacaatttgatcttgaaggatgagttgaaggcttgctttaggtccaagaaaagtttgtctcagcggttatgcgagacaaagaccaacatgttagccatcatcagcaagtaccaagaagaactaaatctagccacgacccacgagcatagagtggcagacgagtatgcccaagtgtacgcggaaaaggaggctagaggaagggtgatcgactcgctacatcaagaggcaacgatgtggatggaccgattcgctcttaccttgaatgggagtcaagagattccccaattactagccaaggctaaagcgatggcagacacctactccgcccccgcattgtatgttggtctcgtcctttgtcacgggaagccggaaggtccatatcaccttcttaactgtacacatggagcactgcgcccccaaatgcgcaa

SEQ ID NO: 898 - DNA, 518 bp, Glycine max
  Peptide Sequence Number=SeqID_92583
ggtacatcctttgtggtacaagtagagtgtacatctacttgggttgtaatactgagaacaagagagggtacatctcttgtggattagttcaagtggagggtatatccacttggttgttcaaagagaacaagggagggtacatcccttgtggatctttacttgtaaaggattttacaaggttattggaaatctcaagaaccagtggttgcttggggactggactctttcatattgcaaggtgcgaaagtgcaaaggaaatatggaaaatgcttgaagtcactcaagaaggcattgcagttgtaagaagagcaagaaagaacactcttgtatctgaatatgtagctttccaaatgaagaatggagaaaccatttatgaacttcaaacaagattcacccacattgtgaatcaccttcttggtcttggaaaaacgtatgaagatggtgagttgaacatcaaaatcctcaattgtcttacaagaacttgggaatcaaagatcgcaacgattaaggtgatgtag

SEQ ID NO: 899 - DNA, 353 bp, Glycine max
  Peptide Sequence Number=SeqID_92584
atggacgaagatcaatggaggtatgactttgcgatgtcaccagaagttcatatggattatgattatgataatcaagaagaatgtggagtgaatgaaccacatgtcgattgttcaaatgcttttaatacatctcaggtattcgctactcgagatgatgttttgcaatgggctcgaacagttacccatgaaaatggatttgttgcagtggttatgagatctgacacagagaccggtagcagaggaagaagttcatttgtgttaattgggtgtgaaaggagtggtatgtacaagtgtagaaataaagaattcgttagaaaagacaccgggagtaggaaatgtggttgtcccttcag

SEQ ID NO: 900 - DNA, 984 bp, Glycine max
  Peptide Sequence Number=SeqID_92585
atgcataaattcactaaagcactggcggccgcaggcctcgccgcgcttatgtcacaatccgctatcgccgagaccatgaagctcggttttctcgtcaaacagccggaggaaccctggttccagaccgagtggaaattcgccgataaggccggcaaagatctcggctttgaagtgatcaaaattgccgtgccggacggtgaaaaaaccctgaacgctatcgatagcctggcggcgagcggcgccaaaggctttgtcatctgtaccccggatcccaagctgggctcggccatcgtcgccaaagcacgcagctatgacctgaaagtgattgccgtggacgaccagtttgtcaccgccaaaggcaagccaatggataccgtaccgctggtgatgatggcggcgaccaaaatcggcgagcgtcagggccaggagctgtacaaagagatgcagaagcgcggctgggatgtgaagcaaaccgccgtcatggcgattaccgctaacgaactggacaccgcgcgccgccgcaccggtggttcgatggccgcgctgaaagccgccggcttcccggagaagcagatttatcaggtgccgaccaaatccaacgatatcccgggcgcgtttgacgccggtaactcgctgctggtgcagcatccggaagtgaagcactggctgattgtcggcatgaacgacaacaccgtgctgggcggcgtgcgcgccaccgaaggccagggcttcaaggcaccggacgtgatcggtatcggcatcaacggcgtggatgcggtaagcgagctgtcgaagggcgcgccaaccggcttctacggttccctgctgccaagcccggacgtgcacggctacaagagcagcgaaatgctctacaactgggtgaccaaaggacaggagccagcgaaattcaccgaagtgaccgacgtggtgctgatcacccgcgacaatttcaaaaccgagctggcgaagaaagggctgatgtaa

SEQ ID NO: 901 - DNA, 165 bp, Glycine max
  Peptide Sequence Number=SeqID_92586
atgggtgcaagggatgaatcaatcatgcacaagggaaataaaaatcctgatcctgtcaatgatcctgtgcatgctcattcaggtccagtgctggtgcagatgatggatcctgtgaaagaggcaggtccgaaactagtgcagatggctcaggttgaggagatatag

SEQ ID NO: 902 - DNA, 153 bp, Glycine max
  Peptide Sequence Number=SeqID_92587
atggcagcagaatggagaagaagaagagttgagaggagacgccacttcaaggagaagatgagtcaagaagaagctcaccaccataggaagccatggataagagcttggagatcaaatccaagattctccactgagtatgcttatgtggcatga

SEQ ID NO: 903 - DNA, 120 bp, Glycine max
  Peptide Sequence Number=SeqID_92588
atgtcttcccatagcgatagcgtcatctctaacggtttgatggcctacgggaaaaagataaagttttgggaggagaaggggaaaaacgaaaatgaggccaaaaagaggcacctgacttaa

SEQ ID NO: 904 - DNA, 1140 bp, Glycine max
  Peptide Sequence Number=SeqID_92589
atggcttccactagctctgtcactccatcaaaggcaagggctcccattttttcaaacctcctactctccattgagaagttggacggctccaactactctaataggacttctgaagtcaccttatggattagtaggttggggtacaaatctcacctcactagtacaattgattccatactcgcggttgaccgtgcacaatgggcgaagattgatgccaacctatgcagtgttattaagtccaccctccacccctcccttaaatcgattttcctaccccatatcatttgcaaatcggtttggactgaggcgcgtgctctttacacaaacgatactcaacagctatatggactcttacctcttgctgcctctattccaattgaggccaagaaggaactagagaaatgcagtgctttctttatgactctagctctttatggtatgcctccagagtattctgctacacaagaccaaattcatgggtcacctgtcgccccaatgatggcatccacttgttctacactgcttaggattccaccgaagcctactaccaacatccccactcctatgatgggggacacatctacccttgcttcccagagcaataattttggatgctctcgaacaaggtcatctaactctgagttgtcacaactacatggtaaaccaccgcaccctgccaatgtagctcagacaactctgctcattccactcatcccacttatcagcctcacagtactccagctacctatgaggactttctctagtagtgtacgtctccaattcgcccctttttctcatagtgaccccaccactagcacgtcaactgatctacaaagaggtgttgagattttgcctcctgctgcatccattcctgctaaggctaagaaagaatctgagaataggagtgcattctttatgaccttggccttttatggcctaccaacaaaatattctgttattcatgagcagattcttagttctcccgcagtgcctatgatgacttttgcctcctctccactacttcaaatttcatccaagctgcacagtaaacctcttcatcctgccaatgtggcccggacacctgtggtagagccaacagagccagttgatcatcctcgtgctacaccggctgcatgttag

SEQ ID NO: 905 - DNA, 411 bp, Glycine max
  Peptide Sequence Number=SeqID_92590
atggatttcaaataccttagtgagtacgacactatggtagatatccttcccaatgctcttgttcttcatcacttcggtagcaaagcagttgaagagaatctggggcaccaacattttggggtcttcaaagaagtgatggatgccatacaacaggagatgggcattgatgacatagccaatgctttccagagagttgatgttgaagaaatgctcgacatgaactcttggttccttgtctttcattgtgacttcggtagcgagaatagtcataggtgtaggcctagtaatctgaacaagggaaccttcctcagatggagggagaggttagggtgcaaagaggtttctgagagagagagtgtgaagaggttgcataagggtgaagagagagaaagagatcatgtgggaagttga

SEQ ID NO: 906 - DNA, 165 bp, Glycine max
  Peptide Sequence Number=SeqID_92591
atggaggagaaggtaaatctgaaaattaatagaggtttaaggagcaccaacttgaagctcttgtgctctgataaccacttgatggaagcttgcttgagaagcttctatgaaggagatgcagtggaggataaaggagaagaggtgagagaaggcaccatccactag

SEQ ID NO: 907 - DNA, 198 bp, Glycine max
  Peptide Sequence Number=SeqID_92592
atggaggtcatttacctaagcttgatggaagaagtactcaagaacacttgggaacatgtctatggaactctcacaagtttacataaactttcgagtttgataaccttgcttgggaaagcttggaagaggggtagaaatggtgtctccatccctcttgaccagctcgtgaagaagaggaagaatgagcatgaatggtga

SEQ ID NO: 908 - DNA, 177 bp, Glycine max
  Peptide Sequence Number=SeqID_92593
atggagatgaagagacgcgagagcataggagctgagatggagaggaagagctgcttgacaccaactgccgcgcaatccaataggtttttcgatgtttcggaaaagaatgtggaaagtaaccaaaagggagggcaaaagggtcatttggaagcttttgctgacccctggctcgcctag

SEQ ID NO: 909 - DNA, 327 bp, Glycine max
  Peptide Sequence Number=SeqID_92594
atgggggatacatatgaagtaccccgagaccacactctagccgacttcgagcctcacctcagatatgccactgaggggcaggcattttgtggcatacccttgccaaacactttgggggggcctcagtatcgcccacaaccacaacccttgcattttgcagtggaaaggctaagggtcattgaaagaggcagaaattatgcctttgctgacatggcaaaattgtgcctagtgcccgacatcgtcatacctccgaagttcaaggtgtcggattttgacaagtacaaggggactacttgcccccaagaatcacctaaagatgtactataa

SEQ ID NO: 910 - DNA, 1043 bp, Glycine max
  Peptide Sequence Number=SeqID_92595
atgtcaaagaagacaagaaaatcaacatggctcacatcattggctactagactagttggggcggagagacctgtagttcatgtggatcctgccactgggaaagtcgatggtccctacaaaagagaatggtggaagccatttaagttagatttcacctccaaatgggctttggaagacggcaaggagggcgagtatgataaagtatgtcaaaagtatgacataagaaaagagaagtggaaccaattttgtcagagccgtagagaaccttcatgggaggcacatgccattcaaaaacaaaacactaccccttacgtgttgtctcgtgggggttatgattttctagaagaaaagttgatggaggacaagaaaaagaaacgattggaggaagcaactcaatccaagagcactaacacaatccttgatcttgcatttcctattagacgatacgtgaagtggaagatgacccgcatgaaaaaatctagtcatatgacgtctgagcaccctgatcatgtccgtgctgttggagttggtgtcacgatcaaacaatacattggatcggcttcaaggagctcccacactcgtagatgcaatcacagggactcgcacaacctcctgcctcctaagcctgaggttggtacttttgctgctcgtgtcagcacaaaggaaagttgtttcaatccctcggggaaggacccagatacggatgactcaaagaaatgtgggttgtatgtcgatgagagtcctccctgcctggttggccttggaagagtttatgagggatcgatgaccatccataacgtccctttgggaaatgatcaagtgaagcatgaaaaacatgatttccctctctcctcctctccaaaagccaccaaaaccctaacacctccttctccaccacccacgaccaccgatggccaccatgagccgccgttgcttgccgccgaacccccacaccaagagaaacattgtaatcaaagtggaatcctcctcaaggattcagtggagaaaactcccttaacccttccttatgtagcttctatgag

SEQ ID NO: 911 - DNA, 342 bp, Glycine max
  Peptide Sequence Number=SeqID_92596
atgaacatcgacgacgccgggcaccgcttcggcctctcttcgccgcagtaccgcaacgcggcgcggcgcgccgacggctcgctgtcgcgctatctgcccgagtggctggcggccggttatcaggtgctggtcaccgccgatcacggcatgaacgacgatcgcagccacggcggcgtgttgccggaagagcgccaggtgccgctgttcgtgttcggctcgggcttcagccaggacgacgccgatccgcagcaaaccgagctgtgcggtacgatctgcgatctgctgcaggtgccgcatgacaagccgcgctgccgggcgctgctggcgcaggatgcgcgatga

SEQ ID NO: 912 - DNA, 312 bp, Glycine max
  Peptide Sequence Number=SeqID_92597
atggggtgtacgggctcgtacttagcccatgggcccgaaatctaccctaaggctcataagaaccctagggccttctcttgcatctctggcccaatctacttggagtttttctatccaatgcccttgcggagtaggattgcatcatacaccctttttgctatccagagacaatcaagtctgatggcacccgaagacaaatcatgggtcatcggcacccatttcgctatccagagacaatcaaatctgacggtacacagagacaaaacagagtcatccagaccttctttggcatcacgagacaatcaagtctaa

SEQ ID NO: 913 - DNA, 315 bp, Glycine max
  Peptide Sequence Number=SeqID_92598
atgggcctctgtcagttctacgtagtgcctgtcgcccccagcaagatcatcaggccccctactaatcgagcttttatcaagaagtactgcgtccccaggcaggcgcagggcgaaacaccacagcagcccggggatggccggcagcgggcgacagacgtaccgccatcacctctagagttcatctcaactcatccacaaaaaggacatcccctttatccccgaaccgctagcaaaaccctgacctatatcatgaccagtcgttctacaagccttgagccagaatcccaacttaccataaaccttgacctagggtga

SEQ ID NO: 914 - DNA, 96 bp, Glycine max
  Peptide Sequence Number=SeqID_92599
atggctacaccaatgagtactgcttgctatttggataaaaatgaaactcgtcagtcaaagacattaagcaatatcgagatttcaatcaaatcctaa

SEQ ID NO: 915 - DNA, 192 bp, Glycine max
  Peptide Sequence Number=SeqID_92600
gaaaaggtccaaaaggagagtggcatcaggtctaggggccaagcaagaggctcagactcgattacaaaagctattagtaagcggaagaagtttaacaattacctgatatgggctgcagctgcggctttgctagtcctcttgttggtggtgcttggatacatatcttttctgagtgggtggctaggtttatga

SEQ ID NO: 916 - DNA, 376 bp, Glycine max
  Peptide Sequence Number=SeqID_92601
atggaccaatcgcgagtagatggcatgattctaaaggatgagttgaagacttgcctaaggtcaaagaggagtttgtctcaacggttatgcgagaccgaaacaaacatgttggccatcatcaacaagtataaagaagaattaaatttggccaccgcccacgagcacaaagtggcggacgaatacgcccgagtgtacgcggaaacagaggctagaggaagggtgattaactcattacatcaagaagcgacgatgtggatgaaccagtttgctcttactttgaacgggagtcaagaacttccccgattactggcaaaggccaaagcaatggcagacacgtgctccgcccccgaggaaatccacaggctcctcagctatt

SEQ ID NO: 917 - DNA, 243 bp, Glycine max
  Peptide Sequence Number=SeqID_92602
atgattatgaggggtcaagacatttatagtagtcaagaggagactatttcttccccttcctctaatggaagtgaagatgaagtaagggatgaagaatctagtgaggaagtctaccctcatgaagaaggtgacctcctaatgaagatcatttacaatggtctaactaatgagattaccctcacccatcttggcactaaatttgtgttgcatcctcaaacaccttcacaggtagctaaggatcaa

SEQ ID NO: 918 - DNA, 174 bp, Glycine max
  Peptide Sequence Number=SeqID_92603
atgtctcgagagaggactagtttagaggaatactttctcgaggcatcagctctcaaaagtgaccaaagagtgatggatggacgaaatcatcgtgcgatagctgatgctctccaagccttagctcaggctataaggaatccaaataggggagaagctgctggggggatcctctag

SEQ ID NO: 919 - DNA, 678 bp, Glycine max
  Peptide Sequence Number=SeqID_92604
gacgaaaaagaagtacttcagactgtcaacgagagacggaggcagtttaaatcatacctcacgaggaaatgggcccttgtagccgatcaagacggtgtggaagacactgtttgtgagaaatacgacataagcaaggaaaaatgggcccagttttgccagactcgcagagacccttcttgggaggatgtgcggaaaaaggcacatgccatccagaaacaaaacactgccccccacgttttgtctcatgtgggttatgaatatttggagcataagctcctggttgagaagaccaagaagaagctagaggaagctgcacagtcgggaagcgttgattgcatcatcgaccctccatcccccgtcagatgccatgtgaagtggaagatggcccgcacaaagaaaacaggagacatgacaattgaggccgcaaagaaaatcgctgagaagatcgcggcacagggatcctttgtcccccatggacgtcaggatgttctcaccgttactattggaagtccagagcaccctggacgtgtttgtgctgttggagctagtgtcaccatcaagcaacacttcagatcagctccacggacatcccgtagctcttcctcgctgcctcttgaagaattacagcaactgacccagcaaatcagggaccagctagaggagtcgatcacagaaaaa

SEQ ID NO: 920 - DNA, 131 bp, Glycine max
  Peptide Sequence Number=SeqID_92605
gagaaagggagctacggcaagaggattgtacatgagagaagcaaggagtcaaccttttcaatatacacatgggttgcaatgcatgtggttggatctcatgtcgatctgaatgaatcatcctttccacggag

SEQ ID NO: 921 - DNA, 195 bp, Glycine max
  Peptide Sequence Number=SeqID_92606
atgagcgtccacgtggcccaggtgattgctaacgtcatctatttgtttgcagccttcatcgagaagtattgcacgcctaggcaggcgcagggtgatgcacctcaggccgcagacgcaccaccaccacctcatcaggccgatcccgctagatcactaggcatggagtgttatctacaacatttggttcgccagtag

SEQ ID NO: 922 - DNA, 78 bp, Glycine max
  Peptide Sequence Number=SeqID_92607
atgaaagcaaaatgcaaccaaaggtggcttgggggagcaaaaaccgtgagtcccgggttgctcgcccaggcgagctaa

SEQ ID NO: 923 - DNA, 246 bp, Glycine max
  Peptide Sequence Number=SeqID_92608
atgtgttgcacacttcacttgaagactctctctggtggcaacatgcgcaaaggaaagaggggtgccgtagatctagatggtgacaaggtgacagcatgcgcaaatttggctggtccgaggtgtgtgggcgaatctgggtggtgttgggtggcggcacatgtggaggaaatatggtcaaacgggggtagtggtgatggtttagggaggaggagggagagaggaagaggggcaaaaaaggggtattag

SEQ ID NO: 924 - DNA, 271 bp, Glycine max
  Peptide Sequence Number=SeqID_92609
atggtttggaaagctgatcctagtggtttttattccactaagtcagcatataggctattgatgactttcagcaaacctattcctcagaggaggattttgcagactattgaagcatgcaatgcacacaaaaaattctctatagagactaaatggggcactatgatgggcagctatcctttttcagaagaacaaccaattccgcttactctcaatacgagggaaatttcaaatgcttatgttggattttgtctacccaaaattgattctccag

SEQ ID NO: 925 - DNA, 90 bp, Glycine max
  Peptide Sequence Number=SeqID_92610
atgccatctcaattaacatcgaccctcctcttcgatgaaagactaggacagttagaaaacgaggaagcccgggaatggggcgcaactacg

SEQ ID NO: 926 - DNA, 180 bp, Glycine max
  misc_feature (48)..(48): n is a, c, g, or t
  Peptide Sequence Number=SeqID_92611
atgagaaaagcgccacgcttcccgaagggagaaaggcggacagggggncggagcctatggaaaaacgccagcaacgcggcctttttacggttcctggccttttgctggccttttgctcacatgttctttcctgcgttatcccctgattctgtggataaccgtattaccgcctttgagtga

SEQ ID NO: 927 - DNA, 810 bp, Glycine max
  Peptide Sequence Number=SeqID_92612
atgtgtggtttttacgccgagcgcgcagagaacgctacgctgtgggatgtggaaggcagagaagtgatcgacttcgcctcggggatcgccgtgctgaacaccggccaccgccacccgaaggtgatcgccgcgattgaaaagcagctgcaggctttcacccacaccgcctatcagatcgttccttacgaaagctatgtctcgctggcggagcgcatcaaccagcgcgcgccgatcgccggcccgtgtaaaaccgccttcttcaccaccggcgcggaggcggtggaaaacgcggtgaagatcgcccgcgcttacaccggccgtccgggcttgatcaccttcggcggcggtttccacggccgcacctatatgaccatggcgctgaccggcaaagtggcgccttacaaactgggcttcgggccgttccccggctcggtgttccacggccagtacccgaatgcgctgtacggcgtgaccaccgaagacgcgatgaacagcctggatcgcttgtttaaagcggatatcgatcccaagcaggtggcggcgatcgtgctggagccggtgcagggcgaaggcggtttcaacgtggcgccgggccgactttatgcaggcgttgcgcgcgctggtgcgaccagcacggcattcttctcattgccgacgaagaacagaccggcttcgcctcgtactgggcaagctgtttcgccatggagcactacagtcgttaaaaccggatctgatcaccatggcgaaaaagccttggccgggcgggcatggccacttgtcggcggtggcggggccgctgcccgagtgtga

SEQ ID NO: 928 - DNA, 379 bp, Glycine max
  Peptide Sequence Number=SeqID_92613
aatgaccaaacttggtctctgcttgtcatcgggctcgccgcctctggatgacaaaaaggtgcggataaccgtaagaatgaccaaacttggtctctgcttgtcatcgggcccgccgcctctggatgacaaaagggtgcgaataaccgtaaggcatctccgcgtatcatgggtgcagaatgactgtcataccctaatttcgtccgggaacctttgctcgatgacgtgcgaccattctttggtcctcgtgaggcccatttgggccctccagaagattcctccagaaggcggttgcttctggaggaagcaaccctgctcgcctgggcgagctgagctcgcctgggcgagctgggcggcaagcatctcccctattttgctataa

SEQ ID NO: 929 - DNA, 507 bp, Glycine max
  Peptide Sequence Number=SeqID_92614
atgtgggaagtcccctttatccccgaaccgctggcccacgtggcccaggtgattgctgacgccatctatttgtttgtaggtatgccacccactaggcaccctctggacccggataagtctcacagggccctggggtttccggcgctgatcaccggcctctgccagtcattcggggttcccgtcacccccagtaaagtgatccgaccgtcgatcacccgggccttcatcgagaagtattgcacgcctaggtggccaaccaccgtgggcaggtgcagatacatgagtgtctctatcggttcagcctcagtcagcagggtcagggttccgctccttttgcattatctactccagagcagtttgggggctaaggtcgcatggcccagagactggcctgaggcccaggcaggggaggagcctgcaggatcccccggtgaggcagatgaggcctgtatggatgaagatatgactgacttgctcggtttcttgggaggaagcggagccacgtga

SEQ ID NO: 930 - DNA, 354 bp, Glycine max
  Peptide Sequence Number=SeqID_92615
atggatatctctgaagatactgacatccgtgtaagcttggggaggccgttcatgttgaccgcaagctgtatagttgacatggggaaagggaagctggagttaggttttgaagaccagaaaattgattttgacttgtttgttgaagacaagcctactccagaacacaatgtttgcttgcaggtaatgggagaaggtcaagaggttctgaaggtgagaaccaaaactcctttcaccaagcgcctgcttctcgctaagcgcataatcgttcatgcactaagccacgagattcaagcgcttggcgcacaaccctggcatctgaggctgactaattccactaagctagccaaggtttag

SEQ ID NO: 931 - DNA, 786 bp, Glycine max
  Peptide Sequence Number=SeqID_92616
gcagagatggactttgatagacaccggttccagagtgcggaacaccagcaacagtttgaggccatcaaaggctggtcattccttagagagaggcgagtccaactgagggacgaggagaatgtggagttccaagaggagatagcccggaggcaatgggctcagctcgtatcacccatggctaagttcgatcttgagatatcagttgctatgcgttctggggtaggactttgcccgaagcgtagcggggagacgggtgcggatcatgtgcaccagcatgaccaccatcacgcagatttggatgactttgcaaggattacgcctccaagacacccagtggacccagagaagtccaacaaggccctggggttctttcctctcatcacaggtctttatcagttctatggagtggcggtcacccccaccaagctcattcggcctcctattaatatggctttcatggagaagtactgtgtgcccaggcaggtgcaaggtcaggcaccccagcagccagaggaggaccagcagcagcctgctgcagatgtgccattgtcgcctctagaggaggtatcatctctgaggtccatcttcgatcacctgcagaggatagaactccagatgcacgggtacatgcatcatgtgactagccagcaggcggctaatcacagaggacagcctggggatgagaccgatttcgagacgcgggcaggacctgcaggagctccgggggacgacggaggagctcaggaggatgacgacatggctgacgcgttggacttcttcacttga

SEQ ID NO: 932 - DNA, 457 bp, Glycine max
  Peptide Sequence Number=SeqID_92617
aggattacgcgtcctcacctttagaggactacacgtcctcaccatcagaggactacaggtcctcgccttcagagggccacacgtcctcgccttcagagggctacacaccctcgccttcagtgggttgcacgcccttgccttaagaggactacacgtcctcgccttcagagggctacacaccctcgcctttagaggactacacgtcctcgccttcagaggactacacgtcctcaccttcagagggcgacacgccctcaccttcaaaggaccacatgtcctcaccttcagaggactacatgccttcgccttcagaggacttcatgttctcaccttcagaggactacacgtctttgccttcagaggactacacgtccttgccttcaaaggactacaagtcctcgccttcagagggtacacgccttcaccttttgagggctgcactccctcaccttcatag

SEQ ID NO: 933 - DNA, 377 bp, Glycine max
  Peptide Sequence Number=SeqID_92618
ccccacctccaactttagcagacccatctgcccagagctcccagacttcagatgccaaattgcaaagcttgtttgaaggacaaattctcattatgcaaagcttgcaagaactggctcagcaaaggcaaattatgagtgtagagaaattcattgagaaggctactcatcctaggccaatgccagtatcagctgatgcaccatttccaggggtggatccatcttcacctcagcacgtagcagactcttccattcctgtcttagagatacctgagggccagaccataccagtcctgactttggacacttctcctccagctactccagtattgcatctgatagatgaagaggatgttcagacacaggacacccaggactag

SEQ ID NO: 934 - DNA, 342 bp, Glycine max
  Peptide Sequence Number=SeqID_92619
atgatgaagtcctctgatgccgcgaacgagaagctcttagaaaatggcacttcttcttctcaaatcaaaaaaggtggcttgcgaaccatgcccttcatcatagtgaacgaatgtctggagaaagttgcgagttacggaatcatgcccaacatgatattgtatctgagggacgattacctcatgcctattgcgaagggcacaagcgtaatttacacttggactgccgcatccgacgtcttatccttatttggggcctttctctcagattcttacttgggtcgattcctcgtcattgctatcggttccttctccagccttcttgtaagtctactttttttttga

SEQ ID NO: 935 - DNA, 1329 bp, Glycine max
  Peptide Sequence Number=SeqID_92620
atggcttctaggaaacgcaagagtatcagttcaagacccacaacacaatatgatacaaggagatttcactccttagatgcttggaaccggtacatggacaatgttttcggaagaaatatcttgccagaaaggaaggtggagatctaccacactgagctagatgattttaagactgaattggagaggtgtaatttccataaacacttcactaatttggttgatgggatcatagacttggctttgttgaaagagttctatgcaaacttattcagctctgagagcccttcaccaaagcaagttagggtcagaggccaacgggtgaagattgatgctgacagtctcaacatattcttagagacacctgtggtgttggaagaggattacagagagattgaggctgccttatgcataccaggccgagggttcatcttgaacgctgagggccatcctaggaagattcttaggaaggatttgactactctagctcaggtgtggagtattctctcatactccaacctggcctccacatcacatacctctgatatgatagtggacagagctaggctgatctttgacctagtctctcacatggacatgaacgtggtagctcttatttctagccagatcacctctatagcccagtctaactcttctagacttgggtttcctgctctgatcaccgccctttgtagggcaagaggggttgtttctgacagcctagtttttgagcgcctgagctcgatcattaacttggcctacatcaggaagaactgttggaatcctgatgatctgacagttactatccgaggggctaggagggcgaggccagctgagcttccttccacatatgtagttcctactccagcatccagttcagcagctacttctgtcccagctcatacagattctcagcgctttgaagccatgcttcagagcattcatcagggacaaatcattttattgcagagtttacaggtggtggcacctccaggatccattccttcagttgagcagtttcgggagatggtagcctggcctgggactcagccttctcttcacagggaagatgaaggtcccacagcccaggtaccacagcatgtggaggatgagtcatctgaggccaccattccagagccattcattataggggaggaggcagagcctcctacaccagtgatggacatatcctcgcctcaacatgcagcagacccctccactcctatcctagagataccagaggacctgaccacaccagtcctgaatttgaacacttctcctctagctactctagtgcttcatctgatagatgaggaggatgttcagacatag

SEQ ID NO: 936 - DNA, 192 bp, Glycine max
  Peptide Sequence Number=SeqID_92621
atgaagaagatgaaggtcagcagctttctcgctaagcgaggcttcatatccaagagcgtggagagaaaaatagaggcacaaaacaaagcaaggaagccaaaaacctcagatttcaagaggattctaggtttaggagtaatttctaggttcctagaggttgaagagacatccccaccactgtgtaatctgtaa

SEQ ID NO: 937 - DNA, 514 bp, Glycine max
  Peptide Sequence Number=SeqID_92622
gcgtaaaacaaagatgtttgttgaccctaaaaatgaaaacatggcgacactggctgaagttgcagagacgttacagtacatggtgtcaccacaagggagaaatacatgggcgattgacgatctagtgccatgtgtggagaaaataacaattttatctgaagagcaggagagaataactgaacctctatcacatggtccaacaacagaacctgaatttccagcccaacagttaaatattctccaatcaagtgttgaaactaaaggcataaccaaacgaagggagactgttgaagtcaaaccatatgtgtactcacagatggcagagcgtggccatggaatgtattacacaccaccaacattttctcagtatccgacacggatgtatcagtattcgttcgaagctcatcaaagtgatacgtctgcaagcaaacattcattaggtggtgttgcggagacatgggaattttccatggcctactatgaccttttcacagcaacacaatgttccaattga

SEQ ID NO: 938 - DNA, 327 bp, Glycine max
  Peptide Sequence Number=SeqID_92623
atgccgccagcgttcatcgtgagccaggatcgaactctccatgagattcctagttgcattacttatagcttctcgttcgtagacaaaggtgattcggaattctcttccattccaaggcataacttgtatccaggcgcttcatattcgactggagttcgctcccagaaatatagcccccccacccctcgtgtaatcccacgagcctgttatccattttcaattattattcgatcacggcatacaaatagaaaaacttacattgggtttagggataatcaggctcgaactgataacttccaccacgtcaaggtgacactctaccgctga

SEQ ID NO: 939 - DNA, 450 bp, Glycine max
  Peptide Sequence Number=SeqID_92624
gcttttcataaaggccgacaaattgattgggcacacttagtccgatatcgcatgcataaggcattgcgattaaatgctccattgccatatccacacctagtcactctcttccttcaacacttcaacattcctcttgattctgaaccttatgttccaatcaagagatcctttctaataggcgctgttgtgattgcatcctttggttaccgtaaagagcatgatggctcttggttgagaaagggtgctcaacccattgatgaagaaggaaatttacatggtggagaagattcctctcttcttcaaaagattttggacaggtttgatactttggagttacaagtggacatgcgattcaatgagatggagtcatggatcaccaaggtcgaagaagatgtttcttacattcatacaagctttgatctaccaccaccactgccaccatcatcatag

SEQ ID NO: 940 - DNA, 309 bp, Glycine max
  Peptide Sequence Number=SeqID_92625
aagtttcataaattcatcaaaaatagaagaatagagagaagccataacttcaacaatgggaagagatcccaagaagtttctcctacacttaaatgctataagtgtaatcaacccggtcatataaaggcaaaatgtccctcaaatgagtcatggtccgagaagaatgagaagaaaagctataaagaaagaagatccaagaaggcgtatattgcttgggatgacaatgactcatctgatggttcggagaaggagatcagccttctatccaaagactatgaaagtgatgagaacatctctcaagaagattaa

SEQ ID NO: 941 - DNA, 429 bp, Glycine max
  Peptide Sequence Number=SeqID_92626
atggagttgcaaagactaaatcaacatgaagaaaatgataggaagaagaagggaataacgcttaaagcttcattctcaatccaagaagaaagtgacatagaagattcaattgacttggatgaagatgaagatcttagcctctttgtcaaaagattcaacaaatttcttagaatgagaggaaatcaaagaagaccaaacttcaaacctaaaagaagaattgaagagtcattccaaacaccaaaatgttttgaatgcaatcaacctggacatctgaggaagattattggagaaaagaaggcaaagaagccctacatcacatgggatgataacgacttagaatcgtctgatgattctgaaaaagaagtaattaatctatgtctaatgggcaaaaactatgaaagcaacgaagaggaattggatacaaactag

SEQ ID NO: 942 - DNA, 216 bp, Glycine max
  Peptide Sequence Number=SeqID_92627
atggctgaagagaaacctcgacgagtgaccttcgaagattactcaagtacttcggtgccacaatatttctcaagggttgcgcagctagaggttcaggcacaaaacctaacttacccaccttcattgatacaactaatacaaagcaatttgtttcatggtttaccaaatgaagatccatactcacaatttgttcgcgctaagcgccttgacccctga

SEQ ID NO: 943 - DNA, 429 bp, Glycine max
  Peptide Sequence Number=SeqID_92628
atgaccaccctgactcagatctggatgactttgctgctcagcaacatccagtccagcgatcataattccgacctcccccctgccgaagtgtcagttggtatggcgcctaccaggcaccctctggacccggataagtccaacagggccctgggttttcccgccttgatcacaggactctcccagtcgtttggtgtccctgtcgcacctagcaaggtgattcggccgcccatcacccgagcttttattgagaaatattgcacgcagagacaggcccagggggatctccgcaggccgcagacgcgcagccacctcatcaggttggtccagctggatcatttgatacggagcagtatttacgacatttggttcgccagcaggcggcctaccaccgggcgcatgtacagacccatgattgtctttaccagttga

SEQ ID NO: 944 - DNA, 348 bp, Glycine max
  Peptide Sequence Number=SeqID_92629
gttgaaggtcaagctgtgacctgggaagccttcaagagggggaacatgattgtggctgaatatgcagtcatgtttgaggagttggtgaggtactttcctcattatcaacgaagagatggtgaaataggtggccttgttggtgcttgcgtgcttagtgcaattctggctcgcttagcgcgcattagtgaatttcggcttagcgcacatcttttcgcttatcggatggattcaagtggtgcacttagtgggattagccctcgctcagcgaacatgcacaactcatccttcttccagattcttcctcgtgctcagccacaagagtggtgcgctcaacggatggctcgctga

SEQ ID NO: 945 - DNA, 102 bp, Glycine max
  Peptide Sequence Number=SeqID_92630
atggggagaaaaaagctggagttggactttgaagatcagaaaattgattttgatttatttgttgaagacaagcctgctccagaacaaaacgttcgcttacag

SEQ ID NO: 946 - DNA, 459 bp, Glycine max
  Peptide Sequence Number=SeqID_92631
atggcgacgacgtgtagtcctctaaaggagaggacgtgtagtcctctgaaggtgggggcgtgtagccctacaaaggcgaaggtacatgatcctttgatggcgaggacgtgtagtcctctgaaggtgaaggtacatgaccctttgaaggcgaagacgtgtagccctctgaaggtgaagacgtgtagtcctctgaaggcgaggacatgtagtcctctgaaggcgagggcgtgcggccctttgaaggcgaggacgtgtagtcctctgaaggcgaggacatgtagtcctctggaggcgaggacgtgtagtcctctgaaggtgaaggtacatgaccctctaaaggtgaggacgtgtagtcctctgaaggtgagggcgtgcagccctctgatggcgaggacgtgtagtcctatgatggcgaggacttgtaatcctctgaaggtgaaggtacatgaccctctgaag

SEQ ID NO: 947 - DNA, 231 bp, Glycine max
  Peptide Sequence Number=SeqID_92632
atgtccctatttgattggagcaaaaagggcccacttctctttttgactgtgacccatactcagtcacaaaagaccaccacccgacagcttgcggggtacttgacgctacttcagtgttggatctatgagcactttcctagtgtgcatcgtgtgacccccaaggcctacactccgaagagtccgtcagggcctctccctcctgatttaggtccaacccagaaaacattttag

SEQ ID NO: 948 - DNA, 255 bp, Glycine max
  Peptide Sequence Number=SeqID_92633
atgatgtcacctccagactctattcctacagtagagcagtttaatgagatggtagcctggcctgggacccaaccttctcttcataaggaagacgaaggtcccacagcccaggtacctcagtatatcgaggatgagtcatctgagaccaccatcccaaagccatttgatataggagaagaggcagaggagacacaggtgagacaagtagatgctaccacgctgatcgagaccatacccgaatcaaataaacattaa

SEQ ID NO: 949 - DNA, 231 bp, Glycine max
  Peptide Sequence Number=SeqID_92634
atggcattaacgcgtgacctttgtaaggaaacaacccatggggcattttggtttgcacatattttctattttttgggacatgcattcattcccgaaaaaggtattagaaataccagaatgtgcacgtatgcaatttttgatagccaaagtgctttgagtatgcatgaaatggccccgaaggaagcttgcctcaaagaggtccaggaaggacaaggcggccgaaggatctag

SEQ ID NO: 950 - DNA, 225 bp, Glycine max
  Peptide Sequence Number=SeqID_92635
atggcagaagaagatgcactttctcttgacaacattgaatgtggtgtatgtgctgagtacaccgatgccggtgtatatggaaggcgaaactctggatcaaacaaggaagcgttcgaaatgggagaacgacgattacatttgtcgtggacacattctgaacggaattatgagactctcttgaatccaagtatatggcagaagatgcctcaagtaacaaattcttag

SEQ ID NO: 951 - DNA, 345 bp, Glycine max
  Peptide Sequence Number=SeqID_92636
atgccacctaccaggcaccctctagacccagataaatctaacagggccctggggtttccagcgttgatcacgggtctttgccagtcattcggggttcccgtcacacctagcaagatgattcaaccgctgatcacttgggccttcattgagaagtattgcacgcctagacaggcgcagggtgatgcactgcaagccgctgacgcaccgccaccacctcatcaggctgatccagctgggtcattcggcatggagcggtatttccaacacttggttcgccagcaggcggccaaccacagggggcaggtgcagatccatgagtgtctctaccagctcagccttagttag

SEQ ID NO: 952 - DNA, 424 bp, Glycine max
  Peptide Sequence Number=SeqID_92637
gcttttcgtcttacagatagcaaaaaagaatgtttatacggataatcactcgggtatttccgcccgtcagcgtgacttaaaagtcagtatgacagatcttgtgagcgcggaagatgacgctttcgtcttacagatagcaaaaaagaatgtttatacggataaccactcgggtatttccgcccgtcagcgtgactcaaaagtcagtatgacagatcttgtgagcgcggaagatgacgtaaatctccgcgtgtcaacgggcttgtcggccgcgattgacgaagggcgcaggagacgacgtatctccgcatgtcagcgtgactcaaaagtcatcatgacagaacttgtgaaaatggccgacaaaagcgaggctcttgctcctacgtatcctccaatgaggaactcagacctacgtagttctggataa

SEQ ID NO: 953 - DNA, 467 bp, Glycine max
  Peptide Sequence Number=SeqID_92638
tggaccatgttgcgctaagcacattcatcgtggctgttgaccaaaacgatgcagatgctaagcgtgcctatgcgctaagcgtcaataatgagctggatagaagacactggtgggaggagttgactgactttctggatggcaacattgatgttgccattgtaaaagaattctatgcaaacctctatgaccccgaggacaaatcacctaagcaggtgagggtgagaggtcatttgattgagtttgatgaggatactcttaacacatttttgaagaccccttccacttcagcaccatcagaggcaccaacaccttcttcttctccagtacccccctcttcatccactcagattccagttattcctccagcatctctacagatgccactcccagctccattatatgcaggaccatcatactttttatttactccacagatgcttcactccatgatgcagagtttgcactga

SEQ ID NO: 954 - DNA, 330 bp, Glycine max
  Peptide Sequence Number=SeqID_92639
atgaagaattggatgcaaaattcaaaacgggatgtctacctaggagcttacctgaatgggccaaacaactaccttaaaggaataattaacaggccagtgttgttttccaatacatttgcattagcattactcagcaacatcaatattgtaatgttccttgtattcaacagtgctttgaaagaacttgacgatactccacaacctaactccgaggttggggataggtggattgttgttaaatgtaatagacaaaaaggaagcactgagtgtgactattacatgatgcactggatgtccactataatcttaggaagtttcaggaataattag

SEQ ID NO: 955 - DNA, 372 bp, Glycine max
  Peptide Sequence Number=SeqID_92640
atggcctcatcaaactatttatttcccgaaggaaactctatgaataggtctcctattttcaatggcgtggcttaccattattggaaaacccggatgcaaatttttatagaggctatagatctaaatatttgggaagccatagaaattggaccttacattcccactatggtggcaggaaatgtggaagcaatgacttccaagattattttgatgataccaaagaatcaagagttaagcaagtttcaaagaatcaggagtcaaaaagcttcaagaatcaagtttcaaagaatcaagattcaagaacaatcaagtttcaagattcaatcaagtttcaagaatcaagattcaagaacaatcaagatcaagatttaa

SEQ ID NO: 956 - DNA, 300 bp, Glycine max
  Peptide Sequence Number=SeqID_92641
atggaggcaaattgggaaggtgtagaagttggtgtctcgctaagcgaggctaatgcgcttagcgagtatcatccgctaagcgaggcatcggctcgcttagcaagtcaaaggaatcttgaagggaatctaccacgcaagcacgcgcccagcgcgccatcagctcgcctagcgattcgtttgtttcttttggcgcttagcgtgcctagctcgctaagccaaaaaaggagtgtgagaaacaaagaaagaaagcgcaaaacagagccaggaagccaaaaacctcagctttcaagaggatcttag

SEQ ID NO: 957 - DNA, 549 bp, Glycine max
  Peptide Sequence Number=SeqID_92642
atgcttccggagagaaatgataacctcttcgtgacagaatatgatgacttccgaagagagctgataagaagaaattgccacagggccatgacccaacatgtggatggtcacatcgatgtggccttgatcaaggagttttactcgaacctgtataatccggaagacaaatctcctagacaggttcaagtcagagggaagctgatcaaatttgatggggagtccctgaatgctttcctggagacaccaccggtcattcagccaggggagcaatacacttcttattctcttttctgcaagtcacgcccaggccctcaggagtttgctgccagactctgtattccagggaccctcaaggccagggctagaggattcgagggcccatcttcatctgctccccctgttcctgcttctacttctgcacttccttctgtttcagcaccacttccaccgccatcattagcagttcggatcggcgcctccgctcagagctcagatcttatggtatcgatgttgcagagcctccaccatggcttatgcatagtgatgtag

SEQ ID NO: 958 - DNA, 252 bp, Glycine max
  Peptide Sequence Number=SeqID_92643
atgccgatgcgcggaggcagcaataccactgtcaacttggctgggatagtcaacacccatggtggcgcggtcgcagaacgaaacgccgacgaagaagacaatgacgacgacacacacggggggaacaaatgtgttgcgaatgatgacgacggggtgaggaaggagaccaaaagcttcagtaaggaagaagaagaaaaaaatggtgagcaagaagaagcggaacgtgggagggagggagagagacgagaatga

SEQ ID NO: 959 - DNA, 360 bp, Glycine max
  Peptide Sequence Number=SeqID_92644
atggttagtactagaggattaggtcgtgtcttaggtcacgttactggcagaggagatcgtgatgattctgatgatactccgcagcgtcgacggcctaccgcttccgcacggaggcagcgagtacatgtgactgcgacgcacgatgagcctgtgctccctgcgccagatgtagaggctgacgtatttccggatgacccgatggcaccagctgatgtagaagacactgggggagacattcctgcagacacaggcgcccaagctactgaggatgagcatgggagatttccgggtggtctgagcgacccatccgtgctgacccagtatgcagatcacgttgcttgcagcgtatggacgggagag

SEQ ID NO: 960 - DNA, 399 bp, Glycine max
  Peptide Sequence Number=SeqID_92645
atgtgccattttggatacacccagaccattcgtgctccacctgtcgattcatgggtgtcgtatgatgatatatacgacagtgaatgcactattcggatcatatggttccagcagccccgagtcgtccctcgggctccagagacagatatccctcacgtgtcggagccaggagcaccgtcgacatctgcgaggaccgctatggaaaagcctagacatgcagtggaagtttgccatgggattgctgagaggttggagcgccatcatagcctaggggtggtcacgccaggctcatcgacacatgaggtgatcgaagaatgcttcaggatggccaggagtgtcacacaggaccagctagtatatgttaggtctcgacgtaggcggtgcacggatcaggtgtag

SEQ ID NO: 961 - DNA, 306 bp, Glycine max
  Peptide Sequence Number=SeqID_92646
atgcatggtgccagttctgatggcgccttcaagctggacgaggcacgtggccacgaaaacgccattgtcagcagcgttttcgcttttgttgagctggctttggaagcgccagcagcagtggcgactgcagtgcaggccctaggtcctttggaagcgccagcagcagtggcgactgcagtgcaggccctaggtccttgttgcagtgcagaggcttgcagggaagcgccagtcattacagcgttttcacttttgatgctttggaagcgccattggtacctgccatttgcatggaaacgccaatggtga

SEQ ID NO: 962 - DNA, 276 bp, Glycine max
  Peptide Sequence Number=SeqID_92647
atggaggtggttggaacatcaatgatgtttgaatcttggaatgtcaacttgttgggtgagcctttaccattaaactttgttgcatctatggttgacagctcagcaatggagctaaagcagaagggatgtaccgaggcagtcatgatgattaaatttatatggagtccacctttgtccctcccaccactgaagccgtcggacctcaatttccatgcagggacagtgggtcgttcccagttaaagctacaaggggtgcagttgtcttccagcaattag

SEQ ID NO: 963 - DNA, 603 bp, Glycine max
  Peptide Sequence Number=SeqID_92648
atgccttccaaacacaaacccaagacccacctatgttattcgcatccgaatatcattgaggtaccctcagtttatcataaacaatgggctccagattacccgaattatgtggtgttggactacaatggaaagaagcaccatataagagttagaaaatttaataaccgagtctacattgctgatggtctcaaacacttcaggagggatatgggaatatatgaaggtgtgatgatcacatttgctgcgccggacaagaattggaagtttgatatccacttctcaccgccactccatgcacagacatgtggcaggcctgcccattctgccagagaatatatactgccactcgatgctgtgaattatgttaatgcaggagacgagtatattactgtccttggtgttcgtgggcatcgtcacttttggaagttgagtatgcataatgggcttcaatgttttgctgagccatggttccaattcttaacagaaaatgatttgatggccggtgatgaagttgtcttttatttcaggccgaatcaacttctttgggaggtcattgccagaaagcaaactgtgtgggacgaggacgaggacgactccccatga

SEQ ID NO: 964 - DNA, 602 bp, Glycine max
  Peptide Sequence Number=SeqID_92649
atgtggcgtcttaacaagcataatggtcgacaatccattgagatggtgttgatggaccatacgggtacaaagattggggcaactctatggcaagaattattcactgaatttgagcccaagttgcattgtggtggtgcatatgttattcagaacgtgaaggttgttgatactcattctgactacaaaacaacgtctgtcaaagaggtagacagacctgagattcctcctaatgttcatgccattacttcatttgctgatataatttcaggcgttgcaaaacctaatactttagttgatattgtgggtgttattgctgaagtgattgaacgcaaaacagttaatcctgcatacagagtgactgtcaagttgagagacaacagtcatgctgagatcatcatgaccgtgtggaaggaatatgctcttcagctggatgatgctattaagaaaaaccattttgtgcaaaagtcattggttgttatgctaacccttgctaagatcaaagaacccaaggacaagtatcccctcaatgtacagaatataaagcatggttcgaagttgtatgtgaatggtgacattgtagaaatccaacagttccatgatag

SEQ ID NO: 965 - DNA, 255 bp, Glycine max
  Peptide Sequence Number=SeqID_92650
atggaaatctttaatcggtcaattgatcccagtgcatggaatgctattgttaaaggaccttttataccaaataaagaagtgaatggtgaattggtgcctaaagaatgggatgagatgaaagatgatgagaaaagaaaagtgcaagatgatcaaaaagctaaaagcattttaacttttttcatactgcaaggtgcaaaagtgaaaaggaaatatggaaaatgcttgatgtcactcatacaggcactacggatgtaa

SEQ ID NO: 966 - DNA, 783 bp, Glycine max
  Peptide Sequence Number=SeqID_92651
atggatggtgtcattttctttgaggtgcataaaatacccattgttgttgatcaatctctattttattctttgacaaaactgagtagtcagggtgttccttttgagggcactctagttgatgattggaagcatatctattctagtcatgatgcccgtaaaatggtccgtaatgaccatgctgatatgaacggcagattgtttgctggctcattcacctttgaatgtcgcattatgcattatattctttgtcgagttttgcttccacattccacaaatcttgctcaggcatctgaggaagatttaattttactatggactcttcaaatcgatcgccaaattgactgggcccatcttgtcaagtaccgtatgcataaggcattatgggccaatgcacctcttccttatcctcatcttgtcactctgtttcttcagcattttaatgtttctttagaggatgaaccttttgttaaggtcaaacattcatttgctattggtgttggtgttgttgcctcttttgggtaccaaaaggatgtggatggccaatgggtgcgtaaacacaaccttccacctctaattcctgatgaacgcacaccttcctcaccattgcaacgagattcctcatcttccttattgaatgacgttctcatcgagcttagggatcttcaagctttcgtcgacgatcatttttatgctatggactcacgcatcacgcatcttgaagatgacatgagcttcattcgccgttctttgatcctcctgcagatccatagaagattcttttaa

SEQ ID NO: 967 - DNA, 1656 bp, Glycine max
  Peptide Sequence Number=SeqID_92652
atggttaagactagaggattaggccatgccttaggtagggttgttggcagaggtctggggagaggggatggtgatgattctgacggtgctccccaacaccgaaggccgactgcatcggcacacaggcgacgggtaactgtcattgttgacgatgttgtgcctgcggtacctgcagactcgtctgcggtaccagagacagaggctgttgtagctagggatgaacccatggtagatgctgacgcacaggacaccggtccagatactgacgcacaagatattggtacacaggatgctgcagatgagcctgagggatttcttggtggacccaaggacccatcagtgcttacggagtatgctgaccatgttgcggccaacgtatggtctggacaggaatgtcctgagttgatgttatgctcccatgggaggaaggaacataacttaggcaggcttgttcctgcaattgatgacatggagacttctagtttccatcttcctgtgggggaggtttcgatcacgctggacgaagatgcatctcttctccatttgcctatcgttggcacattccatgacttccagcctctacgcaccgacgaggtggtggtgctgttggttgagttactgatggtcttagcagaggtggccatgactgagacaggccaatatggtggaccatatgtacgcctgcagtgtctgcgagacgtataccagtgcagatgtcagacgcagcactggatagctgccgctcgtgcttatcttctacatcttttgggttgcactctttttgctaataagagtgcaacccatgttcatgtctcacacttacaggccctgtgttaccttactcttgctgggcggtatgcatggggagctgctgacctcgtccatatgtacgatcagcttaatgatgccagtctcaacaccagccgacagcttgctgttgcggagtgcaatgctgatctggactacgacgaggtgtcaccacatgtgtgttggtggattacaacaaagaagactatgaagaaggtatctacagcgatgtacaggcagcgcctggatcatttgaggatcccagatgtctgttggatgccatatacggagcaccaacctgtgcaggactttcatccgatttcgtgcttctcaggacagctccgctgggggcctgttgttatcagatacagactggagagggttatgcaccagttcagctacgtccagtgcattcttgcacactctgtccattcatgggtgtcatatgatgacgtggacaatacttggatgcactactcagaccatctggtggcagcagatgcatatgcgatgcagcccaatcatatccctcatgaggcagcattggcatcgacacaagcggatcttgatgcggatgagcccagacatgcagtggaggcttgccatgcgatcacggaggcgttggagcagcatctaaatgcaccaggcacatccacacatgaagaggtcatccaaaaatgcctaagcattgtgaggggtgtcacagaagaccgcaatgtgtatatcaagttgatctgtgtatggctcacggatcaacttgatccgcatttggtccgcctgtgttacacggattaccttgatccgcaagagactttcgcagatcaagttgatccacagatcttttactga

SEQ ID NO: 968 - DNA, 282 bp, Glycine max
  Peptide Sequence Number=SeqID_92653
atgatgacaaaaagctcaaaaagtcaagatcacttcatgataacaaagatgatgacattcaagaatgagttcaagattgagtcaagaacacttcaaggatcaagaggaaatttgatttcaagaatcaagattcaagactcaaagattcaagaatcaagagaagacttaatcaagataagtataaaaaaaagcaagcttcatgatgaatcaagattgattcaaagagttttgatgataacaaagatgatgacaaaaagctcaaaagtcaagaacacttcatga

SEQ ID NO: 969 - DNA, 165 bp, Glycine max
  Peptide Sequence Number=SeqID_92654
atggtgttgattacacctctgttttgctcagcgggttcctgttctgggtctagcaatcttcagtgttgtgaccaataccataatgatatctgcagtacttgtttgcatctgaccccggtctcggaggtttcgtctagcgtagccgaatgggtacctccaagttga

SEQ ID NO: 970 - DNA, 435 bp, Glycine max
  Peptide Sequence Number=SeqID_92655
atggagtcgccaactgtcacaacctaccctttagtgggagggcgatgcgagactcaagggtgcgtcttccaaaggaggaaaatgcgcaggagtcgccaccaacgtttattcgagaaaaacgttagaaaaaccaaaaaggggtctgcaaattttaagaataagggttctggagttgtttacgttcgaggaagctcgcccaggcgagttgttgcttcaacccgaagtaaccttgctcacccagctcgcccaagcgagctggttacttcacccctaagctatttggggagcccaggcgagctagaggctagcctgggtgagccagggatcagaaaaagctttaaaatgacccttttgccctcctatttagatagcaagtttgtggcagattatgccaggatagattctcggcatgttagatggctgccaagcaaataa

SEQ ID NO: 971 - DNA, 753 bp, Glycine max
  Peptide Sequence Number=SeqID_92656
atggtgagcaatccttcaagagcacagaaaaaagcaaaaacctccaagaggaaattcacagatgaaagcaagaagaatgactacaagatgatatatgctataaaaaatgtgaggatccccaagtatttggacttggaatggttctctcaacaagggttcaactttcctaatctgttggaagcacaaggattgttaaagctggtgcaaatgaaaaaaactttttatccaaagctagtcaaggttttctccacttgtgcacgtgctgactttgaaggtggagtccgcaagttcgatgaaacgcctgatgagtacaacaagatgcaatactataagggaatgcttcttgacccagctaggaacttgaggaatcacttaggagttggtggactgactatagaagacagtattttggtttacctcattacctacattttcactctaagatcaagaaatcatgctcagagtcatcacctggtggattatgaatttccttatgttgtgcttgcctcaagattcattgactacttcaatgttgatgtctctaataagattgtggactttaccaaagtgtctagtgagattatcgaaaggcatcaagtaacttggaatgagatgaacactatgtttcacctccatcaagagcactcagatgaagttcatagtttgttggagaatataactacccaactggaaaacatagagactaggttgacccttaacaacctccttaaccttgacgaggatgaagcttaa

SEQ ID NO: 972 - DNA, 486 bp, Glycine max
  Peptide Sequence Number=SeqID_92657
atggaagaaacttcgttagatgaaaactcttttaaatgcacaagatgtggaagaggggatctatttgatgactttgcctcaacggaatcacttgaagggaaagataaaggctcccctatgtcaaaatgggatgacaatgggtcaagagcattaaatgcggataaaggaaaaacagtgataacttgggaatataagacattagggcatggtctgaggttttcaaatgagaggaggctcaatgggagattcaggaggaacctcggggtgccaggggaaggccctgaagacaaaggggtgcaagagaaggaaaaaagaacttcaaaggatgctcaagcagatgccttgaaattatgggaactaagtaagaaaagtggggttaataataaagaaaatgagtctaaaatggttaaaagattcactgatttggaagcaagggataaggaggagttcgagaaattgagtcaaaagaataagaagggatactaa

SEQ ID NO: 973 - DNA, 213 bp, Glycine max
  Peptide Sequence Number=SeqID_92658
atgccgaaaaaccaaaaaaatattgatgcacaatcccacccaggcccatttgggccctccagaagattcctccagaaggcggttgcttctggaggaagcaaccctgctcgcctgggcgagctgagctcgcctgggcgagctgggcgcaaccacctcccctattttgctataaataggggaggaagggaagaaggaaatggtcgagccccttag

SEQ ID NO: 974 - DNA, 384 bp, Glycine max
  Peptide Sequence Number=SeqID_92659
atgaggtacaggatgaagactagggagaagaaggagagaaggagaagaaggagagaaggagaattggaatcagataaagcttggtttcattgtgacggaggtggaagatgtataaaccctagtgtcgcaacctacccttcggcgggagggcgacgcgtgactcgcgtgatgcgtgttccacgaaaggaatacgcgcggagtcgccaccaacgtttatttgaggaaaacgtcggaaaaaccgaaaaagacgcgatctacgaacttttaagtgaaaggttcgggagttgtatttacgcacggggaagggtgtttccctttgctcctacgtattcctcaattgcgatgaggaaatcagacctacgtagttctttcttcatcaagtga

SEQ ID NO: 975 - DNA, 324 bp, Glycine max
  Peptide Sequence Number=SeqID_92660
atggatgccacctccactcttccgacaccggcatcaccgacattgctttgcactcctccgggatcaagtcagaaaaagagttgggcagcattggtggagaaagttagattggtgctcaatgagtatccacaactcaggctaacccaagggagaaaagtgctagagatctgtctaaccattaaatgggacaatggcaaggctcttgaatttttgttagaatcattggggtacgagaattcgaatgatgtatttccaatctatattggtgatgatcgaactaatgaggatgcttttaggttaacaaatgttgccacgcctagttag

SEQ ID NO: 976 - DNA, 690 bp, Glycine max
  Peptide Sequence Number=SeqID_92661
atggcctcgaagaaactcctagctaaaagagctaggaagactgctacaggagagggatctagtacagctctacctatagacatcgggtttaatgggcaccgcttccaaagtgaggagcctcagcgccgctttaaggaggaaattgttaggaggcattggacgcagctggcagagcccatggctaaatatgatcctgaagtagtcatgcttatctcagatgccatccaccagtttgtaggtattgcacctccaagacacccagtggagccaaagaagtctaacagggcattaggatttccagcattgattacaggtacagcaatcggggcaagaccagccgtagcagccggccgcagacgcaccaccatcgcctccacatcagctaccatccttagagcagcaaaccataggggccagatgcagttgaatgacagcttctatcagtatacactgcaccaacatcaccaggaccctaacccttacccgtggcctactctagagcagttcaaagccactatcgcatggcctagggacaggcctaattttctggaggaggcaggtcctacagatgctcaaggagctgccacggggacgaaagtggagctgaggatgatggagagatggcaaatttgcttgatttcttcattggaggaggctgagctcctcgaccatgatcttctaaatttgtga

SEQ ID NO: 977 - DNA, 642 bp, Glycine max
  Peptide Sequence Number=SeqID_92662
atggataagaaagaacttagaaaatttttcagtcatccacttgctcagcgcaccctgtgcgctaagcgaatgatccttcatgcactgagcgagtcatcacccgcactaagccgagtcatctcactaagcgcacaacatagtctcgctaagcgcatctgtgcgctaagcgcaattatctctctgcctggaccttcattgtttaaggctttcggtattctgttggcggctaagcgagtcagtctcgctaagccaccatgcctctttagtttgaatatgcctgggctaagcgaatggcctctaggaagaggaaatctactgcctctagaccccaggagccctatgacaccactagattcatatctgagggcgcctgggagaaatatgcacagaacgttcactcctggaacatccttccagagaggaacgcagcctgatggtcacatagatgttgccctggtcaaggagttttatgcaaacttatatgacccagaggataaattaccaaggttctacagtactcacccagaccctcaggagcttgcttccaagctctgtattctagggcgcagttttgttctgaacgatgaaggagcgccctggaagctcttgaggaaggacctcaccactttggcgcaaacctag

SEQ ID NO: 978 - DNA, 543 bp, Glycine max
  Peptide Sequence Number=SeqID_92663
atggaggagagattgagggccattgaaggaggaggaaattatgcctttgctgacatggcaaaattgtgcttggtacccggcatggtcattcctccaaaattcaaggatagtcccaatgtaagaactaatccgcttgcaaatcacggaagctcgtcggtgaacgccattgaaaaaagggagtctcaggagttagagaaaatagaggatgtgtcaaccccaagactattcatcttggaggctttacgtaaggctggcatggttaaatacaatggtgataagggggatcggtgcttgttgcatccaggggagttgcatgatgtagagacgtgcccattatccaaggagctattgcaaggattcatagatgaagggacaccatcgccattcctttacataagtgacaaggcagtgccgtggaggtataacgtacatggatccaacagaaggaaagacatgtttggggctagcatgccaactgctaagggaaaggtgagggaggatgtggtcgaaagggagaaagtaggccttgtgacgaataacaag

SEQ ID NO: 979 - DNA, 615 bp, Glycine max
  Peptide Sequence Number=SeqID_92664
atgaccggaaggctactttccggttcattggcttttgaaagccgcatccttcattatctcattgtgcgtattttgcttccaagatcttcaaaccttgcacaggtttctgaggaagatcttattgtcatgtgggcttttcataccggccgacaaattgattgggcacacttagtccaatatcgcatgcataaggcattgcgattaaatgctccttttccatatccacatctagtcacttttttccttcaacattttaacatccctcttgattctgaaccttatgttccaatcaagagatccttcttgatcggtgctgctgtgattgcatcttttgggtaccgtaaagagcatgatgactcttgggtaaaaaagggtgctcaacccattgatgatgaaggacacttaccagttggagaggattcctctctccttcaaaggattttggacaggtttgatggtcttcaaacctatgttggtgaaaggtttgatgctctggaactacaagtggacatgcgtttcgacgagatggaatcaaggatcaccaaggttgaaggacatgtcacttacatctgcacatgctttgatctaccaccaccaccgccaccatcatcttag

SEQ ID NO: 980 - DNA, 405 bp, Glycine max
  Peptide Sequence Number=SeqID_92665
atgtttctcttcgtgctatcagctacatgctctcacgcatgtatacctatactgtgtcatcactcatgcattgcatttgtctcatcattttgtcacgggaagtcggaagagcctagaggtagtcagtttgcaagagctagggcagcagatggaccaactccaacgtcaagccttccacaagacatatgggaaaagctaggacttggctatggtagaagtttctgtggaagccatcgcatcccttacttattggtaccaaccgtagaagagtttgaagggatcttgggatgccccctaggaggaaggaagtcgtatctgttttctgggttatacccttccatggcaagagtagcaaaggtggtcaagatctcgacgcaagaattgggaccgagtgaaacaaaatag

SEQ ID NO: 981 - DNA, 252 bp, Glycine max
  Peptide Sequence Number=SeqID_92666
atggagcttgttagccttggatcttcttcatcaatggattcatttgcttcttggagattaatggtagcagaatggagaaggaagaaagatgattggagacgccacttcaaggagaagatgagtcaagaacaagctcaccaccataggaagccatcgataagagcatggaggattgcatcacctgggtataaggcccatcatctcaaggtgtgtgataatgtgtgggtgaagtatgtgaatggagcaacctaa

SEQ ID NO: 982 - DNA, 597 bp, Glycine max
  Peptide Sequence Number=SeqID_92667
atggcaagagtagcaaaggtggtcaagatctcgacgcaagaattggaccgagtgaaacaaaatagaaatggggtggttgggataccaaagaagcacttggaagagaaagcgaaagctttggcggatcaaggagagtggacttctttcatttatgttttagcactattggtgttcggagtcatcctctttccaaatgtggatggactagtggatctagcagcgatcgatgcttttcttgcttatcaccacaacaaggaaagtccgaccgttgctattttggccgatgcctatgacacgttcgatcaaagatgcaagaagagcagcacgagaattatttgttgcacacccgctctttatgataaggagcttataagaagcaacaacggtgttattggtggacaacgaagaagtgcaagccttgaaagcagaactggaaagaacgcgagtggtcaaggaaaatttcaaaacgacagccatcagcgaactcaagcttcaaagggccgagagggacgagtcaagattggaaagtatgatattagaggacaagttgaaggcttgtcaaagttcaaagaggaacttgaccgaacagttgagtag

SEQ ID NO: 983 - DNA, 267 bp, Glycine max
  Peptide Sequence Number=SeqID_92668
atgcaactctgcctcctcaaaggaagtagtccagcacatcagccatatcatcatcctcctgagctccaacctcgtctctgggggcccttacaggtcctgcccttagctctatcctccgtaggtgagcggagatggactccagggatggtggctgccgtcgaggtggtggcgacgtatctgcggctggctgctgctggtcctcctcctgatgctgctgtgcctgaccctactgttgtgcctgcctcgacatacaatatttttctatga

SEQ ID NO: 984 - DNA, 621 bp, Glycine max
  Peptide Sequence Number=SeqID_92669
atggccaccgttgcggaactgaaggacgcggtggaggccgtgtttagtcacgtgcctcacaaggggccagcaaaaatttcatgggcgcatgtttgggggcaattttgtttatgctatgatggacagaagctagttacggagaaggattatcttcgaaattatggcatcaaggatggtgaccagctccgtttcatccgccatgtcacaaacaattgctgtgttcaaagaaagcggttgaagaaaagagttgtctatttgaaacaacacaggaggtcattgcaagtggatggccatctaccgaaaggaaattgtgatgataatgacattggttctgatgatgaagccacagatagtgggaagatcaagcaccatattgaagaagaggaagaagaagaagaaagggaagaagagtgcgttggaaagaacaaattagctggctttttgggagacttgttctcatacactccactagcagttgtgagaagaactagaactaaaagcaggatttggccaaccactatgcccaaatgtttacttggtagtcttcgaaagattagaagtatcgtatgctttggcaggaggaggcactattctcggagacttccatggagaccgcattaa

SEQ ID NO: 985 - DNA, 396 bp, Glycine max
  Peptide Sequence Number=SeqID_92670
atgggaaatcccaaaggcttgtcaattgaatcctcctccccagaatttttggatgaagcaagtagaggagcatggaagagggttagtcgcgatggggttgcgcgtgtggaggaggaggaagggggttggttcgtacatggacaagggggagggctagaggtcatgcacgcagaggagaaggaaggggctatgggtcaccgtgaagaaaggaaaaagaagaagaagatatggtgtttggctaaggagagagaagaaggaatgcacgaggtctgttcttccatggatgtcgccaaaagaactggcgacataggtgttccgccattgcagatggcgagaagtacgctgagctggagggtgccgccagtgacacaggcgagacatgctgacgtgcactga

SEQ ID NO: 986 - DNA, 192 bp, Glycine max
  Peptide Sequence Number=SeqID_92671
atgcatttatggcttggccaagagaccagccttcttctagagggagggaggaacatgatgaggaataggttgaagcatcaaaatgcaagagagaaaggtgttgagggtggtaatgatgctggaacaaagaaggaaggatctggatgcactaatgctttttgggaccatctaactgtggagtgtggggagtag

SEQ ID NO: 987 - DNA, 318 bp, Glycine max
  Peptide Sequence Number=SeqID_92672
atggaggttgtgacttgtgaatatgattggatgatcttatggttgatgtccatgacagaaaatatgcaaactgaagaacctagttcacaccaaccaactcctcagtcttcacactatcctactccgttgtcttcacaccaaccaactccagtagaaagttctattgtacagctgaaggtgaaaaagaggctaagttttgaattgcaaaatatagcagttgggctaagctcaacatttgggctaagcacatatccaccgctgtcataccctaattttgtctggggaccatctatttggtgggatgcgaccttcgcatga

SEQ ID NO: 988 - DNA, 183 bp, Glycine max
  Peptide Sequence Number=SeqID_92673
atggctacaaaggaagcatttgtttcaagtttgaagcacgacgttttgatggtggatgttggatcgtcgacagttgcactggaggttatggaggacaagtggtgtggtgggttgtggatcgaggtgtttggaggtaagtgcgttgtagatgaggagagggaggactttactctccgagagtaa

SEQ ID NO: 989 - DNA, 588 bp, Glycine max
  Peptide Sequence Number=SeqID_92674
atggcaggacataatgtcacgagtaaggactgtgatcctagctctactgatgcagggtgtactggtaaaagctctcattcaactgcacctgacccctatgattggccgcctgctggtcggccacatgctgcatatagagttccatcctctgcatgtaagcaaagatggactctagggatggtggttgctatagagggggcggtagtgcatctgcggctggctgctgatggtcctgccccctgctgttgtgcctaccttggaatgcaatacttttctatgaaggtcctgttaatgggaggtcggataagctttgtggggttggcacttcgacaggggaagatcaaaattatgatcaccagggaggatgttgttgaggagcagcgtcatccagatctgtgtcagggtggtcatgctagtatgcatgatccacacccgtctctccatgtcacacgttgggcgaagtcctacctcggaacacatagtagctggccgatggcctcgtcatcaaacctcgaagcctggctccttcttttgctaaacttgcaacgttacccctcctttaggaccaacggatgccccaagaattga

SEQ ID NO: 990 - DNA, 171 bp, Glycine max
  Peptide Sequence Number=SeqID_92675
atgcttctgtcgcaattgccactgaaggtaacacaacctgttggagctgtggaagctgatttaaaatcaaacaagactgagcaaagcgtaaagaatgccaacaagtccgaagtagactcaagcaaggataaaaacaaatttgaggaagacaacctagataaagagatatga

SEQ ID NO: 991 - DNA, 480 bp, Glycine max
  Peptide Sequence Number=SeqID_92676
atggattctttccttgaaatcagaaaagtaaccattgtaataaaaaagaaagatcacgctttacgacacccttactggaagcatgccaagaccaagataatgagtgaaatagaggaggtgcaggaacaaatgaagaccgatatggaggccatgaaggagcaaatgaagaaaatgatagaggcgatgatggatatgaggaagataatggaggttaacgttgctgccagtactgctacagagaggaacccaactcactcgcccatttttaatcaagaaagtaacctagtgttaggtgtggaaggtcaaggaggtgcaacgggggtaactgcatatgggcctaaatacaccaagagccataatagatatatttttccaccatatggtttgcctcctaactatacaccacccatggttgtattggtgcctgccgagaacgttactaatcctatccctatttgtactgagaatagtccaacttaa

SEQ ID NO: 992 - DNA, 186 bp, Glycine max
  Peptide Sequence Number=SeqID_92677
atgaaatataatgataatgtcatggtagagatagaaccaggaggaaacaatgatgttgaacatggaaaaggcatgatggtgatgggtgaaggtgttttagaactcaacaaaaaccctctcataggtatcctttttgaaacgtcgacaattgctctgataccacttgtgacgcttcaagatcattga

SEQ ID NO: 993 - DNA, 147 bp, Glycine max
  Peptide Sequence Number=SeqID_92678
atgaagaaagaatatatgcatatatgcatggagaagagaaggggcaagacaggggaagcggggaaaggaacaacagagaagccaagtccatctcaccaaaggggattgaaatcaaaacatgtcacatcttttaaaaatcacatgtag

SEQ ID NO: 994 - DNA, 981 bp, Glycine max
  Peptide Sequence Number=SeqID_92679
atgcccctcaaaagactcatcatcacttccctttgggttctattcatgagtacccattctcttgctagtgttgagtcttccgattcgaaatatgcacaaaacattagaagtgttagagctgcgtattggcctgcgagtgatgacctttcaccttcttccattgacacaaaatacttcactcacatctattatgactttatccaacaagaccctcaactttttcaccttagtgtcacggaatttgatgaaaaatggataccaaaattcatcaatgggcttcgctactgttacccgccggtgaaaactctcttgtcaattagaggaggtagcagcaactctaccgcgttctccttcatggctagcaacaaacacacccgaaaagtgttcataaactccaagccatttgcaactttttggattgggcaagtccaatgtgctttgattaccatgggacctgggacaattttatgggcaaatgctgcattgtatgatctaaagtccaacataaacccaaatgttcatggggttgaggcaaaagcggttggggaagccactgatatgaatggtactatggactatgatgaaatcttggtgtttaacaaagagaacatagctactgttgtgtatgatgatgtagctgtggctttctactcttatgcgggtacaacttggatcgggtttgatgatggaccatccataaagaagaagggctatttcttttgggctgttgggaaagataaggattggactatctcaagacaaggagaggtgcctttgacaggaggggggacctgcgaaacaaaggactccgacgctcaaaggggtttgatggaaccaacatttatattagttgagcatggttgctggtccttgtttgtaggggctgttgtagcctttgtagataatttccggcttgtagataatagctgggagcttatagataatgttaaagataaaaatttgcttatagataaaaggtag

SEQ ID NO: 995 - DNA, 225 bp, Glycine max
  Peptide Sequence Number=SeqID_92680
atggtggtgggatcggctaggtctttggggtggaaaataaaggaggtgctgaggatgacgcaattgtctagggatgatccaaaatcaatgcgccatttgaggatgacactaactttgatgcctagcgctctgttggggagctcaatgtggaagatagtcttcgtcgaagtcgatggtgagggaagagatggaagaatgggatgtggtggcggtggccacttgtag

SEQ ID NO: 996 - DNA, 304 bp, Glycine max
  Peptide Sequence Number=SeqID_92681
cggacattggcagatggtggtcatcttgcccaaggaacacttagttgtatggttttgttcattgcataacaggccagacaactaccttaaggggattattaatagtgctatcaagggtcttgatgatgctccacagcctaaatcaaaggctcctgctaggtggattgtcgtcaagtgtcaacaaaggttagaggattttaaggtcatcaagggagttgtggagggagataaggcaacaaagattcgatgccttgagaaaaacgagccacacttggacggtaaaggtgtacgcgggtctagttga

SEQ ID NO: 997 - DNA, 456 bp, Glycine max
  Peptide Sequence Number=SeqID_92682
atgttggtttcatcgcgttcatttattctcgtgagaggagaggtccattgtgtcctctttggtcaaggtgaaagtcttacaaaggtacatcggcaagtggtggttgtgtggttgttaacggtggaggtgtttgctacccgtgatgatgttttgaattgggctcgagctgttgcttatgaaattagttttgtgacagtcattatgagttcagacacaaatactggtatgagaggaaagacgtcatttgtcttaattggttgtgaaatgagtggtcagtatagggctaggaagaaagatttggtaagaacaaatattggcagtagaaaacatgggtgtccttttaagctgtgcaagaaaccagtggttggaggccaaggatggatggtgaagttaatgtgtgggagtcacaatcatgaattggccaagtcattagttggacatccatatgttggttga

SEQ ID NO: 998 - DNA, 726 bp, Glycine max
  Peptide Sequence Number=SeqID_92683
atgcttgggcgagatgagaggtggagatcaagacattatttacaaataagcatcagttttgacgtgttaccccatattaagtgcagtagaaagcacaaacatccacatgcttacattaggggattattggagttccaatatcatagatgtttatctacaccgcagacaacaattggttgcaaacggataagaaatatgtgtacagaaatcctccccagccacagctactccttagatctcatcataaacccccctctacagaaacagaagcagaacccaagagcagagaagaatcagagaatggcaactatgactggtgtgagcctttcatgccccagggttttcttcaacgcatcaggctcaccgcaaaacgcgcatgctgtaaaattctatgacttgacaggactgcagaatggaattctgaagcgagggagagagattttcctcactggttgctacctccgaactcccactggaggttctggacattcacgtcttttgccaacagagtatcttgtgattctattggatgaagacttccagaaggaaattgttaaagcagcaaaaacatttacagctataggttataagcatattgaaacagtaatcatattgaagagtctacagaaaaataaatttttgctaacaaccgatgtagaatgttcactattctacatcgaagggcgcgagactttcaacatcgtctcttatgatgacacttcataa

SEQ ID NO: 999 - DNA, 393 bp, Glycine max
  Peptide Sequence Number=SeqID_92684
atgactcgtgatgctgatgaagccccccaacaacgaaggtccataacatatgcacgtaggaaatgggaagctgcacctgtccatcaacaacctcaagaagcagttgttgatgatgtagttcttaatgccgatggtttttcaggcggaccccatgacacattagttatgattgactatgctcatcataaacgtcctgagttgaagttatcctcccatggaaggaaggttgagaaatttggcaagtctgctctaaagattgaaggcttaatggctgccatgggattaagtcctctgattgcatgttcattagacactggagaggtgactatcaccctcgacgatgtggcattgttgcttcatctgcccattacaggcgccttccatagcttcaag

SEQ ID NO: 1000 - DNA, 4737 bp, Glycine max
  Peptide Sequence Number=SeqID_92685
agatatcaagatttttatgaagaaggggagaaagagattttattgactgaagtgtcttctttgagggatcagttgcttcaatatcatggaagaaactccatgcagggtaattcaaatcatgatattcaacctcagaaagctcagtgctgcaataaagaaaataaccttgttgatctagagctaagaaacacccttgatgagttacaggaatgcaggcgcaatttaaattattgcttagaggagaatgcaaaactcaatagggaagtagactctcttcactcaatgttaagcagcacaaatagtacaaaggtttctaccaaagaaccatttattgaagctcaggcagttccaaggatgggggtcaagcatgaaactcatctatcacaacacacaaatgatattttaaatctgcagttggaattagatataataaatgtaattctgaaggaagagaggtctttccgtggcatattggaagagaaaaaaacatgcttaaatcaggattttatgatggcaaaagacaagcttgagcagacaagcaaacaattagaagatgcaaaggaccagcttggagaggcaaaatctgtcattgaagccttagaattgcagcaaatattatctatcaaagagatagaagagatgaggaccaagaacaaccattttatggagcttatggggaaacaagagcatgaaatcatgaccttgaagaaccaacttgcatctaaagagttcagagataatttgctttcaaataatccagagtttgaaaacaagtcccccttacaggtaaaactcagaaggatgcacgattctcttgaaaaagcgaagcaactgaacatgtcgtaccaaagtgatcatgcattccagatatccaatgaggaagagagggatgaaatccatcggcaggccgaggctgaaactgttgaggtaattatcagtatgcaagaagaacttgcccagctccaacatcaagtaaatgatagtcatttgaaggaaacagaaatgaaagagagtatgctgcatctggaaactgaattgaaggagttgcagaaaaaaatgcttactactattgatgataatagaagtttaaaggaggagcttggccaaaaagatatagaactcacatcactggcagaagaatgggaactgttaacctatgagattgaagaggttcttctttatggatgtgaggcaatagttgatgcctctgaagaacttgggaatataaggaattcatttccacagaaaaggatctggatttctgaacaagttggcatgatagttagaaaaatttctgagaatgaattattaattgatgaacttagaagatgtttggaagatgcaagcaataaaagaagtgatatggagtgtatgctaaagtccttaagaagtgcagcgttagtcattactgaatcccaccagaaggagtgtgctgaatatgaaaaagaaattctcctattgacctcacaattgagtgaaaaaacatctactatggcacaattaaaggagcatttggtaatggcagaagatcatatcagaaaagcatcaaattgttcaacagtggcttttgtagttgtgaatagattgtcagaagtgaatcttggttacctggatgatctaaagcataaggatattctgcttagtgaattagcagaaactaataataagaaggatgtccttctcagtgaccaatccacttcatttgttcaagcagagagacaaataacagagttgcacgaaaaatgtaatgatttatggcagaagttgtctgaggagcaagagcattctcgtgctttggaacaaaagcttgaagatattgaaaagaatgccatttcaaagacaagggagcagctagtgacattacaagatggtgtctcttcaatcagatcatgcatggcctcttttgcagaccatccaggaagtcttgataatagaaattcattggatgcatgcacatcagactatgatgatattggtgaacaaaggcatacaagtttggaaacacatcaaaacagtgatttagatccgctttctgttgaagaacatatagttgacctgactgacttacagttggtcaaaagtggatatgatatgaaatacctgaaatcaagaaaagttggcaagaatgtgcttgaaagagatgctactattaggcttttgagaaaagaaatcgaatgtgctcttgaaagcttaaaagaagtgcaatatgagatggccagattacatgatgaaaaaaaagagatgccagtgtctgaaaagaagagtcggcaaagcatagagtgcctcacaaatcagatacttttcctgcaagaagctatgtatcactttgaggagaaatctaaagtcaagattgatgtactcagtcataaacttagaggcctggagaaacctctgaaggaagccagctcccattggtaccaaaggaaagagtcacttgaacttgaagttggagaggcaaagatcattcaagctcagaaagctcaagaggcatcttgtattcttgctaaatttgaagaagcacaagatacaatgagagaagcaaatactatgatcaatggattggtgaaaactaatgagtcaatgaagatagatatagaaagactaaaagacaggactttactcaatgagaagggtacattagtcagcaatattgaaagcttacaaattgttgttgatttgaagcatcaggagatagagaaccttgttgaatcaagtctagtagaaacaagggatctaattgttacgttggatgatgtcattaaagacgtccaattgacgatggcagaaaatttcaagtctttagcttgtgatttagagtgcttgaagtctcaatgtttatattccactaaattgatacagccatggcttgagaagatatggtctgagatagtttttaaagattgtgctatgtctgtgctacatctttgtcacatggacctacaacttcaggaggagataatgctgcaaaggtcgaatgaaatgggatcccaacttgctaaactgatgagggaattggatgtgagtaatacagatattgtgacatcccttttagatcaagagaaactactgaaacagaaagtagtggccattgaatgtgaggtcgaattttttatggcagattggtatgccaaagactttgaatcacttatccatgcatctgaattgaaaaatatgtcatgtaatatagctaatatggaggagcattttgtcaagtactccatattaattgagcaactgaagaaagaaacaatcttttcccaagtagaaactgagttagcaaaacaaattttgatggataaggaagttgaagtttccctattagaaagagaagttcagcagggaaaagtggaaaggaaggacctagtaacaaaattaaaccggaatgtcttaaggattacagagatgggtgaagtgaacaaggtccttgaacaaaatattgagtttctaaaggatgttacttgttctaatcatgcattgaagggtgaacttgttgaagctaacaaggcaaagaaaagactgctggataggattcttgatctagaagctgattatgataaagtaattggtgatgtcattgggaaggatgtggcttctgaattttctttccaacaggtttattttctcgaacatcaaaacacagagttaaagaaagtaaactatatgttggaaaattcatcttgcagacttaagaatgagttgaacctaaaggattcggacttaaccagaatgcagaacttactggaggttgagttatccagaaaggatgatgtagtaaaaggactgttgtatgatctgagcttactacaggaatctgcatcaaacaataaagaccaaaaagatgaagttgaaaaaattgtggctacaatggaggcattagaagtggagctagctgttaaatcaggtgaacttgctgatgttgctgcaaactgtcaattgcttgaagctcagttgcaggacaaatcagacataattagagctcttgagttggatctctcaaaagaacgtgaggctctagcattgcaagtcagtgaaaatcaagaacttagaactcatattgaaggcaccttgacagcgagaaaactggctgacaatgagctaacagaaagaatgaagataacaaagagcttagaagatgaaattctggaaatgaacagtgtttttagccaaatgaatgattcatttaaaaatctgagtagtgatttggatgatgtcactaatgagagggatcagcttcagggtcaaggaatttgcctcaaaaacaagcttgaaaaagctgaagcacaagctaaagctaatgaagcaattgttcaagaagctcagaaggtggcagaatcgagaaaaatttatgctgaagacagggaagaagaggtgaaacttctagcgagatcagttgaagagttggaaagtacagtaaatgtactagaaaaccaagttgacatccttaaaggagatgcagaacgacagaggctacaacgagaagatctagagttggagctacatgcattaaaagatcagatgcaaaatgttagaaatttcgatggtgacatgagaagatttttggatgaaaaagagaaaagcctcaatgaagccctaaatcacatacaggttcttaagagggagttagcaggaaaggatgcagagattcgacaaataaaggctcatatttcagagctaaatttgcacgctgaagcacaggccatggagtacaagcagaaagttagtaactatgtggaataa

SEQ ID NO: 1001 - DNA, 150 bp, Glycine max
  Peptide Sequence Number=SeqID_92686
atgacgattgttaaaggaccaggaataagtgttcttgaactagaggatgacaaatttgggttagaaagaagcacaaaggatgggaggtctgagtcatcaatgttgagaaattcctacggtgtattgtccatgatgaaagagactttgtga

SEQ ID NO: 1002 - DNA, 405 bp, Glycine max
  Peptide Sequence Number=SeqID_92687
atgcttgtttgggagccttacacaacaatcgttatatcattgttgcctctcatttgtgtactcggaagtgtcgcgtggtgcgcggtggtgctcggaatcagccctagctgcatgcatgattcagccctagctacatgcaaatggcttacgaacaatgccctaagctgtctcgcaggaagcaatggcggcactgcttgtcaatggttctcgcaagatgcactggcgagtttcatgcatacgtgggggaggcttctcgccagtggtgctggcgacacacccacgtcaccatgcatctcgccagttgtgctggcggcacatgtaccatgtagccacatcacgaagcttctcgccattgataatggcggcacacctatctcgccaatcctgctgacggcatcaacgtaa

SEQ ID NO: 1003 - DNA, 192 bp, Glycine max
  Peptide Sequence Number=SeqID_92688
atggctaactattcggcgacagcgacgagaggcaacaacaacgacacaaagagaaagagagtgagggagatgaaagtgagcagggtcacgagtgagagtggtgagagtgagcaatgtcacgagtgcgtctcaagggtttgggaagcaccacgactgagagtggtgatgagagcgagcgcgaaaagagactga

SEQ ID NO: 1004 - DNA, 414 bp, Glycine max
  Peptide Sequence Number=SeqID_92689
atgatgcatagggtagtagaagctcttgatgctaatgttaaaaggtggtccaggaaagtattgaagcatataaatcttggggactattttagttctagagttccaagcttgaaggggttctctgaacagaaaccaaacagcaaagtgaaagcttcctcattaaaattacttgcccacattatgcaattcctacaaaggcatgaattcagacttaagcatgatgattggatgaacacggtaaaacctgatcttcatcttggtgtttcagcacaattgcatgaaaaatttgaggtatctaatgcagagattgaaaactcaaaatctgttagaagtgagatgtgtgctgctgtaaattcgcttttgaagtcaagtgaccacgactatgctagggtgttgcctaggatattcccatga

SEQ ID NO: 1005 - DNA, 300 bp, Glycine max
  Peptide Sequence Number=SeqID_92690
atggactccttgaagcaaagttggtacattgatagcggttgctccaaacacatagcgagagattcatcaaaggttattcttatttctcccagaaattgtgaacatgtaacctatggaaacaacaacaaagaatcaaacaaggttacttcaacaaacattcaaaggttaagcattgcttccagattaattcaaggtcaagcaaacaagatcaagaaaaagataaggcctcaaacaatctcattggttgatcaagctttttgcctcaaaacacattgtttccaacatccaaggctctggtaa

SEQ ID NO: 1006 - DNA, 1405 bp, Glycine max
  Peptide Sequence Number=SeqID_92691
ccctagaccttcttctccaccacccacgaccaccggtgatcgccacgagttttcgttgcttgccgccaaaccaccgcatggagaggaacactttaatcagagcagaatcttcaaaactcaactcgaggattcggtagagaacgaagtctccaatcttgtctttgtggtttcttcaagagttatgggtagagccctaggagagaaggtaatcatgattcagatgaaactccctggcagcgaaggtccacagcatccgcacgtaggcaatagaaagttgccgatgttgctgaggatgctcctcacgtggatgacgcaaccattgattggaattgatagaaatgttcagaaattcgggaggcctgctattaagattgaagggttagtcgttgccacaagattaagtcctttgatcacatgttcattggacactggtgatcggggacttatatcgacttttatggagaggaaaggtcccatcgccctcgatgatgtggcctatttgcttcatctgcccatcataggcgcattccacagcttcgagactcttcatgtcgacaaagcggtattgatgttagaggagttacttgaagtcaatggagatgaagccatagttgagactggtgaaaactacacatggggagctactgccctagtgcatatgtacaataatttggatgatgcttgtaagagcggcgacagaaaacttgctggatatatcacactattacaagcttttacggatgaagactatgatgaaaggtcaccacatgcctaccactggacctctacgaaggcattaccaacgtcgacgtatcggaagcgtctatatcgaatgacgactgctgatgtttgttggatgccttatagtgaccaccgtgcagttaaagactttgacttgatttcatgtttttctggacatatccgttggtgtcctacgattcctccacactcttcgggttcaagattatgcttggaagatattgattatagatggatgcatttctcttactaccttacaccagtgggccaaatttgtgttgtgcctgaacaacgtgcaccagactacatggactggttctatatgatttcacatccattcatgaggctgacacagcctggggatccacccagacatccacctgtcatgcaagatgagacatatttcgaaccagatatgcctcagtactcggtggcggcaacaactatgaaggaaacacctagccatgcaccttctgatgtggagcatcctagacatgcagtgcggttgctcaacttaaggatagtgactaaaggcacaaaaacatacgatgtcatgcaagactggctaaggatcgctagaggtgtttctgtggatcgcaatgtatatgtgcggtcacgacgaaagcggcacacagatcacgcatga

SEQ ID NO: 1007 - DNA, 249 bp, Glycine max
  Peptide Sequence Number=SeqID_92692
atgacaacattgttaccacgagtccatgcagcttatgtaggatctattgtggttggcatcgggagggaaccatctatgaaggccaccttgttcttcaccgaaagagctctaccatcattgcacgactccatgtggtgtagttcttgtgatcaagaggctgggagaaagtacatgaagaaaggaagaaaagatattgaaaaagccttagaatttgtattgatcaacaacaagaagattacaagtgtctga

SEQ ID NO: 1008 - DNA, 588 bp, Glycine max
  Peptide Sequence Number=SeqID_92693
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggactttgtaaaaggattttacaaagagaaaggaaaatctcaagtgggttgcttgaggattggacgtaggcacaagggtgtggctgaaccagaatttgatcaaagtgctcaacaagaagaactcattaatgataaaaaaaaggttgaaatcattgagggtattaagaagaaaataagcaatcatgagaagatggtttccatgaaggccattgaaaacgaaatgcttcctaaggccattgaaagtattaacaagaatttcaatgtcgtagttcaggacttggcagagaccaagaatattgttaaggcactaaatgatcaattgactgttggggaggaggagaagaaagctcttgaattagaaagggataatttgctaaaagagaaagagatttgtcagatcaacaatcttccaaactacaagcagaattttccaattagaataaagcaataa

SEQ ID NO: 1009 - DNA, 336 bp, Glycine max
  Peptide Sequence Number=SeqID_92694
atgtttacctccacttttgttgattgtgcctctagttcgtgggttcgttgggaacggttaggtgcggtgaaggtaccggcgttgagcgttgcagtggtcgacgacaacaaacgaggttcgcagatggtgatggacgaagatgagtggatgtatgaaataatgtctgaacgagcggatatggattatgaaaatgcagaagcatgtggtgcgaatgaatcacatgttgattgttcagatgcgttcaacatttctcaggttataatgtgtttgagtgccgagaggatgttttgcggtgggctcgatccgtggctcatgaaaacagatttgtggcagtga

SEQ ID NO: 1010 - DNA, 813 bp, Glycine max
  Peptide Sequence Number=SeqID_92695
atggcggatgtacataggctgtctttggggtcagaagaagcagaacttgagacagagctgttgagattgcaaattctatatctgaagtttgcaataaattggagaggggcgcaaaggagaaactctgagctcttcttggtctatacgtcctgcaatgcatgtaaaaatggattaccttcggggcatgacttagaggaggttgctcaaactgctaaagagaatttgattgccatcaaggatgaacttcgtaataaccaaacaaaaaggtggcaagcaataggaacattgaagcatgtacctatgaagcatggacacaccagtcccttgccgtgtctagtgtccgacactagtccgtgtcgacacgacacccgtactacgttctatattttggacattacaggtgtccacgtgtccgtgccgtgtccggtgtccgtgtcggtgttgatcgctattttcatcgatcttgccaggaaggaaatgcacacagcaatctgcagtagtagatcaatagtaaaagatgccccaccgatagataacaaatcatttctggatacatcgttttggaataccgggatccttgagttggtggagttggttcaaagacctccacagggtggacctccttccctgcctgagcagagtgatgcgtctaattcggaagatttcacaatttcattggtggtaacagaaaagacaaactacactagagtgctgtcaaggaacagtttactgaaggcctacaatgaatggttgcttcctttgcgtaccttagtgacaggcataatggcagagagcaagagtgattatgattag

SEQ ID NO: 1011 - DNA, 228 bp, Glycine max
  Peptide Sequence Number=SeqID_92696
atgggcattcatttgactcatcagcttatggctaggtggggattgggaagtccttattgtactcattgtggtgatgcatgccctactaagcccataaggattggggctcttatccattggagagctcctagtgatagatgggtgactctaaattatgatggttcggttagaagtatagatggaatggctagttgtgtaggtcttgtgcatgactcctggggtggctga

SEQ ID NO: 1012 - DNA, 1011 bp, Glycine max
  Peptide Sequence Number=SeqID_92697
atggcagaatcgtcaaagaaacaaaagggatcatcctccaccaccaccgctgcagtccaccgccgccatggaacctccgaaaaccaaccagcaccaattcctccttctctttcatctccccggtcatccaccttgttttcctccgatgatcagtgtcagaggtactactctcaattttgcaatcgcgttattcttgaccctaagtacatagaccttgaattctttaatggtgaaacatttgattgctaccaagtgtttcaaaactctgaactgattgaattcatgtctctcaaattgccttattttcctaaattagttaaggtcttctataataattttaaaattcaggatgacgtcctttattctgaggtgcataaaattcctatcattgttgatcagtcctttttttattcactgactaaacttcccagtcaaggtgttccttttgagggcactcttgttgatgactggaaaattgattattcaagtcatgatgctcgaaaaatggtctgcaatgaccatgctgacatgaccggcaaattgcttgctgggtcatttacttttgagtgtcgcatcatgcactatattatttgtcgaattttgcttcctaggtccattaaccttgcccaagcctctaaggaggatttaatcttattgtgggctcttcaaactggttatcagatcgactgggctcatcttgttcagtaccaaatgcataaggcattacgggccaatgcacctctgccatatccctatcttgttaccttatttctccagcatttcaatgtccccttggatgatgaaccttttgccaaagttaaacgttctttctctattggtgctggtactgttacatcttttggttaccgaaaagacatggacggtcactgggtgcgcaatcaagacctatcgcctcctattcccgatgagcgtacatcgtctccaccaccgcaacatgatgtctcttcttctcttctgactgaagtcctcatcaagcttcgcgatctttga

SEQ ID NO: 1013 - DNA, 270 bp, Glycine max
  Peptide Sequence Number=SeqID_92698
atgtggtaccatgtcagtgaaaaacctcatcgggcgcctaaaaggagaccagtcagggtcacagtgttttgcgagaatgctccaaccatatgggatctgtcgcaacgtgcccttttgcgggcgagcgaggcgaggctcacgggtgcactttccaagggaggaaagatgcgcggagtcgccaccaacgtttatttgtggaaaatgtcagaaaatctgaaggaaaccggtcaaaatgaaatttctaagttcgggagttgtatttacgcttga

SEQ ID NO: 1014 - DNA, 867 bp, Glycine max
  Peptide Sequence Number=SeqID_92699
atggataatgaaaattttcaatccaaagctaatgaacctcaaatcaacgctgaaggctattctgaacttggtgaccaactcatgcaatgtagacattgtaatgcaaaaatgtgccaacataatggaattcagaggcacattgtttcaactttaagtcaaatgttggatcaacacaatgcccatgcaaaaagttttaggatggctagggatagattggcaaatagtcaagtagataatgtcagattaaaattggtagcagctcgtgaaacagatggtcatgtatacaatctaccaaatgttgctgaagttgttgctcttattgttggtgattttgatggaaactcaagaagagatattattgttgaaactcagaatggagaattacagagaatagatgaattacactctagatatctaggactgcagtaccctctactcttcccttatggtgaagatgggtatagacctgacatacttcaccgttctacatctgccaccaaaaaaaggaagagaaatcgtctaacaatgagagagtggtttgcttacagacttcagtccaggccaaacgaagcacaaactttgttgcattctaaaaaactattcctacaattcattgttgaagcatataccatggttgagtctgaaagacttagctacatcagacacaaccaaaagaaacttagagttgacaaatattccagcttacaaggatcattggatgctgggaccagcaaaggcttatctaaaggaaaaagagtaattttaccttcaatatttgttgggagtccacgctacatggatcaactgtattttgattgtatgacaatatgcagtcatgttggtttcccaaatctttttatcacttaa

SEQ ID NO: 1015 - DNA, 327 bp, Glycine max
  Peptide Sequence Number=SeqID_92700
atggcttcagagttatcgactgactcaacggacacaagcaccagttctaactcatcatcagctacaagcaaggacatgatagaagtgccctctttttaccaccaacaatgggcactagaataccctgagtttgtcaacttcagatatgatggaacaacataccaaatcaggctaagacagcatcgagcaaaaagactccccaactgtgccatcacacatgtaaatgccagcggtcaacatatgaccattctaagaagatttggacctccattacagtggaatgtcgtggtggttgacagtggagttgggcgcaaatatgtcgtataa

SEQ ID NO: 1016 - DNA, 261 bp, Glycine max
  Peptide Sequence Number=SeqID_92701
atggtcaaaaagggcgttgaagccttgggccattatggcttgatagcaaccctcttggttgaccacgatcctcatgaattgaccacgatcgtgagcactctggagtctggacatgtccctgctgctggagccagtgtcacgataaaacaatacattggtatggcttcaaaaagctctcgcacatctacgtccatgactcccaaagacctggagcagctaacacaaaaaattagggaccagttggaggagttcaatcactaa

SEQ ID NO: 1017 - DNA, 315 bp, Glycine max
  Peptide Sequence Number=SeqID_92702
atgtcatcctcaaataacagtaccaaaagctttatgatgatcaccagacacactttgtctccacaaccactactcatcaaattcaccaggctaggactaataaagcagacagaacatggagagaaggaacactatcagtcactcaaaattgttgcaaaaaacaacaaatcagatgcaatgataccattagaagttggtgaaccttttcttcaaaatgtgaacttcatggaagaagagaataatgagatgcttaaagaagcccttgatttggccgaagaaactatcaaggaagtccacatgagagctgagttatag

SEQ ID NO: 1018 - DNA, 255 bp, Glycine max
  Peptide Sequence Number=SeqID_92703
atggtacccaagaggaacgaaactgttgtgattctaggtattaccattgaagagaatgccaaacacattttcccaaaaaagtcattcatccctaaacaatgggtgaactttcaaggtctagaagaagaggacagagtcaatatcaaaggaactattgaaggaaatgaggtgatcatctctcacgcaaccaacgttgttgcatctggatgtgtagaagaaggtttggtgtttgagaaggactggaaaaggagataa

SEQ ID NO: 1019 - DNA, 210 bp, Glycine max
  Peptide Sequence Number=SeqID_92704
atggcggctcgtggcggccaccggtggtcgtgggtggtgaagaagatctcgcttaacaagcttggctcgctaagcgggagcccacttttctcactcagcgcacaaattctctgcactatggccactcaacgggccaattctcgctcagtgcaatttcctctcaggttggaattgcgcttagcatgcccttcgcgcttatcaagatattaa

SEQ ID NO: 1020 - DNA, 207 bp, Glycine max
  Peptide Sequence Number=SeqID_92705
atgtccgcggaacatttcttccgcgagtgtcaacggaagaagaactatggaagaaccttcttccgtggaactacgcggaagaacttcttccgcgagaatcaacggaaaaaggttcttccgtgggtaatcacagaagaagaaatgaagaacaaggccaaaggaaaaggcatggaggtcgccggaaaaggttctaccggtaagcgctag

SEQ ID NO: 1021 - DNA, 1032 bp, Glycine max
  misc_feature (956)..(956): n is a, c, g, or t
  Peptide Sequence Number=SeqID_92706
atggaggcaaaggcgaggaaggttgaaaggtcaaagggaagagaagtgagggaacttcttcttcctccttcgatttcttcttcttcttccacgacccaaagcttcttcaccttcgagttcttcttcttccgcgaccagagctccacgcgtccaacagtcttctccccgcgtccaggtcttcttctccgtgcgcgtcgtcctccattgttggcatttgaagctttgaaacattcgtgttatgccctacaggttgaagacgagctttcttccgcggaagactccaacggaagatggaagatatggcacttccgtgggattccgcggaagaaccatcttccgcgtgtgtcaaagacgttccatttccttctcgcggaagatggttcttccacaaactctcacggaagagccatatcttccatcttccgatggagtctgcggaagaaaggttcttccgtgggagtgtgtttccttcctgcggaagaaccttcttccgcaagcacaggtagaggtagaggacttagtcaggatgtggctgaggatgttcctcaccgtcgtaggcccactgcctcagcacgtaggcaacgggttacccagagagtcgaggatgttcctcagttgcctgaggatgttcctcagttggctgaggatgtgcctcatgtgtttgatggtagcccagagaggacaggagccgccgatggtgccgagtctgatcgagtggctagtaatgggacagctgctgatgatgaggggtttcccggtggaccacacgatccatctgttttgataggatttgctgatcatgtggcacacaacatatggagtggacagcgacccgatctcaagttggtctcccatggtaggaaagtagataaatttgggagaccggctgctaagatcgaatgtatgattgcggccaccagattggatccattgatcaggtgttctgtgatcaccantgatcctggactcatatctgcctttgttgagaggtggcatagggagacgagcagcttccacctcctagtaggggag

SEQ ID NO: 1022 - DNA, 744 bp, Glycine max
  Peptide Sequence Number=SeqID_92707
atgtcatggataaatataaaaggagctgctcccctcaccccaaaaatgaatttcaatcaacatatgggactccaagttgatggtgttaggagcaataggtggcagtgctggtggctggccctaacctggtccatttggaagacaaggaatagtatagtattctctaatgcctctttcgatgcaaacaaagtctttgaagatgcaattttcattctttggacctggcttaggaattatgagaaaggcttcacagaacattttaattactggtccagcaatattagacaatctttttgtactactagagagcattcacgaaacgcacaagtaatcacagtcaccgaaagaaatagctcaaacaaaagcaaaacagaagagcacgtcgagttaccgtctccggcggcggtgcagacagaactgtggcggacgtcgacggctgaagcggcgaatcacatttcctctcccatgggctctccatctcgtgtaatggggagaagcgattgcgggccgttgattgtggatacagctggtttgggaaagtggatggtctgctgtgctgtatggtctggtcaagttgcgtatcatgctgatactgcactgcgtcaggtttcacggggcaatcggtgcgtggcattgcctctctcactctcagtggaggggcagtttagtttcacccatgagacgctcacacgtgttctcataataagtgtagtgttaaaaggtctttctaacctgtgtaaatag

SEQ ID NO: 1023 - DNA, 4935 bp, Glycine max
  Peptide Sequence Number=SeqID_92708
atggagagcccatgggagaggaaatgtgattcgccgcttcagccgtcgacgtccgccacagttctgtctgcaccgccgccggagacggtccaaagaatgaaaattgcatcttcaaagactttgtttgcatcgaaagaggcattagagaatactatactattccttgtcttccaaatggaccaggagataaacacaagctattgtctttatccacaagttgctcatggtttaagatcaaaatttgttggagggaagcaaggccatgtttaccaaagctttccccactcaactgcccatggatcaggccaagccgataccagaaattcatttctgtctctcctttatggtcctccatccttgttacagcatgagtttcgggatttatctgatcgaaagctttgcttctcatctggtgattgtactgctgctattgggaattctgttgttggttccatagaaagtggaaccttccaaacttctggtgtgggggcaatggttggtctgaataatagtaataattttgtcttccacgatattcagagtagcaatactgctattcagcccccaattcctggtagtgagaaagctagggagtctttttcttctccaggtcagtgccaaggtacaatcccggcatctagtctaaatgtttgctgctcagatattcaaactacacaaactattgctttagaaccaagctcatctaagtatgcaactccttttatgagtgggtgtcctcgtgtgttctgcatgggaaaaagtggccatcttcttcttagcaatacagggcttcttggtattgtttgttcatgccattgttgccacatgtctgttcttaagttttgtgagcattcagggttacatggcattgacccaggggaggctgttcgtatggaaagtggggagactatttctcaatggcagaagctatacttcttgaagtttgggattaggtctctggggaatgagaatgaatgggactggccagacgtattatcaacaagaggaagtctgatgagatccaattcatctgcatttgatatgtccaagactaatttgtcgcatatgttgagttcgtctgcagtcatgtcaagaaaacaagcgacaacaatccaggatggttgcaacattccactcaaaggttttacttgtatttcacaaaacagcttgtatgatcagttgaaaaaccagttaatggtgtctaatctagctatgtatacaactgcaccaaacttcattggaactcaactggatgatggttgtcagcctatacctccttcctttgattctctaaaaaggaaaagaaatttgtctagtgcccactctcctttgcaaacttcaacaagccttttgaaagaccatgattgcatcaaaaagaagaatgctagtgatggtcttgtaggcagggatgcagcttcttccaatattgatcttaggcttggtcaaccacctcagacaggaaatccacttccatcatttgtagagccaccgctttttaatgcccttgccagtcctcctaaatcacaacctctgaagcagatgattactagtgcgttgaaccaatatgttgtcttagctgattacctcagcagggaggaggaattacagaataattttagctatgctgctggttcaatcaaaatggttgaagaaatgcctcagcttaaactcaagaaatatatgtctgctgtggttaatgcttctgctagagctagatcagaaactaaaaatgtggccaagggtttatccttttcaccatttctgcaatttgataatcaatatgggggaaagacaaaaactagtgaaaatttgtggaatgatggcagccctatcatgcccaagaaactgtattctgattacggccacacaggaagacaatcaaccaattcgggcataaggaccaataaatgtttgaacaatgataaaggggtgaactttgctaaagactctggtgttaaaataaattctggttttggtattggtcagttaatgaaatacccaagctccatcaagagagctgttggtggtagtgatatttcggttgttaatggaaagatacatgaattgaatcatgaatcaagcttgccatcagatacatctgtgtgtgcagatattttgcgtggttcaaacaatgtatcttttcttggactagaaaatcatactccagaaacatccatttcatttaaagggattttgaaaggcctttcccatcatgtttcaagttctgtgtcaaatcagactcctactttgccacagcagcagcagggcattaatatggattcttgtttgcttgatgaaaacttgaggttgcttgcattgacacagatactggagttatctaaacaacagcatgcattgtattttaataatatgaatcagaagcaagggggatccaacagtatttcaaaagtccagcattatatgtatgaggcttcaacatctgagcagggaacttctggtatgaacagctattgtcatttgtctggcctatcaccaagacctttacattctaaagaaaaggaatcacaatgtaatcattcttatgatcttcaaaatgaagagacttctttaagccttggtataaacaaagacaataccagatcaagtgtatttgaaaaatgctctgagcaaccatcaaatatatgtttcggaggcaagtacacttgtgctgctcagattaactgttgcaagagcaattttttctcaggaattgaacccctttgttatatcataaagcaaaaacttgctaatgccagtggtgaaacttctttgaagatggcttcagatttgagtagagatatgaatagtttcaagggcgaaaatattgagcaaggtgggaagttagatggccaagactcgatcaaaattggctttcgtacacctcaatggagagatgtgccaagtaaggtcaggaaagcagtttgtgatgcaacatctttaggtcagacagctactggtatggattgggaaggacaagacagtgttcaacttggaaacatttctatgaaacgcttcaaaagaactattgacatgggagatatgtcaaaagagcaagaaaattctaatgtttcttctggatgctctgctcctgtggttactcaggcatctttggaggtcaacaaaattgaaccctgcatgggtgatgctgtagacactggctttgtcaacaaccttgtagttgatgaagggtcaggtattgataaaggctggtcgtcagatttggttgaaaaaagtgatgagtttctaggctcatcctctgggagttgcttgaaaaatgattatctgagagtcttaaatgatcaaccatgttgcaatctccttgatgaccttaaactgttagattccttgatatggaagaaaggatggaatcaaaataattttgtgctttcttctaattgtaaaagcaatcaatctcaaaaagtcaagaagggccttaaaggaaaaaagcgaaagagaaatttggtgaggattctagatgcttcattatcttctgaattcccttccttattgcataaaaagaatgaagaagttactggaatatgtaattcctcttctagttgttcaaaagaaatgcaaatgcgccctttatctagcctgcaaaaatcatctaacaagtcttcctttgttcaacctagtaacaaacaaaaacatactgcattttcatccaaatttctttcttgtaagaatcatctgaacaagcatcaaagttacaaagttggctacgagtcagaatcaagttctgatgctgagtttcgcacattgcctggagtttctggatcaaagaaattaaaaaaggatctcacttctgattgttttgagcagtttcaaatgcaagaaccagcctatgaggaacctgaaaatgataagctgaggccattctcttgcaggaaggaaaatgctcatagaatcacaaggccagtagtatgtggaaaatatggtgaaatatctagcgggcatttggctagagaggtgcaaaaaccagtaaaaattgtctctctcaggaaggttcttaaatcttccaaaagatgtacgggtcatacaaatggaaagcctataccaacttcaaaaaagaaatggaagagattgagcattggaacaagtagtggacattgctgtgggaaccctgatttggatagaggtggcaagccacctgtcgtttacaaagggaagagagatgccaaagctaagcagggtaatagtgttggaaatagagcttatgtttcattgaaggtgaagaacaaggaaattcggaaacagcgtagcattactgaactcactgctaaagagagttattttactgagaaatgcctcctcacgatggtttgtaaatgcatgccagaaaccaaagtgatggatatgatgaatagtgctcaagatcaggagcctggtggagccatgactcgagcaataatgagtcacacaattgtcaagagcctcctgaaagtgtggaatggtgagaaagatggcatgccaaagaatacaacttcacatgaagtttttgaaaaggaaatagatgcatttctatcctcaaaagatgggcaagaagttgatcaagaaagtgttttgaagcccaaaattgttgatacatcaacagatctgatgaaagttaccaatcacatacaacacaccccaacctctgtttctaatttcaaggtacataacagtattacagaagcagttcttgatccaactgttaaacaatggattcatatggtttgtggtctttggactcctggaacaagatgccccaatgttgacaccatgagtgcttttgatgtatctggtgtttcgcgtccaagagcagatgtgtgcaggattgctgattgctctatcaagtttcatccttggtgtgctcatcaaaaggttgatgcttccctcccactagatgtgcctaaggacatttccaaggtctcagtatcagatttagagaactga

SEQ ID NO: 1024 - DNA, 186 bp, Glycine max
  Peptide Sequence Number=SeqID_92709
atgaaggaatacacaaggagatgcaaaagtttagcaaagggaaacttcatcaaggcagacttaccacacttcattcctcacaagggaccagttaccagagtcatgagcaaaaggctccaagaggattgggctagagctgttgaagaaggtcctaaggttctcatgaacctcagggtagatttttga

SEQ ID NO: 1025 - DNA, 236 bp, Glycine max
  Peptide Sequence Number=SeqID_92710
atggggtgcatagcttcaacaaagaaggggtgcagagcttcgatggagaagaggcgggagagaggaagggagattcaagtgagaagggagctaggttcgagtagtgagagcgatgctcgccctggcgagctgatgcttagctctaaaggaatgagcttgcctaggcaagctggttgcttaggcacgaagctatttcatggcccaggcaagccagatgctagcttgagcgagctagg

SEQ ID NO: 1026 - DNA, 429 bp, Glycine max
  Peptide Sequence Number=SeqID_92711
atgaaggccgacatggaggccatgaaagagaaaatgaccacaatgatggaagccatgatgagtatgagaaaaatgatggaggtcaacacagctatagtcgttatcgcaagtactgccactaaggtggacccgactcacccatctggcctcaatcaagtaaatcgtccagtctcagatatggtaggtcagggaggcagagcattgggatgtacgggcagcccccattttgtacaggtccagagcaagcattccttcccagcatatggcttgcctcccaactatacaccacccaatgttgcatacgctcctaatgagaatgtcgataactccactcccatacccattgaaagccaaccaccccaatctggtcatgcacaggtccctcaacccatggggagacacatgaagtaccctgagaccatactctag

SEQ ID NO: 1027 - DNA, 510 bp, Glycine max
  Peptide Sequence Number=SeqID_92712
atgttctacggcctcgttgctgcctcctcggtgtcgctacctgttcgtcgtcactatgtcatcgtcgtggctggctcattactgcatcatcatcatcgttgcctcatcactgccttgttgtcaaagcaagagtctagtcctgtttgggtgtcatccttaaaacccactgtttgggcgtcgtccctaaacctcgtcatggaaaggagttcctcatcgtacacctcggaggctcgaagtcacgtgatgtgtttgtgtaacatagaggctccactggtgacatcgtggactgagtataatctagggagacatttttatgcttttggtcaatacaaggttacaggtaggaaagagtgtaattattttgagtggcacgatccagttgccaatagtcttcagaagaggatcattgtagcattgatgaagaaggttgatgaattgaacttgagggaaaaggatttgcaaaccaagatcagtgacatgaagatgaagggaaattttttagggatttga

SEQ ID NO: 1028 - DNA, 687 bp, Glycine max
  Peptide Sequence Number=SeqID_92713
atggccacgaaaaccgcgaagctctaccgcagggtgcggcaacggcattggggcaagtgggtcaccgaaatcagtctccccaagaaccgcacgcgtctttggctcggaacattcgacaccatagaggaagcagcattagtgtacgacaacactgcgtttaagctcagaggcaagtttgcgcgtctcaatttccctcatctacgacaccacgaagcgtttgttttcggtgagttcgaagattacaggcctctaccttcttccgtggattcgaagctgcaagctatttgcaaaagcttggtgaaacaagaggaaaagtcgtgttgctttgtcaaagacgtgaagcctgttatacacgctactgagctagcagaggtggagtctggcgtggcaaaattgaacgttgaatatgtttatcctgagtttgaggattttaaggtcgagaacgagaacccaatgttgccctccaattccctagtattgtcagtagccaaaattgccaaaaagatgaagctaaaatttactaaagcatggattgcatatcttagattgcctcttccaattgatgtttacaaagaggtaatccacaaatgtctcaaggttgtcatgagatccaatgtaggagcggaaggggggaagaaacacaaatggtggaattatagcatgggttgtaagatcctagtagaatag

SEQ ID NO: 1029 - DNA, 132 bp, Glycine max
  Peptide Sequence Number=SeqID_92714
atgatttttggtggcttccagggttgggtaataattcgcgatacaattcccttaatagaatcagctagacctctaacagcacagctgaagtgggatgcaagagtgatagaaattgaaagtgatagtgattag

SEQ ID NO: 1030 - DNA, 279 bp, Glycine max
  Peptide Sequence Number=SeqID_92715
atgttggcttggtgttgcagctcatcccaggagaacgtgaaagagagagaaagacatctcagcttttcagagagaaagataaagatgcattggtcacttggttcggtccgagtcaacaccgggttactacgagtcaaagatgaacctattaaacctcctccgatccccaggtccccattgcttgtgaatttccaattggacaagagcaacttgcttcaatttcaagggaacatgacactactgctctgcaataatatggaaggctatgtttgccaataa

SEQ ID NO: 1031 - DNA, 516 bp, Glycine max
  Peptide Sequence Number=SeqID_92716
atgaagccaaggttcgatggttcatccaacgaagcaccttccttcaataaagagttgaagagaagcttcacaagtgagagaaccacactagtgggaaagaaaagtcatgaagaaaataaatccaagcaaggcacattgtttagaaataacaagttcatggggcatgcaagcgtgcctcttgtgtcacagccagctgagaaagaaagccttcttgtggaatctaacgatgatgatgacgacgatgacatagaaaccgaggaccaagacgttgaaggaggaagaaccgttgctcagaacaatgacaagggaaaatgtccacttgttattggtggagaaagttcaaaaatagatggtgatgaaggaccagatgtggataagaaggtcgatgagttcattgctaagagaattgagtcaatcaagaggagtagaaggagtgcaagaaactcttcaagcacaacctgcatttcaaagatacctttaggggaggactattcacagatactcattagatgttag

SEQ ID NO: 1032 - DNA, 432 bp, Glycine max
  Peptide Sequence Number=SeqID_92717
atgattttgtttgtgtgtttgtggcgtttgaggagtgaaggacacacctttcacatgcactttggttacatcagacgccactttttgttgtcagatgagccccagataccattgattaccgtagaggcactcgttacgtatcatgttcctttcgagtgtactcctcggtgtgacattaaccatattattatctacttaggatttgagcggtcacacaacccactatggttcatgcgacacttctttgagcatgatgttaatgggagggtcaccatatctaccttttgtcagtatatgatcgttaaagtctatgcggatgttggagattttattgatgatgaggatctcacgtcattcgagattgttttctaccagggtgtatgtgatgaagagatatccaaggaagagatgattttgtctgacaaggaatga

SEQ ID NO: 1033 - DNA, 561 bp, Glycine max
  Peptide Sequence Number=SeqID_92718
atgactaaagatggagggtttcccctaagggataggcccaggctttggatagctctgagactcggtgtgtctttcctttctacttcctcctccttatataggctccagttatcaccaaacttttcacagtactaccaaatgactcttttggatgagccaggagacatgggtcatctagaagagagaggagagttgttgcctgatgtgaagccacaatttttagaaaaaggatttaactttgtagctttcaaagtttgtgaggagatcatggagttcctcatagccaatggggtttttgcgtgtgcaaagagcagtagtgatctctttgtagttaggctcgggtccattgaaagtatgaatgatagggtcatcatcatccaaaaatggagaggtgtcccatgcttgtttggaggtcaagacattgccaaacatggtaaccacattctaatccacagaagagatgatgacttgcatgatgaggtggtcttatcgtctccactagcgaaagtcttgatgattggctgcggggcatgtgtttgtgcaatcaataaactcaactaa

SEQ ID NO: 1034 - DNA, 606 bp, Glycine max
  Peptide Sequence Number=SeqID_92719
atggctacaccaatgagtactgcttgctatttggataaaaatgaaactcgtcagtcaaagacattaagcaatatcgagaatcatcgaagaagtgcaaaggatcttcctccaccaccgccgctgctggccaccgtcgccacgaactttctagagcacccacaacacctattcctccttccctttcatctccatgatcatctaccttgttttcttcagatgatcaatgccaaagttagagtcttctataataacttgaaaatacaggatggtgttattttctctgaggtgcatcatgttccaattgttgttgatcaatctttgttcttttcattgacaaaattacccagtcaaggtgttccttttgaaggcacccttgttaatgactggaagtttgatttttctagtcatgatgttcgccgcatggtctgcactgaccaggctaatatgaccggcaaattgcttgctggatcattaacttttgaatgtcgcatcatgcattatataattttttgtattttgcttccacaatcctcaaaccttgctcaagcctctgaggaggatttgattcttatgtgggcttttcaaaccggtcatcagatcaactaa

SEQ ID NO: 1035 - DNA, 471 bp, Glycine max
  Peptide Sequence Number=SeqID_92720
atggggaagaagcagaacgagatccagaaaacggggttaggtcgagtcctgctgtctcgcttctataggaagaagttccttgaatccttcaccgaagtctccgacatcgacgccgtcgtcgagcaatccctagaacccctccccaaactcgccgctgccgcttcaaccactcttatcagccttagtgaaccaggttccgtgcctgatgaaacgacgacaccagaagaagcgaggaagcagcagaagcaagaggaggcgctccacgccagcaacctccgcgttcctcgccacccactgtggactcccaacatgtccgctgatgagctgaatgccagcgaaacgcaagttttcttgacctggcgccgcagcttggcgagatcgaaccctgtcatcaaatctgcttctgcggacttttggttaattatacttgaggaatctcacgctagttgttgtgctgtcaacgttaactga

SEQ ID NO: 1036 - DNA, 1272 bp, Glycine max
  Peptide Sequence Number=SeqID_92721
ggcgcgtcaccgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggattcccacaagcagccatttgcagtgacgtatcttggagcttctcttatggtagtttacctcccagtagcattcattaaggactggttgtataagttatttaaacactgctcttctaaaagtggaagaagtgcaaaagttggggatgatttttctgtcacgtgtacctctcctctcaagggcaatggagtgcaaaaaaccactgaagtagaattagggagcatgactcgaaaagatagtgatgcaaacctttcagtacaagaacaagtaaagccattggtggctaaatataatgatgctactgctataaaggccgagaaagaacttactacaagggaaattgctacttatggattttacattgcacctatctggtttataactgagtatctatcaaatgctgcccttgcacgaacaagcgttgcaagtacaacagtattgtcatctacttcaggactcttcactctcttcattggtgtgtttttgggccaagacaatttaaatgtatcaaaagtagttgctgtcttggtcagcatgtctggggttgtgatgacaactctggggaaaacatgggctgcagatgatgcgctatcaagtgcttccaatggacagcgctctcttgttggagatctttttggccttctctcggccatgtcatatggtctatttacagtgcttcttaaaaaaatttctggtgaaggaggagaacgggttgatgtgcaaaagctgtttggatatgttggattgtttacacttgtagcactatggtggcttatctggccattgtcagccttaggaattgaaccaaagtttacaattccccattcagctagagtggacgaagtggttcttgccaatggatttgttggtagtgttctctcagactacttctgggcactttgtgttgtatggacaacccccctagtggccactttgggcatgtcactcaccattcctcttgctatgttggctgacatggtgatccatggccggcattattcggcgttgtacattcttggctcagttcaggtattgttatggctaaagatgtctgcaactttgatattttctcagctctcctacagtactgtcggcccatga

SEQ ID NO: 1037 - DNA, 666 bp, Glycine max
  Peptide Sequence Number=SeqID_92722
atggggtggagatacaaggcagggttgttcctcatacttactgtggttgtcatatgggtcacctctgctgaagtcacccaggatatttttatagattacaagcagccatttgcagtgacgtatcttggagcttctcttatggtagtttacctcccagtagcattcattaaggactggttgtataagttatttaaacactgctcttctaaaagtggaagaagtgcaaaagttggggatgatttttctgtcacgtgtacctctcctctcaagggcaatggagtgcaaaaaaccactgaagtagaattagggagcatgactcgaaaagatagtgatgcaaacctttcagtacaagaacaagtaaagccattggtggctaaatataatgatgctactgctataaaggccgagaaagaacttactacaagggaaattgctacttatggattttacattgcacctatctggtttataactgagtatctatcaaatgctgcccttgcacgaacaagcgttgcaagtacaacagtattgtcatctacttcaggactcttcactctcttcggtaccgagctcgaattcgtaatcatggtcatagctgtttcctgtgtgaaattgttatccgctcacaattccacacaacatacgagccggaagcataaagtgtaa

SEQ ID NO: 1038 - DNA, 1875 bp, Glycine max
  Peptide Sequence Number=SeqID_92723
atgtatattttggttgacaacagaccatggttgttgagtgaccttggttcacggggagtacacatttggcaattgatggttactaagtcaaggctatctccctttgcatattccaaagctcgaagagagaggaaggaaggcaaggagatttgtcctcaatcaagttcaagtaaaccaaagaaatttatgagatggttcccgttgattgaagcagtgatgttatcaagaaagaaagttttgcttcctgtgaaaaacctgaggaattctttacaattgagcagtgaattgcatagaactctgtatggctttattgtatttgaagttgcatgggctggtgttcgtggtattaactactataatgaacttcagactgatacatcactagctatagaagctaaactgatgaaaagatgggaatttgacagtatagctcaagctgcaggctgtatgtcttcatggttctcaggaacaccttctgaacagctgcttctgaaagaacatctggattccgcctcaggggacatattttatgatgctagtgaagatttttctggcactgtatctgttgatgatggtgatgataatatctgcagaattttgactgttgaagatagtttgggtaccaatgttggagtatatactgatgatacagaagaaacaacagacatgctacatgcacctcctccttctggaccgaataagagaagaaaattaatgaattcctttagtgctggagttgaagttgatagctactcgacagctgaaattgataactcattggattattctcagacctctagctgtgtttctgatgatacagttgaaaccactcaagatgatacacttgaaaccactcaagatgatatagttgaaactactcaagatgatacagttgaagcaacacaatatagtgatgttctactgtcatttaggtttgatgatcatgaccttccatttaaattcagggaagtcatagtatctgatctgcgattgcttactttgttggaggctggtcttccatcttgggtcatcttccttcagtcatatccagtgttatgcaatctttatcgtccttggatgtgcccacttgcaagacttttatattttttgatctcatttgttactgtcctcattggattctatgatttatacaaaaatgttcctgttctcaaggcaactgcatctcgtttatgtgggcctcttcttgattggattgaaacttgggagatggtttcaagggtcaaatacttaggcacaatgctgtttctacataacttccagaaggctgttaggtggtttcttgcctttacacataccatgagatcatttttttccattcttgttcaacctcttgtagagtcactggtggagatttttggatttcttctcccaagcttgaagtttttgtttgaattagcagaaagcatcttttctgtcatttggctcgtagtggatacttcttttgatatagtgggaaatgtactggagctactcttttcaccattgtggtttgtcctcaatgttgtttggagcattgctacttgtatcttatatcctctattttgggttctttgggaattactatatgctcctgttcgtcttgttctggtgatattcagttttgtggcttccataagttcatacatttgtaatacgcttggcaacacatggcagtttgttagcagcattttccagtttgcagcgtcttctgaagcaacagtcagtgtttctgaagtttctatgtggcaaagaactctttggaatgaccttttttcccaggttattttccgtgctctcaagagcatactctatgggtttgctgccttcttcacagcttgcaacaggcatcgtctaagcttaaaagacagtgcttag

SEQ ID NO: 1039 - DNA, 171 bp, Glycine max
  Peptide Sequence Number=SeqID_92724
atgaggccaccagtgaagcaggtcgaacctactggtgggactgtgtcaccgtctgctgtcgttcctcttggtagagaagggagtcaacttgtagttgaggttggccctattgttggtgttgctaaggcctcccccagtgtttcttcctctattttcgttaataggaaatga

SEQ ID NO: 1040 - DNA, 258 bp, Glycine max
  Peptide Sequence Number=SeqID_92725
atggagaccgcaggtaacaacgctgaaagcgttaaatggggacaacaggcttataaaaacctacaaagagatttaaaaaatctatccaaagatcatttaaagcttgagaaaacccttcaggatcaagtagatgactcattggacgagtccgctcgatcatgtaaagcttatgaagctcttaaagaaaaggagtccaagtcatgcattgagatagagacaaatgccaacgaaaaagctacccttcttaaaaacttttag

SEQ ID NO: 1041 - DNA, 762 bp, Glycine max
  Peptide Sequence Number=SeqID_92726
atggggggcacacatgaaataccccaccacaatctagccaacttcgagccttgcctcgaatacgccattgaagggcaagtagttggtggtgtacccctaccaaacactttggagggccctcagtttttcccacaaacacaacccttgcattttgcagtgggaagagccctttctgctatgcctgaaaaagaaaagttggatcaaatagaggaaaggctaagggtcgttgaaggaggcaaagattattcccttgctaacatggaagatttttgcctagtacccgacgtggtcattcctctgaagttcaaggtactggacttcaataaatacaaggggacaacttgcctcaagaatcacctaaaggttatcagtggcaccctaatggcgaaaagggagatgataacgtccaaaggtgcaagaatctttcaaagaatacgtccgaaggtggagggatctggcatcccaagtggcacccccaatgacgaaaaaggagatgataacaacgatagtagacactctactggtgttctactacgagaaaatggtgggatcgaagtgggtctgagaagaggcaaatttgatcaccctactttgatgaatgagaaaactggggcaaatagagagaaagagatggagggaggaacccatgttgtggttatcgttcctacatggccaaattttccaccaacccaacaatgtcattactcagccaatatcatcccttctcattacccaccacccaatcaaccacgaaggcactag

SEQ ID NO: 1042 - DNA, 549 bp, Glycine max
  Peptide Sequence Number=SeqID_92727
atgttcatatttggcaataagtgcatagatgagaggccttctcaaagagtcaacatcgtgctttctcataaggctaaagccctttggactcaaagtcctctatctttatctttcataggactcaaagtcttctgtcatatttgcttctcagaggctattgaagtctcctttgccaacaagagacaagtgagtctgttggcacgtggagacaaattatggtcatccgctcccctttgccttccaaagacaagcgagtttgttggcacacggagacaaatcatggtcttccgcttttcattgttttcaagaccattgaagtctcccttgccaaccagggaccagggagtccgttggcatggggagacaaatcatggtcttccgcttttcattgttttcaagactattgaagtctcccttgccaaccagagacaagcaagtccgttggcacgcggagaccatcatggtcatccgcaccctttaccatccagagacaatcaagtccgatggcatacagagaccataatgtctttatttacatttcgaagatga

SEQ ID NO: 1043 - DNA, 1197 bp, Glycine max
  Peptide Sequence Number=SeqID_92728
atgcgagctatacaaggagctctaatcgtagcctcaagcattcagatagtcctgggttacagccaagtatggggtctcttctcaagatttttcagtcctcttggcatggcacctgtagttggattggttggattagggttaattcaacaaggatttcctgcgttggggaactgtgtagaaattggcataccaatgctgttgttggttgttgggttgtcacaatatctaaagcatgtgagaccgtttagagacactcctatctttgaacgtttcccagttttgatttgtgtcacaatcgtttggatatactctgtcattttgactgccagtggagcttatcggcatagacccaccataacacagaacagttgtcgcacagacagagctaatctaatatctactgccccatggttcatgttcccataccctctccaatggggtccaccaacattttctgctggtcattcatttgcaatgatgtctgcagttattgtatcaatggtggagtctactggtgcatataaggcagcatctcgtttggcaattgccactccacctcctgcttatgtgttgagtcgaggcatcggttggcagggaattggtatcttacttgacggtctctatggaacagggacgggttcgactgtttctgtggaaaatgcgggactccttggcctaacccgagttggaagtcgccgagttgttcaaatttctgctggttttatgatattcttctctactttaggaaagtttggagctgtgtttgcatccatacccttcccaatatttgctgcattgtactgtgttctctttggccttgttgctgcagttggcatatcatttcttcagttcacaaacatgaactctatgagaaaccttattatcacagggctcacactgttccttggaatatctgttcctcaatttttcagtcaatattggaccagttcacatcatggtcctgttcatactaatgctggatggttcaatgctttcttgaacaccatattctcatcgccggcaacagtaggtttgattgtggcagtgttccttgacaacactctggaggtcgaaaggtcaaaaaaagaccgagggatgccatggtgggtgaagtttagaacatttagaggagataacagaaatgaagaattctatactttgccgttcaatctcaacaggttcttcccacctacttga

SEQ ID NO: 1044 - DNA, 330 bp, Glycine max
  Peptide Sequence Number=SeqID_92729
atgggaattgctttgtgcacccaacaacatttcaaaattctgaaagtaccccttcctgctaacttcttcttctttgttttccttcttcatgcggcattcattctcgtgagaggtggtggtccattgttgtgtccgtttggtcatgacaatttggttacaacagttcattggcaagtggtgattgtgatggtggttggtgtggctgttaacggcggagttcattggcaagtggtgattgtgatggtggttggtgcggctgttaacggcgaaggtacgattttgtttttctgcaacttcgatgtagtgtatacggatttgcaacctgtataa

SEQ ID NO: 1045 - DNA, 339 bp, Glycine max
  Peptide Sequence Number=SeqID_92730
atgtgtacctgtgccaagtctggaattgttaagccaaggcttaatccaacattacttctcactcaccttgaacccaaaaccatcaaatctgccctttcaaacctaacttggcttgcagcaatgaaggtcgagtatgatgcactgctcagaaatggcacttggatcttagttgacttgcccctggacccccttccaggaaaggcattggctgcaacagctggatgtcaacaatgctttcctcaatggaattcttcaagaggaattcatgactcaacctccaggctgagtcctccaacaaacagcttgtgtgaagacttcacaaagccattaatggcttaa

SEQ ID NO: 1046 - DNA, 2056 bp, Glycine max
  Peptide Sequence Number=SeqID_92731
gctggctaaacagctataccatgatgcaccacctgtggttcctcgtgtcgctgtcggtgatgtcgctgctggtacctggcgcgttctatcagtggagcgcccgtcagctgggcaaaatgtcgttgccaatgctgatcgccacgctggccgcggtgaatttgtcgagctcatcccggtgaccgcacgcttcctcgtctactacaccgccggttttgcgttatacgtcaaccgcgagaaaattgcccggtacgccaacagtaaactgatgaatggctggctggtggccgcgctggtgctggcggtgtgggccgcctgctatgtcgtcgcgcacaaccacatcaccggggtgatgaaatatgtgccggtgatgctgggcagcgtgctgtcggtgatgctgtcctactggctggtgtttagcttcgaacgcatcaacgtgaaagagagtcgcattctgacagcgattgtggattccgcgctgattatctatttgctgcactatccggtggtgatcattttctcatggctgctggatgtctggttaccggataacctgtcagtcctgtatgtcctgatcgattttgccctcggcattgcgctgagcgcggtgtgttacgctatcgtcaaacgttcacgcttcgcctcgattcatgccgttagcgcaattcctaaagcttatcgccgtcatcacaattccttaagtcaaactagacgttttaagctgatcgcgggcttaatgctgcctgccacaccggtatcggcggtggtattaacacctttcacccccgagcgcaacgacaataaagttggcgcttattgcttatgtaatggttccacccagacgctaagcggcgtgccgcgctttaccgctggagaaagtggcatgagcagcgtcacgctgggtgaactacaaaaggttgggcgtattattaatgacaatttaatcggcgagccccgcctgcaactcggcgcacaaaattacgctattggtattccggatgaagaaacaggcagttatcgtgtctatcaggtttataatagtgcggaaatgattgcaccggcggaaattaatggcgctacggtagtgccagattattatgatgtgaacgataaacaatatattgatgcgcgcgtggcgacagtcactaatggccggttaaatatcaatattggtcagcaaggcgcagccgctaacgccagcaccaatcgctggtcaatggctgccaaacagagtcagttatttgccagcagtaataacggccatattaactgggacagcaataaccgtatccgctttaccgccgccacgccgccgtacggtggcgatcggctggcatttgatgccggaggcgtggtgacctacgccggtctgtttgatgtcacgcttaaggatggcagcagcaacgcgtactacgtcagtaatctcaatgaattgcgtaactataacgactggctgattgaccagattagcggcggcaacctgagcccggaaagttataacgccgcgctgaaccaggcgttcagcctgcgcgacggtcgtgtggtttaccgcatgagcaccggtaattacgatgatgaagtggctgccgcactcggcgatcaggtggtgctgagtgccgatggcgcgaaagccagtgtgaaaatcaatcgcggcaaaacgctggaagtggccaacagcgccagcgccgtgatgcgcgccagcaatggtgcaacggcgattatcgccggaaaactggcgaccagtaacgcgctctcatccgaagcgggcgcgctggagctgatcagcggcgcgcgcggtatcaataatggcgtcatcaacagcggttttttcaacgccgccaatggacgcggcgtggcggaggattctctcggctatgcgggcacagcggtgtcggcgatttatgacagtgagttccgcaacaatggcgtgctcaatgtgcatatcggtgatgcgccgtggggtaccgccggcttatttctcggcagcagcagcgcggtcaaccacggcaatattaacatcggcattcacgatgtggcgaacggctcctcagcagcagcg

SEQ ID NO: 1047 - DNA, 1011 bp, Glycine max
  Peptide Sequence Number=SeqID_92732
cgccacgaacaggatgcatgccgtaacgccatcccgatttatctcttcctgtttaccgtcagcgattacgacagcattgatcgctccgctacattcgcgttgccagcgctcggaagcgctggtgaacctgcactcgcatctttgccagcaaaggcatggccgccatcagcaacgcgatttctgagtgtggttcagccaggcgcgaaagtgcgtttcggcatcacgacgcagtttgttgatggcgatgatgaagcggcgatggccgccgcgctgcccggtgccagcctgctctatctggaaagtccctccagctgggtgatgagtgaacagaacctgcggcagctggccacgctggcgcgcgatgcgggcgtcgtcacgttgattgataacagctgggcttcgcccattttccagcagccgttactgtgtggtatcgacatcgtggtgcactccgcctcgaagtacatcagcggccacagcgatgtggtggccggcctggtgattgccagccaccagcacatcaacaacattgcccgtcacattagcccgttccttggcggcaaactgtctgcgaacgaagcgtctttgctgatgcgtggcctgcgcacgctgccgctgcgcatgaagcagcatcagcacagcgccctgcagctggcggaaaagctgcgtgatcatccgcaggtcagcgcggtttgccaccccgggctcaatccccctacatggtccacgctgcgcggttacagcgggctgttttcctttgccgtgaccgaacaggtcgacataccgcaattctgcaacgccctgcaactgttccacatgggcgtcagctggggaggtttcgagagcctggtgatgccggcgatttcggttattaatcaggccagtgaatttaattcagcccaggattttggtgtctcgccgcgcctgatccgtatctctgttggcctcgaagagaccgacgatctttggaccgatctgaatcaggcacttgctgccgccactcaccgttaa

SEQ ID NO: 1048 - DNA, 303 bp, Glycine max
  Peptide Sequence Number=SeqID_92733
atgtcgcccccgtgtggcgacatggatggggttgaaaaaacattagctctccctgaaaaggaggtgatccagccgcaccttccagtacggctaccttgttacgacttcactccagtcactagccctgccttcggcatccccctccttgcggttaaggtaacgacttcgggcatggccagctcccatagtgtgacgggcggtgtgtacaaggcccgggaacgaattcaccgccgtatggctgaccggcgattactagcgattccggcttcatgcaggcgagttgcagcctacaatccgaactga

SEQ ID NO: 1049 - DNA, 570 bp, Glycine max
  Peptide Sequence Number=SeqID_92734
atggcatacttcaaccagcttcagtcgcagatgcaatctcagggacttacagtgcctcctgagcctctagttggtccctccggtcctcgagtgagcacaaaggggagttgtgttgatccctcaggaaacgatcctgagacgggtgactctgacaggtgcgacttgtacatagaagcagatcctgcccgcctggttgccatggggagagtttatgagggatccactgttgttcataacactcctttgttgcctggccaagtaaaggtgagtgtggatggggcagacacttcacaccttccttgcttggtcgacacatctggtcaagtctttatcacaacagctgtgtctccgccaaaaccacctccgaagcccgatccggaggtcgatgatccgctttatctgatgacattgactatcccagagcttttcttgaggccttatcaggttagatgggatgccaccgtgttcggggtcattaatccagatttccccctctacataaagcacaaagacctctccgaaatcgcacacggtgttcaatgtctcagcatatcggtgttacagttatga

SEQ ID NO: 1050 - DNA, 156 bp, Glycine max
  Peptide Sequence Number=SeqID_92735
atggctcctaataaagtatttcctctatttatgccatttggaaaaagcaatgcattgaaatgtgagaatatggatgagtccatactgtggcacttgaggctgcatttatggcaagatgcacaagttaccatttccaaaaacatcttggagagctaa

SEQ ID NO: 1051 - DNA, 294 bp, Glycine max
  Peptide Sequence Number=SeqID_92736
atggctaccattgcattatcaagtagatatgggagcaagttagcatatggccccggaatttggggtgaatcctacaggctttttgctgcaaaattcctttttggtttgcgttataggtggtgtttgggcattgggcatgtggaatggcagccacaacatgggtttccttcctcattctcatcctcttcatttggccctagttttctcattcatcaaagcaggatgatcaaatttgcctcttttcagacccgcttcgatcctttccccgacgaagaccaaatccgcaaagcttga

SEQ ID NO: 1052 - DNA, 75 bp, Glycine max
  Peptide Sequence Number=SeqID_92737
gcgtccaatgaggtttttcaccgacatggtaccacatttcgtataggattgagtcttagtgtatctgttgcataa

SEQ ID NO: 1053 - DNA, 291 bp, Glycine max
  Peptide Sequence Number=SeqID_92738
atgcaagccacctatccatcttttttgagtaaggtaatcccgctaagcgataaaggcgcgctaagtgcaattctaaccgaggggaattgcgttgagcggcccaaagctgcgctaagcccaactccagctgagaggaagtgcgctgagcgcccagaaggccagctaagcgaaagttgcagaccaccagtggccgccgtgagccgccgttgcttgccgttgaacccccacaccaagaggagcactttaataggagctgtcgcaacgtgcccttttacgggcgagcgaaggtga

SEQ ID NO: 1054 - DNA, 102 bp, Glycine max
  Peptide Sequence Number=SeqID_92739
atggaagtgcttcttaggccaacagctcttaaggtggttggccccttgcttcttgactcaaattcttcaagggatggcaccaatcctccaagattggtataa

SEQ ID NO: 1055 - DNA, 165 bp, Glycine max
  Peptide Sequence Number=SeqID_92740
atgggacactgcgcccccgaatgcgcaacacccaggcccacttgggccctccagaatattcctccagaaggctgttgcttctggaggaagcaacctggctcgcctgggcgagctgagctcgcctgggcgagctgggcggcaaccacctcccctattgtgctataa

SEQ ID NO: 1056 - DNA, 576 bp, Glycine max
  Peptide Sequence Number=SeqID_92741
gatacatcctttgcggtaaaagtagagggtacatctacttgggttgttgtaactgagaacaagaaagggtacatctcttgtggatctgttcaagtggagggtacatctactaggttgttcaaagagaataagggagggtacatcccttgtggatctttgcttgtaaaggtttttacaaggttgaaagcaatctcaaggactgcaggttgcttggggattggatgtaggcacgggttgttgccgaaccaatctcccacaggcaatttagttcctctggacttagaaattgaagctacattgagaaggaactgggatgagagtagaaggaaacttctgcaagacagaacagtcacatccattcttgaggaagaaactcatttttctgattcattgtcacctgattcaccatcatcaagggaatccgctactcaatttcctgaagccactatcatggcagacgagcaacaccagaggatcacccttgaggattattcaagcagctcagtgccgtataagactcaatctattctcattctcattggcaggagaggaaaagaggtggcttcactcgtttaa

SEQ ID NO: 1057 - DNA, 867 bp, Glycine max
  Peptide Sequence Number=SeqID_92742
atggaagaaagcatgtctcctttccttgtgagggatttcggcgcacaaaatttcaaggctatacaaagaatccataaggcatgggaaaccccattaaggaaagatcaagaacttaggggcattcgtaatggcatcattggtggttaccatgaatggttgaaattaaaagtcgtcatcgaagagagttttgaagcaccggaagaggacgaagaagtccaagctctcaaaagcgagttaggaaaggcgaaacttgccaaggagaagttcaagttggccgctacacacatccggaaggagtgtgccggattacgggaagagaatgcaactaccgcgagagcccttgaacaagagactaagagggctcgcaaggaagagtatggccgtaacaaatttcgcggagctctgttgggtagcaacagtgaactcaagctgcgaagggaagagagggaccaatcgcgagcgcatagcatggtcttgaaagaggagttagttacctgttcaaggtccaaaaggagcttgtctcagtgtttatgcgagacggagaccaacatgctagctatgatcgccaagtaccaagaagagtttggtctagccatggcccacgagcatagggtcgcggacgagtatgcgcaagtatacgcggaaaaagaggctagaggaagggtgatcgattctttacaccaagaggcaaccatgtggatggatcggtttgctcttaccttgaacgggagtcaagaacttccccgattgttagctaaggccaaggcgatggcggacacctactccgcccccgaagaaattcatgggcttctcggctattgtcagcatatgatagacttaattacccacataattagaaatcgctag

SEQ ID NO: 1058 - DNA, 369 bp, Glycine max
  Peptide Sequence Number=SeqID_92743
atgtatgatatccactcgacaaggtttgaagtaaaggagaccttcaatcctataacgcaacgtggcggacaaaagtgggcagttaacttgaatggtcattattatcaatgcgaaaagcattatgcgcttcactatccatattcacacattattgcagcttgtggttacgtgagcatgaactactaccaatatatagatgttgtttacacaaatgagcacatcttaaaagcttactcgacacaatggtggcctcttggaaatgaagtggctattcctccttctgatgacgcatccacacttatccctatcccaaaatcaacaaggataaggaatgagatggattggctcgaaccatctgagcaccgataa

SEQ ID NO: 1059 - DNA, 513 bp, Glycine max
  Peptide Sequence Number=SeqID_92744
atggtggggggtcagcttgttatagtatcaagtgaggaggatatactagtaagttgtctgtcttctactccttatgttgaagcagcggagaagtcactagaaatgttctttcaagcattggaaattgtaaataatgcttatgtggagtctcctccgatacaaccaagtttgtctgatacctctttgatggtggctcgagttatgctaaaggatgggtatgagcctggaatgggtttgggccgaaatggtgatggcgcggtaggcttgttggagattgctgaaaaccgtgggaggtttagtttgggttacaagcctacatgtgttgacaaaaagaggattgctttggaaaggaaagagaaatgcttagctcatttacaagggcaagaaccacaggtggggagggtccctatttgtcacatcaatgagagctttgtgagtgcaaggtggatgcatgaagatcaggttgctatgctagatgaagagaccgatcaagatcagtcgaattgggtgtag

SEQ ID NO: 1060 - DNA, 1131 bp, Glycine max
  Peptide Sequence Number=SeqID_92745
atggccaatcaaggagattgggtcccgtttatggatgtgttaactttgctaatttttggggtcgtcctctttccaaacgtggatggttttgtgcacctagcagcaatcgacgctttccttgcctaccaccatagcaaggaaagtccggtggtagctgtcttggcagatctatttgacacatttgaccgaaggtgcgaaaagagtagcgcacggatcatctgttgcttgcccgccctctgtgtttggttggtttcgcacttgttccaacaagacacaagacatccatgtccgctcctgagccatcgctcgtgtactgaaaagaggagaatagattgggaccagcttttggccgggataggaggaacgaggggttgtattaactacaatcccgcgctcgctataagacaactagggtacctcatgaggggagcaccgacggaagaaagcatgtctcctttccttgtgagggattttggcgcacaaaatttcaagactatacaaagaatccataaggcatgggaaaccccgttaaggaaagatcaagaacttagaggcattcgtaatggcatcattggtggctaccatgaatggctgaaagttcatatacgaggtttagattggctcgccaagttaaaagtcgtcagcgaagagagttttgaagcaccggaagaggacgaagaagtccaagctctcaaaagcgagttaggaaaggcgaaacttgccaaggagaagttcaagttggccgcaacacacattcggaaggagtgtgccgggttacgggaagagaatgcaattaccgcaagagcccttgaacaagagaccaagagggctcgcaaggaagagtatggccggaataaatttcgcggagctctatggggtagcaatagtgaactcaagctgcgaagggaagagagggaccagtcacgagcacatagcatggttctgaaagaggagttagttgcttgttcaaggtccaaaagaagcttgtctcagcgtttatgcgagatggagaccaacatgctagctatcatcgccaagtaccaagaagagttaggtctagccatggcccacgagcatagaatcgcggacgagtatgctcaagtatacgcggaaaaagaggctagaggaagg

SEQ ID NO: 1061 - DNA, 207 bp, Glycine max
  Peptide Sequence Number=SeqID_92746
atgtcttcagtcattgcatgctttcaaaaggaaacaatgaccctcatttacatttcaaagatgacaatgtcttcagtcattgcatgctttcaaaaggcgacaatgaccctcatttacattttgaagacgacaatgtcttcagtcattgcatgctttcaaaaggcaacaatgtcctcatttgcatttcgaagacgacaatgtctttag

SEQ ID NO: 1062 - DNA, 1068 bp, Glycine max
  Peptide Sequence Number=SeqID_92747
atggccagcgggggtaccgatcgcgatagcctgatgaagctgcgcagccaactgctggccgcagccaatcagagcggcgaactgcagtcggttcgcgccaacgatctgccacaaatgccacagctgcaggtggatatcgataacaataaagccgtctcgctggggctgtcgctcagcgacgtgaccgatacgctctccagcgcctggggcggcacgtacgtcaacgactttatcgatcgcggccgggtgaaaaaggtctatatccagggcgagagcgacgcgcgcgccgtgccgtccgatcttggtaaatggtttgtccgcggcagcgataacagcatgacgccgttcaccgcgttcgccaccacccattgggaatacggcccggaaagcctggtacgttacaacggctcggccgcctttgagatccagggggaaaacgccgcgggcttcagctcaggtgcggcaatggacaaaatggaaaaactggccaatagcctgccggcgggttccacctgggcatggagcggtatttcgctacaggaaaaactggccagcggccaggcgatgagcctgtacgccatttcgattctggtggtgttcctgtgcctggcggcgctgtatgaaagctggtcggtgccgttctcggtgatcatggtcatcccgttaggcctgcttggcgcggcgctggcggccacgctgcgcggcttaagtaacgacgtctatttccaggtggcgctgttgacgactattggcctgtcgtcgaagaacgccatccttatcgttgaattcgctgaatccgcggtggatgagggctattcgctctcgcgggcggcgatccgcgccgcgcagacccgtctgcgcccgattgtcatgacctcgctggcatttatcgccggagtactgccgctggccattgctaccggcgccggggccaacagccgcgtggcgattggtaccgggattatcggcggcaccctgacggcgacgctgctggcggtgttcttcgtcccactgttctttgtgctggtgaagcgtctctttacccgcccacgtccttctcaggagtaa

SEQ ID NO: 1063 - DNA, 441 bp, Glycine max
  Peptide Sequence Number=SeqID_92748
atggcaggaatgggaaagttggatcatctagaggaaaggatcagggccattgaaggaggtgaagattatgcctttgctaacctagaagagttgttcctaatacccaaacatggtcattcccaaattcaaggtgccggactttggcaaatttggtcttcgccagcaaaaagatcgaagtggatccgaaaagaggcaaatttgatcatcctactaggacgactgagaaaactaggggcaaatgaagagggtgagaaagagggagaaacccatgctgtgactgccattcctatacggccaagtttcccaccaacccaacaatgtcattactcagccaataacaaacctcctccttaccccaccacccagttatccacaaaggccatccctaaatcaaccacaaagtctgtctaccgcacttccaatgacgaagaccacctttag

SEQ ID NO: 1064 - DNA, 315 bp, Glycine max
  Peptide Sequence Number=SeqID_92749
atgaccacattggcctctgctcatcaatcacacttggggtcactgaatgacgaggtgcggataactgtaaggtgtctcgcgggttaccagctcttgggtcatggcaacaaaaggtggtgtggtcgacaaaagcaaggctcttgctcctacgtatcctccaatgaggaactcaaacctaccatttcatttctaaatgaccatttagaggaaacactgggttcgacaaaaatagaagaaatccactcaaagtgtatcaatctcgcacagtgcggggcgaaaaagtcgctagcacacaatatcttgattggcaattaa

SEQ ID NO: 1065 - DNA, 352 bp, Glycine max
  Peptide Sequence Number=SeqID_92750
ggaatgggaagaatcaaaagaattctcagactgtgtcgttttgaattctttgacaagggagaaggaagacacaaaagaattcaggcggttagtcctttgttcttttggaaaagggagaagagagacacaaaaagaatttaggcggttagtccttggcgaattctttttggcaaagggagaagagaatgaaaagatgaatagcacaagttttcaaggtttggaaaaccagaaaacttcagaaagcttttggtacaaagaagaagaagaagaagaagttcaaagagattcaaggcttgtaaaggattgtaagagattgattggaaaagtattcaagattgaatcaatgaattga

SEQ ID NO: 1066 - DNA, 1371 bp, Glycine max
  Peptide Sequence Number=SeqID_92751
atgatagaagtgtctgttgaagccattgcatccctcgttcaatattatgaccagccgttaaggtgcttcacgtttggggactttcagttattaccaaccgtagaagaatttgaagggatcttgggacgcccgctaggaggaaggaagccgtatttgttttttgggttatacccctccatggtgaggatagccaaagtggccaaagtctcaattaaggaaagtccgatcgttgctgtgttggttgatgcctatgacacatttgacagaagatgcgagaagagtggagcaaggattttctattgcacacccgctctttatgtatggctggtctttcacgtttttcgtcatgaaagtaggctcgtttgtcccctacaaggtcaccgcatgtgtgccaagaaagggaaagcaaattgggagcaactcttggctggtatggtagggacatccgttaattggttcccccaatggaaggaaggaggggccagagttttgtcctcatgcgaagggttcccaaacatccccttgatggggatgaggggttgtatcaattataatcccaggaaggataagaagcttagaggaagcagcaatgggatcatcaatagctatcacaagtggctgaaggctcgcacgcaagagataacttggctcccaaagctaaaggtttcaagtgaggaagaggttgaaacccctgaggagagtgaagaggtgcaagccttgaaggcggaacttgaaagaacgcaagtagtcaaggaaaagttcaagatgatatccatcagagtcagaaaggaatgtgacaagctgagggatgccaacatggccacggatgaagcattggaacgagaaacaaagagggcccgaaaagtggaatggggccgaaacaagtttcgaggggctttatggggcagcaacagtgaactcaagcttcgaagggctgagagagaccagtcgcgagtcgaagttatgatattagaggataagctaaaggcttgtcaaaggtcaaagaggagcttgtctgaacagttgagtaggacggaagagaacatgtgggccatcattgaccaatacagagagaagttgagtctagttgctggccatgagcaaagattagaggacgaacatgaaaaagtatcggctctccaagcggaaacggaagtaagggagaaagtaatagattcattgcacggagaagctatgatgtggatggataggttcgctttcacattgaatgggagtcaagagcttccaaggctgctagccaaagccaaggcaacggtggatgtgtacttgcttctcgaggaagttcgtcggcttttcgattattgtcagcatatgatcgatttgatggcccacataattaggagctgctaa

SEQ ID NO: 1067 - DNA, 2264 bp, Glycine max
  Peptide Sequence Number=SeqID_92752
atggcgtggcgagttgcgcttagcgcgtttttaagtttagtggttgcaatggggattgggcgatttgcgtttaccccgcaggtgccgctgatgattcacgacggtcagctcacgctcgccagcgccagcctggtcgcggcgctgaactatctcggttatctggccggatcgtttgacgcgatgcgcgcgcagcggcgcgtggagtggcggctgcagctgggcgtctggggtgccgtcgtgctgacgttgctgtccgcctgtatcagcgggccgtggctgcatgcggtggtgcgtttcctgatcggcgtcgccagcggctgggcaatggtgctggtggcagcatggagcaatgagcaactgctgcatcacggccggccgggcctgtcggcagcggtgtttgccggtcccggcaccggcatcttcatcagcggcatgctggcggtaatgctgcacgccagcggcgtgagcgcggcgtttgcctgggcggcgtacggtgtgctggcgctgctgctgattgccgcaattgcgcgcttcctgccgcgcagcggacagctgcatcgtccgcaacaggccgccgcaccgctgctgctgacgcgtgacctgaagcgcctgatcctcagctacagcctcgccggctttggctatattctgcccgccaccttcctgtcgcaaatggcggcggcgcgcttccctgatagcgcttttgcgcagtttgtctggccggtgtttggcggggcggcgccatcggcggctggcgctggtgctgtgggcgcaggcgctgggcgtatcgcggccatcgtactgccgggcatcaacgctgtcgctgcagtacagccgggagctggcgccgcaccacgcgcgctatctcgccggcctgcttactaccggttatgccatcggacagctcggtggaccgctgctgtcctggatttccagcctgctgtggcaccggctcgatccggcgctgtgggtggccggaggcggtttgctgctggcgggggcgctggcgcagacctgcgggcgcatcacctgccggagaagagtacgatgagcaccttaagtcaggaagccgccctggttcacgaagcactgctggcacgtggcctggaaacgccattacgcgccccggtgcgcgacatggacgacgcgtcacgcaagcgcgagatcgccggccacatgacccagattatgcagctgctgaatctggacctggaagacgacagcctgatggagacgccgcaccgcatcgccaagatgtacgtcgacgaaatcttttcaggtctggattacgccaacttcccgaaaatcaccgtcatcgaaaacaagatgaaggtggacgaaatggtcaccgtgcgtgatatcaccctgaccagcacctgtgaacaccacttcgtgatcatcgacggcaaagccaccgtggcctatatccctaaagacaaggtaattggcctgtcgaagatcaaccgtatcgttcagttcttcgcccagcgtccgcaggtgcaggagcgtttaacccagcaggtgctggtggcgctgcaaaccctgctgggcaccaataacgtggcggtgtcgatcgatgcggtgcactactgcgtgaaagcgcgcggcgtcaaagatgcgaccagcgcgaccaccaccacttcactcggcggattgttcaaatcgagccagaacacgcggcactcgatgcaacgctatctcgcgctggatttcattcgtggttgcgccattctcggcatattgctgctgaatatcgtcggctttgctaaaattcctgacgctgtttgcgctgctgtttggtgccggactggccctgcaggtgccgcgcggcagccgctggatctcctcacgcttaacgctgctggtcttcatcgggttcatccacgcggtgttcctgtgggaaggcgacatcctgctggattatgggctgattgggttgattgtctggcgcatgctgctccgcagccgacgcgttcgtggctgccgggcgcggcagatctggagtatgagagctactggaaactggtcggcggctgggaagcggtgcagaatcgcctcgaacacctgtcatccggcctgatggcgctggcttcgcagtatggctggcagctggccgggctgatgctgatcggtgccgcgctaatgcgcagcggctggctgagcggccagtttagtctgcaacactaccgacgcgcagcggcgctgttactgaccatcggctggctgattgccatacccggcgtgctggcgcagtggctgctgca

SEQ ID NO: 1068 - DNA, 1293 bp, Glycine max
  Peptide Sequence Number=SeqID_92753
atgtttatcggattcgactacggcacggctaactgttccatcgcagtaacggatagcggcacaccgcggttactgacactggaaaacggtcagcgcctgcttccctccatgatttgcgccccgacgcgcgaagccatcagtgaatggctgcaccgccaccatcaggtccccacgccagacagcgaaagtaccgcgctgctgcagcgcgcgctgcgttataatcgcgaagaggatatcgaggtgacgcctgccagcgtgcagtttggtctgaccgcgctgcagcactatatggtcgatccggaagaggtgtggttcgtcaaatcgccgaagtcgtttctcggcgccagtggcctgaaaccccagcagatcgccttctttgaagatctggtgtgcgccatgatgctgcacattcgccagcagggtgaaacccagctcgatcaaccgattgaccaggccgtgattggccggccaatcaacttccaggggctgggcggtgaagacgccaaccagcaggcgcagggcattctgctgcgtgccgcacagcgtgccgggttccgcgacgtcgagtttcagttcgagccggttgccgccggtctggagtttgaagccacgctgcagcaggagacacgcgtgctggtggtggatatcggcggcggaaccaccgactgctccatgctgctgatggggccgcagtggcgtaatcagtccgatcgccgtgccagcctgcttggccacagcggctgccgcgtcggcggtaacgatctcgatatcatgctggcgttcaaaacgctgatgccgctgctgggtctgggcggtaacacgctgaagggcactgccctgcccgcgctgccgtggtggaacgcggtggcgattaacgatgtgccggcacaaagcgacttctactcggctgccagcggtaagctgctgcgcgatctggtgcgtgatgccgaacagggcgataaagtcgcacatctgctgaaagtttggcagcagaagctgagctaccggctggtgcgcgcggcggaagagagcaaaattgcgctctccgatcagcgcgagactgcggcctcgctggcgtttattgcgcaaacgctgcaggcggagatcagcgccgcgcagctggaagaggcgatcaaccagccgctggcgcgcattcttgagcaggtgcagctggcgctggccagttgtgacacccgtccggaggcactgcccgacacgcccatcgccagcggcgatgatttcggctcggtcaccgccggcctggcgcgctgggccgaagtgatgttcagataa

SEQ ID NO: 1069 - DNA, 752 bp, Glycine max
  Peptide Sequence Number=SeqID_92754
tcggggtgctgctggcggaactgaacaaggcgcgcggcgatgtcgggggcgattttatcgggctggagatggcgggcgcgggagagattttcaagcgaggagagctcgccggggttaaagcggctgagccacttgtagccggttttgcggctgatgccgtggcggtgacacagctgcgtcatggattccccgcctgcctggcaggcgaggatgaattcaaggcgttgcatggtaacagtctcagtccagggcataggtgcgcagcagataatccccgacgcgcaactcctcaccttcggccggcacgtgctgcaggctatccatcagcaatcccgccagcgtatgccgccatgctctgcgggctgaatatcgtaacgggcatcaatctcttccccttcattgggcaggttgccggcgatggtctccatcacgtcgctcagcgttaccacgccttccaccgaaccaaactcatccactacaaaggcaaaatgggtgcgagcatggcgaaactgctccagcgcctgcagcagggtgacgcgctcgggaaacaccagcggctggcgaatcagcgcacgcaaatccagcgatttactgtgcagcgactgatgcagcagatcgatcacatgcaccacgcccagtggctcgcgtccctgttcggtgatcagcaggcgcgtatgctggttgcggtcgagtttatccatgatcgactgcgggtcttcgctcagatcgatgtgctcgacgtcatggcgtga

SEQ ID NO: 1070 - DNA, 282 bp, Glycine max
  Peptide Sequence Number=SeqID_92755
atgcgcaccctacgtggacggtgcaggagaattgacctctttgctggtgcgcataaatgcactgacggtcagaaccgtgcccgaggctgtagggtcgccattcatggcgaccggcaaaccgctttctcgaacataacgccatgcatggcgactaaatttttcggtgcgttttgcaccatccaacatacacacagcacaatcttaggtatttccgtgacgaacaaagccgattcctttctacaggccgctcgcgttaccgttgaatctggaacagctgtttaa

SEQ ID NO: 1071 - DNA, 2121 bp, Glycine max
  Peptide Sequence Number=SeqID_92756
atgaccaagcttaaagcagtaatcccggttgcgggtctcggtatgcatatgctccctgcgactaaagccattccgaaagagatgctgcctatcgtcgataaaccaatgattcagtacattgtcgacgagtgcgtggcggcgggcatcaaggagattgtgctggtcacccatgcttccaaaaatgcagtggaaaaccacttcgataccacctacgagctggaagcgctgcttgaagcgcgcgtgaaacgccaattgctgagcgaagtgcagtcaatctgtccgccgggcgtgactatcatgaacgtgcgtcaggcgaacccgctgggtcttggccactcggtactgtgtgcccgtccgatgattggcgacaacccatttgtggtggtcctgccagacgtgctgctggatgactccaccgctgaccacctgcgctacaaccttgccgcgatggtggcacgcttcgaagagaccggccgcagccaggttctggcgaaacacatgccgggcgaagacctgtctgaatatggcgtgctgaccaccgagcagccgctggataatccgggcgatatcagcaccatcaccaacttcgtggaaaaacctgagcatccgtccgagctgaactcagacctgaccgccgtgggccgttacgtgctttctgcggatatctggggtgaactggagcgcacggagccaggcgcctggggccgtatccagctgaccgatgccatcgcctctctgagccagaaaaaaccggttgatgctcagctgctgaccggcaccagcttcgactgcggccgtaaactcggctacatgcaggcattcgtctcttacggagtacacatggctattttggtaacgggcggagcagggtacatcggctcccatacggtgctggcgctgttagagcgcggcgacgacgttgtagtcctggataacctttgcaatgcctcgcgcgaagcaatcaatcgcgttgagaagctggccggtaagaaagcggtcttcgttgaaggcgatatccgcgaccgcgcctacctgcgcgatctgtttgccagcaatgacatctcggccgtcatccacttcgccgcgctgaaagcggtaggcgaatccacgcgcatgccgctggaatattacgaaaacaatgtcgccgggaccgtggtgctgctggaagagatgcgcgccgccggcgtgtggaactttatcttcagctcatccgccaccgtgtatggcgctgacgcaccggttccgtacgtcgaaacgacgccgattggtggcaccaccagtccgtacggcacctccaaactgatgattgagttcgtgatgcgcgacttcgccaaagccgagccgaacttcaaagccatcgcgctgcgctacttcaacccggtcggcgcgcacgaatccggcgagattggcgaagacccaaccggtattccgaacaacctgctgccgtacattgcgcaggtggcgattgggcgtctggacaagctgggcgtgtttggcgatgactacgcgacgccagatggcacctgccagcgcgactacattcacgtcgtcgacctggcggaagggcatctgaaagcgctggatcacctgccaaaagttgaaggctacaaagcttacaacctcggcggcggcaaaggcttctcagtgctggagatgatcaaggcgtttgagcaggcatccggtaaacagattccgttcgagttcaaaccgcgtcgcgacggcgatctgccggcgttctgggcggatgccagcctggcgaacaaagagctcgactggcgcgtcacgcgcggtattgatgcgatgatgcgcgatacctggaactggcagaatggagcaggaaaaagtacttcattagggctcgtagctggagttataaaaccatcttcaggaagcgttgtaactcgcggccgcgtggcttcaatgcttgagttaggaggcggttttcatcctgagttaacaggaagagaaaatatccgtttaaacgcaaccctattagggcttagaagaaaacaactaaatgaaagaatcaataaaatcatagaattctctgagttgggtgagtttattgatgagcctattcgagtttattcaagcgggatgttggcgaagttgggtttttcg

SEQ ID NO: 1072 - DNA, 821 bp, Glycine max
  Peptide Sequence Number=SeqID_92757
aagcatacgctttacttaaaggcgcactaggtctgaacaatgaagagctggctaaaaccttcactgactggaacaacggtgagctgagcagctacctgatcgacatcaccaaagatatcttcaccaagaaagatgaagacggtaaatacctggttgatgtgattctggatgaggcagccaacaaaggtaccggtaaatggaccagccagagttccctggatcttggtgagccactttctctgatcactgagtctgtgttcgcacgttacctttcttcactcaagtcacagcgtgttgcagcttctaaagtgctgagcggccctcaggcgcaagccttcaccggtgacaaagctgagttcattgagaaagtgcgccgagcactgtatctgggtaagatcgtttcttatgctcagggcttctctcagctgcgtgcggcttcagaagagaacaactgggatctgcattacggtgaaatcgcgaagatcttccgtgctggctgcatcatccgtgcacagttcctgcagaaaattactgatgcttatgcgaccgatgctaacatcgcaaacctgctgctggatccctacttcaaaaacatcgctgatgaatatcagcaggcgctgcgtgatgttgtctcttatgccatccagaacggtattccaacgccaaccttctcagcggcaattgcatactacgatagctatcgctcagaagtgctgcctgccaacctgattcaggcgcagcgcgactactttggtgcgcacacttataagcgtattgataaagacggtgtattccataccgagtggcttgtaaataattaa

SEQ ID NO: 1073 - DNA, 603 bp, Glycine max
  Peptide Sequence Number=SeqID_92758
ggcgcgctcaacgcttacaacagcggcaaggtgaattatctgctgctgagcggcgataatgcgctgcagagctacaacgaaccgatgaccatgcgacgcgatttgatcaaagccggcgtcgatccctcagacatcgtgctggattatgccggtttccgtacgctggattcgattgtgcgcacacgcaaagtcttcgacaccaacgacttcatcatcattacccagcgcttccactgcgaacgcgcactgtatatcgcccagcatctgggcattcaggcgcagtgctacgccgtgccgtcgcccaagaatatgctgtcggtgcggttccgcgaggtgggtgcgcgtctcggtgcgctggcggatctctatctgatgaagcgcgagccgcgtttccttggcccgctgctacccggcggtcacaccggaacagttgctcgagctggaagagaagctgcggaaataaccggcgagagggcagcagccggatctgacgttggcaagttaagcaggatcgcggcgatgctgccggtgcgcatcaatgcgcaccctacaaaataccggccatcccctgcaagtctcaccgctatccttattgtgcaataa

SEQ ID NO: 1074 - DNA, 1440 bp, Glycine max
  Peptide Sequence Number=SeqID_92759
atgaagccagcggcaagtatcacgtcaatcagtataccggcgacgaagccgcgcacccgcgttacccagtgggaaacgctggactgggtagaggaagtgcagaagctgggcgctggtgagatcgtactgaatatgatgaaccaggacggcgtgcgtaacggctacttcctggtgcaactgaagaaggtgcgggacgtgtgtaaggtgccgctgatcgcttccggcggcgcaggaaccatggcgcacttcctcgaagcctttgagcaggcaaacgtcgacggcgctctggcggcttcggtgtttcacaaacaaattatcaatatcggcgagttgaaaaacttcctgatcgacaacgaacaactggccagactggactgggccaaaaccgcgggcatgatgcccgtcatcgtccagcacaacgtctccggcgaagtgctgatgcacggttacatgaacgaggacgcgctgcacaagacgctggccgacggcaacgtcaccttcttctcccgcaccaaaaaccgtttatggaccaaaggcgaaacctcgggtcacttcctcaaagtggtcagcatcacgccggattgcgataacgacacgttgctggtgctggccaatccgattggccccacctgccatctcggtacctcaagctgcttttcgcctgccgcaccggactggacgttcctgtatcagctggagcagctgctggcctcgcgtaaaagcgccgatcccgccagctcctatacggcgaagctgtacgccagcggcaccaagcgcatcgcacagaaggtgggagaagaaggtgttgagaccgcgctggccggtaccgtcaatgaccgccacgaactgaccaacgaagcctccgacctgctgtaccatctgctggtgctgctgcaggatcaggagctggacctcagcaccatcatcaacaacctgcgcgcacgccataaaatggaaacccccatgaccacgcatgaaaaactgctcgccctgctcgatcagcacaacgcccgttaccgactcatggagcatgaagcaaccggtaaatgtgaagccgtggccgcgattcgtggcacggaagtgggacaaggtgccaaagcgctggtgtgtcacgtcaagggcaacggcatcaaacagcatgtgctggcggtgctaccggccgaccagcaggccgacctgagtaaagtggcagccgccgtgggtggccgtcgcgcctcgctggcctcgccggctgaggtggatgcgctgaccggctgcgtatttggcgcgattccgccgtttagctttcatgcggatttacagctggtggtcgacccgctgctgttcgagcgctacgacgaaattgcctttaacgccgggctgctggagaagtcggtggtactgcaggtggaggattaccgcgcactgcataatggtaacgtgatgaaaataatactctaa

SEQ ID NO: 1075 - DNA, 477 bp, Glycine max
  Peptide Sequence Number=SeqID_92760
atgatcgttgcggcctttggttttcaggtgcagcgtgctcatcatggcgtacgacagcgagcggaagaagtgctcgaccatttcggtgctcaggtcgccaacgcgctggtagctgaactcggctttgtattcgaggtgcggacggccggagatatccagcgcgcagcgcgccaggcactcatccatcggcagcacgaagccgaagcggccgatgccgcgcttgtcgcccagcgccttcagcagcgcttcgcccagcgccaggccggtatcttccaccgtgtggtgatcgtcgatatacaggtcgcctttcacctcaatgttcatgcggaagccgccgtgcacggcgatctgatccagcatgtgatcaaagaagccgacgccggtgttgattttgctgccgccttcgcgatccagccacacttccactttaatctgcgtctctttggtgttgcggttaaccagcgcgtgacgatcgcg

SEQ ID NO: 1076 - DNA, 558 bp, Glycine max
  Peptide Sequence Number=SeqID_92761
atgaaaaaggtggcgattgtaggtctgggatggctgggaatgccgctggcgatggcgctgtcagcgcgcggctggcaggtgaccggcagcaaaacctcaccggatggcgtcgatgcggcgcgccgctgtggtattgatgcgtttcagctggtgctgtcaccggagctggagtgtgaagcagatgatttggccgcactgatggcggtggatgcgctggtggtgacgctgcccgccagccgcaccgtgcagggtggcgaagattacatgcaggcggtgcagaacgtggttgataccgcgctggcgaataaagtgccgcgcatcatctttaccagctctacctcggtatacggcagcggcgacggcgtaagaaaagagagcagtgcgctgcagccggagacggtagcgggcaaaacgctggtggagctggaaaactggctgcatgacctgccgggcaccagcgtggatattgtgcgtctcgccggcctggtcggcccgaaccgccatccggggcgtttcctcgccgtaaaaccaacctggaaaacggcgcgcacgcggtga

SEQ ID NO: 1077 - DNA, 1416 bp, Glycine max
  Peptide Sequence Number=SeqID_92762
atgacgaacctcgtggaagtagaagacttcacgcgacacagtgaagaaaaacgaaccagcgcgttccagctggaggtgaaaacctggctggaacgccatccggaaacgcagtatgtcgatattctgttaaacgatctcaacggggtatttcgcggtaaacgcattcccgtctccgcgttagctaagctggaaaaagggtgttactttccggcctcggttttcgccatggacattctcggcaacaccgtcgaggaagccggcctcggacaggcgctcggcgaacctgataacctctgcataccggtccccgggaccttaattccttccgcctctgacccgcaacgcatcgcccagctgctgctgaccatgtgcgaccaagatggcactccctttgacgttgaaccccgaaacgtgctgaaccggctgtggcaacagctgcgcaatcgcggtctgtttccggtggtagcggtagagctggagttctatctggtggacaaaaagcgcgatgccgaaggctatattcagccgccgtgtgcgccgggtagcgaagagcgcaacatgcagagtcaggtgtattcgctggataatctcgaccatttcgccgatgtactgcgcgatatcgacgcgctggcgaaactgcagaatatccccgccgacggcgcgctggcggaagcctcgccgggccagttcgaaatcaacctgcaccatacgcgcgatatcctcaaagcctgtgacgacgccattctgctgaagcggctggtgcgtcaggtggcagaaaatcacggcatgaccgccacgtttatggccaagccgtatgaggagtatgcgggcagcggcatgcacgtacacatcagtatgctggatgccgccgaccacaacgcctttgcgctggatgatggcagcgattcgccgctgctcaagcgggcgctggctggcatgatcgatctgatgccggcatcaatggcgctgctggcacctaacgtcaacgcgtttcgccgcttcctgccggaggcgtttgtgccgctgcaggcgtcatggggacacaataaccgcacggtggcgctgcgcattccctgcggcgatgtagaaaaccatcgcgtcgagtaccgtgtggcgggtgccgatgccaatccgtatctggtggtgtcagcaattattgccggtatcttgcacggtctggataatcagctacccttaccgcatccggtgaagggcaatggccacgaggcggaagggctggaactgccgattcgccagagcgatgcgctgtacgagtttgaaaacagctatccgctgcaaaagctgcttggcgagcgtttcagcggcgtgtggcacagctgcaaacagtatgaactgcgcgagtttgaacggctgattaccgccacggaaattgactggatgttaaagaacgcctga

SEQ ID NO: 1078 - DNA, 1441 bp, Glycine max
  Peptide Sequence Number=SeqID_92763
atggcgatcgaggttgtgctgtaccgggctgacgactattctttcacttttctgttccacgattatgaaaccttcggcaaaagcccgtcgctggatcgtccggcgcaatttgcaggcctgcgcaccgacaaagcctttaacgccgttggcgaaccgcaggtgttttactgccagctcgcggacgattacctgccgcagccggaagcggtaatgatcaccggtatcacgccgcaggtggccaacgcgcgcggcgtgccagaagtggagtttgctcagcgcattcacgcgctgttcagcgaaccgcagacctgtgtgatcggttacaacaacgtgcgcttcgatgatgaagtgacgcgcaatatcttctaccgcaactttatcgacccgtatggctggagctggcagaacggcaattcgcgctgggatctgctcgacgtgatgcgcgcctgctatgcgctgcgcccggagggcatcgtctggccggagaacgacgacggttttccgagctttaagctggagcatctcacccaggctaacggcgtggcacacgaacaggcgcacgatgcgatgtccgatgtgtacgccacgctggcgatggcaaagctggtacaggagaagcagccgaagctgtttgagtttctgtttacccatcgcaacaagcagaaactgatgacgctgattgatattccgcagatgaagccgctggtgcacgtttccggcatgttcggcgcggcgcgcggcaataccagctggattgtgccgctggcgtggcatccggataacaaaaacgcgttgatcgtggccgatctggccggcgacatgacgccgctgctgacgctgtcgccggatgagttgcgcgagcggctgtatacgcgatacagcgatctgggcgatttgccggcggtgccgatcaagctggtgcacatcaataagtgcccggtgctggccccggccaatacattgcgcccggaagatgccgaacggctgggtatcgatcgtcagcactgtctggcgaatctggccctgctgcgccagcatgccgaagtgcgggaaaatgtggtgacgctgtttgctgaagcggagccgttcacgccgtcggaggatgtcgatgcgcaactgtatgacggcttcttcagcgacgccgatcgcgccggcatgaacatcctgcgccagacgccgccgcagaacctgccggcgctggatttaacctttgaggataaacgtatcgcgaagctgctgttccgctatcgcgcccgcaacttccctggcacgctggatgataaagagcagcagcgctggctgcagcaccgccgcgagcagcttaatgcggagcgggtacaggcgtttttgctggagctggagtcgctggccagtttacatgaggccgatgcagagaagatgggcgcagctgaaagcgctgtatttgtatgcgcaggagctg

SEQ ID NO: 1079 - DNA, 423 bp, Glycine max
  Peptide Sequence Number=SeqID_92764
atggtgaaaggcgagactgaacaggtgattgccaacagccacgagctggaagccatcacccaggagctggaagcgctgatcgccaacggcagcgcgcggctggaaaccaccgcgatttacggttacgtctggctgagtctggagcaggcgcgtcagctggagcgcatgacagacctgcgcgaaattacggacaacgaaaagaaaatccgtgataaccagaaacgtgtgttgctgctggacaacctgagcgagtacatcaaacctggtatgagcgtggaagcgattcaggaaatcatcgccagcatgcgcgtggattatgaagatcgcgtagacgagtacatcatcaaaaacgccgatctgtcgaaagagcgtcgcgagctgtcgaaaaagctcaaagcgatgggcgaaccgaaagggcagtaa

SEQ ID NO: 1080 - DNA, 570 bp, Glycine max
  Peptide Sequence Number=SeqID_92765
atgcagctgtcgccgctgcacgtgctttactacggcgcgctggacggcaacaacgatgcccgtctggcgcgcgtggatgccgcgctgcgtgacgcgcagtttgacagcgtgttcgccgataacattatcagtgagctgtgggagaagtggctgctgctgagcacgctgggtgcggtgtgttgtgtggcgcgcggcaatacgcagcacatcctgcgttcagccggtggtgaagcgctgctacagggcattttcgccgaggtgctggcggtgatcaccgccgatggctaccaacagcgtccggccgtgacggcgaagatttatgagacgctgaacaatcctgatgcggcgatgacctcatccatgtaccgcgatttaacccagggctacgatatcgaagccgatcagatcatcggcgatttgctggtgcgcggcgcgcgccatgcggtggcgacgccgctgctgaacgcggttccggtgcgtggcgtgcctggtgcgcatgaatgcgcaccctacggcccggtacgcgggaataacctggtgcgcatgaatgcgcaccctacgatactgtag

SEQ ID NO: 1081 - DNA, 1209 bp, Glycine max
  Peptide Sequence Number=SeqID_92766
atgacggcggtagccggcctgttttcgctgctggccggattaccgctgggactgattctggtgaccaccagccccggcggcattgctgaaaaccggagcatcaaccgcctgctgggcgtagtgatcaacggctttcgctcgctgccgttcattattctgctggtggcgctgattccctttacccgtctgctggtcggcacctccctgggcacctgggcagcaattgtgccgttatcgatcaccgccacgccgtattttgcccgggtagcggaagtttcactgcgcgatgtcgatcgcgggctgattgatgcagtgcgtgccatgggcgccagcaaattacgtattgtctgggaggtgctgattcctgaagcgctgccgggcattctttccggttttgtcgtcacgctggtggcgctgatcggcgcctcggcaatggcgggtgccatcggggcgggcggtctgggcgatctggcaattcgctacggttatcagcgttttgacacggcggtgatggtggcggtgatcgccgtactgatcgtgctggtgtgcggtatccagtggctcggcgatcggctggagagttttatggaattaaccggtaacaccattttgatcaccggcggcggttcaggcataggacgtgctatggctgaagcgcttttggctgcaggtaatcaggttattattgctggcaggcgaaaagaggtactggatgaaactatcgcagccaatcctggcatgcacgccatcgtaatggatatggatagtcatgattcaattctcagcggtgcgcaaactgtcattcagcgctggccggcactgaacgtggtgatccataacgccggcattatgcgcagggaagatctgaaaaggggtgacgtcactgtggctgaagcagaaatcaccaccaatttattaggaccgattcgcttaacggctgcgctaattgaacattttctggcgcaaccccgcgccgctattctgaccgtttcttccggtctcgcttttgtgcccctgtcgcttacccctgcgtattgtgccaccaaagcggcaattcactcctggacgcagagtctgcgctatcaattgcgtgataccgccattcaggcagcacgcaacgaatccggcagcgatgccgttggcggagtatatgcaggaaacgctgcaaatattgcaggaacagccggacactgccgaggtgctggttga

SEQ ID NO: 1082 - DNA, 186 bp, Glycine max
  Peptide Sequence Number=SeqID_92767
atggcgaagggcgaccgcggcatggcgcaggatggtggtgccgaaattcaaccccgcacgaatcgtagcggcgcaattcattgcgcattccggcaactgtgcaatgtttcacacagcgcgataaatcgcgccgctacaatgtgtgcagaactgtggtgcagaactacaatgtcgcacggatcgtag

SEQ ID NO: 1083 - DNA, 1323 bp, Glycine max
  Peptide Sequence Number=SeqID_92768
atgcgtggtggccggatcgccagcttcagcgacagcggcagtcagcagccgggcgcgctggacggcgggaacgcgtttttgctgccggggctggtcgagctgcataccgacaacctcgataaattcttcacgccacggcctaaagttgactggccggcgcattcggcgatgagcagccacgatgcactgatggtcgccagcggcatcaccacggtgctggacgccatcggcgtcggtgacgtgcgcgacggcggtcatcgccttgaaaacctgagcaaaatgattacggcgattcaggacagcaaccgcaagggcattaaccgcgccgaccaccagctgcacctgcgctgtgagctgccgcaccacaccacgctgccgctgtttgaagcgctgatgagcaccccggagctgtcattggtgtcgctgatggatcattcacccggccagcgccagtatgcgtcgctggagatgtaccgcacctactatcagggcaaatatcagctcaacgatgagcagatggatcagtttgagcgcgaacagctggcgctggctgccgaattctccacgccgaaccgcaacgccatcgctggcctgtgccaggcgcgcggtattccggttgccagccacgatgatgccacggcggcgcacgtcgcggagtcacacgcggtaggcagcgccattgccgagtttcccaccacgctggaagcggcacgtgcctcgcgcgactgcggcatgcgggtactgatgggcgcgcccaacattgtgcgcggcggatcgcactccggcaatgtcgcggcgtggcagctggccagccacggcctgctggacatcctctcgtcggattactatccggccagcctgctggatgcggtattccgcctggtggccgacgagcgtaatgcgctgacgctaccgcaggcggcggcgctggtcacgcgcaacccggcacaggcgattgggctgcacgatcgcggcacgattgcggaagggctgcgcgccgacctggtgctggcacacaccgatcacgggcaggctggtgttctgatggcgcgcctcatctggctgaccgggccctcgggctcgggtaaagacagcctgctgaacgcgctgcgcgaggcgccccccgacaagctggtgatcgcccatcgctatatcacgcggccggccgatgccggcggtgaaaaccacgtggcgctgagcgaagccgaatttcgccggcgggaagcgctcggcctgttcgccatcagctggcgcgcacacggcctgagctacgcgctcggcaaggagattgaccactggctggcgcgcggtctcaacgtgctg

SEQ ID NO: 1084 - DNA, 495 bp, Glycine max
  Peptide Sequence Number=SeqID_92769
atggagcgcaacatggcacaggcactactcaaaaccgtcgtcgacaatgcacatcctgcccagcgccatggcgacaaagtgctgtcggtgcaggggctgtgcaaagccttcggtgataaccgcgtgctggatgatgtcagtttcgatctgcatgcgggcgagctggtggcggtaatcggccgctcgggcgcaggcaaatcgaccctgctgcatatgctgaacggcaccattgccagcagcgaaggcgcgattctcagcatgcgtcacggcgaggcggaccgcgatgtggtgacgctcaacagccggcagatgcgcgagtggcgcagcgagtgcggcatgatctttcaggacttctgcctggtgccgcgcctcgacgtgctgaccaatgtgctgctgggccggctcagccagacctcaacgctgaaatcctttttcaaaattttctccgacaccgaccgtgcgcaggccattgaaggctgctgcagtggaagatga

SEQ ID NO: 1085 - DNA, 1163 bp, Glycine max
  Peptide Sequence Number=SeqID_92770
atgagtcacagtctgcactggcacgccggcgcgcgcgggcgcctgctgatgtttaacctgctggtggtgagcgttacgctggcggtgagcctggtggctattttcggttttcgccacgccggtcacattcaggagcaggcacaggcacaaacgctggccgatatgaacggcagcctggcgctggcgcgtgatacggccaatgtcgctatcgccgcggtgcggctggcgcaggtggtgggcgcgctcgaataccagagcgagtcggcgcgtctgcagcagacccagcaggcgctgcagcagtcgctgagtcagctggccagcgcgccgctggccgcacagcagccggcgctgctggcacgcatccgcgagcgcagccagatgctggagcaaagcatcagccagctgctgctggaggggcatcagcgccatttacagcgtaacgtgatgctcagcggcctgtggcaggcgcagctgctgctcaaccgtatcgacctgctggccagcgacggtgcgtttctgccgctgcgccagcagacggccgcgctgttaaccgtggcaattcagtccgccacgccgcaagccgcagtgcaacagctcaacagcgtgctgccgatctggtctgcgctgccgctgcagggcgtgctggcgatgcagcgcgcgcggctggtcagcaccagccagcagctgctgccggtggccggtcagctggaacagagtgacatcgccatcgcctacgccacctatcgcatcaaggcgctggtggcgatgctcaacgaagacatcacccactacgttcagctggtggcgcagcagagcgatgcgcgcagcgccaccgcccatcaggaactggattcaatcatcggtttcatcggtctgtttatgctgactggcgctgctgattaccgccttaccgctatcgcgcacgccatgacgcggctggcgcagggggagaaaagcgtcagcgtgcccggcctggcgcggcgcgatgagctgggcgatctggcgcgcgccttcaacgtgttcgcgcgcaacaccgcttcgctggcgcatacctcgcagctgctgaaagagaaaagcaaccagctggaatcgaccttcctcgccatgcgcgacggcttcgcgctgtttgataacagcggtcagttggtggtgtggaacgcgca

SEQ ID NO: 1086 - DNA, 1323 bp, Glycine max
  Peptide Sequence Number=SeqID_92771
atgccgatcagtacggctccggtcacgcgacgcgcttccagcaccacaatgataaagaagcccagcagcgccagcagcggacccggtttggtcaggtcgcccagaccgaccagcgtagccgggttatccaccacgatgcccgccccttccagcgcaatcagtgcgaggaacaggccaatgcctgccgcaatcccggcacgcagcggcagcggaatgctggcaataatccattcgcgaattttaaaaatcgacagcgcaaagaagatcaccgccgagaggaacaccgcacccagcgcgatctgccaggcccatcagaatcgaaccgatggccgcggccagacaggtggcaacaaacaccgagcctttatccataccggtcgccccgaggatgctgggattcacaaacaggatgtaggccattgccagaaaggtcgtgataccggcaatgatttcggtgcgcaccgtggtgtgcgtgccgttgcggctaagaaaattctgaaccagaacgaggcgcgattatggtgcattgcaccacctgcgcgcaaacgttttcccgccgtgcgcagccggggtgcaatgaagcccgcgattctggtcgttgatgatgatcgtgccatctgcgaattgctgcacgatgtgctgagcgaacatgtgtttaccgtttatagctgtcatcaggggcgcgacgccctggcgctgctggcgcagcatccggaaatctccctggtgatgctggatatgatgctgcccgataccaacggcctgctggtattacagcagatgcagcgtcagcgccctgagctgctggtgatcatgctgaccggcatgggatcggaagccgatatggtggttgggctggagatgggcgccgacgactatatcgccaaaccctttaatccccgcgtggtggtggcgcgggcccgtgcggcgctacgccgctgcgggcgactggcgcagccggaaacggtgattgatgagggctggcagttcaatggctggcggctggatgatgtgcgttgtcagctgtttaatccgcagcgtgaaagcgtaccgctcacccagggcgaatacagcctgctgcgcgcgctggtcggccacgcgcgtaaggtcctgacgcgcgaccagctgctggagctgacccacagcgagagcctcgacgtgttcgatcgcaccattgatgtgttgatcatgcgcctcagacgcaaaatcgaggctaatccgcatcagccgatcctgatccgcaccattcgcggactgggctatgttttttccgccgatgtgatgcgcccgtccgccgcggcgcgcgaaacgcaaatcgcctga

SEQ ID NO: 1087 - DNA, 357 bp, Glycine max
  Peptide Sequence Number=SeqID_92772
atggcgagcctcacagggtgcgcatttatgcgcaccgggataatgcaggaattttccaatgattacgccagcaacgcacactgcggtggcaggcggcagctcaacgcaccgggctgcacctcaatcacaaactcgctgccggacagcggctcgccgtcgaggttaaaggtcatctcatgcggtgaacggatggtcagcgacgtcagctgtgccgcgacaatgttcgggttttcgtcgtcgcgcgtcagcgagtgcagcaacgttggcagcagctcctgggcggtgacgatgctgagattgagctgtccgtcattgatcagcgcttccggacataaccgctgtccgccaccggcctga

SEQ ID NO: 1088 - DNA, 2535 bp, Glycine max
  Peptide Sequence Number=SeqID_92773
atgggtgtagagatgatggcagtcaactggcagacaatagataaggttgtatacatcaacctgaacaaacgcaaggatcgcagggtacgtatcgctcgtcaattaaaagcaattggcgtaccacgtgaaaagattgtccgctttgaggctattgaagaaacgccaggctatatcggctgtattaaatcacatattctcgtgctgcaaatggctcagcaaaacggctggaaaaatgtattgattctggaagacgatatggttttccatgatgatattcagaccaaacagcgaattgatctatttctctcctctttacagcagatcaactggcatgtcgcgctgctcgctgccaactatgataacgtcgtgccgttaaaaagtgtggattatattgttaagccgcaatatgcatggtgcgcttgcgcttacattgtgaacggtgattactactccactctcattgataattatgcagaaagcttgcaggggttgctggcgggtggcgttcctcagtgctgggctttagatgtacgctggaatagtttgataaaacgtgaccgctggttgggtatctttcccaatgcgggctatcaggccgctgataaaagtgatattgaaaaccaacctgttgattatcgagctcatttcgctaaaaaattagaagaaatagtctggccagcctatcaacctggcgaagaaaagataaaagtggatatctttttccagtgggcccccggctggactaactttgagtcggtatatcgcgctatgcaggccaaaccgcattttgattgccagattatccttgcgccctatttcagtcggggcacaaaagcaccggattacactgcacagcgtgatttattaaatgataagggtatccggtataccgagtatcacgagtatgagattacggcgcgtaagccccatgtggtttttttacaaaatccttatgatgatgcacgtcccaatgaactgcaaagtttgacgcttaatcgacgcaatatttctatcgcctatattccttatgggttagatatgggtgatggcgagagaaaccgtgtttatcagtacaatcttccctgtcaaaatgttgccaggtgggtattcgttcgctctcagcggcataaagatgagtttgctaaatattgcggaaatggcaatcatcacgtctatgttagcggacatccaaagctagataactatccatcacgctttggcgtccagacggatggcaaagttaataaaggcaagccaacgctattatgggcgccgcatttcgtcatgcctgatgatgaaaagatgtggtctacgtttaatttatatacacaggcaatgcttgatatcatcaaacgtgatgacgtcaatttgattattcggccacatccgctttttaaacaatttctggatattcgtaaagagcgcggaacacacagcgaaactgctcagaactggcaaatgctgcgcgaatactctcatctcaaatcacatgtggagtgggatttttctgcagattatcgctacgccttttcacaatcagatgcgctgatggcagatgcaggatcgtttttgctggagtatttaccttcgcgtaagccaatccttttcctgactcatgaaaattgcctcggtattaacagtagcgctgaatttatttatgacgcttatgacgttgcgaatgaatccgcagatattaaaactttcgttgataatcttgtttcaggcaaggatcccatgcgtgataagcgactgcaggttttacgtgatgaacttcatatgccagagcagggcgcaggcaggaacgagaatggggcattgaccctaaattatcctaaatgcttgctaccggtcggtgaaatcaccgtgctggataggttgctgactgagctgttaaaatgcggcgagcgtgaaattgtactggttaccggtcatcagtcatcagttgtagaacgctggattaaagataattatgctgatgctaatattaagttagcgcacaatgataattataaaaatgatgtcaacatattatccgttgaaaaaggtgtcagcgcgcttaatcatcctgaatatggctatacaattatcgaaacggatgttctgctggatccacgtgtatggccgcggttaatgcaagctgaaatgggcagtgacagtttttggctcacccatggttattacaactcttgccttactggcggtattgtcgaagccagtaaagctgaacctgctataaagaaaattgcctatgtgcccgattacgactccgcatttgatggctggatgaaaatggtcggcttgctaagtgtctctccggaacaggtggaaaacgatcgacgcctgcggcagacgtttttacagacaagcactcagcaatattacatggcaccctggattgtacaccgctcttgcttaccctgccgtgctgtagatattacggatttgtttgcaagatctttcaacgaagaagtcgattaccggcaggcggttgcggattatcatttattattagaaaattttgaggcactaaaatga

SEQ ID NO: 1089 - DNA, 1785 bp, Glycine max
  Peptide Sequence Number=SeqID_92774
atgggcgcttctgcgacctgcgcctgggcggagcgactgagcgctgctgacgtgctcggcccggcggccgtggcgccactggatcatccccagccgcctgcgcgattaattgtcgatgccccgctggccggaccgctgcgcaagggcgcggtgtttatccagtaccgggcagaaaacctgcgcattgagcccgtgtttggccaggaagcgctgaaaatcacgccgcgcatcggccacattcacgtcatcgtggatgacaacccgtggcactgggcggacaccagcggtgagccggtgattctggtcggtctgcctgtcgggccgcacaaggtcacccttattcttgccgatcctacgcataaaccgatcgacagcaaaaccatcacctttaacgtgcccactctgttggcaacgctggttctcacggcggcaggcaccgcgtttgccgccaccccggcctcacgcgattacgccgctgacttcagccacgtgcagcagatcaatgcgggcgtactgaacacaggctatgtggacatcggtccgcgtgatggccaggcggtgatcctgttgcacggctggccgtacgatatccagagctatgctcaggtggcaccggcgctggcggcaaaagggtatcgggtgatcgtgccgtatctgcgcggcttcggcagcacgcgtttcctgtcggataaaacgccgcgtaacggccagccttcggcaatcgcagcggacgtcgtggcgctgatggatgcgctcaatatcaaacaggccgtgctgggcggctttgactggggcgcacgcacggcggacatcgtcgcggccctatggcctgaacgggtaaaatcgctggcgtcggtcagcggctatctgatcagtagccagcagctgggtaaaaaaccgctgccgccacaggcggaacagcagtggtggtatcagttctatttcgccactgagcgcggtcagcagggcgatgccacctttaaccagagcgccaaagcgctggataatccggatcaggtggcgatcactatcagcaactaccgctggcgcctgggcctggaaaaaggcgagcaaaaatatgccgcttatgagaaaacattagccacgttaccgacaattcgcgtccccaccatcaccatcgaaggggataataacggggcgccgcacccggcaccggagacgtaccgcaccaggttcagcgccaggtaccagcatcgcaccttcacgggcaatatcggacacaatccgccagcggaagcaccgcaggcgtttgtgcaagccgaggctgttttggagcacgttgatcacattctggtggtggatgatgaccgggatatccgcgaactgataaccgactatctgattaagtccggttaccgcgccaccggtgcggccaatggccgcgagatgcgcgccgtgctgagcagcagcctggtggatctggtggtgctggatatcatgatgccgggtgacgatggcctgacgctgtgccgtcagctgcgcagcgatccccggcagaacctgccggtactgatgcttactgcccgcagcgaagagaccgatcgcattctcgggctggagatgggtgcggatgattacctgatcaaaccctttgtggcgcctggatacctccgcgcgccatctgctggacagcgacggcgtgattgtggcgctgagtggcgcagagtaccgcctgctgcgcgtgtttctcgaccatccgcagcgcgtgctgaatcgcgatcagctgctcaacctgacgcagggtcgcgacgcggagctgtttga

SEQ ID NO: 1090 - DNA, 3255 bp, Glycine max
  Peptide Sequence Number=SeqID_92775
atgccaattaccttcaatcaggccttaactgcagagtgcgagttttcagaatggacaatcagtaataaaaatcgagctaagctgattgaagtgattgcctatttatatttacggcaggaagaaaatgctcagagagtaattgatgccctagagccgcgatggcgggtttcgaaaggcagggtggcggagaatgttgtgagaaaactgacggctccgcgtgctgaagacgtcgagctactccagtcaggaaccgaagcacagaaggaggcagcgagaaagcggatcaacacatctattattcaccgggatggacttctatttcagcatatctcctggattgccgctcggcttgagctttcggacggctatatgacgtcaccccacgttcgacaggcggataaaggctttgacggttttatcatcgagctagatgaaagagtgtgtgagatcaaacgaattgtgctctgtgaggacaaggcttcgaaatcgccgcgcaaccttataacctctagcgtgtggcccgaaataagaacaattcggagcggcgatcgcgatgatgagatcctcgctgacctcgtaactttacttaggagtgttccaagtatcgacgcagaagaggctgtggataaaattttctgggaaggtgctcgcgagttcagagttgctgtagcaactggtgaagatcagcgcagagctggggattttttgcatatcatagccggttttaaaacggcggctggtggtgaacttgaagctcgcatggctggtgtgttggccttcgaagatgtgcgtacgggtttggatcttctcgccggagaggtggctgccaaagtcgaggagatcgccaatgcccctgatttgcccggcctcgcacctgaaactctagacgagctgttgacggctgcacacatagaactagcgactgtacggcttctgtctcgcgaaggtgaacctgaggccataagcgatgtactcgaccaggtacgacgccttgcttcgaccttcgaagcctatgttgcactcgatcttcgaccagagcaaacacgcgccacggcttttgtcgccgcgagcgctcatcagatattgagccgcgttcgcgagaccgcaacggatcgcccaaccgttgtttcaagtgatgcaataggatcatcaatttcagcgacgcttttattcctgattgctggtcgggcagcagacgcagcggaagtcgctagtcagctccgggcgaagggtgaacgtcgggcagtacgacgttcgctgatcctgagccttcgggaattggctactggtaatctcacgacactgatagagcgtgacctcggcgaacacatcatcgcaacgcgagatagccgagaagtagccactgaccttcttttaagggaatgtgcttatgtcgttcaggggcttggacaggaggcgcgtggaagcgctgtgcccgacactgatattcgttcaagactcaagcgtgttctccacttgtcggaggcctcagaggtagagatcaacgcagcgttggaagggaaagttcatcaccagtttgccggtccgcatcatttggccactttgttgagtcggcttattgatggagtgcaggctgcgatgctaattcgactgccagcaccatcaggtgcgcaaccaaagacatgggccgactggctcctgtctcagacacattcccgtccatttctctggatcaatcatttaaaagctatcgggacgggatatctgaaccgtggcaggtctatggtaatgacgtcaccgactggttcgggcaaaactacgctatccgtactaaaaatcgcagcaactctttgtgcgggtgagagcgttgtttatctagctcctactcacgcgctcgtcgatcaagtcgagaccgatctctccgcacaaatcggcgagttagaagtggtgagcgtcgttgaagacgttgcgctcgaagagcttggggaaaagctgccaccattctctgtcatgacacctgaacgttgccttgccctccttggtttcgcacctgagctttttgataaggtcggtctccttgtcttcgatgagtttcacctcattagtgcagatgatcccgctacttcatcgaaaattagtacacgagccattgattcgatgttggcactcctgacgtttctccgccatcgtaagagagcagacctattactactgtcagctatggtctctaacggcgcagaaatcgcacgttggttgcggtctgtaacgggaagggaggttgagtcgttcgacgatccttggaagccaactcgacagcttcgttcttgcgtcatctatgaccgctctgacgtgcgtgaggccgtacaagttgcatcaaaggcaaagaccaaagctgcaaggaatcgggtttacgcacaacctcttggactcttttccctgatttctgggtggcatcctaaaaggccagagaagctggtaatacaggcgctcacggatcaaaggccgtcgcttcttaaaaatgccaaaggaaaattgacatcaaacagaaatgaagtcgctgcgcgaatcgcggcagactatgcagccataggaaagcgggtgattgtgttctgcaacgataccaaagcgtgcggaagcgttgcaggccagatcaatgagctactggcgccggccaccatcgctttggatgtgacgcaggaggaaatgcgtaaatcagttatcagggatattggagcggtcgaagctacatttgaccctatggggtgcagggctgcagttcatcatggtgacttgctaccattggaacggcggctgaccgaaagcgtttttcgggctcgtagggatactgatagtgaggacctaggacttgatgtggtcgccgcaacatccacaattgcgcagggacttaatctgccgtgtgatgttgtgattcttgctggaaccgatagaagtgcggttgatgatcccagcgggaaccctcgtgcggacttacgtcctcacgagatacttaatgcgctcgggagggctggtcgtgcggcgtatgccgcaaccggcttggcaatcgttgttcctgcaacacctatctgtgtggaaatagataacctctcccttccgtcggatggaattatgaagatcattttctcggaacaggatgcctgtgaagaggtatatgatccgatagagttacttcttgaccggatcgagatatccgctaattcggatcctaaagtgcagtcaattatccggcgtatgtctgctgtcaccgcaacaggagagagcggcttcgacgatatc

SEQ ID NO: 1091 - DNA, 1543 bp, Glycine max
  Peptide Sequence Number=SeqID_92776
atggtatgcggagtgaggggggcgggtagaaccaaaagcacttactacgtgtggcgctctcctggaagagaagacgtcgaagtgatagcgctaacaacagtcttactggtgatgcagataatgctagctgacgcagctacctatcttagcttattagtcggtgtactggcactgtttggtattgggggcggtgttacatatagaatcagacagcaaaacaacatcaaacagaaggcaaagaaaaccgagggtgatgtgaaccaggccgggcgggatattaatcagaccaccaacgtttaccacacatccaatgaatctgctgaggaccctgtaaaaaaaaagcaaaatgagcatgatctgaagatcatcgaccagattcttgaattgctgccttatgaggatactactcaatgggttgagcagagctacctgagcggtatacggcaagatgtttgcttaaacattgaaaaagctgaaaaatttagcggtgaaaagtatcggttattcaatactgaagtgaatggtgcgaaggacgcttttatggacgctatgaccgcatacgtagatagtacgctaccgtttatgagtgttgattacccgaacagaaagccagtgatgctaagccttccccatgactggaagagtaagagtgttgaatcggaggcaaacttccgctttcatcagcaaaatgtgcgtgaaacatcggggccgtccctccgggggcggcttttttatgactatcatggacagaatcacctgaacgtccaggtgggtttccctgacatgacgtcaaggaatgttcgctttgtgccaagagcggaagttgaagatcaggaccaagaaagaagactaaacattcgcatctttgaacccgcaagcacagttgaggatattcttatcgtttaccacggtggtggagtcaactcagatgctggttacgatatgcttgctcatcatataagtcatcatggagctatttgtacatgcctcatagatatccgtggacacgggcgctcattgggtaacaaaggtagcgtttctaatccggagcaggtctggcaggatatcgacactgttcttgaacatgttcgcgtaaagttcccttgggccagagttcacttgcttggccattcaagcggaggggggatgttgatcaattattttactcgcttcaccccctctcaacaaagtgacagcctgattttacttgcgcctgagtttgggccttttgcaccagctaaaatttgcagaaaaacaatggttccattcgcgtcggtgagcaagtggcctttcgtactaaatgcgcttagtgtgggattactatgcggtaaccgttatgcagttactcttaattttcccaatgaggttatgctattaagacctgaatttgttcagcgatacagcgtgaatatggcgaatgctttgacgccgcgtcaacctgcaaggcaaattgcagcattgccattacctgtaactgttctgatagctgaaaaggatgagctatttgatgcaagacaaatgtcagagtttgtagaaggatgtg

SEQ ID NO: 1092 - DNA, 1659 bp, Glycine max
  Peptide Sequence Number=SeqID_92777
atggggccggtacttatctggattttccagtggctttatcggggcctggtcatcggcagcgtcccagtgctaacctggccggtgcttatttcctttactattgccggtattattttccatattctgctgcgcagagtattaacccccgaactggataaaataaagaaacgccttgtcagaaaaaccacgcttgaacgggaattacgtactgatgtccgtacggtgaaatccctgctgccggaaacgctgcattatgacccgctggattatatcgacctgaacaaagggttatttatcggcatggaccgcgatattcagccgatgtacctgccggtaaaggactggcaaaaacaacacgcggatattatcggcaccactggcgccggtaagggcgttgccaccgggatattactttatcaaagtattttggctggtgaaggcgtatttgttatggaccccaaggatgatgaatgggccccccacctttaccgtaaagcctgcgaggatgcagggaaaccctttgccttaattgacctgcgaaaaccccaataccaattaaacctgattgaagcgatcaccgccgatgaactggaagagctttttgttgccggtttcagtctggcagagaaaggtcaggagtcggacttttatcgcattgatgaccggaaagcggcccggatagccgcgcagtttgtcacccgtaatactgccgcaaccattcgggatgtgtataacggagactacgttcagggtattgccgataaaataaaagccttttttgggaaaattgaagagctggccctgctcaatgccatcaatgcgccgacaggattttcgctcaataagatatttaaggaaggtggttgctgttatgtgattggctcaatgcgcaacagcaaaatcattaccgctcagcgcatgctgctggttcgcctgtatcagctagcggaaaagcgcgagcgagtgaaaaaagtgccccgccccattgctatttatctttccgaactgaaataccatttatccaggacagcgctggaaggtttgggcgcggcacgggataaaggcgtgcatattattatggaccaccagtcgattgccgatttaaaagactgcccggcagatttgaaaggtgacgccgttgtcggcgccgtcgttgagaacgccaaattcaaactggtttatcgcgttatggacccggataccgctgaatgggtagccaggatgtcaggcactatattagtcgatgatgaggtccgcaaagcgaaaaccgatgccgtgctgacagagactatcgacagtgaacgcaccatcagacaggccgagcgtttctttaccgacagcaatatgatcctgaacctacccgattttgtcagcttcatttttacgacaaaagcactcccctctgcttctctgatttcgcccatcagggtgaaaaaacgcgaactggagatctgtgccgtgtcgcccgcgattgccgccaccgcagcaacaataaacatcgccctggattttagcgaggaagaaatctcccccggaccggcatcaacgccggatatcaccacaacgcggcccgatcttttttttgataatacggacgaagaagacacaacaacaccgaacgccgaaaaagaggaaaacccatcattgatggatttttaa

SEQ ID NO: 1093 - DNA, 1762 bp, Glycine max
  Peptide Sequence Number=SeqID_92778
atgcgttacgcctttgcctacggcgccgacgcggtctatgccggccagccgcgctacagcctgcgcgtgcgcaataacgaattcacccatgaaaacctcgccaaaggcatcagcgaggcgcacgcgctcggcaagaagttttacgtggtggtgaacattgccccgcacaacgccaagctgaaaacctttatccgcgatctgacgccggtcatcgaaatgcagccggatgcgctgatcatgtctgatcccggcctgatcatgctggtgcgcgacgccttcccgcagatgccgattcacctgtcggtgcaggctaacgcggtgaactgggccacggtgaagttctggcagcagatggggctgacgcgcgtgattctgtcacgcgagctgtcgctggaggagatcgccgaaattcgccagcagcgcgatcccaatcagggcacctgtaccaacgcctgccgctgggaatataacgtggccgaaggccagcaggatgaggtcggcaacatcgttggcttccatcagccggttgcagtgcagcccgcgacgctcggcgtcggtcagcctaccgatcgggtattcctgctggaagagaagatgaagccaggcgaggtgatgagcgcgttcgaagatgagcacggcacctacatcatgaactcgaaagatctgcgcgcggtggcgcatgtcgaacgcctgagccagatgggcgtgcattcgctgaaaattgagggccgcaccaaatcgttctactactgcgcgcgcaccgcgcaggtgtaccgccgcgcaatcgacgatgcggccgccggcaaacctttcgatccggcactgctggagacgctggaagggctggcgcaccgcggctataccgaaggttttttgcgtcgccacacccacgacagctatcaaaactacgaagcagggtttttccatttcggagcgtcagcagtggcggtgaagaacaagttcatgctgggcgatagcgtagagatcatgacgccggacggcaatctcaactgcacgctgcaggcgatgcagaatgacaagggtgccgcggttgaggtggcgccgggagatggtcatcgcgtctggatcagcgtgccggagggggatcacagaccgccgcttcgccgcgcattagaatcgcgcctgctgctaacgagtaacaacaaacagcaggtagtaccaggaaccacctcattcacccgcccggctcccccggaagcgataatgcaaaataaacccctcactttgctgattctgaatggaaaaggcgcaggcaatgaagagttgcgtgccgccgtgaataccctgcgcgacgaaggctttaacctggcggtgcgcgtgacctgggaaaaaggcgacggtgaccgctacgtgcaggaagcgctgcagctgcaggcggaaaccgtagtggctggcggcggcgatggcaccatcaatgagattgccaccgcgctggccgccctgccgccagcgcagcggccggtgctggggattttaccgcttggcaccgccaacgattttgctaccagcgccggtatcccggcagaaatggaagcggcactgcggctggcggtactgggcaaagccacgcccattgttatggggagggtgaactgcgaccgttacttcatcaacatgccgaccggcggttttggcacgcgcatcaccacagaaaccccggagaaattgaaatcggcgctgggcggcgtctcttattttattcatggcctgatgcgcgttgatgcgctgaagccgaacagct

SEQ ID NO: 1094 - DNA, 960 bp, Glycine max
  Peptide Sequence Number=SeqID_92779
ccagcgcgaagtgaacccgctgggctttatcgtcaccagctaccagcgcgacaaagagttgaggggggaatgatgctgaaatacattctgctcctcacgggtttactggtgtcatgtgtggcatggagctccgcgacaccgcgcggcagcgcgtatgacagccggatgcagaacgtcacgtacaacagccagaacgccacggtcgtcagtacccgccccggctacgtcaccatgctggtgtttgacgatgatgaaaccgttatcgatgcgcaggcgggttttcccagaggctggaccgtgacgaaaagcgataaccgggtgggcgtcagcccgaacccgattacccagccggtcacggatgccagcggcaacaccgtcagccaggtgtttctgccgacggcaaaagactggaaaaccaatctgttcgtggtgacctcgaagcgcgattacagcctggagctgaacgtgctggataaagactcgcccgttcaggcatttgttatccgctaccgctatcccgatgagcagaggaaaaagtcagccgctgccagcgccacccgtcagcaacgacagcaggaaacactggaccgcaagcggatagcggcggcattcgggaaggctaccactccgcgcaactggcgctatacaaaacgggtggcagcaggctcagccttcatcgccccggactttacctgggatgacggtcgtttcgcgtatatcggtttttcccccacgaagaccctgccttccgttttccgggtggttaacggccaggagcaggcggtcacgcccggaacggttaaacggggcagttacaccgtggtggtggttccggcatcgacgcagctggttctgcgttacggcacctcggtggtgggggtcgaaaacgacggatccgggcgtatcccgctgaccaacagtgacactgtttcaccctccgttacgctggaggcaaaatga

SEQ ID NO: 1095 - DNA, 486 bp, Glycine max
  Peptide Sequence Number=SeqID_92780
atgaatgctcttaatcagttatcactcgatgaactgtttgctgtcagccgggcggcggctccctttgtttcggtcagtgtccgccatgatgttctgcatcatttattggcgcaggcccgacaggaataccgacagcagcagcagattaaccgggctatccggctgggcggttctatcgcgttgctcaaccactactttggcctgacgtctaatgatgtctgccttcagcgacggttgctgggtgtcagcgtgccatatggacgtacacctgagccggatgaagagacagatgccgagatctggcggcaatggcagaagtgccgggtgggcaacctcgaatcgcctgacgcactgattgccatgatgcaggtaacggaagccctgaagcgtaaggtcgaagggctatcactcaccatggtctggaaacgtatcgcactgtgcgaacaggacgctgccgctgacaggaggacgccacatgccggatga

SEQ ID NO: 1096 - DNA, 1977 bp, Glycine max
  Peptide Sequence Number=SeqID_92781
atggcttctccttcactactgaatgatgcgaacgctctgctctattcggcgaagagttttaccgctgcgatgctcgcatactatattgcattatcaattggcctagagcggccttcctgggcaattatcaccgtatatattgtttcccaaacctccgtcggagcatcgctaagcagaagtttgtatcgtctggtgggaacggtaattggcgctggcatgacggtattaattgtacccacgttcgtgaattcacccgtattttgcagcgtgatactggcaggctggattacattctgcctctatctgtccttgctggaacgtacgccccgggcctatggttttgtccttgctggttacactgcgagtctgattggcttccctgcagtatctgatcctggcgcgatttttgacatcgctatcactcgggtacaggaaatcatgatcggtatcttctgcgcggcacttattcatcgctatgtattgcccgcgcgcatctcaggtcagttcaacagtaaattatcgcagacgctgctcgcggcgcgacagcgtatcgcagagactttaacaggcaaacccgatcctgtttcctcgccgctgcatatggcactggcattgcagttcctgcagggcatcagccatcatatcccttatgattttgcgttctctgtaccggtccggcaagcgagaaaaaggcttcatgacaggcttgcgcgattagtcattgttaactgtgagttacgtgaccgtttagcgctgatagcgaagatacctttcgatgtgcaaattttaatggatgatgttgaggtctggctggcctgcaaagatgaaggaaaatttaaaagcgagggggaagcgctcaaaaaacgcagtgaaaaattactgcagcgctatgtcgtacatgagttgacgtttgtagaagcactgcatgtaagttttatgcgctacctgacagaggccattgtcctcgtgcagcagtgctatcgtctttcggatgccattcatcacgcgaatcagatgcctgcgcactcagaaatgaataacgtgaaagggtatgtattccaccgcgatcctcttactgctgcccgcaccgcattgggcgctttcaccatcattttgagcggctgcatggtgtggattttctcggcatggcctgatggcggtacggcagtatctatccttggcgtttgttgcacactgtttggcagcttcgatacgcctgccccgcatattgtgaaatacatcattggttccctctggggagttgtgataagcctgatctacagcttcgttctcctaccgcaagtcagtgattttatcgtgctggtagtggttctagctccggtatatctgcttgccggatcgctccaggcacggccgcccactacttttatggcgatggggatcacactgacgctgcctattttgtgcgagctgggtgctcattacagcggggattttgccgtggcggtgaatacctctatcgcattattttctgcaactggctttgcggtattcagcatgggctttctgcagactgtgcaggcagatgcggcaataaaacgcctgcttaaattatgccagcgcgatattaaccgcagcgtgaaaggtgtgttgaatactgatgaaactctctggatcaacctgatgatcgatcgggctgcgttgatactgccgcgtttgccgcgcagcggacagtcatcagaacaggcattgaatcatcttttgcacaccctgcgtataggcctgtgtgtaatgcgattacgccgatgggatgcgcatgcagacaaagaaataaaagaggttctcacttgtcttacacactcgacggatattaacaccttacttgaacggattgtcagcctgactgagcgtagcctgtccgtagcagatgaactatcgcggcatcatgttaatcaactggttgatctgtactgcgcattaagcactcaggaaatggagcatgccgatgatcaatga

SEQ ID NO: 1097 - DNA, 698 bp, Glycine max
  Peptide Sequence Number=SeqID_92782
atggtggccagacgagaacctgagctgattcttgctgcgaaaaaaatttcagagaaatacggtgtttcggtgctgcctattgccggggatgtgactgatcccaaactaccttctttagtggttgaacaagcggaaaaggtttttcagcgtattgatttactggtgaacaatgccggaagagcccatgcgggcacgctgttaaccacttcggaagaagactggcagataatgactgagaccaaattctccgccatgcgacgtttttgtaaggtaatcatccccgggatgcagagacgaaactgggggcgtattgtcaatatctcatccattggcggtatctaccctaatccgcaacttaccgtctcacacgcactgagcgccgctatcaacaacctgacccgtagtttagcacttagcgtggctccggatggcattctggtcaatgcgatcggagtgggtgctgtcgcgacggataactgggcgcagaacatgctaccgaatgttcgcaatcgtcgtcctgaactagctgacagaacagacgaagaggtaatggcattactgggtaaagagaaaacgcctgtgggccgctttggacttcctgaagatattactgcaattgctgcgttcctactttctgggaggaatcagtttgttactggacagacaattgaagcatcaggcggagcagacagatttat

SEQ ID NO: 1098 - DNA, 3362 bp, Glycine max
  Peptide Sequence Number=SeqID_92783
atgaaaaatgaaaatggtaacagagtttcagaaagcgagcagcggttacagcaatggcttggcagcattcacgcccgaagcggcgacctcgctgcaagtgaggctaaagttgtcgatctcctgcttgtcgatcctttgtttgtcggtacaagcacgacagcacaggttgccacccgcgcaggtgtatcaccgccgacagtaatacgcgctgcacgagcgattgggttcaccgggttcactgaacttaagatagagattgcccgggctcgtggtactgcccggttctttgcaccgcctgaagttctcacagcggatgcgacgttggcatcggtgctggaaacatcagttcgtgctggtgcagacgcgctgactgcgctcagtggtgctattgaaatctccgcccttgatgaggcggtcgatttaatccagagcgcacgccaggtatttgcatttggtgccggcccctctgcgacggttgccgctgatgctgtatttcgtctgcggacggctggtgtgataaccatcagtatccaggattatttatcagcgatgattgctgcccgcctactcggttcaggcgacgtgatgatcgtcgtcagctcgacaggtcgcacatcatccacactcgccgttgctgatgccgcatcctcggccggagcatcgcttatcgcaataactaaccagtacgatacaccactggcgacactcgccaacgtttcgctcgtggttggcggagcgccattaccggcacagatggccgctgccggcagtagactggcccagctagtcgttattgatacgctggtcgctgccctcactctgcgggataaagaacaaagtcgccgggctgaacgagcggtagctcatgcagtatggaatatagcctcaaaatacaagaaggaagacacacttttgttcgtctgggcctacagctgtgcctcagcattgttgtgggttccgatcagcctcattctgacagttgagggacaacaggagctcgactggcgactcgcagtcggggcagctggctacgagcgcgccgaacttggtgttgtttatccgattgcccgggggagcggaccggttctgacgatactgtttgcaacccttctgatgggggaacggctttcagcaagcgctttactcggcgcgcttctcgttatcgctggtattttcgttgtcaccggcaatccattcaggagcggaagccggccacttaaaggaatgatatggggggcagcgacaggcaccgccatcgctggctataccctctgggatggttattcggtaatctctctgcacctggatccagttagttactacgccagcacactcctgctacagagtcttattctgacccctggtgcgatgcgacgacggtatcgaatcccaacggctgtacgtgtagatagagttccgatccttatcatcgctgtatgttctccacttgcctacatccttgtgctgacagccatgcagagcatgccactggcactcgtcgctcctctcagggaaacatctattattgtcggctctcttctctcgtactggttgtttcgtgaaaatcatctggcacgccggattgccggtgcagtggtggtatcaagtccgcttcctctgtctgtggctgttagcgccattgagataagactgtatataccgccatcagtcctacgagagttcgtgatgctcaaaacagaagatctcaacactatgatatcaattgatgagattcactttgctgactggcaaatctggccacagctaaggattctgttacatcggggtaagccagtaagaatttctgccagagcttttgatgttctagttgctctggcacaaatttcagctatacgccgcatactgggacatgaccgccatctactggttactgaatttggttgtgcgtcgattctggggcgtgataaagctgtgcaggaattatgcgccttattggatcaataccgtctggtgacgattacaggctcagggggcgtgggtaagactcgtctggcatgggaagtcgtcagtcttacacacacgcattttcctgatggaatatgtgtggctgaactggctcatatcaccgaagcatccagcttgctatccgttatttcacaagcgctccatcttccattagctgccattcataatgatgccgatttacggcaacagcttgcacggcgtcgatgtttactgctgattgataactgtgaacatgtagcgttgcaggttgccggcgagcaacattatctactaccaccattacaagttcctgagagcgaagaggctgatacccacgagttactgactttttccagtgtccgcctctttatcgaacgcgggcaggccaatcgacatgattaccatccatcagccagcgaactgtctttgattggcgagttatgccgtcatcttgacggtctgccgttggcgattgaacttgcggcctcccgtctgccagtcatgagtgtcaaagagatctatagccgactggaagaccgtttccagctattgagcaatacgcacagatctctggagcccagacatcagaaaatactgaccgcgctggagtggacttatcagttgctcaacacacgtgaacaacgattattttgctctctggggatctataccgatatgttcagtgtgaaatcagtaagcgaccttctgctgattaaagacaagcatcgctggcaggttgttgacgatctgcaaagattgctgtgctttatccctgattcaggtcagtactcaggtaccagagacccgtttccgcctgctggaaaccatgcgccaccaacgggacagtggcgtgaacgttatagccatatgcttaatgatttgcggagtgtattacagcaaacgttgactgagggggccgatccttctaaggggcttaagatattacaagcgatgacccctttttggattgaatattcactatacgatgaatgtaaggcgtcaacctgggcaaaaggccctacgcctgaaacacattcagcctggaaaaccgcgctgacaattgcagaaaagctcgacgacaaagaaatacgtttacaggcacattacggattatggttgtattatctgcgtactggcgagttggataaagcgcttgagcatgcgcaatctatgtgcgagctagcacggtccattaccgacgaggaggcgatggcaaccgggatgcgtattctcggtgtatccctgcattttttgggccgtcatgatgtcgggcgtgattatctccagcaatctcttgattggtatgaacatggtgaattaagccactctttccgttttggtcttgatcaagagagcgctcggtcaggcctttctgtctcgtttactctggttacagg

SEQ ID NO: 1099 - DNA, 435 bp, Glycine max
  Peptide Sequence Number=SeqID_92784
atgcgcactgctcatatcgtgcccctctcacagcaggctatagctattctgaaacggattaaggaaatatccggggtttatgaactggtattccccggcgaccacaacccgtacaagccgatgtgtgaaaacacggtcaataaagcactgcgcctgatgggattcgacacgaaaaaagacatctgtggtcatggctttcgggcgatggcatgcagtgccctgatggagtctggtctatggtcgcaagatgcagtggaacgccagatgagtcaccaggagcgcaacaccgtgcgtctggcttacattcataaggctgagcatctggaagcccgcaaggcgatgatgcagtggtggtcggattatcttgatatatgccgggtcgcatacgtacctccttttaacacaggacgggataaaaacaacgaagcggcatga

SEQ ID NO: 1100 - DNA, 1908 bp, Glycine max
  Peptide Sequence Number=SeqID_92785
atggcgctgaccatcgccaccggctttgtagtggatgacgccatcgtggtgctggagaacatcgcgcgtcacgtcgaagccggcatgaagccgctgcaggcggcactcaccggggtgcgcgaggtgggctttaccgtgctgtcgatgagcctgtcgctgattgcggtgttcctgccgctgctgatgattggcggcattattggtcgcttcttctcggagtttgccatcacgctgtcggtggcgattctcatctcactgtttatctccatcaccctgacgccgatgatgtgcgcgtatctgctgaaaccgcaggcgaagcgcagccagccgcgcacgcgcggatttggccgcgtgctgttggcggtgcagcagggctatgcgcgctcgctgggctgggtgttgaaccacgcgatctgggtgctgttgctgctgctcggcaccgtcgggctgaccatctggctgtttatcgccatcccgaaaacctttatgcccgagcaggacaccggccgtctcaacggctttatctccgccgatcagagcatttcgtttcaggcgatgcgcggcaagctgcaggatttcatgaacatcatcaaggctgacccggcggtcgataacgtcaccggcttcaccggcggctcgcgcaccaacagcggctcgatgtttgtgtcactcaagccgctgtcagaacgcagcgaaagcgcgcaggaagtgatcgcccgcctgcgcgtgaagctggcgaaagaaccgggtgccaacctctacctcaatgcggtgcaggatattcgcgtcggcggacgcgagtcgaacgccagctaccagtacagcctgctgtcggataacctcgccgatttacgtgagtgggagccgaaaatccgccaggcgtttgccgcgctgccagagctggccgatgtgaactcggatcagcaggacaacggcagcgaaatggcgctgacttacgatcgcgaaagcatggcgcgcctcggcatcgacgtgtcggcggccaatgcgctgctgaataacgccttcggccagcggcaaatctctaccatctaccagccgctgaatcagtacaaagtggtgatggaggtggatccgcgctatacccaggatgtcagcgcgctggatcagatgttcgtgatcaacagtgacggcaaagcgattccgctgagctggtttgccaaatggcagccggccaacgcgccgctgtcggtcaaccatcaggggctgtcggcggcctcgaccatctcgtttaacctgccggaaggggtatcgctgtcgcaggcatcggaggccattgaccgcaccatcacggcgattggcgtgccgtccagcgtgcgcggcagctttgccggcaccgcgcaggtatttcaggattcgcagtcgaaccagctgtggctgatgctggcggcgattgctgcggtgtatatcgtgctcggcattctgtatgagagctacgtgcatcccctgacgattctctctaccctgccctcggcgggcgtcggcgcgctgctggcgctgcagctgtttaatacgccgttcagcctgattgcgctgatcggcatcctgctgctgatcggtatcgtgaaaaagaacgccatcatgatggtggatttcgcgctggaggcggagcgcaacggcaacctgtcggcgcgcgacgccattttccaggcgtgccagctgcgtttccgcccgattctgatgaccacgctggcggcgctgtttggtgcgctgccgctggtgctgaccagcggggacggcgcggagctgcgccagccgctgggcatcaccattgccggtgggctggtgatgagccagctgctgacgctgtacaccacaccggtggtgtatctgatgatggataaactgcgccgacggaaaaagcagccgcggttgataacggagccataa

SEQ ID NO: 1101 - DNA, 488 bp, Glycine max
  Peptide Sequence Number=SeqID_92786
atgtcattgtcacttttcacgtttttcctgatctctgcctgtacgccgttttcccacctgactacacttcttcaattcgttgttatccggagcctggctactgatgccaatctcgccactgtcatcacgccgcatgacgcctgcgctgcgcgtgcatctctcctcgatagccgctttcaggagagtctggacgagcttaattactatcagcggatgctcagctacgcgctgacgcacccgctgaatgccgattatggtcagcacgccctgcagcgttttcagcagttgcgccatcagccggtgtggcagttgcagatcgctaacctgcgcagcatgccgattaacggcgtcagcgacgaatggctgcagcgtgatgcgctgctgcagcgcgatgatacttatctgctgcccgagctgcgcgctgcgctggagttcagctttatcatgcagttcagcgatgaggcgcaggactttcattcacgcttctg

SEQ ID NO: 1102 - DNA, 348 bp, Glycine max
  Peptide Sequence Number=SeqID_92787
atggctacagcaaaagagtacagcgataacgtgcagcgcgaagtgaacatcgacgtggacgcgctgctggaagcgattcagaaaaaaacgtcaggtgaagtgcaggagtttatgcaggctgaagatgcgcaccgcgtgaaggtgaatggcgaagcgtttgactcctacaccgaactggccgaggcgtttgaactcgatattcgtgatttcaccatcactgaagaaaatcttaacaccgcttcagagtacgccttagctgaagtaagacaagtctcaattctgcacgcaattcgaacaaatctgcataatcatgcactgctgttaccgaaaacatcgcgctacggctga

SEQ ID NO: 1103 - DNA, 6888 bp, Glycine max
  Peptide Sequence Number=SeqID_92788
cagccgctgcgcgagaaattcctcaaaaacatgtcggcgcgcgccgccgatatcctgcgcgacgacctcgccaaccgtggcccggtgcgtatgtctgcggtggagaacgaacagaaagcgattctgctcatcgtgcgccgtctggcggaagcaggcgagatgccgcctgagcctgaactgctgctggcagaggagccggacagcgacctcgtgctgagcgaggaagatgaacagcagcagcagctggaacgtctgcagcagcagatgcgtaaagatgcgcagacgcagggctacagcgaaggttatcagaaaggcttcgccgaagcgcagcaaaacggctatgacgccgggttccagcagggactggccgatgcccagcagcagcaggcgccgctgcaggcgcgtatgcagcagctggtcaccgagttccatcacacgctggaagcgctggatagcgtgattgcgtcgcgcctgatgcagctggcgctggaagcggcgcgcacggtgattggccaggcgacgcaggtggatggcagcgccctgctgcgccagatccagcagctgattcagcaggagccaatgttcagcggcaaaccgcagctgcgcgtgcacccggatgatctgcagcgcgttgagcagacgctgggcccaacgcttgatttacacggctggcggttgctggccgacagttcgctgcatcccggcggctgtaaactcagcgccgaagacggcgatctggatgccagcgtcgccacgcgctggcaggagctgtgccaccgcataagtcaggtgcagacggtgcgccgctatggccgcctgacgcgtgccaccggtctggtgctggaagccaccggcctgcagctgccgctgggcgccacctgcattattgagcgccacgacaacggcacgattaccgaagtggaaagcgaagtggtcggcttcaacggccagaaactgtttctgatgccgctggaagaggtcgatggcattctgcccggcgcgcgcgtgtatgcccgcgtgcacggcgatcacagcggtaaacagttgctgctggggccggagctactcggccgcgtgctggacggcagcggcaagccgctggatggcctgcccgcgccggaaaccggctaccgcgcgccgctgatcaccgcgccgttcaacccgctgcagcgtacgccgatccacgatgtgctggataccggcgtgcgggcaatcaacgccctgctcactgtgggccgcggccagcgtatggggctgtttgccggctccggcgtggggaaatcggtgctgctcggcatgatggcgcgttacaccaaagccgacgtcatcgtggtgggcctgattggtgaacgtggccgcgaagttaaagagtttatcgagaacattcttggcgccgaagggcgcgcgcgctcggtggtgatcgccgcgccggccgacgtatcgccgctgttgcgtatgcagggggccgcttatgccacgcgcatcgccgaagatttccgcgatcgcggtcagcacgtgctgctgattatggactccctcacccgctacgccatggcgcagcgtgagatcgcgctggcgatcggcgagccgccggccaccaaaggctatccgccttcggtgttcgcgaagctgccggcgctggtagaacgcgccggcaacggcattcacggcggcggttcaatcaccgcgttctataccgtactgaccgaaggcgacgaccagcaggacccgattgccgactcggcacgcgctattctgacggccacatgcgtgagctgcgcgtcgcctggcggagcaggatctggaacgggtgatccggccatgcgtcgcggatcagcacaggctcgatcagccgatatgtccggcgtgcgccagtcaggagcagattactctccagctattcagacgctggaaaaagccatcggaacagcgtcgccagcagcttactggaaccagcggctggaacaggcgcgaatgaacacgctgccaacactgctgacacagcttgccaaaaccggcaaagcgcaaccttcagcggcagtggacaatctgtccgctgctgacaccctgccgcagggatttattactgagctgggcaaccgcctgctgacgctggttaagcagcagggaaatggcgcgcaatccgctgatctggcggcagaaattgacgcgaaaaacgtcacaaaagcgtcattaagcgccctgctgctggcactggacaaaccagaggcgttaaacgcacttttacagccggaaaacactaaagccggactgaaatcagccgatgataatgacaagcgcgcagcaagttcgttaactgccagcgacttacagaatgtgcaggcgctgtttgctatgttgccagcggtggtcgaaaaccgcagcagcccgccagcggataacagcaccgcgctggaaacccggggtgaggcgcgcaccagcttaaacgctgcgttacttaacagttcgctgcaaagtgcgctgaaagaggaacaggcgaagccggatggccagccatcgaaaggcagcgatgcgctgaccagcctgaccggtgtcagccatagcccggtgcagagcgcggccgccagcggcacgccggccagcaacagtggtatgacgctggatgagagttttcagcaggtgctgagcacgctgagcaaaccggaagagcggcgcgagatgctcagcagccatgacagcagcgcgccggccatcagcagcccgctgagcagtaccagtccgctggtcagcaccacggccagccccagcagcgcgccttccacgccgatgctgaatgcgcagctgggcagcaacgagtggcaacaggcgctgagccagcagattgtgatgttcagccgtaacggccagcagaacgccgaattacgtctgcatccggaagacctcggcgcgatacagatcagcctgacgctggataaagatcaggcacagttaacaatggtttccagccacagccatgtgagggccgcgctggaagcggcgctcccacagctgcgtacggcgctggcggagagcggtattaacctgggacagagtaacgtcaacagcgacgccttcgcacagggccagagttatcagggccagcaggaaggacgtcgcgacggccagtacggcagctttaccctctcccaggacagtgacaacgagataacgcctattgccgtcccggcagccctccaggcgcgcgcgaccggcaacggcgctgaagtaactgcaaacatgtctgataacgcgaaagctaaaggccgcaaacgttcattactaattccggtgttactgattgtaacgctggccgcttgcagcgtggcaggctatgcagtctggcgaatgatgaataaacacgagggtgacaagccggaggctgccaaagtggagccgccgcccgccccggtattttttgcaatggatacgtttacggttaacctggtcaatcccgacaacgatcccgatcgcgtgctgtacgtaggctttaccctgcgtctgccggatgaggatacccgtcgtcggctgaatgactacctgcctgaggtgcgcagtcgtttgctgctgctgctttcacgtcagagcgccagcgcgctggcaaccgagcaaggcaaacaggccctggttgaacagatcaaacaggtgctggcgccaccgctggctgagattgacgcgctgctcaatggcgacagtgacagtgcggaagtagagaacagttccaaaggggccgatggcgatatccgcccctatgatcccaatacccagcgtcgcgtggtgcgcgagcgtctgcaggcgctggagatcatcaatgagcgttttgcccgtcattttcgtatggcgctgttcaacctgctgcgccgcagcccggatatcagcgtaggggcaatcaagattcagccgtaccatgagtttgcccgcaacctgccggtgccaaccaacctgaacctgattcacctgcagccgctgcgggggactgcgctggtggtgttctcgccgagcctggtgtttatcgccgtggataacctgtttggcggcgacggtcgttttccgaccaaagtggaaggccgtgagttcacccacaccgagcagcgcgtgattcgtcgcatgctcaagctggcgctggaaggctacagcgacgcatggaaagccatttatccgctggaagtggaatacgtgcgttctgaaatgcaggtgaagttcaccaacatcaccacctcaccgaacgatatcgtggtcaacacgccgttccaggtggagattggcaacctggtgggtgagttcaatatctgtattccgttttcgatgattgagccgctgcgcgagcttctggtcaatccaccgctggagaactcgcgtcaggaagataaccactggcgcgacaatctggtgaaacaggtgcagcactcggagctggagctgattgcccacttcgctgaaacgtcgctgcgtctgtcacgtattttgcaactgaaacctggtgacgtcctgcccattgagaagccggaccgcatcattgcccacgtcgacggcgtaccggtactgacgagccagtatggcacgctcaacggccagaacagcccaatgagtgacagcaaaaaaccgtccgatgatatctctgcggacgatctgtgggctgaagcgatgaacgagcaggcggcgaccagcagtgcggcggagccaggcgataacgtatttaagtcgcttgaggccagcgccgccagcggctcgctgcaggacatcgatctgatcatggatattccggtcaaactgaccgtggaactgggccgtaccaagatgaccatcaaagagctgctgcgcctgacgcagggttcggtggtggcgcttgatggcctggccggcgagccgctggacatcctgattaacggctatctgatcgcccagggtgaagtggtggtggtgaacgacaaatatggcgtgcgcatcaccgacattattactccgtccgaacccggtggtgtccaccagttcagtcgttgggcaagtcagcagcgtgctggcggtgatcgtgctgctgattctggcctgcggctggctggcgaaacgcctcggctttgcgccgaaagcggtgagcggccaggcgctgaaagtcagcgccagcgtgcagatcacccatctgcactcgctgccgccgctgccaccggaagcgtccctgcccgtcagcgcggcgccgcaggattttcaacctggttaaacgtcccggaaaaccccaatgatgcgtcgattgctccctcttctgccgctgctgatgctgctggcaccggctgcccatgcgcagctgccgggtttgatcagccagccgctggccaatggcggtcagagctggtcgctgccggtgcaaacgctggtcttcattacctcgctgacctttattccggcggtgttgctgatgatgaccagcttcacccgcatcattattgtgtttggtctgctgcgcaacgcactgggtacgccgtccgcgccgccgaatcaggtgatgctggccaggacaaaatcagcatggacgtggcgatcgacaaaggtgcccagccgctgcgtgagttcatgctgcgccagacgcgcgaagccgacctggccttgttcgcccgtctcgccaacagcgcgccgattcagggtccggaagcggtgccgatgcgcattctgctgcccgcctatgtcaccagtgagctgaaaaccgctttccagattggtttcaccgtctttattccgtttctgatcatcgacctggtggtcgccagcgtactgatggcgctgggaatgatgatggtgccgccggccacaatttcgctgccgtttaagctgatgctgttcgtgctggtggatggctggcagctgctggtgggatcgctggcgcaaagagcgcaacatgacaccggaatcggtaatggtaatgggccaggaagcgatgcgtatcgccctgatgatggccgctccgctgctgctggtggcgatgacactgtcgtttatcccgaaaattcttgccgttgcggccaccgccgtggtggccggaccgtggatgctcaacctgatgctggactacatccgtaccctgttcagcaacctgccttatatcatcggctaatggtcaccctcgacagcagccagctggtgcactgggtggcgcaattcttctggccgatggtgcgtttgctggcgctgtttgccagcgcgccgctactgaatgaacgttcgattccaaaacgggtcaaaattggactggcggtagtcaccacctggattctgatgccgctgctgccgccggtcgaggtgacgctgtttaccccggcgggcttctggatgctggtgcagcagctactgattggcgtggggattggtctgaccatgcagctggctttttctgccgtgcggctggccggtgagatgattggtctgcagatgggtctctcttttgccaccctgctcgacccgaacagccggatcaacatgccgctgctggcccgttttctcgacatgctggcgatgctgctgttcctgaccttcaacggtcacctgtggttgatctcgttactggtggacagttttcacacgttgccgattaacgatcagccactcaacgccaacgcctttatggcgctgaccaaagccgccagcttaattttccttaatggcatgatgttagcgctacccttaataattctgctcctcacgctaaacctggcactaggtttgttaaaccgcgtttcacctcagctgtcggttttcgccatcggcttcccaatcaccttaacggtagggatcctgagtctgggtatgatgatgccgttgcttgcacctttctgtgaacatctgttcggtgaagtctttgatttactcgcgcagtttgtatcagaactttcccctgcccgttga

SEQ ID NO: 1104 - DNA, 636 bp, Glycine max
  Peptide Sequence Number=SeqID_92789
atgaatgcgagtgcagccgccacacaggatacagcaaagaaaggctttaatgaccttctcgcccgcctgcgcgcaaatccgcgtattccattaatcgttgctgccgcggccgctatcgccgtggttctggcgctggtgctgtgggccaaagcgcccgactatcgcgttctctataacaacctctctgatgaggatggcggcgcgattgttacccagctcacccagatgaacatcccttaccagttcgctgaaaacggcggcgccctgatggtgccggccgataaagtgcatgagctgcgtctgcgccttgcccagcagggactgccgaaagggggttcagtaggctttgagctgatggataaagagaagtttggtatcagccagttcagtgagcagattaactaccagcgtgcgctggaaggtgagctggcgcgcaccatcgaaacgctcggaccggtgaagagcgcgcgcgtgcatctggcgatgccaaaaccgacgctgttcgtgcgcgagcaaaaatccccgtcggcctcagtaacgctgaacctgcaaccgggccgtgcgctggatgaaggccagattcaggcgattcagcacatggtctccagcagcgttgccggtctgccaccaggcaat

SEQ ID NO: 1105 - DNA, 1108 bp, Glycine max
  Peptide Sequence Number=SeqID_92790
atggcgcagcgcacccgtgacgtggcgtcgatcattatgaaagatccggcggtgcagagcctgacctcgttcgtcggcgtggatggcaccaacgcggcgcttaacagcgcgcggctgcaaatcaacctgaaaccgctggaccagcgtgacgatcgtattccggcagtgcagcagcggctgcagcaggcgatcgatcgcctgcccggcgtgtcgctgtggctgcagccggtacaggacctgaccattgatacccaggcgagccgcacgccgtaccagtttactctgcagtcgggttcgctggagtcgctgggcagctgggtgccgaaactgctggcacagctcaacaccttgccacagctgcgcaatgtcagcagcgactggcaggatcaggggctggaagcctttgtacgcgtcgatcgcgacagcgccagccggctcggcatcagcatggccgacattgataacgcgctgtacaacgcctttggtcagcgcctgatctcaacgatttacactcaggccaatcagtatcgcgtggtgctggagcaggacaacacgcaaacccccggtctcgccagcctcgacgcgattcgcctgaacagcagcgacggcggcagcgtgccgctcagcgccatcgcgcaagtcgaagagcgccacgctgcgctgagcattaatcatctcgaccagttcccgtcggccaccttctcgtttgacgtggcgcacggctactcgctcggcgatgcgctgcaggcgatcaccacggcggaagatcaggtcggcatgccggcagagatgatgacgcagttccagggcagcacgctggcgtttgaagcggcgctgaccagcaccatctggctgatcgtcgcggcggtagtggcgatgtatatcgtgctcggcgtgctgtatgagagcttcatccacccgattaccattctgtcgacgctgcccaccgccggcgttggcgcgctgctggcgctgatgctgagcggcaacgaactggatatcatcgccatcatcggcatcattttgctgatcggtatcgtgaagaaaaacgccatcatgatgatcgacttcgcgctggccgccgagcgtgaacagggcatggcgccgc

SEQ ID NO: 1106 - DNA, 651 bp, Glycine max
  Peptide Sequence Number=SeqID_92791
atgacagaccagtctcgtttcactaaggaggatcacatgcgtcaacacaaaacccgtcagctgggcgacagcggtatcagcgtgccgctgctgacgtttggcggcaacgtttttggctggaccgtcgatgaaaaaacctcgttttcactgctcgacgcgctggtggaaaaggggctgttcttcattgataccgcagacgtttactcacgctgggcgccgggcaacgctggcggtgaatcggaaactatcatcggtaagtggctgaaaaaaagcggtaagcgcgacagtatcgtgctcgccaccaaggtaggcatggaactgacgccggagaaaaccgggctgaaaccggcctatatccgccaggccgtggaagattcgctgcgccgcctgcagacggatgtcatcgatctctaccaggcgcaccgtgatgacgacagcacgccgctggtggagacgctgaaagccttcgactcgctgatcaaagagggcaaagtgcgggcaatcggtgcgtccaactacagcgcgcagcgcctgcaggaagcgctcgacatcagtaagcaggagggactggcgcgctatgaaaccctgcagccggagtacaacctgtacgatcgtcaggagtatgaaagcggactggagcagtggcggtga

SEQ ID NO: 1107 - DNA, 56 bp, Glycine max
  Peptide Sequence Number=SeqID_92792
atgggtgccaagcacctcacaaggaccaaagaaaggtcgcatgtcatcaagaaaag

SEQ ID NO: 1108 - DNA, 396 bp, Glycine max
  Peptide Sequence Number=SeqID_92793
atggcagaacaagctagacaagtatttatgtgcaagacccttgtgatgaaaggtggtgcgtggttctacagggcaaaacaattggtgttaaagatcatggcttctccacctgcctcacctcctcctcctcctcctccttcagacacattagcttcaccgtctgccgtgaagcggacatgcaaagccacatgtctacgatcgttgtctactagaccacctggtgctgagagactagtggtccacattgatcctgctaccggcaaggccgatggtccccacaggaagaaattaagaacatatttaggggttgtggcgcgtgataaggtggacgtcacgtatgagaactggaaggaggtccctactgctcagaaggacttgatttgggaggatatttag

SEQ ID NO: 1109 - DNA, 926 bp, Glycine max
  Peptide Sequence Number=SeqID_92794
ttgctgccgggggacgcagcgccgctgctgtggctgccggtgttgaacccggccgagctggggcagtggttgagcctggcgctgctggcgcgctggctgtacagcgggcaggcgccgcaggcactggtgaagatccggctgccgctgttggcattggccaccttcgttgcgctgaccagcctggtgctgcacggcgtgcatcagtggggcggcctgtcgtggagttcgtcgatgatgcgttccagcctggcgcagaccagcctgaccgtgctgtggagcgtgctcggcgtgatcgcctgggtctggggttcgcgccgcggccagcgcgtgttgtggatgcacctgggcaacctgctgggcattgcatcgttcatcgcctacggcctgctgtgcacggtcgtgggttatctggcaccggcaccgccgagcgcggcgccgaccgtggaggaaaaacaatgaagacgtggagcagggcgctgctgccggcgatgttcggcatgctggccgccgtcaccgcacaggccgccgattaccgtacccagtacgccgaacagtggccgctgacgttgtccagcgcacaatcgggtgcctaccgtgttgtgctggaaccggcgatctaccgtcgcgccggctgtgcggacctgggcgatgtgcaggtgttcaatgccgccggccaatcgttgccgtcggccttgctggcgccggatcagccgctggcgcagccgccggtgcagcgtgagctgccgtggttcgcgttgccaccattggccgaagcacagcgcaacgacttgcagttgctgaccgagcgcgataccgatggccgtgtgcgtcgcgtggaagcccgcgtgagtggtgggtggctggctgatcaacgccagtgtgctgtgccagcagccgctggcggccctggtactggattggactga

SEQ ID NO: 1110 - DNA, 77 bp, Glycine max
  Peptide Sequence Number=SeqID_92795
agagagaagaaggagagacaggagtcacttatttcaaatcgttttgggttggaactattgtgattgagatcaattaa

SEQ ID NO: 1111 - DNA, 363 bp, Glycine max
  Peptide Sequence Number=SeqID_92796
atggtgaaagttggaacctcttacgtgccgatcaacgtctcattttcgccaaaagttggcccagggcttcccgatcaagcttatcgataccgtcgacctcgagggggggcccggtaccagcttttgttccctttagtgagggttaatttcgaaaagcttggcgtaatcatggtcatagctgtttccttcgggaaacctgtcgtgctgcaaggctgcattaatgaacggtccaacgcgcggggagaggggcgaattgagctccaccgcggtggcaggagaaaaaagtggcccccgggctcgcaggaattcgatacaggagatattcccttcctcgctctgatcggctacgctcgcgttcgatga

SEQ ID NO: 1112 - DNA, 460 bp, Glycine max
  Peptide Sequence Number=SeqID_92797
atgggccccattcatagacatcctcacgcttttgatcttcagaggagtcctctttccaaatgtggatgggttggtggacctagcggttgcatcagttacaatcccgttcttgctataagacaactcggctaccctatgagaggggcaccactaaaggaagagctcgcacctattattgcaccaggtttcaataacaccaacgcgaaggcacttcagaaggtccgcaaggcatgggagatggtgcaaaagaaggacaaggaactcagaggcaacagcaacgggcccatcggcggctaccgtaggtggttgaaagcccacatgcaaggtctggattggctcccgagtttgagaaccactaaaggggtggaagttgaagcgccggaggaggacgaagaggtgcaggccctcagggcagaactcgagaaagcccaaacagtcaaagaaaagtttaaatcagaag

SEQ ID NO: 1113 - DNA, 48 bp, Glycine max
  Peptide Sequence Number=SeqID_92798
ggtgaatgctgtgaaatttccccagacgcccgaaatggactcggatga

SEQ ID NO: 1114 - DNA, 420 bp, Glycine max
  Peptide Sequence Number=SeqID_92799
atggttgctcacatcccgaatccaagggttgatccttctcaattttgtgatttagtacattattggtgttctgagaaaggacagacaacaaaggctaagggagtgcaaccttctcgggaagaaatttatattgacactcgaactcaaaaagatggaagcattgttactgaaaaggctgctactgatgaattaaaaaagaaaatggttgaagcagagagttcacaaaatttacaaagcatacaagattctattaattggacaaatgatacatattcaaaagtcaaaggacctgaaaaaagaggacatgtgcgttgtcttggcaagcttccacatcaagccagttcatctcaaagctcttgtgcaaacaatagaattcaaaaattggagaatttgcttggaaaccttgttgttgtcctttaa

SEQ ID NO: 1115 - DNA, 251 bp, Glycine max
  Peptide Sequence Number=SeqID_92800
gcccacttgggccctccagaatattcctccagaaggctgttgcttctggaggaagcaacctggctcgcctgggcgagctgggcggcaaccatctcccctattttgctataaataggggaggaagtgagaaggaaaaggccgaggcgcttccgaaacgtttccgtaacgttttccgtgaagaatttcgcaaaggtttcgaccgttcttcgacgttcttcattcgttcttcatcgttcttcgatcttcaacgg

SEQ ID NO: 1116 - DNA, 267 bp, Glycine max
  Peptide Sequence Number=SeqID_92801
atgtccaagttcgacccagacatagtcctggaattttatgccaatgcttggcctacacaagagggcgtgcgggatatgcgatcttggccagttcctgggatatcctttagtgctagaggagggccaagagtgcgagtatggccagaggaggaaccgggccgatgggttgatgaggaggccatcgctcagttgctgtgtataccgggggcaggattttgcccggactgctgctgggagaccaggtgccgatcatgcgcaccaacatga

SEQ ID NO: 1117 - DNA, 213 bp, Glycine max
  Peptide Sequence Number=SeqID_92802
atgggttgtaagtcagatggattgcctcctagtcatacactacattcagcatgcacacaactatttgcccttgtcataatcgctttttttggacaatggagacctcagccagcctatggcaggctgtcgcggtgtaggaaatttttttctaccccaaatgcatatataataaatgcgattctgataaccggagcaaaagttatggccgtttga

SEQ ID NO: 1118 - DNA, 500 bp, Glycine max
  Peptide Sequence Number=SeqID_92803
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgagaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggcagcaggaattcgatgtttcatgattgcctaagtgcggaccctcaaggcaatcctccattctccccgctttttcgaagctccatgaattgcgtttacgttcatgtgtactccactttcgagttgggagctgtgtttcatgattgcctaagtgcggaccctcaaggcaatcctccattctccccgtttttcggagccccatga

SEQ ID NO: 1119 - DNA, 676 bp, Glycine max
  Peptide Sequence Number=SeqID_92804
ccaaggtcgcgggtggccaagagggcccacttggagacttgggatctcagcaggaaatgcgaagggaatactctaaccctggtaactggggcctggccaaagtccagggtggctcaaagttcgatcaagcagatccctgtcctggaataatcctccaggttataaagcccactaggactactaaggaagaggaggaaaaaaaagcttatgatgagcatctatttgagtcgattaatcatcccttgcatcatccttacaccgattctcttgttcccctcataattattctttgtgttctttcgggcctcgaatccgggtatacgttgcacatgatggatctagcaggaggtcagcctgctgccaatcctacagcggagcaaccctcaaacgtgccttcaggcgcatcgacctcgggctggagaagtttcgaagaaggtgttttgttagaatcttcaaacgaatccagcgaagcgagcgtgaatcagcagcctgtgattcccgaacttgaacctccgcttctcgatgacaacacccggcgagcagagctcgctgttcgattgagggcgaattggtgggggatcgcttataacgagcgaatcctcgactccttcgtccggagtcaacttgcaatcgaaaggcacatagaggccgcacttgtggcggacggatattcccc

SEQ ID NO: 1120 - DNA, 396 bp, Glycine max
  Peptide Sequence Number=SeqID_92805
atgccgatctccccctacagtagtataggttggtctgtgccgtcccgacatagggatcacgcccacaagacacccagtggacccggagaagtccaacagggccctggggtttccagctttggttacgggcctctgtcagtcctacagggtgcccatcccccccagcaagggatcgcgcccacaagacacccagtggacccgaagaagtccaacggggtcctggggtttccagctctgattatgggcctctgtcagttctacggagtgcccgtcgcccccagcaagatcatcaggccccctattaaccggactttcatcgagaagtactgcgccccaggcaggcacatggcaaggcatcacagtagtgggcaacaggcacaccgccactacctctag

SEQ ID NO: 1121 - DNA, 444 bp, Glycine max
  Peptide Sequence Number=SeqID_92806
atggtgccgtttcctcgtcttcatttctttatggttggttttgcaccactgacttctagaggatctcaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 1122 - DNA, 1107 bp, Glycine max
  Peptide Sequence Number=SeqID_92807
atggatcaaatgagtcaacaagtctattttcactccgaaagtatccatttcagtggcaccaacatctgtctagcttcagggaatggaattagtttagattgccattatgtactagatgctcatgacagctatttagatcagcactttcaaccatatgtacaaggtcatgctttggcttggcatctgtctcttccagtgccatatgtacaagctttcattgctaatggaagttcatcagagaatggaagaattggtccacagagatatcatgatacaactagcagcagaggtggccacagatttccacaaagatatcatgatacaactggcagcagaagtggccacagatttccacaaagatatcatgatacaactggcagcagaagtggccacagatttccacagagatatcatgattcaactggcagcagaagtggccacagatttccccatcctcctccacagtaccatagctttcatcatcaagtactgcctgcacaagtgatcagaggtcactccttcaacattcatcctcccgtaactgcaccttcgtatagagttccaacaaatccttcacacggttcttcaatcctcatacacgatgcttttgagatgggtgctaggcatcctggctttgcaccatttgcaggcgcacgcatacgccagtctcatagaggcaacttgcaggagatgataactcttataaatcttcctcctgcagtctttttcccagatgatgatgttgctttactggttgaccatcatactgatatgcacttggacactgaagatatgtcttatgaggcaagtgagcagattggcaacgcaaaatcgggtttatcagaaaaaataattacaagtcaaatgaagaccaaaacttatatactacctactaatgctactaacttggaggaggcagattctgaggaacaggaaactgatctttgcataatatgccaggatgaatataagaacaaagagaatattggaattcttcgatgcggccatgaatatcacgcagattgtttaaggagatggttacttgagaaaaatgtctgccccctgtgcaaatcagtagcattgactcctccaggagaaaaacaatga

SEQ ID NO: 1123 - DNA, 165 bp, Glycine max
  Peptide Sequence Number=SeqID_92808
atggactcaggaaggttccaagttagtgtaccaggtaacagctacccccaatggttcttggggcaagtagtccccttctacttgtcaaagtctggcaccttgaacttgggaggggtgatgatattgggtactaggaacaactcctctaggttagcaaaggcataa

SEQ ID NO: 1124 - DNA, 321 bp, Glycine max
  Peptide Sequence Number=SeqID_92809
atgacaaccactagggtcaagaaagagtgtaacgagctaaggtatgtcaacatggtcgtggccgaagtgttagagcgagaaacgaagagggcccgaaacaagttccgaggggctttatggggaagcaatagcgaactcaggcttcgaagggccggaagggacatcaagggtggaaagtatgatattagaggacaagttgaaggcttgtcaaaggttcgctctcactttgaatgggagtcaagagcttccaaggctgttagccagagccaaggctatggcggacgtatactcctctcccgaggaagttcatgggctttttga

SEQ ID NO: 1125 - DNA, 282 bp, Glycine max
  Peptide Sequence Number=SeqID_92810
atgatgagatgtacctgtgaagacactctgatgctcaagttagaaatgcaaagacacaccgacactcaagttagcgacacagaggtaagaaggtgtcaccctattctcttaccagggagcctccatggcctcacctcacagtggctggagatctgtgcaaaaagacttatgatagaggcccaaagcatattgaagaactcctcaaattacaacttagacccaaactcgggtagtgcacgtaactcaacagggacctcaccaaccaagagcatagacacatag

SEQ ID NO: 1126 - DNA, 432 bp, Glycine max
  Peptide Sequence Number=SeqID_92811
atgacgagtttcagaaagcctaaccgattgaactgtttcaatgtactaggaataaaactcaataacttctttgcaacatacctttcaataatggaagcttctggacaaagcatcacagagcaaggcggtgctactctccaaatgcaccacactcttccttctgcgcgccacgagccacgattcctccacgcccctcacatgcaagcctctagccatgctcctctcctttggcgacagctcacgcgccaccacctcggctactgtattggtcctaatggaccaccttcaggggaccaacaacatcgtcgtgccctaaagtgcatgattgccctccaccacatcatctaccacaacaacttcatcctccaagaccagctctccgtgtacccctacgtaggcggcaaaaactacctcaacctctccaatttctga

SEQ ID NO: 1127 - DNA, 405 bp, Glycine max
  Peptide Sequence Number=SeqID_92812
atgtctcctccacctctaggacctcacaatcgcttacaaactcatctcaagctctcaggacagcttcctcttccagctctggtctctgcagatcttcacacaacaaattctctcaaactctctggaacttggacctttctctctctagaactctccaattatgcagaatcttcaagaaaaggccaaactcctcttcaaaatctgatttcaatcttaaataggtggctttcgagacttttctcgctcagcggatggaccgaagtgatgcgcttagtgggatggccttttgctcagcgaacaagcacaactcatccttcttccagattcttcctcgcgctcagtcgaggattgttgcgctcagcggatagctcgctaagccaacagattggcttagtgagaggctga

SEQ ID NO: 1128 - DNA, 454 bp, Glycine max
  Peptide Sequence Number=SeqID_92813
gcaggcgcagggcgaaacaccacaacagcctggggatggccggcagcgggcaacagacgcaccgccatcacctctagagttcacctctgctcatccacaaaaaggtttgagtattgcctacaccacatggccgaccaataggcgaccaagtccaaagccaaagggtgagaatgtcaatccttaccctcggaagcaaaaaagaagagaagggaaatttccaatcaaagaaaaagacaaggaaagtttccaatcaaaggaaaaaaggaagcaaggaaattcccaatcaaagagagggagaaagaaaaaaagaaaagaaagaaaattcccaaccaaagaatgggagaaagtaaagaaagaaaagaagaaagctcctggtcaaagaaaccagaagaaatgtgcagagaggtctttagaccggacaatatctgaacaatacagaattgtcaccaaatga

SEQ ID NO: 1129 - DNA, 567 bp, Glycine max
  Peptide Sequence Number=SeqID_92814
atgctagctatcatcgccaagtaccaagaagagttaggtctagccgcggcccacgagcataggattgcggacgaatatgcccaagtatacgcggaaaaagaggctagaggaagggtgattgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctattgtcagcatatgatagacttaatggcccacggaaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaggtatgaagcagctcatggagaagaacgcggccactgccgccgctgtcagttcgctgccgaagcagacccgactctcttggcaactacgcaccatcctccctcaaacgtag

SEQ ID NO: 1130 - DNA, 249 bp, Glycine max
  Peptide Sequence Number=SeqID_92815
atgacaaagggtgcggataatcgtaaggtatctccgcgtatcatcgggcccgcgcgcctctggatgacacaagggtgcagaatgaccaaacttggtctctgcttgtcatcgggcccgccgcctctggatgacaaaagggctaccagctcttgggtcatggtaacagaaagcagtgtggtcgacaaaagcgaggcttttgctcctacgtatcctccaatgaggaactcagacctacgtagttctggataa

SEQ ID NO: 1131 - DNA, 432 bp, Glycine max
  Peptide Sequence Number=SeqID_92816
atgacgttgctatttagtaacattctgcccggacgaccacaatgccaatctccccctgcagatgtatcgggattgcgcccacaagacgcccagtgggcccgaagaagtccaacagggccctggggtttccagctctggttatgggcctctgttagtcctacagggtgcctgttcccccagcggaggtcatgccatcgtgacatagggccctggggtttccagctctggttacgggcctctgtagtcctacagggtgcccgttccccccggcaaggtcacgtcatcatagggatcgcgcctgcaggacacccagtggacccgaagaagtccaacagggtcttggagttgtcaagctctagttacggggcgaaacaccacagcagcctggggatggccggcagcgggcaacagacgcaccgccatcacctctag

SEQ ID NO: 1132 - DNA, 81 bp, Glycine max
  Peptide Sequence Number=SeqID_92817
tcgaagtgcttccgtaacgcctccgtaagcgattctgtggaaattcttcatcgttcttcaccgttcttcgttcttcgacgg

SEQ ID NO: 1133 - DNA, 354 bp, Glycine max
  Peptide Sequence Number=SeqID_92818
atgaaattccccacacatctagccaacttcgagccttgcctcggatatgccactgaagggcaagcagttggtggtatacccctacaaaaccctttggagggccctcagtatcatccccagctacacctcttgcattccacaacaagtaaaaaccctcatgctatggcagaaatgggaaagttggatcatctagaggaaaggctcagggccattgaaggaggtgaagattatgcctttgctaacctagaagagttgttcctagtacccaatatcatcacccctcctaagttcaaggtgctggactttgacaagtacaagctcactttccccaaaagaactcatcgagtcagttga

SEQ ID NO: 1134 - DNA, 718 bp, Glycine max
  Peptide Sequence Number=SeqID_92819
cattctctctttttctcactgtggctcttccgcaaaaagcttcttctcttctctcttccccgacaagcttcttctccgcgagcttctccgacagcccttggacccatttgcttcgaggagtcttccggaagaccccttaggggttcttccggaagttccggaagaacgttttccggaaagtttccggaagaagtgttcttccggaagtaaccaaacgtcttccggaagaacacttcttccggaagacttccggaaaacgtcttccgggaactttccggaagaagtggttcatccggaagaattccggaagactcgcacttccggaagaagtttcaaacttccggaagacctttccggaagaacccttcttccggagtgtttccggaagaaccacttcttccggaaagatagagctgctggcgaggatgctggcgatgttcccgagaggcgtaggcctactgcctcagcccgtaggctacgcgttcatcaaatgactacggagggacgtgatatggctgaggacgtcgctgacatgactgatgatctccctgagcagcctacggaggcacctgagatgcgtgcggacgcacagggtgctgatagtggtgaggggtcagatggtgatgatgctgcagagggattccctggtggtccacgtgacccgtcagtgctcacatcatttgccgagcatgttgcacatgccgtgtggagtggacag

SEQ ID NO: 1135 - DNA, 368 bp, Glycine max
  Peptide Sequence Number=SeqID_92820
atgggtacctcaaagccttacactagggcaatgaggggcatcgtgcatgagcctcaagtgaacataggggcagatcaaaagttctcacccttcgatgacccttgggtgcacgccctcgccttcaaaggactggacgccctcaccttcagagggctacacaccctcacctttagaggactatacgtcctcctcttgagaggactacatgtcctcaccatcatagggctaaatggcctcaccttcagaggactgcacgtcctcaccttcagagggtttcacgccctcgccttcaaagggcggcatgtcctgaacttcagagggctgcacgctctcgccttcagagggctgcacaccctcgccttcaaagg

SEQ ID NO: 1136 - DNA, 478 bp, Glycine max
  Peptide Sequence Number=SeqID_92821
atgctggaagatgaacaggcaaaggtatcagctctgcaaattgaaagggaagtgagagagagggtgatagagttattgcacggggaagctatgaaatggatggatagattcgctctcactctgaatgagagtcaagagcttccaaggttgttagccagagctaaggcagtggcagacacgtactcagctcccgatgaagttcacgatctttttgattactaccaacacatggctagaatcatgaacgggatagaggaagtgcatgaacaaatgaaggctgacatggaggccatgaaagacaaaatgatcaccatgatggaggctatgatgagcatgaggaaaatgatggaggtcaacgcagctgcagtcgccactacaactgtcaccactgaggtagacctgactcacccatctggtttgaatcaagtaagttgttcagtcccggatatggtaggtcagggaggcgaagcattgggaa

SEQ ID NO: 1137 - DNA, 571 bp, Glycine max
  Peptide Sequence Number=SeqID_92822
atgacatgcggggaaccatttggtcccgcaccttttttcaccttttgtcatccagaggcggcgagcccgatgacatgcggggaaccatttggtcttgcactttttttcaccgtttgtcatctagaggcggcgggcccgatgacatgcggcgggcccgatgacatgcggggaatcatttggtcccgcacttttttcaccttttgtcatccagaggcagagggcccgatgacatgcgaggaaccatttggtcccgcactttttttcaccttttgtcatctagaggcggccggcccgatgacatgcggggaaccttatgactcgacgcctgatagcacgcaaagactaacgtcatcttctgcaccttttgtcatccagggacagcgagtcaggtggtgggcggagataccttgtggtcatccgcgcctttcgtcgatcgaggggaacgaattgggtagtatcaggatgatgtttttcactctcgtcgtccggaaacattcaagtctagcgacgcatggaattcttctctgctgggcagagacgattgggtgcaatggcaaagggaagtgtcatg

SEQ ID NO: 1138 - DNA, 264 bp, Glycine max
  Peptide Sequence Number=SeqID_92823
atgtgcaaaatcagaatgctcagaatcagaatgctcaaaattataatgctcaagatcaggatgttcaaaatcaccaataacggaatgcacagattcaccagttatggaatgctcagaatgatcaaaagaatcgctttttttggacgatggagaccccagccggcctacggcgggctgccacggcgcaggaaatttctttctaccccaaatgcatatataataattgcgattctgataaccggagcaaaagttatggccgtttga

SEQ ID NO: 1139 - DNA, 131 bp, Glycine max
  Peptide Sequence Number=SeqID_92824
gtgaatcttccattggtaattctgatttatcgaagcaacatatccctcttccattccctccaagagcaattcctaacaaaaaaatggaagaggcagagaaggagatcttggaaacattaagaaaagtagag

SEQ ID NO: 1140 - DNA, 567 bp, Glycine max
  Peptide Sequence Number=SeqID_92825
atggagaacaacgcggtcgcaattgccaccaccagcaccaccgctgaggcggatccgacccatccattcgccataaaccaagcaaaccaagcaatcccaaacatggtgggtcagggaggagaggtgttaggcagcatgggcagttctcacatggggcaaaataataatgcattcccatatggcttaccccccaactatacaccacctaataccatgcacatgcccaatgagaacgctaaccatgtcgttcctgttccctttgaaggccagcaaccccaagcctcgggtcatgctctaggtgactttgaaccataccctatgttttccactgagggactgacgtgtagtggtatgcctcagcccaatgccatgggggttcctcaacaccgcccgttgcaacctctacacttctccgtggggagactgcctctggccgtggaaggaagggagaaattggatctcattgaggagaggctaagggacatcgaagggattagtgattatccgttcgtcgacatggcggagttgtgtttagtacctgacgtcgtcatccctccaaagttcaag

SEQ ID NO: 1141 - DNA, 1596 bp, Glycine max
  Peptide Sequence Number=SeqID_92826
atggcacgtggtgcgggtgaagtgcagcaactgcgagcagacccgcgatctcaactactggtcgctggacagcgagcaggcggcggtgaaggcggaaagctgcggcgactgcggcacttacctgaagatcctgtatcaggaaaaagacccgcaggtcgaagcggtggccgacgatctggcttcgctggtgctggacgcccgcatggaagaagaaggcttcggccgcagcagcatcaatccgttcctgttcccggcggagtaaccgcccggccccgttcgcgcggggccggaccagcaatttcagcacgggcttctggcattcgcccggacgagttgctacgtttaggccataacgcgccaagcgaaaggaaccacgatgttaaacaccctggcaaaactgaccgcggtcgccgtgctggcggtcggactggcggcctgcgacaacaaagacgacaccaaaccggcggtgccgccaccggacaccaagccgaccgtgacgcagcccgcgccaccgccgccgcctgcgccggtagaaaccccgcccgcgccgccggggctgaacgtcgatcaaacgctgaacagcggcatcatcaacgacagcacctccaccattcagcgctttctcgacggcaagtcgcgccagagcgcggtctcttccgaagtgatcccgccggacggcatgaagctcaacaccagcgacaaaatgctgaaagagctggcgcagagcgccatcacggtgctggccgagcgctatcagaatatccagaccaccaaagaagagaacttcagcgtcggcaaacagaagtttcgccgggtggataccgagcagaccgtcaacgggcaaaaggtggtctccacgctggtgttgacggtgttcaacaagcgggtggtgacgctgcaaatgctgtcgccggccaaaacgccggaagtgcatcaggcgctggtgcagcagattatcgataccctggcggacgaagcggaggagaccggatgaagcttatcggcagttacaccagcccctttgtgcgcaagatttccgtaatgctgctggaaaaagggatcgcgttcgaattcgtcaacgatccgccgtatgagcccggcagccgggtgaaggagcttaacccgctcggcaaggtgccggtgctgatcgccgatgacggcgaggtgttttacgattcgccggtggtggccgaatacctcgaactgctgacggtggagccggcgtttttgccggccgatcgcgccgccgcactgcgcgtccgccaggtggcggcgctggcggacggcgtgaccgaagcggcggcgaccctgtttcgcgaaagccggcgcgcgccggaaaaacaggacgaaaactggatgctgcgccagcgtgacaaactgacgcacgggttggatgcgctggaggcgctggcgcgggacaaaacgtggctcaatgccgagcggctgacgctggcggatatcgccaccggctgcgcgctgggctacctgaatttccgccgcatcctgcccaactggtgcgtcgggcgcccggcgctggtcaagctggccgaacgcctgttcgcccgtgaaagcttcgcccgcaccgcgccgccctga

SEQ ID NO: 1142 - DNA, 313 bp, Glycine max
  Peptide Sequence Number=SeqID_92827
gttcttcttgaatcccggagaagaacaactagacaagagaatccgtgctagcctcctgcggaccctgacttacctgacagctatcaatcatgaactagcaggacggactgcctttgaagccggtattgctaaagcaactgtacaacaggcgatgttatcagcgatgcctcgcagcggtgaccaacaaagcattattgaaagaagacaacaatcgtccggtggagtagcccttttagtagacctcccctcagcctctcgactcatacagagggaggggaaagagacggatgctactaccaataccaggtaccgg

SEQ ID NO: 1143 - DNA, 828 bp, Glycine max
  Peptide Sequence Number=SeqID_92828
atgtatacaatagaatttcaaaaacgagggctgcctcatgtccatttgttgttttttttacatcctgataacaaatacccatcctcggatgaaattgatcaaattatatcagctgagataccttcacagcaagatgatccagaactgtattcattagtaaaaaaccatatggttcatggcccatgtggaactctgaatcctggatctccatgcatgaaagaaggcaagtgcagtcgtttctatcctaaaatgttccagccgcatactgttttagatgttgatggttttccgatctatcgtagaagaaacaatggtcactcaattgagaaaaatggtgttataattgataacagggatattgtaccttaccatccaagattgctcagaaaataccaagcacatatcaatattgaatggtgtaaccaaagcacttctatcaaatatttatttaagtacatcaacaagggatatgatagagtaactactgttttgattcatgaagataatgatcaaactcagaatggtggcattcataatgatgagatcaaagaatatctagattgcagatacatatgtccccgtgaatctactaggagaatatttgggtttccaatacatggcagaaaatctgctgttgaaagattacacttccatcttccaggccaacatattgttctctatgaagaccatgatgatattgatgatgtattgtctaagccaagtatctctgattcaaaaagaaaagatgttggcaccttaggaagaaaggctacaccattggcagattactatgggtcccatcaattacaggggaattattttatttga

SEQ ID NO: 1144 - DNA, 183 bp, Glycine max
  Peptide Sequence Number=SeqID_92829
atggagtggtatcatgacttacgatgtttaaagttcttacctactgatcatgcatttaggaggaacaaaaatgtggaagcaatgtcttccaaggttattttgatgatgccaaagaatcaagagttaagaatcaagaatcaagtttcaagaatcaagattcaagactcaagaatcaagttttaa

SEQ ID NO: 1145 - DNA, 279 bp, Glycine max
  Peptide Sequence Number=SeqID_92830
atgaaggggactgggtttggctccatcctaggaaggatagattccctactaaatggaaatccaagcttagccctagaggggatggaccttttcacgtcatggagaggatcaataataatgcctataggttggacctcccaagagagtggagctaatatagaggaggaggaaccaacagatttgaggtcaaatcctcttcaagggggaggggatgatgcaatccaccctaggaaaggaccagttactagagccatgagcaagaggctccaagaggattag

SEQ ID NO: 1146 - DNA, 507 bp, Glycine max
  Peptide Sequence Number=SeqID_92831
atgacatcaaggttcaacgggatcgacagacccttggcatcactctacgatcttaaattgggaaagtttcacttggtcacataccaaagtgtgacaatccattgccatccttcaatggggcgcatgatagatcccaaagccttatgttttcttgttgtgcagaataatcaaaggggtgttcttcatccctgggcccatcaagaatcttctggaggaagcaacagcttgcttgggcaagcatgttgcttcaagcttaagccaccagctcacctaggcgtgttgggcggcaagctcctcctccatttttcctataaaatggcattgggggctgaggggaaggggttcaacacctttggcaatcatatttcatttaaaattagtgaggagaggaagaaagaaggagaaaaatcaaggtcgaggcacttccgtaacgcttccgtgatcaaatccgtgaacgttcttcgccgttcttcgttcgttcttcgttgttcgtcgatcttcgactag

SEQ ID NO: 1147 - DNA, 789 bp, Glycine max
  Peptide Sequence Number=SeqID_92832
atggcagaatcatcaaagaagcaaaagggaatgtcctctaccactattgttgctggccatcgatgccacagaccatctgaagcacccatagcactagttcctccttcctttcaaggtgttccttttgagggaactgttgttgatgattggaagtttgattactcgagtcatgatgctcgtcgtatagtctgtaatgaccaggctgatatgaccggcagattgcttgctgggtcattaacctttgactgttgcatcatgcactacatcattgttcacattttgttaccctgttcgtctaatcttgctcaagcctctgaggaggacttgattctcatgtaccaaatgcatacggcattacgggccaatgcacctcttccttatcctcagttggtcactctttttcttcatcacttccaaattcctttggatattgaaccttttgttcaagttaagaggtcttttgcaattagtgctggagtggtaacttcttttgggtaccgtaaggatattgacggaaagtggattaagaaacaagatttaccaccactgattcctaacgagcgtactccatctcctccgtcacagagagatgcttcctctactcttatgcatgtagttctttctaagctatgtggccttcgagcgttcgtcggtgaccgttttgatgccatggatagtcgcctggatgccatggatgctcattttgaaggcagggatacacagattaatcaacttaaagatgacataagtttcattcgccgttgcttcgatccatcgactgccccatag

SEQ ID NO: 1148 - DNA, 406 bp, Glycine max
  Peptide Sequence Number=SeqID_92833
atggcagaaccatcaaagaagcgaaagggcacttcgagtcggaatcaacggcattccgagtcacaggaaacgccgattccttcctccattccctctggatcattattttcatcagaggaacagcggatacagtacacaaacctcttttcctctcgttccattattgacccaaaattcatttatatggatttcttttcaaatgagagttttgaatgctttcaagcatttgaaaactccaatcttattccattcatgtctttaaaattgcctatttattctgatctagtcaaagccttctattcaaacatagaaatccaagaaggtaccctaatgtttaaggtttatgggattaagatggtcattgaccagtccctattctatgatttaaccaaattgccaagtgaag

SEQ ID NO: 1149 - DNA, 168 bp, Glycine max
  Peptide Sequence Number=SeqID_92834
atgggctccagttctaagcagcctttctcttataagccaaacccatattctgctacaaattatcttacgagcaagagttttccagtgattatatctgtctcccttgctgatgagcaagaggagaagttattgtcagttctcaagaagcataagaaggctatagcctga

SEQ ID NO: 1150 - DNA, 237 bp, Glycine max
  Peptide Sequence Number=SeqID_92835
atgttgattgttttgtcggataatgatgagaaaaagaataaagaaggacttcaaaaagaaaataagaaaaatgatgaagtggtgaatagtgaaaaagtgaaagaaaaagtgattaacattcctttttctgagacattagagcagatgtcaacatatgctaaattcatgaaggactttcttatgaagaagaaaagaattatgaatgatgaaatagtgaagcctcagccacaacaataa

SEQ ID NO: 1151 - DNA, 300 bp, Glycine max
  Peptide Sequence Number=SeqID_92836
atggctgaagaaccaagaagagtaaccctggaggattattcaagttctacagtgccacaatttttcaccagcacagccagaaatgcaatcaggttgagtctgttctcattttctttagctggagaagctaagagatggcttcattcttttaaaggaaacaatatgaagttatgggatgaagtagtagaaaatttattgaagaagtacttccctaaattgaagactgcagaaggcaaagttgccatctcttccttccaccagttaccagatgaatcattgagtgagcacttgaagatttag

SEQ ID NO: 1152 - DNA, 492 bp, Glycine max
  Peptide Sequence Number=SeqID_92837
atggaatcgagaaaaagagctagaacagaggacatcccttcatcatccactccagctcctccatcagtaaccgtaggacaggatgtccaaagttcacaaactttagtccctatgctgcaaagcttattccgaggacagtttattatcatgcgcaacctgcaagagtttgctcataacaggccaatcataactatggagcattttcttgagcaagctaccccgactaagcccagtcctacgcaagttgatccagagccagctgacccacaatctctagtggtgaatccactgtcttctcctgagcgtgaagtagttcccccatctccacctctgattatcatctctgatgcatcatcagatgaagcggctgcccctcttgattcaccagcaggagaaacaactgaccttcctacttccccagttggaggaatttctgatctttccgatttgtcatctggagaagctgttgctctcactgattccccattttag

SEQ ID NO: 1153 - DNA, 288 bp, Glycine max
  Peptide Sequence Number=SeqID_92838
atggcgatgaggggagattttcatgaccaaatcaacaagtttagtcaattgagaaacatacaatgttactattgcagtgagaatgatcatgtgcaagtgaggtacaaacaaatgaaggaagatttgaagaaattaagagatatgaacaaagatagtgccaactcccaagctaatgtagtgaaaagtgttggagatgaagatgatgtgtttttggcaataaatgatgacgttgctaaaacaaaatgggtgatgaattctgttgtctcaaagcacatttgcaaagattga

SEQ ID NO: 1154 - DNA, 1222 bp, Glycine max
  Peptide Sequence Number=SeqID_92839
atgtcgagagagaattggatttggttagacaatgtgtggttggtaaacaaggatcggttttttagcaaggtacggaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaacagagatagaatcagagcgattccctaaaatcctttctggatattcctcaatgtgccgactattcatggaacgtgagaagcagatgaataatcatctgcttccgcaagaaatcgaagaatttcttgggaatcctgcaagagctactcgttcttttttctctgacagatggtcagaacttcatctgagttcgaatcctactgagaggtctactagagatcagaaattgttgaagaaagaacaaaagaaacatcttgttctttccaggcgatcggaaaataaagaaatagtgaatttattcaagataattatgtacttacaaaataccgtctcaattcatcctatttcatcatatccgggatgtgatatggttccaaagggtgaactggacagttccaataagatttcattcttgaacaaaaatccattttggggtttatttcatctattccatgaccggaacagtgggagatacacgttacaccacgattttgaatcagaagagatatttcaagaaatggcagatctattcactctatcaataaccgagccggatctggtgtatcataagagatttgctttttctattgattcctccggattgggtcaaaaacatttcttgaatgagttattcaactccagggatgaatcgaaaaatcactctttattggttctacctcctcttttttatgaagagaatgaatctttttatcgaaggatcataaaaaaatgggtccagacctcttgcgggaataatttggaagatccaaaacctaaattagtggtatttactagcaacaacataatggaggcagtcaatcaatatagattgatccgaaatctgattcaaatccaatatagcccccatggttacataagaaacgtattgaatcgattcaatacaacttcgaatatggaattcaaag

SEQ ID NO: 1155 - DNA, 447 bp, Glycine max
  Peptide Sequence Number=SeqID_92840
atggccccgaggaagcttgcctcaaagaggtccaggaaggacaaggcggccgaaggaactagttccgccccggagtacgacagtcaccgctttaggagcgttgtacaccagcagcgcttcgaagccatcaagggatggtcgtttctccgggagcgacgcgtccagctcagggacgacgagtatactgattttcaggaggaaatagggcgccggcggtgggcaccactggttactcctatggccaagtttgatccaggaatagtccttgaattttatgccaatgcttggccaacagaggagggcgtgcgtgacatgagatcctgggttaggggattttgcccggactgctgcagggaggcgagtgcgaatcatgcgcaccagtatgaccaccctgacccagatatggatgacgttgctcctcagcaacatcctgcccaccgatcataa

SEQ ID NO: 1156 - DNA, 141 bp, Glycine max
  Peptide Sequence Number=SeqID_92841
atggagctgggacgcctgatcaaaagactctcagacagtggcattgatgatgctgaggaagaagaagaagcagctgaggaagaggaagatgcagcagaggatacagaatcagatgatgatgattctgaagccaccccatga

SEQ ID NO: 1157 - DNA, 417 bp, Glycine max
  Peptide Sequence Number=SeqID_92842
atggcacgaatttcaaggtacatcctttgtggtacaagtagagggtacatctacttgggttgtaatactgagaacaagagagggtacatctcttgtggatcagttcaagtggagggtacatccacttggttgttcaaagagaataagggagggtacatcccttgtggatctttgcttgtaaaggattttacaagaagatctactgcagttgatttgattcccattgatttggagattaatgccacctatcgaaggcgtaattcagagagaatcaaatttttttggcaggatttagaagcagcagcaactccagaagaagaacctcaatcttccgaggcatcttctagttttcctattgcagggaattctcatataaaatcagttgaagatacaatcatggatgaagagccaagatga

SEQ ID NO: 1158 - DNA, 204 bp, Glycine max
  Peptide Sequence Number=SeqID_92843
atggagggaggcataggtcccatactagacccgactcccaaagaagagaaaaggatagaagataatgttgaggcctacccagattgggaaatgaagggaaaagttccattggctacccttagcttccaagggtatgccctctattggtggactccccttgttagggaaaaaaggattcatagggatcccccagtagagcattag

SEQ ID NO: 1159 - DNA, 261 bp, Glycine max
  Peptide Sequence Number=SeqID_92844
ctgtttggagcatttggcagaacagaaatttcggtttacgttgggttgaccatgttcactgagtcccaatcccaatctcaggattattttggagagtgcggctactatgtgatgcactggatgtccaccatcattttaggaacttttaggaataattgggaagcgtattttaacgatcctagaccattggagccagagagattaaaagcattgcggatccagtgggcacagttttatctccgagttagagatcaagcctag

SEQ ID NO: 1160 - DNA, 510 bp, Glycine max
  Peptide Sequence Number=SeqID_92845
atgaagcacttcactgacaccctcatcagtgccaacataggaacaaaagctggtaccgggccccccctcgaggtcgacggtatcgataagcttgatgattcgctgaatagtgagataggacactgcaacggaacaccctggtttacaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 1161 - DNA, 600 bp, Glycine max
  Peptide Sequence Number=SeqID_92846
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggctagaacaggttctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 1162 - DNA, 561 bp, Glycine max
  Peptide Sequence Number=SeqID_92847
atggccacactgtttaaaacaaaggatgtcaatgaagaaataaccccaaaggatattcggagcctaatggaacagactaattacaccgacaaataccttcaggtgttaggggaatctattagtaaagaaaaagtctttactaaacccaaggaccatgggttgccatcattagccgttcaaatggaaaaacctttgttcaaaccttttaaggagataggtgataacaatagtgaattattaagaaagattaatagtttacttaaaaccgtccctgaaacccctcaatcttcggaggaatcatccaaaataaggactagacacacctccgaactaattaatgccattaacaaggatactgacaataattcagaacaagtatctgaagaaggttcagtttctgaaaaggtaatcaatccgattaacaccaaacattggaaaacaccttccaaactttattaccaaagaccaaccgcccctgatcttctactagaggagagaggcgaaagtaactttaaaagttttagtgcaaacaacatctatgaatggaatacaacctcatga

SEQ ID NO: 1163 - DNA, 287 bp, Glycine max
  Peptide Sequence Number=SeqID_92848
tggatcccccgggctgcaggaattcgatgtctttcctccacccagcagcagcagattgcgcggcacctcgcgaagctatccattctaacctgtctttgcctagcaagatacgtctagttctccctccgcttgcctatctcagtaggaaattggaacagtctccgatttcaaaggcgaagccgagggggtcccattccaatgagaatcaaaggcaatcgggaacgggttttcatcccccctttttgttctcgtctaagcagtcggcccagtctcgtacatacaagtag

SEQ ID NO: 1164 - DNA, 366 bp, Glycine max
  Peptide Sequence Number=SeqID_92849
atgccagccgacgtcggccaggaaaagatgacagatcgaggtctcaagaagaagcatgaccggatgactccgatcgaacatttccaaatcgacatcgtccaaccaacattgcgcaatttctttcacaaacgctggccgataatatttctttacggtaaagggtcggctaggttttttcgtgcgaactcaaccaaagttgtgtttcggccgacaccggcatgttctcgtttattctgccaggaacacattaacccacctcgggcaaacaaccattattctccgatactgattgagaaaaacaatagccgatgtcgtccaggaaagatgaccgatcgaggtctaaaaatcaaaagcctcacccgatga

SEQ ID NO: 1165 - DNA, 54 bp, Glycine max
  Peptide Sequence Number=SeqID_92850
atggtgaaggatgggataaggtggagggtgggcaatggtaaaaggattagagtg

SEQ ID NO: 1166 - DNA, 119 bp, Glycine max
  Peptide Sequence Number=SeqID_92851
atgcaagggataaagtggctcccaaagctaaaaagtctaagtggaaaagaggctgaaattcctgaggaaagtgaagaagtgcaagctctgaaagcggagctcgagtgggatcctctaga

SEQ ID NO: 1167 - DNA, 261 bp, Glycine max
  Peptide Sequence Number=SeqID_92852
atgaaagactcgggaatacgcatgctatgcatggaaaataaatgggtttatgatcccaacatggttgactcatggtacctaacacatgcaactaataataggaaaacacaaggatcatgcatgagcaaacatgaaaacaaaagaggtatcatcccctttgaaaaacatattgcggcagtagggactaccaacaacaatatgttatcaaagagaaaaactctagatgagggttcactgttatcaagcaagttggagacctag

SEQ ID NO: 1168 - DNA, 144 bp, Glycine max
  Peptide Sequence Number=SeqID_92853
atgtcagtgaaaaacctcgtcggacgcccaagagtacatgataagacagaccacacactgcttaaaggagcactcaaatcaggtgtatttaccccaaggccaagacttcgaagagtccgtcagggcctctccctcctgatttag

SEQ ID NO: 1169 - DNA, 357 bp, Glycine max
  Peptide Sequence Number=SeqID_92854
atgggaataaatcaaaccggaaaaagattctatcaagtcaagattaagggcctagatatcaccagccttaaggagttggggcggttgatgggacccctccagatgcaagccttccgcaaagcgtacggaaagattttagatttgaccatagcggagggattcgacaagagagttggatcatgtaaagcaaactcgaaacggcgtagtgggcctatcgcggaagtacttggaaggcaaggcaagagatatggcgaatcaagaggagtgggtcccgtttgcggacgtattagctttgctaatctttggggttgtcctctttccaaacgtggacggtttggtggacttagccgcgattga

SEQ ID NO: 1170 - DNA, 561 bp, Glycine max
  Peptide Sequence Number=SeqID_92855
caaaataatgtttatacggataaccactcgggtatttccgcccgtcagcgtgactcaaacgtcagtatgacagatcttgtgagcgcggaagatgacatagcaaaagaatgctttgaaagtgcggactaccacttgggtatctccgcatatcacatgactccagtggcgaaaaagtcgctgacacatcgaattcctgcagcccgggggatcccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 1171 - DNA, 746 bp, Glycine max
  Peptide Sequence Number=SeqID_92856
gaaatataccctcacaaattgggaagctttcgaatttgcagaagctttatcttggcagatattctgatggtggtgctctcaaaattgacgacggagatcattggccgtctaatctcatttccttaacccatctttccttgctctccatatctaatctcaacacttctcatagcttcctccaaatgattgccaagttaccaaatcttagagaactaagcttatatgattgtagcctttccgatcattttatcctttcattgaagccctctaaattcaatttttctacttccctttccatctttgatctttcctggaacagcttcacgtcatcaatgatactccagtggctgtccaacgtcacttccaaccttgttgagcttgaccttagtcataacctcttggagggttccacatcatcaaatcattttggcatggtcttcaattcacttgagcaccttgacctctcctttaacaatttcaagggtgaggttttcaagtccttcataaatgtatgcaccttacattctttatacatgaaaaacaacaatttgagtgaagaccttccatcaatccttcataatttctctagtggttgtgttagacactcattacaagaattggatttggcatataatcaaatcaccggctctttacctgatctttcagtgttctcatctgttgacaagaggatcaaggtgaacaaaggaaaacttattctcattgaaagtgaaaagggaaaactctaa

SEQ ID NO: 1172 - DNA, 246 bp, Glycine max
  Peptide Sequence Number=SeqID_92857
atgaaccatacattgaagcaatctcaagcacgaatggtgtattatgtagatgatgtagtcaatgaaggatggagtgttgttgtacacataaagccaagagatttatatgacatgggagaagaagtagaagaaaatgcatatgaaaatgagccataccaagagcaacaacttgaacaattttctaggcttgatgatcaatatgtacaattggctacaaaccatctaaatgatgatatagttgattga

SEQ ID NO: 1173 - DNA, 309 bp, Glycine max
  Peptide Sequence Number=SeqID_92858
atgtcttcaaacagcaatagcggcatctctaacgagttcccaaatgtcagggagacggagaagggattgaagcctccattctatactgcttcatgcgatgcatatttctccctccacagacatgttttttcaaattccaacggtggaggtttctgtgggaaaggaaaaggctacgatacgaagggtatttctataagctcagacatgatatcgaaattcccaacagttggtgatctgcgggaaaaagagaattttgagagaagaaaagagaaaaacgaaaatgaggcgaagaggaggcacctgacttaa

SEQ ID NO: 1174 - DNA, 261 bp, Glycine max
  Peptide Sequence Number=SeqID_92859
atgatcgactttagggtctgtcgcaacgtgcccttcgcgggcgagcgagggcgaggctcacgggtgcactttccaaagaaggaaagatgcacggagtcgccaccaacatttatttgtggaaaacgtcgggaaaaccgaaggaaaccggtcaaaatgaaaattctaagttcgggagttgtatttttgcttgaggaaggtcgacaaaagcggggcttttgctcctacgtaccctcctttggagaggaaatcagacctacgtag

SEQ ID NO: 1175 - DNA, 245 bp, Glycine max
  Peptide Sequence Number=SeqID_92860
gggcagaatcgtcttaggacacgatcagaggtcgagacaaagttaaaggcagaagccaatccagaggctaaggttatgaccgacagattgtcgtcccttcctagctctgggcaagctaaaaacgccgctgcaaggcagtctagggatggccttaggcctatgttgcatcctgaagcaatggggcatgccacattgcccccattctcttgctattcatgcctaaacatgcgcccaccaagtgctcg

SEQ ID NO: 1176 - DNA, 222 bp, Glycine max
  Peptide Sequence Number=SeqID_92861
atggttgcaacagattcgttggtgcttttggtgttgagcttggatattggcgcgcgaatgcttcccacttcagacttcataatcctgaagtataaagcaccaaggtgtgtcaagtttgcccccattgtggaattgttgaactcaagggtaacatccaactacttcagtcctaagtgtcccaagtgggttccgggacacaaacagtggatccatcagaattga

SEQ ID NO: 1177 - DNA, 2007 bp, Glycine max
  Peptide Sequence Number=SeqID_92862
atggattcacaacagctcttcagtttcggtggtgttactagtgcaggattaccttacatgtcttcttttcccactgttccatcgctacccaacagtctacttagatccttgaaatatgacacaggaaactcacctaattcacccttttccacttattttgattctgatactctttcagcattgagtgacggccaggagcaatacagcccaggagaaatcctctctggtgtcagctcttcactggaaaccaaccattatatgtataatagatcaatctccactttggacagtttcccattatattctgatcggaactctcttctacagaatgcgagttctaatcagaaaatccaacatgctttgctggagctagaaactgctttgatggccccggatgacgatcaagttaccacaccgaatacattggccgagagacacaggtcctggaacaatgagaaccatgtgtcacaacataatactcaagctcagccatcatatgctaccggcaataggcagtcaagtgaagttgtgcatgtagagaaacggcaaaagttgatggaagaagaagcaacactggaagctttcccaccaaacaatttgaagcaattgctgattgcatgtgccaaagccctgtctgaaaacaacatgaatgattttgatcaattggtaggaagggctaaagatgctgtgtccatcaatggggagccaatccagcggcttggtgcttacatggtagaagggcttgttgcaaggacgcaagcatcggggaatagcatctatcatgcccttaggtgcaaagagcctgagggtgatgaattgctcacttacatgcaactgctgttcgaaatctgcccctacttaaaatttggttacatggctgccaatggagccatcgcggaagcgtgcagaaacgaggatcgcatacacatcatagacttccaaattgctcagggaactcaatggatgactcttcttcaagcgcttgccgcaagacctggcggtgctccccatgtgcggatcacagggattgatgatcctgtttccaaatatgctcgtggcgacggaccagaagttgttggcaaaaggttggccttgatgtctgagaaatttggcatcccagttgagtttcatggggtgccagtttttgctccagatgtgacaagggaaatgcttgatatcaggccaggagaggccttggctgtgaacttccccttgcaactccatcacacagctgatgagagtgttcatgtgagcaacccaagggatggacttttgagattggtaaggtcactttctcccaaggtgaccacattggtggagcaggaatcaaacacaaacacaacccctttcttcaacaggttcattgaaaccttggattactacttggcaatctttgagtccattgatgtcaccctcccaagagacagcaaggagaggattaatgtggagcaacattgtctggccagggatattgtcaatatcattgcttgtgaaggcaaggaaagggttaaagatggccggcttccagcaatgtcctttgagttcttatgtgaattctgtgataagaagccttctgaggtgctattcagaacactatacactggtggagaaggatggagccatgttgttagggtggaaggacagaaatttgatatcagcttcagcctggcattgctaaaacatagactgtgtagtagtagaaatattatgatgatgggggaagctgaccacggtttatgtttcattgccagtgctatctcatctcatgatgaaaatattggtgatgctaccaaaccacctcaagttcaactcaggaggtccaacagggagagacaaccttctaggaggtattctactaatgagtatgtgatcctaacagacgatggaggacttgagtgctttagagaggccatggaaagtgaagaaaagaaaaaatgtttggatgcaatgaagtttgaagcttgttgtgagatcgtcggtttgacgatcacctccacaaaattgtga

SEQ ID NO: 1178 - DNA, 642 bp, Glycine max
  Peptide Sequence Number=SeqID_92863
atggcagccatggctgcactccagagctcaatggccggtctctccctctcttccaaatctttcttaggccaactccttcctcccatcactctcccttctcttcttccgggtaagtcaacagagaagcaatgtcccattgtaatgaggcttaaacgatgggagcggaaggagtgtaaaccaaacagtcttcctatcttgcacaaaatgcatgttaaacttggagatacggtgcaagtcatatctggacgagaaaggggtaaagttggggagattactaaaatcttcaagcataacagcactgttatagtgaaagatttaaatttgaagacaaagcatgtgaagagtagagaagagggtgaaccggggcaaattattaagaatggagttataagattgactcggtggttaaaggaagaagggagaggggaaggttgtattgaaggtcctatccacagctcaaatgtgatgctctactccaaagatcagaaggtagcaagtcgtgtggggcataaagtcctagataatggtaaaaaagtccgctaccttataaaaactggagaaataattgatagttcagagaactggaagaaactgaaggaggctactaagaaatctgaagaagctgctgctgctgctgcctag

SEQ ID NO: 1179 - DNA, 372 bp, Glycine max
  Peptide Sequence Number=SeqID_92864
atggcgcctaccaggcaccctctggacccggataagtccaacagggccctgggatttcccgccttgatcacaggactctgccagtcgttcggagtccccgtcgcacctagcaaggcggccaaccaccgggcgcatgtacagacccatgattgtctttaccagttgagcctcagcctgcagagccagggttttacttcttttccgtgccctactccggaccagtttagggcagaggtcgcatggcctggagattggcctgaggcccgggcaggagaggcaccatcagaggctcccgacgaggcagatgaggcccgcgaggacgaggagatgaccgatttacttgatttcttaggagggagcggagccacatga

SEQ ID NO: 1180 - DNA, 153 bp, Glycine max
  Peptide Sequence Number=SeqID_92865
atgagtttgtcaggtcactctcacataggcttaaaggagcactcaaacccggtgacccccaaggcctacactctgaagagtccgtcagggcctctccctcctgattcaggtccaactcctaaaatcattttagcacacagacactgttcgtga

SEQ ID NO: 1181 - DNA, 285 bp, Glycine max
  Peptide Sequence Number=SeqID_92866
atggagggtgcagtgacctcgttggacatccctggtgggggagatagagtggttaaagagttttatgcatttctggagggggatggcttagaatctttaattatccacggtcagtgcattgatggtgtccatgtttcatacgtttttttcatgaggaaaaatacttgtacttgggggcatgtcacttggtttggaacacccttgagactcaggctgatcaccatggggggagtgttgcatgtgcatgatagggtgacctcgacacttactgcccagttttcctaa

SEQ ID NO: 1182 - DNA, 309 bp, Glycine max
  Peptide Sequence Number=SeqID_92867
atgagtctccccaacaacaacagaagagccccagtagggggcgcgaggaaaaaggaaggagacgcctacggggtcaccaccgccccgacgtggatgaaagcaccccaaaatatccaaagctcataccagcccaatcccccaaattttttaatccgagccgggaattccctcccgactcaagtaaaaggaccacccgcagcagaaagagtgccggctcaacgcacagctccagccgcacctcggccagttaataatacagcccccggcgcgacctataaacatgcacagccaccccctcgaaagaagtag

SEQ ID NO: 1183 - DNA, 802 bp, Glycine max
  Peptide Sequence Number=SeqID_92868
gggacctctcagatcccccctcctcgaaaacatcctcataccgacagactgtcagccgcgacacctcattctggttaaccctgggccatggcgatgacattaagccagacaaaaccgagcgaaaggatattataaagacacgcaaagccaggcattttgatggcccagcagatatctgcaactatatcaataattcgctggcggcgtatttcagagataaccctgataaaatcaatggggtaatttccgatatgctttattcactcaaaagaaaaactccgcctgaaggtgaggtggcctggattaagagtgataagcgcgcttgcttttggttgtggacggagatctattgtcttaatcatgatgacacaccacgtgaggaagttaaaggatttattgcacacagtcatcaagaacggcatcgtgaggaccaggaaatcggtcaagtgataatccccagcgcaacggtacagtatgctggggagtgcgctgctgactttggccctgcgtctatggctcatgattcagtccggcgatccaccgtttccaccggccgccaaatcgtcctccttccccccgcccggtcgtacacaggcctgacaaccgcaggaggagaacagcctctgctcttcccatatcacgccctgcgaagaggagataaaacgtattacaacaacacatcggcctgggcgccgttgcggataccgtattttcctcctcccaacggatttcagcccttcaagcaaccacgccggcatcctttccctgcgcgttggcacaccactattcccggcagcaggaa

SEQ ID NO: 1184 - DNA, 245 bp, Glycine max
  Peptide Sequence Number=SeqID_92869
ggatcgcgcccacaagatgcccagtggacccgaagaagtccaacagggccctggggtttccagctctggttacgggcctctgtcagtcctacagggtgcccgtcggccccagcaaggtcatcagccccctaccaattgagctttcatcaagaagtactgcggccccagacaggcgcagggcgaaacaccatagcagcctagggatggccggcagcaggcaacaggcgcgccgccaccacctctag

SEQ ID NO: 1185 - DNA, 324 bp, Glycine max
  Peptide Sequence Number=SeqID_92870
atgcccttgtggggtaggattgcatcactctggttacgggcccctgaatcgcgcccgcaagacacccagtggacccgaagaagtccaacagggtattggagttgccaagctctaattatgggcctctgtcagttctacagagtgcctgtcgcccccagcaagatcatcaggccccctactaatcgagatttcatcaagaagtactgtgtccccaggcaggcgcagggcaaaacaccacagcagcctagggatggccggcagcgggcaacagacgcaccgccatcacctctagagttcacctcagctcatccacaaaaaggttag

SEQ ID NO: 1186 - DNA, 159 bp, Glycine max
  Peptide Sequence Number=SeqID_92871
atgcggaaattgattaaggaaaggatggaaaataaggtggctaatttcgtgggtcttaataaggtggttcttggcataaaatggatgaatgggatgggtgatgatgaaaggaaggaaagaatcactctttccagcgagggcaacgcgcaaaggttgtga

SEQ ID NO: 1187 - DNA, 654 bp, Glycine max
  Peptide Sequence Number=SeqID_92872
atgcagaccgacctccgcctgcagaaaggtgccgctgccttttttgcgcacaatgatgccaagtgcttcccagcgcttgagcgcctcgcgcaccgtattacggctgacgcccagtttctccgccagctcgcgctccggcggcaggcgactgcccggctgcgcgccggcatgcgccatgtagcgcgtgagcgcatcaagaatcagcgtatcgctgcgcgtcggaataatgggatggagttcagccgggtcatgcatcgctttgccttaattgggtgcaccgtggtgtggcggtactcagccgttgcccagggaacgatagtggtgcgcgaccaggcaaatcagcagcaggatgttgctgcacttagccgcgacaccgagcacgctaatgacagcatcagcccgattttcgacaaagagaaggagcagaaacgcctgcagacggctcagctgctcggtgaatcaggcagccaggtcgctgatatcgcccggacgcaggggcagattgaggcgacggaagcagggtttggcgggtggcaatctggcgctcaggcagggatgaatgcggtggagaataactcgctgagtgatattgcgcaggcacaatctgaaggtaagacactggagcaaaaagccggggagcccaaaaatttttga

SEQ ID NO: 1188 - DNA, 896 bp, Glycine max
  Peptide Sequence Number=SeqID_92873
gactacacgtcctcgcattcacaggactacacgtcctcgccttcagaggactacacatcctcgtcatcagaagactacacgtcctcgccatcagagggctacacgtcctcaccttcataggactacacgttctcacctatacacgcctacacaccctcgccttcaaaggactacacgtcctcgccttcagaggacttcacgtcctcgcctttagaggacttcacgtcctcaccttcagaggactgcacctcctcatcttaagaggactgcacctccctaccttcagagggctgcacgccctcgccattagagggctacacgccctcgccatcagagggcagcacgccctaaccttcagaggactacacgtcctcaccttcagaggactgcacgtccttgccttcagaggactacctgtccacaccttcagagggctgcacgtcatccccttcagaggactacacgtcctcgccttcagaggactacacaggactgcacatcctcgccatcagaggaatacacatcctcgccttcagacgactgcacatcctcgctatcagaggactacacgccctcgccttcagagggcaacacgtgctcgccttcagaggactacacgtccacaccttcagagaactacacgtcctcgccatcagagggttgcatgtcgtcgccttcagagggctacacgtcctcaccttcataggactacacgtcctcgcattcagaggactacaagtcctcgccttcataggactacacatcctcgccatcagaggactacacatcctcgccatccgagggctacatgtcctcaccttcatttgactatacgtcctcacctttacagggctacacgccctcgccttcagaggactacacgtcctcaaatttag

SEQ ID NO: 1189 - DNA, 303 bp, Glycine max
  Peptide Sequence Number=SeqID_92874
atgactctatttttgcacgcgacttcctatcgaatcatagatcaaacgtacgatcacggaccaataggattttctcgagcattccattcgctctcccttgaggagatttcactgtcctttgcttcgggggaaagaatgaggattccttttttacaggccaaggttcaaaaaggtccgaggttgtgtttcaatggggtcttttatcgtgggaacccaatcttgatatctagggcgaaacaaatctgggtgacaaggtgtcggtctcgggccgaacttccacattattccataaggcatgcgtga

SEQ ID NO: 1190 - DNA, 630 bp, Glycine max
  Peptide Sequence Number=SeqID_92875
atggcttctaggaaaagaaaggcaccctctacacctacccaagccagatttgatagatccagatttacttcccaagaggcttgggagagatacactgacattgtggtgtctcgtaagcttttaccagagaggaacgtggtagtttactatacagagtttgatgagttcaaggaggaactcgagagacgccattgggatgaggagttgactgactttgtggacgacaatattaatctttgtatcccagggaggggattcgagcttaatgctaatgggcagcctttgaagattctaaggaagaacatgaccatgcttgctcagacttggagcattctttccttttctaacctcatccccacttcccacacttctgatgtcaccctatacagagccaaactcatttatggcatcgtcatgaagatggatatgaatagcttgagtcctgccattaatttggcttatattaagaagaactgttggaatcttgatgatccaacagtaactttcagaggagccaggaaggccaggggtaagagatctgaggccctttccactttagcattagaggcaccaacaccttcttcttctacagtacctcatgcaatcctaccctgcaagggcattggatag

SEQ ID NO: 1191 - DNA, 477 bp, Glycine max
  Peptide Sequence Number=SeqID_92876
atgacgaacaaaagaaaagttttaggaaaaaataatgaggaaacaagaagttattttacatggaatttggaaatggaacgtgtattggctgatgtacttagagatcaaaggaatttgggcaacaagggtgacggaggttggaaaaggtcagcattgaatgttgcagccgcagtgttatctacaagcttcaatgttaatgtcacatcagataatgtcaaaaccatatcaaattatggagatcgtggtatggtattagccaccggtcatagagctgaaactgctatggatgctgatgaagcgacgagtagagaaacaaatgaagtggaattcatggggttaggtgctactgccatagatttagaagaaccaagctctaatacaaaaggaaaaagacaaggttcgacttcttctggcacacatcctcacaagagaaagaaagatgggagaaaaagaaggaatagcagcttctttggataa

SEQ ID NO: 1192 - DNA, 282 bp, Glycine max
  Peptide Sequence Number=SeqID_92877
atggtggttcgtgcctttgacggcacccgccgagaggttaggggagagattgacctccctatacagataggcccctatacctatcagctgtcttttgggatgtcggtggatccactcggtgggagtcgttccctctacactccaccaaaaactgaaattcgtagtagaggggcatttggttattgtgtcgggggaggaagacatcttggtaagttgcccgtcctctatgccatatgtggaagccgcagaggagtcattagaaacaaccttccaatcttttga

SEQ ID NO: 1193 - DNA, 190 bp, Glycine max
  Peptide Sequence Number=SeqID_92878
atgtcaaaaacagtatcaaattatggagattgtgatatggtattagccattggtcatggagctgaaactactatggatgttgatgaagcgatgagtagagaaacaaatgaagtggaattcatgggtttaggtgctactgctactatatacttagaagaaccaagctttaatacagaaggaaaaagacaag

SEQ ID NO: 1194 - DNA, 240 bp, Glycine max
  Peptide Sequence Number=SeqID_92879
atgacttcctcctcatcaagtcggcccttccacctcctctattggctcaaacctgacactgtgcaccactgcctcttcctccgatggatgcctctacatcgacaaccagatcttgattacattgaactttgccagcaacaccgttgttctagccaccaattgggccctcaatctgaatctcttgccttggacgtgtgtggtggttgttgtacagccacaaattgtgatttgattttttaa

SEQ ID NO: 1195 - DNA, 528 bp, Glycine max
  Peptide Sequence Number=SeqID_92880
atggattcaaatgcttgtctaccacacttgctagtgttagcaataacattggtattggttagtcatgcaatgggagattcagctaaagacaaacagaaatgtgcagaatccctgacaggtgttgcaacgtgtctgccatatttgggtgctgacgcgaaagcacccacagcagattgttgcagttgtctcacacaagccatgaagaccaacaagaagtgtgtctgccttattctcaaagacagggatgatcctgaccttggcttaaagattaacatgacaattgctgttggtctcccttctctttgcaaaacacctgataatctctcagtgttctggcacatatattgtgctgtcatcccaagagaaggatcaaacattgatgatgcagaggtgctaagatattgcaagaagaatcttgcatctttcaaagtccctgaaaaggtcttcattactgattctttgcccaagactgccaccggaaagattttgcgtcgtcttgtggcagaacacattgtctctcaaatttga

SEQ ID NO: 1196 - DNA, 954 bp, Glycine max
  Peptide Sequence Number=SeqID_92881
atgacgctgacaccaaaacaactcaatcaagggatcaccaagagaacacaggcacaacagcttgcaatagctgataaagccgtgtcagcaaaaaacaccgtagcttccaacctcggatatggcaacaacactgaaacaaaaacaactcaaaccactcaaacaaggaatcaattaaagaacacaggcaatgagaaaccttcaaccatctcatcagcaacctctgcaatagctgataaagctttctcagccaaaaacaccgtagcttcgaagcttggttctggcgacacagcaacaacaacaccacaagagaagagaactgaccatgctgctgctcctacagaatatggaaaaagtgttgctcagtctctgacagagaaactagctccagtttctggaaaagatgctggtgtaggaagtggtgtgaagtccaaagtttctggaactcaaactagtagtatgggtgtggaacaggacaagggggtttctgtgaaggactatttggtggacaaactgaggcctggtgatgaagacagggctctctctgaagtgataccagagactctgcacaagaaggaactgcccccagtggaagttactgaagaaggtgtgagaaaggtggtttctgatgctgtgcataagagagaggatgatcctgagagaagaatggaacatcaaagaatactgggaaaggtaactgagtcagaggaagtgaagagaaggttaggaggtgaaagtgtggtgacagagaaaaagtaccaagagatgtatgtgaatagtccggggaaaggtgtggttgataagcttaaaggtgtggttgggacatggtttaccgacccagcagagaatcaatcttcacaagattcatctatgaattatgaggcaggaagggcagaagtggaacaagttaaccaaggtgcagcaggtgaaagaaggctgcaggagtcatctaattga

SEQ ID NO: 1197 - DNA, 729 bp, Glycine max
  Peptide Sequence Number=SeqID_92882
atgtgggacagaattagttcactgtacaaacaagagaagagaactgaccatgctgctgctcctacagaatatggaaaaagtgttgctcagtctctgacagagaaactagctccagtttctggaaaagttgctggtgcaggaagtggtgtgaagtccaaagtttctggaactcaaactagtagtatgggtgtggaacaggacaagggggtttctgtgaaggactatttggtggacaaactgaggcctggtgatgaagacagggctctctctgaagtgatatcagagactctgcacaagaaggaactgcccccagtggaagttactgaagaaggtgtgagaaaggtggtttctgatgctgtgcataagagagaggatgatcctgagagaagaatggaacatcaaagaatactgggaaaggtaactgagtcagaggaagtgaagagaaggttaggaggtgaaagtgtggtgacagagaaaaagaaccaagagatgtatgtgaatagtccagggaaaggtgtggttgataagcttaaaggtgtggttgggacatggtttaccaacccagcagagaatcaatcttcacaagcaaagtgccacattaattttgaatttgtgtttgcatggtgtgaagggcagaagtggaacaagttaaccaaggtgcagcaggtgaaagaaggctgcaggagtcatctaattgaagaagggtctttgctttgggtgattgtgtag

SEQ ID NO: 1198 - DNA, 218 bp, Glycine max
  Peptide Sequence Number=SeqID_92883
atgggttggtacaagggtccttgtggcagccatcatgcacaacaatgcaaattccctgacttggtaataaaggctaggaaggaattcgtaataaccactgaatcaaagtcttctgtaacatttggaaatatgcctagatttcttcttggtatcagaatgtatcctagatccattcaaaagaattacgcatcatgccgaaagagtgctagacgtgaggg

SEQ ID NO: 1199 - DNA, 348 bp, Glycine max
  Peptide Sequence Number=SeqID_92884
atgactatcaccttggatgatatggcaatgttgctgcatttgcccattacaggcgcgttccatacttttgagtctcttcatgtggacgataccatcttgcaactagtggaattgcttgaagattatgatgagaggaaaccacgtgcctaccgttggaagtctggaaaggcattactagtatcgatgtatcgtaggcggttggatagattgacgtctgatgctgtatgttggatttcgtatggtcaccattgtgcattcatagagtttgaggttatctgtttatttttgggacatattagatggggtctgtttattgtcatacaccaagtgaagagggttgttcgatag

SEQ ID NO: 1200 - DNA, 186 bp, Glycine max
  Peptide Sequence Number=SeqID_92885
atgacaggagtctttggtgcaatgttgttgaatcaaagtatggggttgaaggggattcggaaattcagatgttgtgaagaaagtctccctttggtggagagatttggcaaagaatattggaggctagggagttgtagggatgctaaattcggacttgattcccttaacccgtggattgaaaattag

SEQ ID NO: 1201 - DNA, 842 bp, Glycine max
  Peptide Sequence Number=SeqID_92886
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatggtgcatggaattggagttcgcactacctatggatgaaccatccattaccacggtagaaagtgctcaagtagataaggaaactatgagcaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 1202 - DNA, 165 bp, Glycine max
  Peptide Sequence Number=SeqID_92887
atgaccggatggctcgctaagccagcagatttgatgcaagctccattggagcttctaggcctaggatcttcttcatcaatggattcctttgcttcttggaagatgaatggcagcggaatggagaaaggaagagagagaggagacgccacttcaaggagaagatga

SEQ ID NO: 1203 - DNA, 324 bp, Glycine max
  Peptide Sequence Number=SeqID_92888
atgaacacacaaagtttcacaattctacaatttcctaaaataggcctagctcacaaaaacagtccccagtggagtcgccaactgtcgcaacgtacccttttgtgggcgagcgaggcaaggctctcgggtgcattttccaaaggaggaaaatgcgcggagtcgccactaacgtttatttgtggaaaacgtcagaaaaaccgaaagaaatcgttcatgaagaatattctagattcgggagttgtatttacgtttgaggaaggtcgacaaaagcggggctcttgctcctacgtaccctccatcgaagaggaaatcagacctacgtag

SEQ ID NO: 1204 - DNA, 410 bp, Glycine max
  Peptide Sequence Number=SeqID_92889
cggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgggaccgctacacttgccagcgctgatgtccgggggtgcttttgccgttacgcaccacccccgtcagtagctgaacgggagggacagctgatagaaacagaagccactggagcacctcaaaaacaccatcatacactaaatcg

SEQ ID NO: 1205 - DNA, 719 bp, Glycine max
  Peptide Sequence Number=SeqID_92890
atgaggggtacgccaacggaagggagtctctcacctttccttgtgaaagatttaggcgcgcaaggtctcaaggttatacaaagaatccacaaggcgtggaggagtccgttgaggaaagacaaggagcttagaggcatccgaaatggcatcatcggtggttatcatggatggctaagagttcatacgcgagggttagattggctctccaaattgaaagttatcaatgaggccataatggtggcgcgtgttatgctcaggaacggatttgagcccggaatgggtctaggcaaggacggcctcggaaatgcttatgtggtcgatatcaagggaaatccatacaaatatggattagggtatgaacccgggatgccggggaggaggaacgtgccgtcaagatttcgggcggatagggtatggcccggccgtattagccagtgtttcaccagtgctggaatggtgtccgaggaagaggtggccgcaatagaagaggagttccctcaagacccaccaagttttgtgcaaccatgccaccccgattcccaagtggggaactggcgcgtgataagccagtcagaagtctataccgctaattcaatatatgagggtcgattctttgaggatcctaacaacgagggtttgaaaatcgatttcgatcgagatataagccaaacgataaacgaggaagaggaagaggacgtcctgtcaccagagttggagag

SEQ ID NO: 1206 - DNA, 109 bp, Glycine max
  Peptide Sequence Number=SeqID_92891
atggcgactaagatgaagcgatgcccattggaagccttgggttcggtggccccgatcacgtctatgccccacatagagaatggccaaggtgctgccaagatgtttaatg

SEQ ID NO: 1207 - DNA, 597 bp, Glycine max
  Peptide Sequence Number=SeqID_92892
atggcacaacctccacctcgtgagaggactctaagggaaatggctgcacctgatttcacctacgaaagcttgtgcatccaataccctgatgaggatgtcccatatgttcttaaaacaggactgattcatttgcttccaaagtttcatggccttgcagagggagtggcaaaggactggctgtattaccttgctccaaggtccatcacgagctgggatgaccttaagagagtattcttagaaaaagtttccctgcttccaggaccacagccatcaggaaggatatctcagtttagcgccagaaatgatgccatagtcattagaggagtgcatgaggtagctacaaacccatctgcatcatctgaaactaagaagcttgaaggcaaactggatgcattggttaacttggtaacccagctggccttgaatcagaaatatgtacctgtcgcaagggttcgtggtttgtgctcctctgctgaccaccatacagacctttgcccttccatgcagcaacctggagcaattgagcagcctgaagcttatgctgcaaatatttacaatagacctcctcaacctcagcagcaaaatcaaccacagtag

SEQ ID NO: 1208 - DNA, 343 bp, Glycine max
  Peptide Sequence Number=SeqID_92893
atgaggagatttttggttgatagagcaagtattgagaatgtgaatgttgtacaacaagaagccgaattagaaccgccacctaatgtggttaatgagtttaacccaaatgagattgtgcgtgatccagttgatgttgtcaaagctcggttgggcacaatgagagagagtggctggaataatttttttgccgatgtccaaggattttgtgttgctaaaagtattctggtaccaaatatggatgacgaaataccagttcggggtcgttcaagagcagaagggaggactatcactaatcttcatcattaccgtgcagagattttttatgttgctattgataaaatat

SEQ ID NO: 1209 - DNA, 255 bp, Glycine max
  Peptide Sequence Number=SeqID_92894
atggtgggaatctatgacatggggtcaacattcatggagcttttccgtagaaaccgtggcagcacttttcccagcacgcgttctgtttgcctagtagaattcgtcttaaccgatggagaagttggtggctgggtcctcacatggacaatgtggcagcaccggaataaaatcatcttctctaatcaaacttttgatggtaacaagttaatggaggatgctattttttacactatggacatggctgaagaactttga

SEQ ID NO: 1210 - DNA, 183 bp, Glycine max
  Peptide Sequence Number=SeqID_92895
atggggaaggctgttgcttctggaggaagcaacctggctcgcctgggcgagctgggcggcaaccacctcccctattttgctataaataggggaggaagtgagaaggaaaaggaatttcgcgaaggtttcgaccgttcttcgacgttcttcattcgttcttcatcgttcttcgatcttcaacgg

SEQ ID NO: 1211 - DNA, 498 bp, Glycine max
  Peptide Sequence Number=SeqID_92896
atggacaatggagatggaatagccgtcggttggttaggacatcctgtctttagagataaagaggggcatgaactttttgtacgtcatggggatggaattgttagggccgatgttccttttcgaagggcagaatctaaatatagtgtggaacaagtaggtgtaattgttgagttctatggtggcgagcttaatggagtcagttatagcgatcccgctactgtgaaaaaatatgctagacgtgctcaattgggtgaaatttttgaattagatcgtgctactttgaaatcagatggtgtttttcgtagcagtccgaggggttggtttacttttggacatgcttcttttgctctgctattctttttcgggcacatttggcatggtgctagaactttattcagagatgtttttgctggtatcgacccagatttagacgctcaagtagaatttggagcattccaaaaacttggagatccaactacaaaaaaacaggtagtctaa

SEQ ID NO: 1212 - DNA, 554 bp, Glycine max
  Peptide Sequence Number=SeqID_92897
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgcttcaaagcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 1213 - DNA, 423 bp, Glycine max
  Peptide Sequence Number=SeqID_92898
atgccttatttgcaagaaggaagacccgttgatatgctcttcgatccactaggggtagggtcacgaatgaatgtagtacaaatatttgaatgctcgctcggtggacattatgcacttgttacacaacaaccacttagaggaagggccaagcagggaggacaacgggtaggcgaaatggaggtttgggcctggaaggatttggtgtgctcatatttacaagagatgcttacttataaatctgatcatattaaaactcgccaagaagtactcgggactacgatcattggaggaacaatacctaaacctacagatgctccagaatcttttagattgctagttcgagaattacgatctttagctatggaactgaatcatttccttgtatccgagaagaacttccggattcataggaaggaagcttaa

SEQ ID NO: 1214 - DNA, 1225 bp, Glycine max
  Peptide Sequence Number=SeqID_92899
gagtacaccatgcgtcatcacctcgcgaccgccttgcagtttgagccaccattactggatcaaccccagccgtggcaatgggatgaagatgtacaaactactgccggcggagaaacgtcacaagcgcgctttatcctgaaccgcctgttccaggattatccaggtgcattttcggtgagattatggaatggcaacctgctgaatatcggagaaggtgacccagcatttaccttttgcctgcaacaagcttctgtcttacgcaacatggtgtggttctgcgaccctaaatgcctggcagaggcttatttctcggggcagatccagatactgggcgactttcacgccgccatgcagttacgtgaacattttgaatcgctctctttgccactccatgaaaaattaggcttgatcttccgggcgctgacactggcaaccgattttgcccaacctgaacaaacctcccttcctcagatagaccctactcccaaccagttagacacctcatccccggtagcactcagttacgacaatgtgccagaagacttttaccagtgctggctcgacgaacacatgctgcattcgtgtgcttatttctcaggaaacacgcgtgacctggcacaagcacaacgtaaccagctggacctgatctgcctcaagctgcacttgcaacatggtgattcactgctggatatcgggtgtggctggggtggactcgcctgctgggcagccaagcattatggtgtgtttgtccacggcattacgcaaaacgccagccagtatgcctatgccaccaaacaggtgaaaagattggggctggaacacctggtgacaatagagctgggcaactatcaagacctgcctgccacaggcagctatgacaaagcggcgtgcattggcattgccgaccatatcggcgaggcacattttcccgattacctggccaaggtacatgccgccctgaaacccggcggcctgttcctgacccatggcatgaccaacgaacagttggccgggcaacaagatgcgtctagcgcatttatcaaccgccagctgtttccacaaggggatctgtccacattcccccactttttgcagcagatggatgcggccaagtttgacgtatttaacgtggaaagcttgcgtcgccattatgtcatgaccttgcatcaatggctggccgggctggaagccaatcacgcgacagtcgccagcctcgtcggtgaac

SEQ ID NO: 1215 - DNA, 524 bp, Glycine max
  Peptide Sequence Number=SeqID_92900
gcacccggatgtacccggataagtccaacagggccctgggatttcccgccttgatcacaggactctgccagtcgttcagagtccccgtcgcacctagcaaggtgattcggccgcccatcacccgagcttttattgagaagtattgcgtgcagagacaggcccagggggatgctccgcaggccacagacgcgctgccacctcaccaggctggtccagccgaatcgtttgatacggagcagtatttgtggcatttggttcaccagcaggcggccaaccaccgggctcatgtacaaactcatgattgtctttaccagatgagcctcagcctgcagagccagggttttacttcttttccgtgccctactccggaccagttcagggcaaaggtcgcatggcctggagattggcctgaggcccgggcaggagaggcaccagctgaggctcccgacgaggcagatgaggcccgcgaggacgaggagatgaccgatttacttgatttcttaggaggaagcggggccacatga

SEQ ID NO: 1216 - DNA, 206 bp, Glycine max
  Peptide Sequence Number=SeqID_92901
atggcaggacatggtagggatcagaaccgtgacgtcctcgactgcatcacagctgtgctggaaaccctattgcaggaacgtgatgtggagtcagcagattatcgggcactcatggctttccgtaagaaggcgatgggttgcctcgaggagcataaggtcccttatgcgacattcatgctccaaggagaagccgagaattggtggaa

SEQ ID NO: 1217 - DNA, 55 bp, Glycine max
  Peptide Sequence Number=SeqID_92902
atggtgtgtctcttggagtgtgagaatcttgaacacaagggtgagcgatcccaag

SEQ ID NO: 1218 - DNA, 435 bp, Glycine max
  Peptide Sequence Number=SeqID_92903
atgaccatgattacgccaagctcgaaattaaccctcactaaagggaacaaaagctgtagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 1219 - DNA, 408 bp, Glycine max
  Peptide Sequence Number=SeqID_92904
atgactcaagatgatacatctaaggaggttaattacatggcaaatcataataggcaaggatttcatccaggtggctatgcaggatatcaacaagggggaaatttttctcataaccaaggtcaaggttggcagtcacaccctggaaatcagtttaatagagaccaaagaggtccatccaatcgacctcccaaccaagggcctaatctgtatgagcggaccaccaaattagaagacacactgactcaatttatgcagttagtagaaaattcctctagaaattttggagcaaacacagagaaaaacccaaaggaggagtgtaaggctatgatcactagaagtcaatggagaatgctagtgggaaaggagagtaaaaatagtgagggagagctagaagaagaggaaaaatag

SEQ ID NO: 1220 - DNA, 444 bp, Glycine max
  Peptide Sequence Number=SeqID_92905
atgtcgcccccctccgtgtggcaggagcaggcagtgtgtgatattttcacagttcggctttctcaattttttgggagcaccatgaatcgcttttttttcaaagtttccccccccttgtggttggaggttgtgagggatgtaggcaattctccttctccatttttttggagcccccagaattgggtttttgttcatgtgttctccaccttcgagtttggaagtatgcgtagtgattgtttagtgcaattcttccttctccacttttttgggagccccatgaattgcgttttcgttcatgtgtcctcccccttcgagttgggagctatgcgtagtgattgtttagtgcaattctccattttccatcttttcggagccccaagaattgcgttttcgttcatgtttcctccaccttcgagttgggagctatgcgtagtgattgcttag

SEQ ID NO: 1221 - DNA, 195 bp, Glycine max
  Peptide Sequence Number=SeqID_92906
atgttggtggcgactccgtgcatctttcctcctttggaaagcgcacccgtgagcctcgccctcgctcgcccgcgaagggcacgttgcgacagttggcgactccactggggacgacttgggccctatacccgggttcatgggaatttaaggagtggaggtgaatctatcatcatgctaggtctccgacttgcttga

SEQ ID NO: 1222 - DNA, 228 bp, Glycine max
  Peptide Sequence Number=SeqID_92907
atggatcgaagttggatgaacgaaagtcgcatgagccctgcatataaggaagatgttgatgcaatcctccctaggaagggaccagtcactagagccatgagcaagaggctccaagaggattgggctagagctgctgaagaaggccctagggttctcatgaacctcagggtagggtaccctagaaatataggatttttcagcccttgtattttagggcacctagactag

SEQ ID NO: 1223 - DNA, 307 bp, Glycine max
  Peptide Sequence Number=SeqID_92908
atggaagagggatatgctgcatctgtaaatcagaattaccagtggaaggttcatttgcggatgaagaagatgttgctggttgagtcattttcctcacaagttcttcaagggaaggttgcggaggagcctcaactgtttgttgtttatggggctgttgctgttgttgttgctggattggtggaggaacgtcataattgttctattgtggctgattttgctgctgatgttgaggaggtttgttgtagatgtttgcaacataagcttcaggctgttcaattgcttcagattgttgcccagaagggcaaag

SEQ ID NO: 1224 - DNA, 159 bp, Glycine max
  Peptide Sequence Number=SeqID_92909
atggggtgtagcaagcaaatgctcacctcccctttaggctggcatagagccatcaagattggggacattgggtgttgtcacatgaggaagatcaagaccaatcaatatttgggacttcaagagcttgtgaggaatcaattggtggtgaaggatttatag

SEQ ID NO: 1225 - DNA, 303 bp, Glycine max
  Peptide Sequence Number=SeqID_92910
atgcagagttgccaccaacgtttattcgtggaaaacgtcggaaaaactggaacgtgtggtctacgaactttaagtgtgaaaggttcgggagttgtttttatgcacggggaagaaaaggaaactgaaagtgacgagatgaagatgaaagcaagcaaaacaagaaatgaattgaaagcctcggattcgagcacttaccggttgaagactgaagaagggacaaagaacggtgaagaacgacggaaaatcttcacggaatcacccatggaaacgtctcggaagcgttacagaggcacctcggcttga

SEQ ID NO: 1226 - DNA, 243 bp, Glycine max
  Peptide Sequence Number=SeqID_92911
atgaagaatggtggaaaaccgtcacgaaatcgcccacagaaacgcctcagaagcgttacggaagcgcctcggcttggattttcttcacggaaacaatttttctcactaatttcaaggaggtggttgcctcctagctcgcccaggcgagctgggttgcttccaccagaaggcaccgtcttctgttggaacaccctggaaggtccaagtgggcctggttgctatttgcacacccctgtttactaa

SEQ ID NO: 1227 - DNA, 964 bp, Glycine max
  Peptide Sequence Number=SeqID_92912
tggtacctggagatatgtcgcgggggtcaggagaccttggggacgtcaggcgagctcctggcaatcaacagatgaaaggaacaaagaccacaaagcaaggaggcttgtgtggtggctggccagctatgaatcttgtgtgatatatgggttatggcctctggaagctatgagggcttctagtaatcgattaccaagggggtgtaatcgattaccaggcttagaaatgaaggcaacaggttgtggaggttttcatgtcctgaagctgtgtgattcgagtttggcctctggtaatcgattaccaaggctgtgtaatcgattaccagggatgaaaagccttgagataccccttttacttgcatgtagtggttatgagacgaattgtatcgtgatggcggcgcagctaatccatgatcgagtagagatggagtgcctagagggagcttgggagaccctcgaaggcaacatgaggtgccgatttcggggcatgattcgatttacggcgacttcattggtgcatccaaatgaacccgtgcgcacgcttcagcgtactgtggagtggatactacccacgcctacaccataccgtctagtggagccagtccaagtgatcgaggtgacgtcatccgaggaagaccctgaggaggatcccgaggagctacctcctgagcctgctgtggatgctcttgactttctagagggtgatgaggacccacttcctgaggtggattttcccgaggaagtcatgtcggcatctgaggcagactctacggaggatagtggcctgagagagatggcgaccaccaccacagtggatacctttgctctggatgacactatgtattttgtaaaacttcccatattttggacagctttagatgatgaatgtccttcaatggtgattttccaccatggagatgcagtggaagataaaggagaagtggtgagaggaggcaccatctactag

SEQ ID NO: 1228 - DNA, 153 bp, Glycine max
  Peptide Sequence Number=SeqID_92913
atgaagtcgctgagagggaaggagatcgcattggtgaaagtgcagtggggacccgacgagggtgattcaacctgggagttagaggatagggtatattgcgggaaagataagcaggttaggctaattaacgaagagaaatccataactggatag

SEQ ID NO: 1229 - DNA, 120 bp, Glycine max
  Peptide Sequence Number=SeqID_92914
atggtgagcaaagtttggagctttaatggaggcttcaatggtggaggagaaagggagaaaaaacaactcccgcgcgtttctttgcacccgtcgaggccagttttcgaaagtgagcaataa

SEQ ID NO: 1230 - DNA, 351 bp, Glycine max
  Peptide Sequence Number=SeqID_92915
atgaaaagaagcatcgcgggaaggaagaacaatggtcagagctcgcgttggaaacaagaaagtgaaggaagcccgccctgccacataagtagaagctttataagtgcgggtctgggagacgaaggtcaagtgttcgcgatatgtgaagatgatgttccaagtactttggatttggtccgaccatgccctcctgatttccagctaggaaattggcgagtggaggaacgccccggcatttacgcaacaagcataatatccgatgacgagtcccccccgaaggtactaatacctggggccccgtctatcgacttcgagcaagaaaagaatcaaacggaagatgaaggaaaatga

SEQ ID NO: 1231 - DNA, 249 bp, Glycine max
  Peptide Sequence Number=SeqID_92916
atgaaagctataccaagcaagccaacaagaaaaggaaggaagtgcttctctctgggttccttgttgaaccaatctcagacttatcaaggtaatccttgtggcgtctaccctgacttatcttccttcaccagaagtggcgtctaccctgacttatcttccttcactggaagtggcgtcatccaaaaaactctacagcctgtatctagcgatctgccccgtaaggttcacatcatgatgtatgagaattag

SEQ ID NO: 1232 - DNA, 450 bp, Glycine max
  Peptide Sequence Number=SeqID_92917
atgaccatgattacgccaagctcgaaattaaccctcactaaagggaacaaaagctgtgaggacccgaaggggaaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 1233 - DNA, 129 bp, Glycine max
  Peptide Sequence Number=SeqID_92918
atgtcagtgaaaaacctcgttggacacccaggagtgaaatcatggggatgccaatctgggtcacgctgttgtgcaagaatgctccaaccatgtgggatcgacacatgcttaaaggagcactcaaattga

SEQ ID NO: 1234 - DNA, 387 bp, Glycine max
  Peptide Sequence Number=SeqID_92919
atgtggctaccaccaaagccttggaacgagaaaccaagagggcttgtagggaagaacgcggccggaacaaattccgaggggctctgtggggtagcaacagcgagcttaaactccgaagaaaggaaagggaccaatcgcggggtggaggacgagtatgcccaagtgtatgtggaaaaggaggctagaggaagggtgatcgacttgttacaccaagaggcaaccatgtggatggaccgatttgctcttaccttgaacgggagtcaagaacttccccgattgctagccaaggccaaagcgatggcggacacctactccgcccccgaggagatccacggacttctcagctattgtcagcatatgatagacttaatggcccatataacttag

SEQ ID NO: 1235 - DNA, 396 bp, Glycine max
  Peptide Sequence Number=SeqID_92920
atgttcccacccgccccggagcattttttgattgctgaaacagaatgccgtggtcgtgcagtctcgttagcggattttattaaggtgacggatgagtgcaatctttggcacgacgtagctcgttttctcgcttatcgtctgatggtgatgaacgttcgcgaccgggagctggttggcgttgactcttatcttaaggttcgtgcgttattaatcgaaattgccgcctacaacgacgaatatcgccagagcattaatgttctgaactttattcaacgtcgtaccggaatatcgcggagtcgtaccatgaagcttctttctgaattgcgaaagggcggatatatcaatattgatggtggacgtctgttagggattaaaaaactgccactggcttactag

SEQ ID NO: 1236 - DNA, 439 bp, Glycine max
  Peptide Sequence Number=SeqID_92921
atgttgtacttgggatgtgattcaattccagaagctgttgagaatgaggatgatttagatgatgtacatgttgttggccatgaggaagatgttggtggtggagggagagaggttggtgctggtgagcatgttggtgctggagagcagagagatgctggtgagcagagggatgttgatgctggtgagaagagagatggtagtggtgaagagagagatgttggtggtagtgaggaggaaaaggaagttgacagtgatgagtggtttacaaatttctcttgtatgatgaatgaagttgaagttgagacatatggttatcattcagaggagttgaaaatccccattagtagtcatgatgaagatgaggatgttgaagtttatcctcaatatagtcaaagtagtggagttggtgaacagaagttggaaatagggatgaagtttg

SEQ ID NO: 1237 - DNA, 408 bp, Glycine max
  Peptide Sequence Number=SeqID_92922
atggaaacagcaaccctaattgccatctctatatctggtttacttcccggggatccactagttctagagcggcccgcccccgcggtgggagctccaatttcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 1238 - DNA, 423 bp, Glycine max
  Peptide Sequence Number=SeqID_92923
atgagattttggatgttagcattcgtttctaaaccaacatttagaggaaacattgggttcaacaaaatagaagaaaatcactcgaagtgtatcaatctcacacagcgtgttagcagctcaatagtgaatgaccttttttttttcttgggagaccccattgttccttcttccgaggacacggatggaaattctcatcctggttcaaggtttatggtggtttgtgtagaagcaaagcttcatgatgacgacaaaggtgatgacaaaaagctcaaagatcaatcaagaacaattcaagagttcaagataagaatcaagaagaattcaagactcaagaatcaagattcaaggttcaagatctcaagaatcaagatcaagattcaagactcaagattcaagaatgaagagaagactcaatcaagataa

SEQ ID NO: 1239 - DNA, 496 bp, Glycine max
  misc_feature (12)..(12): n is a, c, g, or t
  Peptide Sequence Number=SeqID_92924
ggccctgggttnttcggcattgatcacgggtctctaccagtcgttcgaggttcctgtcacacctagtaaggtgattcgaccgccgatcacccgggctttcaaagagaagtactgcacaactagacaggcacagggtggcaacccgcaagccccagacgcaccaccgccacctcctcaggctgacccagctgggtcatttgacatggagcagtatttacggcatttggttcgccaacaggcggccaaccacagggcgcacgtgcagacccatgactgcctctaccagttcagcctcagcctgcaaagccagggttttgcctcttttccatgccctactctggatcagttcagggcagaggtcgcatggcccggagattggcctaaggcccaggcaggggaggcacccgcagaggctctcggcgaggcaaatgaggcccgcatggatgaggagatgaccgatttgcttgatttcttgggagggagcggagccacatga

SEQ ID NO: 1240 - DNA, 318 bp, Glycine max
  Peptide Sequence Number=SeqID_92925
atgttagccatcatcagcaagtaccaagaagaactaaatctagccacggcccaagagtatagagtggcggacgagtatgcccaagtgtacgcggaaaaggaggctagaggaagggtgatcgactggttacatcaagaggcaacaatgtggatggaccgatttgctcttaccttgaatgggagtcaagaacttccctggttgctagctaaggccaaagcggtggcggacacctactctgcccccgaagagatccatggacttctcagctattgtcagcatatgatagatctaatggcccatataattagaaaccgctag

SEQ ID NO: 1241 - DNA, 1275 bp, Glycine max
  Peptide Sequence Number=SeqID_92926
cattcggtatcaatctcagctatgccgaacagccaagtcccgatggcctggctcaagcatttttgatcggtgaagaatttttggccggtgagccgagctgtctggttttgggcgacaatatttactttggtcaggggttcagtcccaagttgagaagcgttgcagcacgcaccaccggcgcgaccgtgtttggctatcaggtgatggatcccgagcgctttggcgtggtggagtttgacgaccacttccgcgcgctgtcgatcgaagaaaaaccggttaaaccgaagtctaactgggcggtgaccggcctgtacttctacgatagccaggtggtggagtttgccaaacaggtgaagccttcggagcgcggcgagctggaaatcaccagcattaaccagatgtatctggaacgcggagagctgaacgtcgagctgctggggcgtggtttcgcctggttggataccggcacgcacgacagtctgctggaagccagcagcttcgtgcagacggtagaaaaacgccagggctttaaaatcgcctgtctcgaggagatcgcctggcgcaatggctggctggatgatgagggcgtaaaacgcgcggctcagacgctggccaaaaccgagagcgccaaattacatttcgatagctcggcggcacccgtagccgaggctgatttggatgcctatgcgttggtgcaggccaaaattcccgcttatcgcctgggatgggccgatgcgctgtcgacgctgggattccggctggtcgaaggggaagtggacctggtggtgaacgttgcgcctgaaagcgcgatggccgatgccgcttcggcggttgcggtgcgtcaggccgttcccgaggacatcccgtcattgcgcgctgccgccggtgaggtgttcgctgccagccgatttcgcgccccgtggtacgatcgcgccgatagcgggcgattctatgcggcctggatcgaaaaagcggtgcagggcacctttgatcatcaatgcttgctggtgctggatagccaggggcaacccgaaggctttgtcagcctgcgtgacattggcggccaggaaatgcgcattggcctgttggcggcgttccccggcgcatccggccggggcgtgggcgccaggctgatgacggcggcgatcgccgaatgtcggcagcaggggatgcagcgcctgcgggttgcgacccaggtgggcaatatcgccgcattacgactctatcaacgacagggtgccgtgattgaaagcaccgcgtactggttatacagag

SEQ ID NO: 1242 - DNA, 244 bp, Glycine max
  Peptide Sequence Number=SeqID_92927
atggagaattgcactaagcaatcactacgcatggctccaaactcaaaggtggaggacacattgtcgcaacctacccttctgcgggagggcgacgcgagactcgcgggatgcgtgttccacgaaaggaatacgcgcggagtcgccaccaatgtttatttgaggaaaacgtcggaaaaaccggaaaagacgcgatctacgaactttgaagtgaaaggttcgggagttgtatttacgcgtggggaag

SEQ ID NO: 1243 - DNA, 390 bp, Glycine max
  Peptide Sequence Number=SeqID_92928
atggcaggagctggtgacaatggtggtgtatatcatcaactggacggatctcaacgcttattactggatgcgatgactacacaaatgcaacgtttgttgaaccgtaacaaagaagagctttgcaggcaaatagtcaaatcttccttgtttactcttaaacctctatcccctagagaagtgtgtgatgaccaaatcagaatgagagaaaagagagaacaagagaaagaaaatagtgaggcaacacagaggaataggaaaaagaagagtgatgcacccgagggaaagagtgatacacataagagagagagagaatttgaaaatgtctttcctaaggagattcctcatggactgccaccttcaatcctggagcttcattgcttaacaggctaa

SEQ ID NO: 1244 - DNA, 327 bp, Glycine max
  Peptide Sequence Number=SeqID_92929
atgggggtgcaaatagcaaccaggcccacttgggccctccagaaggcggttgcttctggaggaagtcaccttgctcacctgggcgagctgggtggcaagcatctcccccattttgctataaatagggggagaaatgaagaagaatttcgttcatccctcttggtaattcaagaatcacttgaaattagtgaaaaaaattggttccgtgaagaaaatccgagccgaggcgcttccgtaacattttcgtggggattttcgcgaagatcttcagccgttcttcgacgttcttcgttcgttcgtcatcgttcttcggtcttcaacgggtaa

SEQ ID NO: 1245 - DNA, 377 bp, Glycine max
  Peptide Sequence Number=SeqID_92930
ctgaacggtctggttataggtacattgagcaactgactgaaatgcctcaaaatgttctttacgatgcattgggatatatcaacggtgggacaccaggatttattttttctgcgaagtggtcttccgtcacaggtatttattcggcgcaaagtgcgtcgggtgctccagtggcttctgtttctatcagctgtccctcctgttcagctactgacgggggtggtgggggcgcgtcccattcgcccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 1246 - DNA, 195 bp, Glycine max
  Peptide Sequence Number=SeqID_92931
atggaaaaatctgaaaagaaaaatcatagtgaaaagaaactgaagaaagcatacatcacatgggatgaaaatgatatggaatcttctgaagattctgaaaatgaagagataaatctctgccttatggctaaaagttacgaaagtgatgaagagatcagcaaatgcatcttgcaattcatcaaaagaaatagataa

SEQ ID NO: 1247 - DNA, 279 bp, Glycine max
  Peptide Sequence Number=SeqID_92932
gagcaaaagccccgcttttgtcgaccaccccacctgttgctatcgtgacctgtgagtctgatgacatgtggagatgcccaagtgactcagagtccggtagcatgcaaagactaacgtcttcttctgcatcctttgtcaatcaggggcaagcaaacccgttgacacgcagagacttacgtcgtgttctgcgcctttgtcatcctgacttgcagagatacccaagtggttatccgcataaacactctttcactatccgtcagactcagagtccagtagcat

SEQ ID NO: 1248 - DNA, 257 bp, Glycine max
  Peptide Sequence Number=SeqID_92933
aaaggaaaaggctacaatacgaaaggtatttctctcagctcaaacagtatatcaaaattcccaacggtgagaattctcgtaatagggcttcaaatgtagtgctaaaatttcacgacgatccaacggtgaacgagtccgagatcgtcgtttttctgagacaggttaggtggcctgcgggaaaaatagagggttttgggagaagagagaagaacgaaattgtgaggcagaggaggctgaggagtcagtctgaaaactga

SEQ ID NO: 1249 - DNA, 498 bp, Glycine max
  Peptide Sequence Number=SeqID_92934
atgcacatcagggcgcagacgcaccgccaccacctcggcaggccgatccagctgggtcactgggcgtggagcgttatctacagcatttggttcgccagcatgcggccaaccactgtgggtaggtgcagatacatgagtgtctctactggttcagcctcagtcaacaagggcaaggttccaccccttttgtatgccctaccccggagcaatttggggctgaggtcgcatggcctggagactggcccgatgcccaggcaggggagggagcctacaggatccctcggtgaggcagatgagtcccaatttggcattatggctctcagttatttcgtcactatttttattgcgactgtcgcaacatgcccttttgcgggcgtgcaaggcgaggctcacgggtgcgctttccaaaggaggaaagatgcgcggagtcgccaccaacgtttatttgtggaaaatgtcggaaaaaccgaaggaaaccgatcaaaacgaaaattctaa

SEQ ID NO: 1250 - DNA, 204 bp, Glycine max
  Peptide Sequence Number=SeqID_92935
atgactgagacaagtatgcgagcagaaaatgccgattatgacaaaggtgatgaacaaaaaaaagctcaaagatcaaagaacaactcaagtgaatcaagaacaagtcaagagttcaagaatcaagaaggattcaagatctcaagaatcaagatcaagattaaagactcaagattcaagaatgaagaaaagactcaatcaagataa

SEQ ID NO: 1251 - DNA, 515 bp, Glycine max
  Peptide Sequence Number=SeqID_92936
aagaagtccaacagggattccaacaattcaacaagctctataatagcaaggaatcacgtattccagcagatttaaagtacttttccagttttgccttgtcatggattttttcatggcaatacagatacggaaaaactgaaaacagcaagcaatatccaccgttacagagacacgcctttgtaaaatggtggtcacaattcgatacttcaaaggctgctccagatcaagtcaataactggttccagagcaatcctgagttcctcaaacctgctgatcaagagacatctttgttcctgaatcagaagtcgcaactagcagcattcttagcaagctcaaaatctaaagagagtcttgctcagaatttcaaagaagttctccaactacttcaacaggaagtggaagaagaaccttccaagaaggaagctgaatcatccgagactaatgatgaccaagaagacgatccattctaccagaatgaagatgactgttttggtatatcgttagacgacgattaa

SEQ ID NO: 1252 - DNA, 423 bp, Glycine max
  Peptide Sequence Number=SeqID_92937
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaccccggaaagacatgcaaaagcaccactggcagcagccactggtaattgatttagaggagttagtcttgaagtcatgcgccggttaa

SEQ ID NO: 1253 - DNA, 894 bp, Glycine max
  Peptide Sequence Number=SeqID_92938
atggcttgtaatcgatttcaaggcatccctgtctataaatatctgcatttttgcataacccttatcccgcattcttgtgtgatgacgccccttgctcccaaatctccgtatctcactcatttcttaaccaaatcacttcaaacaaagcacaatcttcatcattttcaattctttttcaaacccactgatcaaaatccgctgcaacatcttcaaatgacagaatcatcaaagaagcgaaaagaatcttcctccaccaccatcgctgctggccaccgctgccaaggaacctctggaaacccacccacaccagttcctccttctctttcatctactagatcatccacattgttttcctcagacgatcagtgtcaaaggtactactctcaattctgtaatagagtcattctagaccctaagtaccttgaccttgaattcttcaatggagaaacatttgattgttaccaagtgtttcaaaattatggtttgattgatttcatgtctctaaaattgtcttactttcctgaattagttaaggttttctataataacttgaaaattcaggatggtattctttactctgaggtgcaaaatattcccattgttattgatcagtctttattcttttccttgactaaattgtccagtcaaggtgttccttttgagggcacccttgttgatggctggaaatttgattattctagtcattatgctcgccgcatggtctgcaatgaccaggctgacatgatcggcagattacttgctgggtcattaacttttgattgtcgtatcatgcattatatcattgttcgtattttgcttcctcgatcttcaaaccttgctcaagcctttgaagaggatttgattatgatgtgggcctttcaaactagtcgttag

SEQ ID NO: 1254 - DNA, 428 bp, Glycine max
  Peptide Sequence Number=SeqID_92939
gaagatgggtatgtctctttgtgccttcttgctcggacaagggcaaggaggatggtgatgagactgatgatgagttggagatgccgaatcttataacggatggtctacaggtggttcagtcaaggtttataagtggtcgagaggggtctagaggtggatctagagttttagttacgatggaggtcaatggctatagtagccatgctgctagggttatggaggatactcagagggaggttgtgtcttcaaacccccaaaaaggacagagctgggtggttccaagatctagctactgtttcgactactaccagggtggatctaggagcaggaaaccaaaaagtgtgaggcaatggtttccctggggaggcaacatgttcccccatgaaggttctttcgctaaacataagggggatacaggatcgacctaa

SEQ ID NO: 1255 - DNA, 585 bp, Glycine max
  Peptide Sequence Number=SeqID_92940
atgtatgcttatctacaaatcttgcatgccatttttgtgtttctctttgtgccttggtacctactggagaagcctgtaatggaagtttcgcagattcagtttaatttttggatcttcttgtccaacgctatatgtgctctagccttaaatttctccattttcttagtcattggtagaaccggtgctgtaaccatccgggtcgccggtgtgcttaaagactggatattgatagctctttcaactgttatattcccagaatctacaataaccgggttgaatataattggctatgctattgcattgtgtggagttgtgatgtacaattacataaaggttaaggatgtccgtgcctctcaattgcctgttgaaagtataccggataggatcacgaaggactggaaattcgagaagaagtcatcggatatttatgtgccagataacattggtgacgatgagggaagcagtggagctaatggtactgcttctgatatgaaaattgatgaagaaacgccactaatttcatcatcaaggttatctcatattggacgaacgcagttaaccaaccaatatgcaacaggaaagtga

SEQ ID NO: 1256 - DNA, 801 bp, Glycine max
  Peptide Sequence Number=SeqID_92941
ggtttccaaaatggagcagccgtgccggttcctacttccacccagcccaaccggttctacgtccactccgccacctctcacggcgccatgaacaacgttcgcaaggacctcatccacgactttccccagaaaaccatcttcgacttcttcaacgagaatgacctctctttcgacgtctactaccagaacatgcttgccacgctcttctttaagtgtctgcacaagctcaagaatgcggtaaagctccatgactacgccttgaagttcaagaagcacgccctaaaggggaagctgctgaactatgttgtggtggagcagaggtactttgatgtggaggtttttccgacgaatgatgaccacccctcacaagacgtggcggtcgagcaaatgttcgtgaaggaggtgtatgaggttttgaggaagagtctgcagtgggaggagatggcggtgttgattacgtacgatgagcatggtggattttatgatcatgtgacgacatcggtggaaggggtgcctaacgccgatgggatcattgggccccgcccttattactttcggtttgatagacggatgggaattaaaatcgttgggttaaatcagattggaaaaaaagatgaaaacctggttagggagtggaaccacacctctggtcaatggaatggagacactaatgacaaagttgagtaccctgaattcagcaacaaggataagacactagtcttccaattttctgtcaagcatgaacagaagcttgactgcggtggtggttacatgaagttacttagtggtgatgttgattag

SEQ ID NO: 1257 - DNA, 102 bp, Glycine max
  Peptide Sequence Number=SeqID_92942
atggccgtaaaacaggcaagattggtgaagtgcagatttcatgaactcgctaagccactcatcttctggcaaagcgcatcatttgctaagtgcccaatctga

SEQ ID NO: 1258 - DNA, 237 bp, Glycine max
  Peptide Sequence Number=SeqID_92943
atgtccaaatcttgtggatttgggatgaccagccctctcgatgagtcgatctcttgctttctcataaggggctacacgccctcaccttgggtactagttaccctcaccgtcagaggactacacgtcctcgccttgagaggactacacgtcctcacccagagggctgcacgccctcacctccagaggactataagtcctcgccttgagagggctacacgccctcaccttgggtactag

SEQ ID NO: 1259 - DNA, 126 bp, Glycine max
  Peptide Sequence Number=SeqID_92944
catggaaataaaaatcctgatcctgtcaatgatcctatgcatgctcattcaggtccagtgctagtgcagatgatgggtcctgagaaagaggcaggtccaacattggtgcaaatggctcaggcttag

SEQ ID NO: 1260 - DNA, 291 bp, Glycine max
  Peptide Sequence Number=SeqID_92945
ctttcttctcatggaggaggtgaggccttcgcagctcaggagcctcaaccagatctagagactacacctactgctcaagaggatgattcagaggccactcccctagagtcatttgcaccagaaactgatccaaaggcagacccagtgattgcggaggccagtccacaggcatcaccaatatctacaccagtgttggagctgagcaccccacaaggatcaccagttggcactcctgtgctgcatttgaccggtgatgaggccatggatcaggacccaccgcaggaccagtga

SEQ ID NO: 1261 - DNA, 363 bp, Glycine max
  Peptide Sequence Number=SeqID_92946
atgggtgaccaagaggagacacaggaacagatgaaagccgacatgtcggctttgaaagagcaaatggcttccatgatggaggccatgttagggatgagacaactcatggagaataacatggtcactgctggcgctgttagttcgactgccgaagcagacccaactctcccagctaccacacaccatcctctcccaaatgcggtaggacgagaaaggagcatactggggcacatcagcaactcccattggggatacaaccgggtggcttacccttatggactaccacctaattacacaccaccagtcatgcgtgatgaagcgggtcatgtcccttcccccgtccttgaaggggagcctccttga

SEQ ID NO: 1262 - DNA, 383 bp, Glycine max
  Peptide Sequence Number=SeqID_92947
atgataaatgcaggaatgatatgtccattacgattccatgaagagatgcatgatgcaatcaaggagcaagccagagtgagtttgctatgtgcccccctaatggaaaggatccaaaagtccccttctattgacaactcccaagggtggtttcatgtaactttactggcttctagagatatcatcctcttagataatacattgtggcgatatggactatcagcgataatgcatcacaaaaataggaaaactctatatgaggcttcactattatcaagcgagtcagagacccaacatgaccacagatcgacctccactccttatggctcacatagacccgggtatagggcctatatctcaacgtgtgtgcgaggtgtaggtgccat

SEQ ID NO: 1263 - DNA, 414 bp, Glycine max
  Peptide Sequence Number=SeqID_92948
atgaccaccctagctcagacatggagtgttctttcattctctaatctgattcctacctccgatacttttgatgtcaccctagatagagccaaactcatttatggcatcattatgaagatggacatgaatgtgggaggacctaggaaggccaagggtaagagatctgaggccccttccacaacatcatcagaggcactagcaccttcttcttctacacttcctccctcttcatacactcagattctaaggattcctcctgcacccatacacataccacttccagctcctctctctgtaggtccaacagattttattttcactcctcagatgcttcactccatgctccagagcatccatagagggcagtccatcatcatgcagagccttagggcttgggcttgccctccattatga

SEQ ID NO: 1264 - DNA, 669 bp, Glycine max
  Peptide Sequence Number=SeqID_92949
atgctggcgtatttacctgagctactgaaaggcctgcataccagcctgacgctgacggccgcctcactggtcgccgcgctgctgctggcgctgctgtgcaccattgtgctggcgctgaagctgccgctgctcaactggctggtcaaaggctatatcaccctgtttaccggcacgccgctgctggtgcagattttcctgatctattacggtcccggccagttccccagcattcagaacgtgccgtggctctggcatttactgtcgcagccgtggctgtgtgccatgctggcgctgtcgcttaatagcgcagcctacaccacacagctgttctacggcgcggtgcgcgccattccggccggacagtggcagtcctgcgccgcgctgggcatgcgccgccgcgatacgctgcgtattctgctgccgtacgcctttaagcgcgccctctcctcttactccaacgaagtggtgctggtgttcaagagtacttcgctggcctataccattacgctgatggaagtgatgggccacggccagctgctgtatggccgcacctacgacgtcaccgtatatgctgccgccggtctgatttatctggtggttaacggcctgctgacgctgctgatgcgcctggtcgagaagcgcgcgctggcgtttgagcgccgcaactga

SEQ ID NO: 1265 - DNA, 325 bp, Glycine max
  Peptide Sequence Number=SeqID_92950
atggagatggatgagagtgcattgctgacaactgcttatggaagaacaaagcaactaagtctcaagctaatcagaaggggaatgggacacatgaagaagaattgcctcgaattccagaaatggctagagaagaaagggtatgcaaaacctaaggaaacaagcattttatcaggcaataagctaggctcacatgtggaggccattggaacttgcattttatctttaagacatatctccattgggaggattaaaaggttagtgaaagatgaggtacttaatactctagattttgctgactttaagacttgtgtggactgcgttaagg

SEQ ID NO: 1266 - DNA, 240 bp, Glycine max
  Peptide Sequence Number=SeqID_92951
atgtcacgaaaccttacggattacgcaatcgtcccttctttggcttctgaaatgttacggaactttacggattacgcattaacgcttcctttcgactcccgacatgtcgcagaacttcacggatttcctaacaatgggtgtcaagtacctcgaggtggtcaagtgaaggtcgcgtcccaacaaacagatggtccccggacgaaattagggtatgacactgggcttagcctaagtctataa

SEQ ID NO: 1267 - DNA, 285 bp, Glycine max
  Peptide Sequence Number=SeqID_92952
atgcgtctaccagggaaggagagtctgctgatgaaaccccccataaccataaatgagattttggatgttagcatttcatttctaaatgaccatttagaggaaacactgggttcaacaaaaatagaagaaatccactcaaagtgtatcaatctcgcacagggtaaagattggcattctcaccctggatcaaggtttatggtgagtcaggattttggcttaaagcttgtagactggccagacatgatgtatgtcagggtgttggtttggccagtggttcagggataa

SEQ ID NO: 1268 - DNA, 186 bp, Glycine max
  Peptide Sequence Number=SeqID_92953
atgtctcctccacctctaaaaatctcacaatctctcaaaaactccttcaaagctcttcaagatgcctcctttgtgccaatttcgcgcttagcctggaagatgatggatgactcacttagcgagcgacaacgtgctgagcgcatgcttgcaaggcagattctcttccagattcttgtgtctcgttga

SEQ ID NO: 1269 - DNA, 625 bp, Glycine max
  Peptide Sequence Number=SeqID_92954
caggcctggccgcacacccatcagtgcatgcgcatgaattacgtaccggacagcgacaagattgagcgtgcgctgctgaatcgcctgttcgacttcggcgttccagccaaaaccggcgttgagccggaagcagtgatcgtagcggtgatcggtggcgaagatgtgcccgggcgcgatgccgatgcccgcgttgcgcgccttgagaaacagcgcgcgcacgttcagcgcctgttgcggcatctccacccacagcacctcgcgccgcagcttgcgcaggtgcgcatcgtaaccgccgctgcgcagcagttcggcaatcgccgcctgcgacagcaccgacgtgcccatgctggtggtgtacttcagcgaggcgattttgcgcatgtacttggtgctgtgcacccagccaatacggatgccgggcgccacggttttggaaaagccgctgcacaggatggcattggggctgaaggcgcgcatcggaaacggccggcgctcgccgaaagccgtatcgccaaagatatcgtcctcaatgattaccacatcattctcatcggcctggcgcgcgatatacgccttgtgctcgttgggaatacttttgcccagcggattattgatgttgttgatg

SEQ ID NO: 1270 - DNA, 186 bp, Glycine max
  Peptide Sequence Number=SeqID_92955
atgggacaccttagtgatcaaggggttcccacagaccctaagagaataaaggtcattcctgattggcccactccaccaagtgtcgagggaagtagcccagagtatgaagaaccttgggatttgaggtcaaatcttttccaaggtggaggggatgatgcaatcctaccccctaaaggtattggatag

SEQ ID NO: 1271 - DNA, 477 bp, Glycine max
  Peptide Sequence Number=SeqID_92956
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcttcctgcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 1272 - DNA, 522 bp, Glycine max
  Peptide Sequence Number=SeqID_92957
atgggtgatgaaatgcaagttggaattcatcagttgcggattactcaggactggcatgaagttactgaggagtgggagcagcgggggaactgggtgtttcttgatttggttgaggagcagaagaggaaatcgtttgttgcagtttcggctaagcagatttgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 1273 - DNA, 452 bp, Glycine max
  Peptide Sequence Number=SeqID_92958
atggcttctccacctgcctcccctcctcctcctcctcctccttctactccttcggacgcatcggcttcgccatttgccgtgaagcggacacgcaaagcctcacatcctgctaccggcaaggccgacggtccctacaagaagaaattaagaacatatttggggattgtggcatgtgataaggtggacgtcacctacgagaactggaaggaggtccctactgctcagaaggacctgatttgggaggatattcagaggcttctgacagtaggacgaaaaggaagttacttcagactatgggggagagatggaggcagtttaaaccagacctcacgaggaaatgagctcttgcaaccgatcaggacggtgtggaggacactgtctgtgagaaatatgacattagcaaggaaaaatgggcccagttttgccagactcacagacacccttcttgggag

SEQ ID NO: 1274 - DNA, 612 bp, Glycine max
  Peptide Sequence Number=SeqID_92959
atgtatggtagaagagttctacttgtggtggataattgtccagcacatccaagaaatattgaagggctaagaaacgttgagttgttcttcttgccacccaacatgacatcaaaaattcaaccttgcgatgctgggataataagagctttcaagatgcattatcgtagaaggttttatcgcaaaatattggaaggttatgaggtgggacaatctgatctagggaagataaatgcccttgatgctatcaatttggcaatcccagcttggacgatagatgttcgaaaagaaacaatagcgaattgctttcgacactgtaaaattcattcagctagtgacgttgcaagaaatttggatgaatccacttttgatgaagaaactcaagacctcgagactatgatcaaccaatgtggctatcatacggtgtctttggagcctgttacgcgaaaggaagcgcttatggcgtcgaacactcttcacaactttatgatacaatacaaaaatacaacacctgagctattggatgcaataagaaaagttagagatgagctccaaatagacttgaactttaaagaaaaacagacaactattgaatcatatttcaatagagtgtaa

SEQ ID NO: 1275 - DNA, 315 bp, Glycine max
  Peptide Sequence Number=SeqID_92960
gatggaccctcgggtactagtaccctcgcctccagaggactacacgtcctcaccttcggtggactacacgtcttcgccttgagagggctacacgtcctcgccatcagaggcctgtacgccctaaccttcagagggttgcacaccctcgccttcagagggttacatccccaaacttcagaggactacacgtcctcaccttcagagggctacacgtctgtcgcaacctacccttcggcgggagggcgacgcgagactcgcgggatgcgtgttccacgaaaaggaatacgcgcggagtcgccaccaacgtttatttga

SEQ ID NO: 1276 - DNA, 366 bp, Glycine max
  Peptide Sequence Number=SeqID_92961
atggattttgttgcctcaaagcacatttgcagagatcaaaagatgtttgatactttgaaaactgatggagaatccggccatttcaagttagggaatggtggaaaaatgaaggttgaaggcatagggagcgtgaggatgaagctccatggtggtgctattcgaactttcttaaatgtgaggggtacaaatatgttggttcaaagtggggatgcaaagtgtacaagggaagacacttggtgttgtgaggacagaaaaatagagaggaaccatgatagcaaagtgaagaagaaagtgaagttttctaatgttgtggaagtgttgggagatacttccgttgaagggggagtttgttcactctcaaattaa

SEQ ID NO: 1277 - DNA, 977 bp, Glycine max
  Peptide Sequence Number=SeqID_92962
tcgccgccgagatcatcgacctgcagggtctggacgccgccaccacggcgcaggcgctcggccagttccaccgcatcgcgacgggccatctgcctcccgcacgtggaggccgtgacatcgccgccggcctgctggaggcgtcgttcggcgccgaacgcgcggccgccgtgctgggccgtgtgggctcgacgtcgatgacctcgtcgttcgagttcctgggttcggcggaccccgctcagctggcgacgctgctcgacggcgaactgccgcagaccgtggccctcgtgctcgcgcacctgcccaccgatcgggcggccgccgtgctggccgcgttccccgatccggtccgcaccgacatcgcccaggccatcgcgagcatgggcaccgcctcgcaggaggcgatcgcgatcgtggccgacgccctgaagacccgcaccgggacgttcgcgacccgcgatgcgcccgagatgctcggcggcgtcgagccgctcgtggagatcatcgcccggtcgggagccacggtggagaaggcgctgctggcaagcatcgaggaccgtgacagcgtgctcgcggaggacatccgctcccgcatgttcacgttcgccgacatcgtcaagctcgacgaccgcgacacgcagcgcgtgctgcggggcatggacatccgttcgctggcactggcgctcaagggagcgaaccagggcatcgccgatctcatccgccgcaacgtctcggagcgcaaccgcgagaacctggacgaagaggcacggacccttggcccggtgcgcatgtcgcaggtcgaggaggccagggccgagatcgtccgcacgatccgtgcactcggggggtggcaggagacatcaccgtacagcgcgccgacgaggacgagtatgtctactgacgccttcgcaccggtgctgttccccgcgtctggacgcaggcgccggacagcgcgcagcatgcccgctcccgccttcgcg

SEQ ID NO: 1278 - DNA, 456 bp, Glycine max
  Peptide Sequence Number=SeqID_92963
atgtggtataggcctccttcatccaatgtggaaccacctaacaatgacatttcccaaaatcatgacgaagtgcatgtgttccttcgaagtgcattgttgctctttgtatattggcttatggctcacctactgatagtatggatgagtatgttcagattgttgaaaccattgcaggacaaatacctaaggaggcctaataacgaagacaatgaaagactactacaaatgggagcaacacttggctttccagtttttggcaccacgggttcaaataatggcataatcatgttaaatgcatccaatgtgtttaatgaagttttgtcaggacatgtgtctgcagtgcaatacatagtgaatggaactcaatatgatatgggatgtcgtacaggatgtcacgacatcacgcttcagaacatgcagattgtctttgactgtatgaacagattaaacaagtaa

SEQ ID NO: 1279 - DNA, 192 bp, Glycine max
  Peptide Sequence Number=SeqID_92964
atgggaaaagaaagctcagaagatagaagaaaaaatgcatgcagaaagccttgtgggagattcatcatccaaggagaaaaggtatattatgataaaccatggcaactgaggaagagaagtgtgagagccgccaagaagtcgacagctagggatgttacactagatacaaatgaagaaggagatgcttcttga

SEQ ID NO: 1280 - DNA, 441 bp, Glycine max
  Peptide Sequence Number=SeqID_92965
atggcgagtccgatgacatgcgggggtaccttatggttttactttcatcatccagagacattcaagcccgatgacgcacaaggttctgctggttgggatattgatcggccaaatgatgggaaggagggcagagcaaatggtttcaacccttctgctattgagaaatctctcaaaattagtgagaaaaattgttttcgtgaaaaaaatccaagccgaggtgcttccataacgctttcgagacgttttcgtggagattcttcactattcttcatcgttctttgttcgttcttcgtcgttctttggtctttaaccggtctgatttcctcatcgcaactgaggatacatagaagcaaaagccccgcttttatcgatcaccccaagagatcgttaattgtgcaacgccttaacgtttctctactttccaaaccaagagatcgttaa

SEQ ID NO: 1281 - DNA, 423 bp, Glycine max
  Peptide Sequence Number=SeqID_92966
atggcgacgactcctacaccaaaggctggctcgctctcgaaacaatcacgctgggaaaaattttctcgagttgaggaggaggtcgaagttgcggaagccaacgtcgacgtcaatggagaccacagagaagcccaagtggaaagaagcagaaagagaacaagaagaaaacagcaaatgaggaaagatgagcaacgtgagtgtcactcgcctgggctagcaatcaactcgcttgggctagtgacattccttcagcatgaaggaaccaactcaagtgcacaagttggtttggcacctcttggattatttcagttaaaagccatgcacaacagcaagaagaaaactagagagcagaaaccagaggaagaaccaatgaccaaggagagagaagagagaaaaagtggatctagagctacagagaagtaa

SEQ ID NO: 1282 - DNA, 414 bp, Glycine max
  Peptide Sequence Number=SeqID_92967
atgttgtgtactcttttagaagaggagtacacaaaggtacacaacttgaagagtgctaaacaaatatgggataactttgctgtaacatataagggcacctcacaggtaacaacactgagagtgttaaagaatcttgagtctatttcccttgaggaacttattggtaccctgaaagttcatgaacaagagctccagcaagacaaaggtcttgcaagagaaaaatctctagctcttagcagtaagaagaacaagaaagaaccatcatctagagaacaaaagacttggatgaggacgatctcgccttcatctatcacaaaatctataagatgtggagaaacaaaagtgggtctaagtggagaagctcttcaagaagaatgccccaggacaagaaggaaaaagacaaaagctccatag

SEQ ID NO: 1283 - DNA, 474 bp, Glycine max
  Peptide Sequence Number=SeqID_92968
atgaaggaactacaaccagtgcaagtagagcctaacacaaatccacatgctaagctggataaggtaattcttcaatatgtgttagttgcatctatcaacgaggatcttatagtggcagatgttgtggaaatagatgatagagtgctaggggttgttccaagaccaatgactgcagaggatgagaagaaagtaattgagaccctagagaagcatatggaagcatgtagacttcaaaggatcagaacttacaaaatgttgaagaagatgaaaaaacactatggtaggatctattatcttatcacatgtcttctcaagactaacaacaaatgttgctccaaggtcccagtttccaaactagatcatcagacgttatccaagtttggcacctccaaagccaacattcatagaacctcaaagggacacatatatcaatgtcagacacaaccacaggttgaagagaaagtatgtgaatga

SEQ ID NO: 1284 - DNA, 531 bp, Glycine max
  Peptide Sequence Number=SeqID_92969
atgtcagtctctgcatgctatcaagcgttctgtcttacagatagcaaaaagaatgtttatacggataaccactcgggtatttccgcccgtcagcgtgactcaaaagtcagtatgacagatcttgtaagtgcggaagatgatgtaaatctccgcgtgtcaacgggcttgccggctgcgattgacgaagggtgcagaatgaccataatttgtctctgcgtgccatcggacacgactgtgtctgaatggcaaaaggtgtgcggaatgaccataatttgtctccgcatgtcatcgggcccccacctctggatgggacaaaagggtgcagaattgaccataatttgtcttgaaaaggtcgtccactcggacacgactggtctgacattccggaaaggtgcagaagaccgtaaggcgtctctgcgggctactagctcttgggtcatggtaacaaaaagcggtgtggtcgacaaaagcgaggctcttgctcctacgtatcctccaatgaggaattcagacctacgtagttctggataa

SEQ ID NO: 1285 - DNA, 510 bp, Glycine max
  Peptide Sequence Number=SeqID_92970
atgcgtgattataatagaagcagaggaataaggggggacacagaggatgtgatttttgtgattttgtggaaacttaagataccacctaaggcagcagtatttacatggcggcttatcaaagaccgcttaccaacaaagatgaatctaagagggagacaagtagagataagtgacccaatgtgcccgttatgtaacaattcggaggagtcactctcatgggttaattcagtgggtgctttcccgaaagaacagaaagatcattacatgcagcacagcagaaggaatgctacacgaacaaaagatataagatggagctattggtggatagccctcacaaggaccatatggcaacatagaaataaggtggtctttgataaccaaacttttaatgcaagcaagctgatggatgaagcgcttcttctagtctggtcctggcttaaagctatggagaaagatttctatacacattttaatcagtggtcttccaatttgacaaatgcctttgtgtaa

SEQ ID NO: 1286 - DNA, 990 bp, Glycine max
  Peptide Sequence Number=SeqID_92971
atgtcagaacacccccaaaataccgccaatcaacctctgcgtcacccagtcgccaagctcttgctgacctcagccatgctgctggcgccgggcgtacaggccggaaccgacaacgttgagcgtgatatcaccgtcgtcgccggcgcacaggaaagcgtcaccgcgccgctgcagggcatcgtcgccaaagaaagcgcggcgggaaccaaaagcgccgcgccgttggtaaaaacgccgcaggccatcaccgtcgtcacgcgcgatcaaatggatcaacaggatgcggcttccgtcgcccaggcgctgcgatactccagcggcgtcgtggcggaataccgcggcacctctaaccgcagcgacgaagtgatcgtacgcggctttcgttacgccccaaaatatctggacggcctgagctatcaaagcggccagatcgacccctggctgcttgaacgcgttgaggtggtgcgcggcccggcttctgtgctgtacggccaggccaacccgggtgggctggtggcgatgaccagcaagcggcccgtcgcccaggctattcgcaaactgcaattgagcgcgggcaacctgcatcaaggagaggccgctttcgacttcggcggcgcattggacgaagatgccaaactgctgtatcgccttaacggcatcgccggcaccaaagagaccggcatcaaagatcacaaggaaaaccgcttcgccatcgcaccggcgctgacctatatcgccaatgaagacacgacgttcaccctgttgaccagctatcaaaaggaaccggagaacggctaccgcaacttcctgccgacctccggcgtggcgatcaaaagcagcgccggctatctgccgtatgatttcaacgtcagcgatcccggtttcaatcaggctcgccgcgaacaaacctcgttcggctatatcttcgagcactatattaacgacgttttctctttccagcagaacatgcgttacaccacggtgggatga

SEQ ID NO: 1287 - DNA, 297 bp, Glycine max
  Peptide Sequence Number=SeqID_92972
atggcctctgtggagacctctgccatggttaggtcccagattttactaaatgcatatggcacagatgcattttatgaatatgggagcccagggaattgtccccttcttagatacaacattcgggcagcatggtgcccgacgtatgcatttaagaaggtgacacagaccctccgtcggtttgacaaagtgaggggatcaagacgcaatccgtgcatgatgcagatgcaaaaggcacaacacggggatgtacatagtacaacaatatccataaataattataagcaaaggcgtacatga

SEQ ID NO: 1288 - DNA, 129 bp, Glycine max
  Peptide Sequence Number=SeqID_92973
atggtgattttccaccatggagatgcagcggaacataaaggagaagaggttagaggagctaagctcacctccttgagaagcttccttgagaagctagggcttagctacacacacccctctaatagttaa

SEQ ID NO: 1289 - DNA, 260 bp, Glycine max
  Peptide Sequence Number=SeqID_92974
gatcatggcttctccacctgcccctcccccctcctcctcctcctcctccttccgacgcatcggcttcgccgtctaccgtgaagcggacacgcaaagcctcatgtctacgatcgttgtctactagaccacctggtgcagagagaccagtggtccatgttgatcctgctactggcaaggccgacggtccccacaggaagaaattaagaacatatttggggattgtggcgtgtgataaggtggacgtcacctacgagaactag

SEQ ID NO: 1290 - DNA, 276 bp, Glycine max
  Peptide Sequence Number=SeqID_92975
atggtgaaagttggaacctcttacgtgccgatcaacgtctcattttcgccaaaagttggcccagggctttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 1291 - DNA, 333 bp, Glycine max
  Peptide Sequence Number=SeqID_92976
atgaagaagaagattgatccttctttgttaagaaatttcataaatacccttacccatgaattgataggcgtcagaatttcaataatggaagaaaatcacaagaggattctcaagtccttaggtgttacaaatgcaacccaattggtcacatcaaggccaactgtccatcaaatgaagaatggtcggagaaaagtgaaaagaaaagaattgacgaaagaagaacttaagaaagcatacattgcatgggatgacaatgattcatccgatggttcagaaaaggaaattaatcttttaaccaaagattatgaaagtgacgagaacatctctcaatga

SEQ ID NO: 1292 - DNA, 579 bp, Glycine max
  Peptide Sequence Number=SeqID_92977
atggataatgaagagggcgtgcaagagcagatgaaggccgacctatcggccttaaaagatcaaatggcttctattacggaggccatgctaaaactccagaaaactctagaggataatgccacggcgaccgcctccaatacagttagggaagcggaaccggtgctacagcccgccataaacttgggccgagatagaaacacaacggtgttcggtcggaggtacagtccgcgagcttacccatatggcttgcctctcgacttcactccccgtgccgctccggaagatgtgagccaagcccctactttcagggggcaacttcctccttatgccgattaccccctgcaagaagatgatgaaggagatgcccatctaggccttccgcttcccctcaaggatccggccccccatgaattaccccaaccaaacatagtccgccatgtcccgtcttcacccgcacccgtaaaagaatctgttccctttgcagaagataagggaaagattgattcacttgaagagaggctaagagcggtagagggccttggcaattacccgttctcagatttagcggacctatgtctg

SEQ ID NO: 1293 - DNA, 495 bp, Glycine max
  Peptide Sequence Number=SeqID_92978
atggagattattatttctattccacaaataaattgtgatttttgtcgaagagagcattacaaggaaaattgttatctctattccacgaataattctgggtggagacaggagtttaatccttacaatcattatgaagaagaaagagctcctgatcttgaaagtgtgtttaaagaattcatggcatatcatgctagctctaaagctaatcaaaattcaatgcaaaatcatgagattcattttggcaagagctattctttagaagatcatcaaagggaaccagagttacaaacctaccatcaaaaggaggcagaaagaggtttcaatatggacaatttgttaatgcaattcaaggatacaattgaatcaattcaacgagcatttaaaagtacagaaattcaggttggtaagctggtagaagaagtgactcaagctgtgggcagaagagaagaagaatttgtagaggttgaagctcaagaggaaagccctgtaaattag

SEQ ID NO: 1294 - DNA, 348 bp, Glycine max
  Peptide Sequence Number=SeqID_92979
atggaagaaggaaacaaacacacaagagtttttatactggttcggcaacaacccgtgcctacatccagtccccaagcaacctgcggtccttcagatttctttcaaccttgtaaaaatccttttacaagcaaagatccacaagggatggaatgggaagaatcaaaagaattctcagactgtgtcgttttgaattctttgacaagggagaagggagacacaaaagaattcaggcggttagtcatttgttcttttggaaaagggagaagagagacacaaaaagaattcaggcggttactccttggcgaattctttttggcaaagggagaagggaatgaaaaagatgaatag

SEQ ID NO: 1295 - DNA, 231 bp, Glycine max
  Peptide Sequence Number=SeqID_92980
atggtttttcacttaaggcttgtaatgagcttcaaaacaaagaaagggaaacataggctcaaagggctatcaaagggattaattcaagcatcaacaagaatcaagccaagactattgtgcaagcaatcaatggggaaaaacactccaaatgattatgatgatggctcaaattctcacaaaggtaaacttatcacttccaaattgagctttcaaaactatcatgacatgtag

SEQ ID NO: 1296 - DNA, 960 bp, Glycine max
  Peptide Sequence Number=SeqID_92981
aaaggtggacccttgggtactagtaccctcacccttagagggctacacgccctcgccatcagaggactacacgtcctcaccttcagaggattacacgtcctcgcctccagaggactacatgtcctcacattcagaggactacacgtcctcaccttcagagggcttcacgtcctcgccttcatagggctacatgccctcaccttcagaggactgcacatcctcaccttcagaggactacacgtcctccccttcagaggactacacgtcctcgccttgagagggctacatgtcctcgccatcagagggttgcacgccctaaccttcagagggttacatcccctcaccttcagaggactacacgtcctcaccttaagagggttgcacgccctcgcctttagagggctacacgccctcaccttcagaggactacacggctatacgtcttcaccttcagaggactacacgtccccaccgtcagagaactgcacgtcctcacttttcagagagctacacgccctcgccatcagaggactacacgtcctcaccttcatagggctacacaccctcacctttagaggactacacatcctcatcttcaaaggactgcacgtcctcgccttcgtagggctacacgccctcacctttagaggactacacgtcctcgccatcatagggctacatgccctcactttcagaggacttcacgtcctcacctttagaggactgcacgtcctcgccttcagagggctacacgccctcgccatcagaggactacacgtcctcaccttcgtagggctacacaccctcgcctttagaggactacatgtcctcgccttcaaaggactgcacgtcctcgcctttgttgggctacacgtcctcgcctttgtagggcaacacgccctcacccttcagagggctacacgccctcaccttcaaaggactgcacgccgtcgcctttag

SEQ ID NO: 1297 - DNA, 769 bp, Glycine max
  Peptide Sequence Number=SeqID_92982
aggactgcacgtcctcaccttgagaggactgcatgtcctcagcttcgtagggctacacgccctcacctttagaggaccacacgtcctcaccttcagagggctactcgccctcgccatcagaggactgcatgtcctcaccttcagagggctacacgccctcgccatcagaggactgcatgtcctcaccttcgtagggctacacgccctcacctttagaggaccacacgtcctcaccttcagagggctacacgccctcgccatcagaggactgcatgtcctcaccttcagagggctacacgccctcgccatcagaggactgcatgtcctcaccttcgtagggctacacgccctcacctttagaggaccacacgtcctcaccttcagagggctacacgccctcgccattagaggactgcatgtcctcaccttcagagggctacacgccctcgccatcagaggactgcatgtcctcaccttcgtagggctacacaccctcaccttgagaggactacacgtcctcgccaacagagggctgcacgccctcaccttgagaggactacacgtcctcgccaacagagggctgcacaccctcaccttgagaggactacacgtcctcgccaacagagggctgcacgccctcaccttgaagaagactacacgtcctcgccaacggagggctgcacgccttcaccttgaagaggactacacgtcctcgccaacagagggctgcacgccctcacctccagaggactacacatcctcgccttga

SEQ ID NO: 1298 - DNA, 243 bp, Glycine max
  Peptide Sequence Number=SeqID_92983
atgacgtttttcttaagctacacaaaagcaaaggctgaacttcgagcacactccagacatatgatcaaagatcccaacggtcagatcgtggacaattgtcatgttaagctgctggccaaagttggagaagatccaacggttaacgaaggctggacagcgtttttactgaggcagcttcatgtagcttcctctagaagcttcattaagaggcttcttcaagaagcttccccgtggcttctttga

SEQ ID NO: 1299 - DNA, 180 bp, Glycine max
  Peptide Sequence Number=SeqID_92984
atgttggggattggatcgacttttggtcgtcctcctgttcttggttggaactggttatgtgactcagatctggttagtcctactggaattgaacgggttctaaccgaaaaagaccttctggctgacgcatattcagacctagaggcttctatccttgatgcccaccctttctcctactga

SEQ ID NO: 1300 - DNA, 289 bp, Glycine max
  Peptide Sequence Number=SeqID_92985
atggtcctaggcaaaccatggagtctcacaacttccctaaaaaagagttttgagatatgggatgcatcatccaccttgtggcatggtataaagtgtgccatcttgctaaagcttatccaccactacaaagatagagtctacacctctttgggttctagggagcccaaggacaaagtccatactaatgtctacccaggtgcagatggaatggggcttgtctatcccaaagtggcccatgagcccaccctcatggctctccttcacaataatttcctgatggttccttggg

SEQ ID NO: 1301 - DNA, 111 bp, Glycine max
  Peptide Sequence Number=SeqID_92986
atgtcgaacgctataagtcgcccatcaggaccaaagatgtacgagaagcctcatcgaagaagagcggaactagtggacttaggaagctcgacgggtgaagacaagaagtaa

SEQ ID NO: 1302 - DNA, 396 bp, Glycine max
  Peptide Sequence Number=SeqID_92987
atgtatcctctacaattctcttgtgaggttgagagtgagtgtgttggaggtatatttgtgcatgtgcttaggaaaaagagacaacaaagctatgatcctattaatcttgaaacacttgatgaccatattgattgggaaatagaggagtcaccaccattcttgaccaatgaggagacatatgcattaagtaaagacctttcaaatatgaccatccaacttggtcctttaaatttagatgatgaggatgatctagaggatgcacaaggcaataccatgaaaaacatgaatttaaatgaaagcaatgttgatgaagctattatggaagattctttgttctttaatgaagaaggagttcttgaatatgacaatgacataacttatgctccttggtcatag

SEQ ID NO: 1303 - DNA, 336 bp, Glycine max
  Peptide Sequence Number=SeqID_92988
atggctgattccaagggtaccacatcaacttctatttctaggaaggaagttagtgacaggattgctaaaggattgtgtaggttctgtggggataagtgggataaaaatcataggaaaaaatgtaatgtttggggggttgatggggacccggtgctgagaggaacgaggatatgggctacgtgggagtacgtgagctcagttgaagagttgatttgcgccatcgcccgatcgccacctagtaccacatatgacggagtggtacctggagatatgtcgcgggggtcaggagaccttggggacgtcaggtggggtgctattgcccaaaaccaagcttga

SEQ ID NO: 1304 - DNA, 291 bp, Glycine max
  Peptide Sequence Number=SeqID_92989
atgacggttccaaagttagaaaagataaaaagacaagatgaaactaacaagaaacaaggtttcgttctctaccgaaaccgcaagccaagttggaagattccgcttcggttgaagggttcctctcagtgtggggtttcaatggagaacaacgatggtttgtggtggctaatggtggctgtgggtgatggaaaaagtgtttgggacgttagaaatgactttggaagaaagaaaagagaagaaatgatgtttttcctaagctacacgaaagcaaaggctgaaatgcttaaataa

SEQ ID NO: 1305 - DNA, 402 bp, Glycine max
  Peptide Sequence Number=SeqID_92990
atgttatgcatagaaaatattgacaatagatggattcagttatttgaataccttgcaccagtgggtcagatatgtgttgttcctggacagtgtgcagcagactacatggaatggttctacatgatttttcagcccttcatgagtccgacacaacttggggatccacctagacatccatctgtcatgcataatgacacatttgttgaacttgatattcctcagcacccggtggtggcaacaactatggacacagcacctgtagatgcacctggtcatgcagagcagcctagacatgtattggaggcttgtcaagaaatagttgaaaggttggaacggttgttcaacctaaggatagtgactaaagatgaaggcgacgtatggaagacacatgaagacatttag

SEQ ID NO: 1306 - DNA, 225 bp, Glycine max
  Peptide Sequence Number=SeqID_92991
atggtggtggtagtggcgacaacgacaataggtggaattgtggtagaggcagtgcacgacaacgacaatggaggtgacataatggtggtggcggtggcagcagcagggatagtgtggtgtggcgatggtggtggtggaatagtgacgatggaggtggcaacaatggggtgtggtggcagtggaagtggaatggtggcgttggaggtgacgacaacaatgtggtag

SEQ ID NO: 1307 - DNA, 432 bp, Glycine max
  Peptide Sequence Number=SeqID_92992
atggtggttccaaaggtttcaacggagaactatggcggttcgtggtggctactagtggttgtgggtggtgaagaagaagcttgggacattggggaagggttttggaagaaagaaagagaaagtaatggttgttttccaaggctacacgaaaagaagcgtttctcacacaccagaagacattgcagatcacaacggtcagatcatggacatctaccctatgaacctccagaccaaatttcgagaagatccaacgtgtctgcagcgctgtctccctccttagtggcctccaaaggcgtggcggcaggcgtagcctctggagtctcctccggtgatgcctatggtgtcgccttcggctctggctgcggctcttggggtgtaggagcctcacctccccccgcaggagaaggctggactcttggccaggccacctag

SEQ ID NO: 1308 - DNA, 342 bp, Glycine max
  Peptide Sequence Number=SeqID_92993
atggtattaaattgttctaataaaattgactgttctgttggggttctcgggggaattgaagatgctggagagcccaaatctgctgccattagggaacttcgagaagaaactagaatagtgtctactgagataattgctaagtttgcgaagatgagcggtgcggggtttagggcttcaattccgagcagtgtgaggaggacgatccagaacatcaaggagatcacggacaatcacaatgaggaaaacgtctatgcaatgctcaaggaatgttccatggatcccaacgagactactcagaagcttctccttcagggtagggatttcgatcttgaatcttattaa

SEQ ID NO: 1309 - DNA, 129 bp, Glycine max
  Peptide Sequence Number=SeqID_92994
atgcgacgaggtgggtcgttacaaagcacctgggacccctggcccacatcagcacaggatattccgacgccagctcaggatgccccctcaccacctcaggatgacccagtaccggcacaggaggattga

SEQ ID NO: 1310 - DNA, 510 bp, Glycine max
  Peptide Sequence Number=SeqID_92995
atggcatccatgggagcctcttgttcgtcatttgggtttgattgtgttcgttgtttgcgcaacaagccaataattcaactaacatctcgaacgaagaagcatcctgacaagatattttggctatatgttgagtgtaatgaagataggaggtgtaaattttggatttgggatgatgatttggtgaaacagttaaaccaaggttgtacaagttctttggaggttaatccttatctatcacaagtggaggagctgaagcagaagcttatagcagttgaagagaaacttgcctttcatgaggatagaattcatgtgtatgatggacaaatacaggaattgaagaagatggttgcaaaagaagaggcttattgtcaaggatatgccactggagttgaagagctacagaaaaaattagcaaagcaacagatgaagacaaacattcgaggatatgccactggagttgaagagccacagaaaaaattagcaaagcaacaaatgaagacaaacatttag

SEQ ID NO: 1311 - DNA, 298 bp, Glycine max
  Peptide Sequence Number=SeqID_92996
atggctagctccagagctttatatattgatgcaaatttgaaggagcaactttcagggaaggaatgccaaaaggagaaggacatgaccaagagcaatggcaaggatccacttgaaggacatggaggacctatgacaagggctagagcaaggaaagccaaggaagctcttcaacaagtgttgtccatactatttgaatacaagcccaagtttcaaggagaaaagtccaagggcccaattggcaacctaggcatcagccttttgggagaccaaatggtggctgacttgttggctgttgggg

SEQ ID NO: 1312 - DNA, 210 bp, Glycine max
  Peptide Sequence Number=SeqID_92997
atgaaagggaagaaggaattggtgttgtgggtgctccagaaggttcgtggcggcggtggccagcagcagcaatggtggaggaagatcctttgcgcttcttcgatgattctgtcttttgatgaagttttaatgaatttcaatcgaaggttcgtggtgacgatggccagcaacagcggtggtggaggaagatcctttgcgcttcttcgatga

SEQ ID NO: 1313 - DNA, 315 bp, Glycine max
  Peptide Sequence Number=SeqID_92998
atgaagggcccaaagttcaaccccacaattgacaggccagcagctgcaaaaaatataaccaagaaccatgcagattggacagaaagatctccagcagctatagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgctttttgccgttacgcaccacccgtcagtag

SEQ ID NO: 1314 - DNA, 615 bp, Glycine max
  Peptide Sequence Number=SeqID_92999
atggagaaatcaagtgaacaacaagaagcaaagggtagttacagacaagacaagaagaagcaactgagcgtcagagaagaagaagaagaagaagcaactcagtggactaaattgcctattcactcaattattgtgagttttggatttaagggattcgacatgcaagactttgccacgttccattgtgtgaagtctttgctactggatgttacaaattttcctgaattagaaactctatttgttcaagactgtgttaatttagacttagatctgtggaaggaccaccatgaagaacaaaaccccaagttgaaattaaaacttgttggatttggggatttaccacagctggtggccttacctcaatggcttgaagaaactgccaactccttacattccttgtttatgatgaactgcgacaatcttgaaatgcttccagagtggttgtcaactatgactaatctgaaagcacgtactatatcagattgtccaaagcttatatctctcccggataacatccatcacctcaccacacttgaatatttgtatatcgatggttgccttgaattatgcaaaaaatatcatccccatgttagtgagttttggtccaaaatataa

SEQ ID NO: 1315 - DNA, 608 bp, Glycine max
  Peptide Sequence Number=SeqID_93000
ctaactatgaagataagagggataaggaagaaaaactagaaaaacaaaagaaaaagaaggatagtaaggccttatcttcaaaggccaaggggaaggaaaaagaggaaaaggattcctccaagaagattgttaagaaggaaaatcattatccaacaaaaggtgatatcaaaagagcactccttcttaaacaatctttctaccttctcctatcgagggaaacatcccttagcactaccatatctcttgagcttgagggtttggttcataagagcttaaatccttgtgctttgttggtgcccaaaataggtattatgaggcaccgaatctctatgatagttggtatgatgaatgtaatgagtggtgcaaccctcttttgcaaaatctctcgtgcatccaacatctttatgattaacatacatagggactcattaggtagtgatcaaggggttcccacgaaccctaagagaataaaggtcattcctgagtggcccactccaccaagtgttgagggaagaagcccaaagtttcaagaacctctggatttgaggtcaaatccttttcaagggggagggaatgatgctatcctaccccctaagggcattggatag

SEQ ID NO: 1316 - DNA, 441 bp, Glycine max
  Peptide Sequence Number=SeqID_93001
atggtggaaagggaaatggttaccatgatggtagacaccttgcctgtgttttactgtgagaaattagtgggctacatgccctccagcttcgcagacttggtattcgccggggaaaggatcgaagtgggcttgaagagagggaagttcgattatgtctcctccacaggtaccaacgctaggaggatcgaagcaactggggcaaaaaggaaggaaggagatacctatgccatcacttcaacgcctacatggatcaagccgctgcagatctcccacggtacccatcaatatgcacaacattacccgagcttctcagcttgcgccggggactcctccaactcagcggccgtacaacctagggcacttgcgcccatccagagggaggcccccaagctccggctccaaccccgactcgctcggccggcaatgcccactttggcatcg

SEQ ID NO: 1317 - DNA, 492 bp, Glycine max
  Peptide Sequence Number=SeqID_93002
atggcctctggtttccatgttctgaagctgtgtaactcgagtttggcctctgatcgtgatggggcagcacaattaatccatgaccgagtggagatggagtgcctagagggagtttgggagaccctcgaaggcaatacgaggtgccgattttggggcacgattcaatttacggctacttcattggtgcatccagatgaacccgcgcgcacgcttcagcgtactatggagtggatactacccacgcctacaccataccgtctagtagagccagtccaagttattgaggtgacgtcatccgaggaagaccctgaggaggaccctgaggaaataccttccgagcctgctgtggatgctcttgactttctacagggtgatgaggacccactccctgaggtggattctcccgaggacgtcatgtcggcatctaagccagactctacggaggatagtggccctggagagatggcgattagtggaggctcttcatcatag

SEQ ID NO: 1318 - DNA, 429 bp, Glycine max
  Peptide Sequence Number=SeqID_93003
cgcactgatcacagactctgccagtcgttcggagtcaccgttgcacctaccaagagacaggctcagggtgatgctccacaggccgcaggcgcgccaccaccacctcatcaggctggccaggctggggcatttgacatggagcagtatttacggcatttggttcgccagcaggcggccaaccaccgagcacatgtacagacccatgattgtctgtaccagatgagcctcagcatgcagagccagggcttcgcttctttttcatgccctactccagaccaattcagggcagaggttgcatggcccggagattggcctgaggcccaagcgggagaggcgcccccagaagctcctggcgatggagaagaggcccacgaggacgaggagatggccgatttgcttgacttcttgggagggagtggagatacatga

SEQ ID NO: 1319 - DNA, 288 bp, Glycine max
  Peptide Sequence Number=SeqID_93004
atggacatgaatgtgggttacctcatctctcacgaaatctctattattccacagcatgactcctctaggcttggatttccaaccttaatcacagctttgtgtaaagctagaggagtcacatcagattctagatccttggagagcctcagccccgccattaacttggcgttcattaagaagaactgttggaatctggatgatccaacagtgacattcagagggccaaggaaggtcaggggcaagagatcagaggcccctactacttcagcagcactagagacaatttga

SEQ ID NO: 1320 - DNA, 336 bp, Glycine max
  Peptide Sequence Number=SeqID_93005
atgggatcaaatcaaacacctcggctcaagaaaaggttctatcaagtcaaaatcaagagcttagaggatgctagtttactaaagttagggcaattgatgggtcaacttcaacgacaagccttccgcaaagcctatggtaagatttgggacctagctacaatagaagtccccgtggaagtgattgcatcccttacccaatattatgaccagcccctgagcacatttgaggatttccagctagtgacgactgtggaagagtttgaagaaatcatgaggtgccctctgggaggaaggaagccatatctcttctcggggttctaccccctccatggctag

SEQ ID NO: 1321 - DNA, 219 bp, Glycine max
  Peptide Sequence Number=SeqID_93006
atgcgtaatgattgcttagtgcaattctccattctcaaccctttttcggagcccatgaattgcgttttcgttcatgcatcctccacccacgagtttggagccatgcgtagtgattgcttagtgcaattctccattctcaaccctttttcggagccccatgaatttcgttttcgttcatgcgtccccacgagtttgcagccatgcgtagtgattgcttag

SEQ ID NO: 1322 - DNA, 489 bp, Glycine max
  Peptide Sequence Number=SeqID_93007
atgccctgggtcaaacacccacgtcactacatgaaagggctgagagcatatcggggtttttcaaaggaagcacaaaacataccatggtggttccaaagtcagaaaagatgcaaagacaagctgaaactaccaaggaacaagcatagaatcatggttacctcaaggaaaatcacgaaggtgatggagaaagtgcttgggatgttggaaatggttttggaagaaaggaggagaaggaaatggcgtttttccaaggctacacgaaaagcaaaggttgaaacacttaagtgcttctgctcgcgggaaaggaagccttcctcagatgccagacattgtatcagagatcgcaacggtcatatcgtggacatctatcaaatgaacccccagaccaaatttcgagaagatccaacagttaacgaaggctgggaagcgtttttaccgagacagcttcatgtagcttgcttgagaagcttcattaagaggctttcttga

SEQ ID NO: 1323 - DNA, 330 bp, Glycine max
  Peptide Sequence Number=SeqID_93008
ggcaaaacaattggtgttaatgtagaagatgatgattcatacatggacacctatgttagtcctttgaccgctcaaatcactcctaacattgtcggagaagaagaagctgacgatagacataggtcaccaaagcaaattgctctatgcatttctgaagctgaaccactagaacatacgaagaaaagagatacaggccatcaaagtgtgtcattggagaataagacaggagattcaattgtgctgaagatagtaaattcggataaagttgtgataaaacaagacatgaagggaagaaggcataaatatgggtttaacaacaacaaacgttga

SEQ ID NO: 1324 - DNA, 238 bp, Glycine max
  Peptide Sequence Number=SeqID_93009
aacttgtaaagggcttttgcaagttagtggaactctcaagcgggttgcttggggactggacgtaggcacaaagagagagtacatctcttgtggatcagttcaagtggagggtacatccacttggttattcaaagagaacaagggagggtacatcccttgtggatctttggcttgtaaaggattttacaaggttgaaagaaatctcaagaaccgttggttgcttggggactggatgtag

SEQ ID NO: 1325 - DNA, 423 bp, Glycine max
  Peptide Sequence Number=SeqID_93010
atggggtcctttggagaagaaagttggcagtgggaattctcatggagaagaaacctttttgacaatgagctgggaagtgcttcagactttatcgaacaggtcacagctctaagccctaatgcagctttgaaggactattgggtgtggggtgctgatccaaaaggaatttttacaacaagcactgcatacctttgtattaaaggtcatcagcataatcttcatcaagggccttccccttcaaccagtcccaataaaaatgacatggaggttaaggatgatgattatcaggacttagccaaggaattgggagtttttttcgcagatgataaaagcagtggtacaaagttgaagactgatatggacaatactgaaaattctccaaaatcagcagctgtgttgggaaatgaagacaatggctcatga

SEQ ID NO: 1326 - DNA, 134 bp, Glycine max
  Peptide Sequence Number=SeqID_93011
atggagattgaggaaccttggttggggttatggctaccattgaattatcgagtggatatgggagcaagtgagcataagacactgggaattggggtgaattctacaggctttctcgctgcaaaattcatttcttg

SEQ ID NO: 1327 - DNA, 633 bp, Glycine max
  Peptide Sequence Number=SeqID_93012
gtcggtattgaggaggttaaagatgcagatgctcccgttcctgtatccactgacgaggttaacttagtgggacagacacttaacaccttccttgtttggccgacacatctcgtgaagcatttatcagaacatggagttgtaggacctacaaaacttgtagataggccagatcatgaggttttgtgggatgctaccgtgttcggggtgtttaatcaagacttccccttgtacataaagcacgaagatctgtctgaaatagcacacggtggtcaatgtctcaacatctctgttatacagttgtggattctgcttttgactgagacaagtatacgagcggggaatttcgatgtgtatggattcctcgagccacaatccatccagagatctgggcaatccacacactggcaaatggtcattattttgcctaagaaaaatcttgttgtctggttttgttccttgcataacagtgctttgaaaggaccttatgatactccacaatctaaatccaaggctggtgctaggtggattgttgttaaatgtaataaacaagaaggaagcactgagtgtggctattacgtgatgcactggatgtctagtataatcttaggaagtttcaggaataattggaaaacg

SEQ ID NO: 1328 - DNA, 1211 bp, Glycine max
  Peptide Sequence Number=SeqID_93013
atgccacaagaaaagaaagtcaaccatctcagcattttcctcatcaaacagcaatttacgaccaatcaccaagttataaagatcgaggactgcgacgcgcctgttgaggttgccatcgcgggccatggggccggacaactttttgtcaagaagaatcctccgttaccgccgaaatggtcggcactgtttaatgagttcatcaaccccaagagtctggccgttgagggcgtcgctgctgcctttttcgttaagatcgacgaacgctgttttgtcctggtcttcggccaggcagggcgcttccttctgagagatgatgtgatcgaagagcgcttcggacttctctgcgctctcaatgccgttgatcccaagacgttccgctgcgtcgatgtgcaatcgctgaatgccatcgaaagccacatgcgcatccaatccggtcaggagacgacaccggatcagttcggcctgagtgttgagcaggacatgctgaaggccatcgtcggcgcacccaagaatccgatcctcggcaaccgtatggcaggcagcgacgcgctggctgtctcggtcaagttggatctttccgatctcccgtttttgcttgatcaatacaggagacttttcgaagccgaactaaacgcagaggactatcaatgggtcaacaacatctcgacaaccaagagtgcagcggtcataagcgtcctcgagaacgcgctcgaagcaaaaatggccgcaggccaattcgacggcatctggctgtcgattccggaaatcatcgaatggacgatggtcaagggattcatgtactcaccctacggcggcggcattcttcatcctgacatcaatatggaagggtttcgcggcactgtcgatggacccatcactcttgaggtcctgcgtgcgcgccatgttcattgcgccgacgcggaccataagaaggttttcaagtcatggtcagtattcaaatgcctctatgctgagatcgaactcaacggtgtcacacatgtcctgaacgacggcaagtggttcagtatcgccaaggatttcgtcgaacggacgaaccacgactatgcggcgatcccaccgtcgaatatcaagctgcccgaataccaggggggcggagaaggggcgtataacgcacaggtagcagcgctcgaaccggcgatctacgacttgctcgatgacaagaagaaagttatgcacggcggcggtcatgg

SEQ ID NO: 1329 - DNA, 840 bp, Glycine max
  Peptide Sequence Number=SeqID_93014
atgtccaaatcttgtggatttgggatgaccggccctctcgatgagtcgatctcttgctttctcataagggtggacccttgggtacttgtacctatcaccttgagaggactacacgtcctcgccttgagaggactacacgtcctcgccttgagaggactacacgtcctcgccttgagaggactacatgtcctcaccatcagagggctgcacgccctcacctccagaggactacacgtcctcgccttgagagggctacccgccctcgccttgggtactagttaccctcaccttcagagggctacatgtcctcactttcagaggactgcatgtcctcactttcagagggctacatgtcctcactttcagaggactgcatggttgcacgctctcaccttcaaaggactgtgtgtcctcactttcaaaggactgcatgtcctcaccttcagaggattgcatgtcctcaccttcgtagggctacacgccctcacctttagaggaccacacgtcctcaccttcagagggctacatgccctcgccatcaaaggactgcgtgtcctcaccttcagagggctacacaccctcgccatcagaggactgcatgtcctcaccttagtagggctgcacgccctcacctttagaggactacacgtcctcgccaacagagggctgcatgccctcatcttgagaggactacacgtcgtcgccaacagagggctgcacgccctcaccttgagaggactacacgtcctcgccaacagagagctgtacgccctcaccttgagaggactacacgtcctcgccaacagagagctgcacgccctcaccttgagaggactacac

SEQ ID NO: 1330 - DNA, 123 bp, Glycine max
  Peptide Sequence Number=SeqID_93015
atgagagactcatcacgctttccatttatggttggggataccataaatggaaagcttgatgagtctctcattcttgaagttgttgcggatgggggaaagagaaatgttcttgggtttgagtga

SEQ ID NO: 1331 - DNA, 405 bp, Glycine max
  Peptide Sequence Number=SeqID_93016
atggagggatatacatgggagaataagatgaagaacaaggaaattaaagagaattcaccgaacaaaaagatagaggaagcaaaagaacatcacctagatgaagatgctctgataccacatgatgtaagcttcgttggagcttgtaggcctgggatcttcttcatcaatggagtcctttgcttcttgaggtctgattgcagtggaatggaaaaggagaaagatgattgcagcggaaggagaaggaagagagagaggagacgccacttcaaggagaagatgagtctagaagaagctcaccaccataggaggccatggataagagcttggaggaagaaagagatgaatgaagggagaggaaaagaagagcacgaaattttgtgctttaaaagagctctaaaatctgaa

SEQ ID NO: 1332 - DNA, 1470 bp, Glycine max
  Peptide Sequence Number=SeqID_93017
atggcaacaatatctcgaatgtggttcatatttcttggaataacttgtttctatgttacttattcttatggtgagaacatgcctcaaaggactctttctagaggcactcatcaagaagcattgcttggacttaaggcattgaaggcctctattactcggcgtgactccattgcttcaacaccaccttcattctcaccctctcctactccttctcctcttccaccacaggaaatcaagaaaccacatgtgtaccttgtgacatcttatggtgcagatccaacaggcaattcagacagcactgaagctcttcttgcagccatagcagatgcagccaaaggtccaagtgaagggttcttaatgaaggacatcaaagatcttggaggtgctcagattaatcttgagggtggaaagtacataattagccaaccactgaagttgcctctggccagggctggaaacctcatgatacatgggggaactataagagcctcaaatctttttccaccagatggccatctcatagacttgtccacctcaggagaaagcaactcctacaattatgagtacataactctcaagaacctcttgctggactccaatttcaggggagggggcattgcaataaaaaactcactaagaatcaacatagacaattgttacattacacatttctccaccactggaattttagtccaaagtggccatgaaacctacatcaggaacaccttcctaggtcagcacatcactgctgggggagacaaacatgaaagggacttctcaggcactggaataagccttcagggaaatgacaatgcagtcacagatgttgtgattttctctgctgacataggaatattggtcactggtcaagccaacactctttctggagtgcattgctacaataaggcctcgggctttggaggcacagggatttatttgaaacttcctggcttgacacaaactaggattgtgaattcttacatggattacaccaatattgtcgccgaagacccggttcagctccacatctctagcagtttcttccttggtgatgccggtattgtgttaaaatcagtcaaaggggttgtaagtggtctcaatattgttgacaacatgttctctggcttaaataaaggggttgatatagtcaagttggaccaatcaaatagtcattttaatcaaattgatcaagtttttgtggcaagaaatgttgtgaggggtatgaacttaaaggccacagctgcaaagatgtctttgcttggtaatggaacctcatggactgctgattttaacaaagttttgcttttccctaatcttatcaagcatgttgtgtattctttaagtgccagtggcaacaccttcccgaatcatgctctcagaaacgtttctcagaatcgcgttgtgatcgaaacggatgaggctgtgaatgcaaatgtttttgtcacagtggatcaaggtaatgcaagttga

SEQ ID NO: 1333 - DNA, 141 bp, Glycine max
  Peptide Sequence Number=SeqID_93018
atgggcgaggaagagaaaaaaccagaggaaaacaaagcggaggaagaagaaaagaaagaagaagagaaaaaaccagaggaatcaaaagatgagaaggaatccaaggaagaatctacgctaccagaaatggggatcctctag

SEQ ID NO: 1334 - DNA, 1467 bp, Glycine max
  Peptide Sequence Number=SeqID_93019
atggagggtcaatatcaattgagggaagctagagtgtgtaagagacatggaagacaaaaggtgtgcaaggttgcaagcgattgtggaagggatcgtcacgagagagttgaatgtgagaactgcgcatgcaaaataaattgggccgatttggacacacaccccgtcatcttcttcttgttctgtgccgcactctcgctcgcagttacagaaaccatgacgacggtggtgcccacctccgaagaagacgctgctctctctgttgtccgattcgcctctgaactcgcctgggccgatgccggtcccgagccgacctctcctggtggcataaggcctttgttttttgtcctaagggataaggttgctgagcctcaagttagtagactctgcatggaggctgaagagtttatcgttatgggaaaatggttggaactagcatcattgatgattacctctgctgaattggttttctcaaaggtttctgaaacagatatagagtccatcttcactatcatctgcaatcttgtgacaaagactgagaatccagatgaagtgatggagattgtaaaagttataactgcaaaaataattcagcagccaaacgaaaagcctgctgtgcgattgaagactttgatcaatctgtacaatcttttggagactccatactgccagttttatgtctacatgaaggcattgaatttagctgttaatgggaaagtcacagaatacattataccttcattcaaaaagatagatagcttcttgaaagagtggaaaattgggatacctgaacagagagagctctttctcactatctctaatattttgaaggaaaataaaagcatgtcaaaggatgcttttaagttcctgagcaattatctgtcgaccttttcgggagaagatgcacatgttttgagtgaagccaaggaggaggccgcacgtgcaattgtggaatttgtcagagctcctgacatatatcagtgtgatttgcttgacttgcctgctgttgggcaactggagaaggatgccaaatatgctctgttatatcagcttcttaagatttttcttacccagaggctagatgcatacttagaatatcaagctgcaaattccaccttgttgaaaaactatggccttgtgcctgaagaatgcatttccaaaatgaggctgatgtcattgatggatcttacctctgatggttctggccaaattccatatgaacttattagggacacacttcagatcaatgatgatgaagtggaactatgggtggttagagcaataactgccaagttaattgactgtaagatggaccaaatgcatcaatcagtagttgttagcttatgccactctgggcacatggacttgcacctgttggccatagttattgtgttcagggtcagatatcccatcttgttgaaaattcatttagctattatgcatgatttaatcaccaatggcaagcactga

SEQ ID NO: 1335 - DNA, 354 bp, Glycine max
  Peptide Sequence Number=SeqID_93020
atgtggcacatgagagacaacatgacaaatccccatggtggaagtgaaagccccatcttaagtcatgaaaatgatggttatgctacaattgaaattcctgcccacctactcatcattgaatacgatgatctaatcagtgctatagtcaaatcaacattcccagacttacatcagcaccacaataatcctcaattcttcaaatccagggcaatactagcttcaacaaatgaaacagtagaacaaatcaatgattatgcactatccttcattccagctgaaattattttaggcaaaaacattggccacagtgtttatattccaagaatatcaatgtccccttcacaatcaccatga

SEQ ID NO: 1336 - DNA, 270 bp, Glycine max
  Peptide Sequence Number=SeqID_93021
atggagccggttgtttacttgaaccatgacaagcagcagctgatggtgaatgatcgtcccattttgaagggaatgacagagaacttcacactgagctcagtgacggaaggtcatgggcatttccttgaggtgaacaactctgcgcatgttgtctccctcgaagtgctcagctgcctctctttcacggcatcattccggagggatagatggtatatggcgcgggagaccggagactggggggatttgaagtgggatgtgttagaaaaataa

SEQ ID NO: 1337 - DNA, 144 bp, Glycine max
  Peptide Sequence Number=SeqID_93022
atggagaaatttaataggcttctcccgaaaacctccgcacttgttcagctgccgacggtggtttctggtgactacatcggaaaagaagaagaaaaagaagctgatggtggcgttgtcgatgccgcaggacacggtcatggttga

SEQ ID NO: 1338 - DNA, 840 bp, Glycine max
  Peptide Sequence Number=SeqID_93023
atgaccccatttgtttgcttttttagtgtcattttgcttcatgtcaaggccaaggtgttggacttaatcaaagaacatggtcgtatgttgatagcaaagaacgaatattcgatagtcccatttgctaaaagactgtcagacattagaaaggtcaattttggttgtttatttatattcatggtgtttgtgaaaaaagtattccctgaaatggcttttactttggttatccatcacaatggtactttttccatggtccgacatcttcactatatagagacagataaggatgcaatttacaatcaggatgtggacacttggtcttattttgaagcaatggttgtggtccacgaattggggtactctaaagaaaatttcaagttatggtggaagaaaaatgatgagtgctttgaagatgggttgaaactaatcattgaagatcaacaaacattagagttagcaaagtatgcaatcgaccacaatgttgaagtccatatgtatgtccaacatattccccatgctgaagttgaaatacttgaacatatgggttgggggaatgatggacaggatgttggtggtaatgcagaaatggtggatggagatggtgttgttagtgatgttgatatgcaacatctagctaatgaaggttctattgatcaaggtgatgtgcatgcagttgatgatcatgttgttggtgctgtagatgttgttgaaaatggtgaagtgcatgatcaaaaggttgttgttgatgaggatgttgctgatcagggtgatgtgcttatagttgatgatcatgttgttggtgttgttgatgttgctaaaaagggtgaagtgcatgattaa

SEQ ID NO: 1339 - DNA, 1251 bp, Glycine max
  Peptide Sequence Number=SeqID_93024
atgaagaataagaaggttgtagtagctggtgtctcgctaagcgaggcacatgtggttagcgagcaacatccgctaagcgagacattagctcgcttagcgagtgaggagaatctggaagagaatttgccacgcatgcacgtgctcagcacgccatcagctcgcccagcgagacagaaaacccttttaaaggctgaagttggaaaaatcaaggaggagcatatccaagagcatagagagaaaaacagaggcgaaaaacagagcaaggaagccaaaaaccttagctttcaagaagattctagaacttgtaaaaggaatttacaagatagtggaactctcaagcgggttgcttggggactggacgtaggcacaaagggcctaacagtctttggtgttgtggcgcttgtctgccttgtgcctcctgtccggtttgtgcaagtcggccttggtgtttactttgcgcttgtcgtgcttctatttggcgaagagcatggaatgaaacgctatcttgggattgagattttagatttggacggttattcacgcaaatttgtccatgaactttctgagggactcgtcgttttcttgtcattaattggccaaggcggccgaggtcatgcggtgagacctgttaccgatgacctgtgcactgaatcgttcgacaagggtgtcgaagctgtttatgcacctaggaagacatctagatgctcatttggatctgttgtctcatcgtaccgattgaggttgagtggcttccaccccaagggtatgtctgcctccaaaatatggtcgacaaaaagatgccgacggacaatctgcgctttgcggtgcatgtgggagagactcaaatcatctgcagtgttgcctatgtgttgggggtgtgatttcccttgggtgcgttcaggcgagcctctagctggtcatggtcagcatttagcattgtcaactcttcctcctggcgttgctccatctaaacaatgtagttttggagttgttgtagtgtttgtgtttgtcatagatcgagtgctaaccatgggtgaatgtgagaggattgatgagaagccgcaagagtggatgtggttaagtgaggtcttgaacttcacacgtcgattagagagcaagtatatgctatcaggagctcgtatgagggagagaggaagagggaggcacaagggctattgtagccttgtagataatagcctggagcttatagataacgttagagataaacatttgcctatagataaaaggtag

SEQ ID NO: 1340 - DNA, 180 bp, Glycine max
  Peptide Sequence Number=SeqID_93025
atggcacatagggggccacgtgagatattaccctattggtcaaataaatttggaagtctacatcttatcattttatggtcaggcatgatggacaatgatttcttcattgataatgctgtcttcaattccgataagaaagaaatgtacgagttgctcttcctctatgtaaacgttatgtaa

SEQ ID NO: 1341 - DNA, 664 bp, Glycine max
  Peptide Sequence Number=SeqID_93026
atggatttggaaccaacacaaccggcaaccccaccggagaagaaacaagtttcagggcacattcaaaagggtcctttcatgctcaatctactagatttctctgctgcatttaggaaagagaacaggggaaaggaattatgtcaaggaagagctatgcttgcattgatgagcttaaggggagttgctaggtgcacccagcaatattgctggtgcacccagcaatttattgaaactacttcgaactgcttcttcttctctcccggaactgcttcttcttctctcccggaacctgcttcttcttctcttctctgtgaagcttcttctctgcgaggcgcgccaaggctttcttcttcttctccgcgaacagacgagaggggagaagacgagactacgccgaaaaaaatggcggaaaaggctgacggcggagtcttccggaagacccgttacgggttcttccggaagtttcggaagaacattttccggaaagtttccggaagaagtgttcttccggaaataaccaaacgtcttccggaagaacacttcttccggaaactttccggaagaagtggttcttccggaagaactttcaaatttccggaagaactttctggaagaagtggatcttccggaacaattccggaagatccacttcttccggaaagtg

SEQ ID NO: 1342 - DNA, 1272 bp, Glycine max
  Peptide Sequence Number=SeqID_93027
atggtcagatttgattctaacatattgctcaggcgagagtgtgacaagaagaatcaatcagtttataatgcaacatatacgattaaatatttacatgaagctggagcaaatgtcatcttggtcagtgattggaatatgaatactccagaatttcacatagagtcagtcgcagatttcgtatcagaagttcttcaaatacaagttgttccacttcatggaagttcttttaacaagctatcaaagactaatggccttgagaaagagaatatccttcttcttgagaatctttctaatatcaaagaggaagttgctaatagtttggagtttgctagagtattatcgtcaggagttgatatttttgtcaatgactccttctccaactctcataaagttctagcatctactgttggtgtcacccgtttctgctatgtctgtatagctggttttcactttgaggagaggctttgtctgctgaagaatcttgcagaggaaagcaggaagccatatgtagcaattcttggagggggtaatctctatgataaagcagcttcctttcagtttttagcttccagatgtcaagggtttgtatttgtgggaatgatgtcatttcaagtaatgcatgcattaggagtatctgttcctcgtaatttagtggaccataaggcatttaatgaagctctagatatagtgagacttgctcgagatagaaacgtgcagattctgtacccaaaagatttttggtgcagaaaaaaatgtgatccaacgcaattgcaagtatttccttctcatgaaatttcggatggttgggtgcctgttgaccttggacctgcatcattggaagaaatttgttctatgcttacaaattgtaagaaaataatttggattggtcctgtgaaatttactgattcaagtaaatacacctatggggcatctaaattgacaagaatacttgaacaactaagccaaaacagctgtgaaataaccgttgttgggactatggcaagcaaactggtgagacaggaaaaaagttcattgtccttgataaatatggttgagaatgcttcagttctatgggaatttctcaaaggaagaaagctgcctggtgttatggctgttgacaggttgattctagtattccattttaatcatgctgataaatctgatcttgctttaagcaacggatacccttttgaaatcaactggaacagcatttactctgacccagctcaatctctggttgttgatataggaagtggtatattttctttttaa

SEQ ID NO: 1343 - DNA, 1012 bp, Glycine max
  Peptide Sequence Number=SeqID_93028
atgaaactcaccatgcaattgcttcttcttcacacgcgcaatggattgaaagtgctcgtgcaatcgatcccacagatgccacgagaaacgataggcagcgctaacgatgttgttgtcacaatcttcaatggagagaaatttctacggaatttgcgaagcgagaatgtaatcgagaagaccatgcccaatgattacagcattggaacaggcagcagaggaggaggcagagaagaattgttgtttgcggaagccattttcagaagcaaggatctaaccgagctctttgataccataaagaaatttagggagaagagagaaagaggaaaagcggagcggcccccatccgcgacggacacctctgtagcggagcggtttcgtttcgcggctggagcggccgctatcgcggtagcgcggggcagagcggcgcggtttctggaacggtttttcgcgccgctacttcgaagcctccaccttttcctcctccacccttcgtcctccttcccctcatgcgccagcgctcgccatagtgtagaagatgtgttttccggagaggaagcgggggcgggagatgacgtggtcgtacttgtcagagagggctctgaaggtgcgatggagagggcgcttgaggtggtggaggttgccgattatggggagagatggtggacctggtgggaggatactacttgtcctttatgtggtgatgtgcaagaggaggtggggcatttatttttcaactgcgagaagatagtagggctttggtgggagtccatgagctggattcaggctaagggacctctagcagtctctccagtggaccattttcttcagttttgtgatggttttggagctgtgagaaatcacagtacttgctgtggatggtgggttgcattgataagtactatatggaagcataggaacttcctcattttccagaacaaacctttcgagccgcagaaggtcatggaagatgctatgttctcaatatggtcttggttaaaggctagacaaaaag

SEQ ID NO: 1344 - DNA, 1206 bp, Glycine max
  Peptide Sequence Number=SeqID_93029
atggcaagtagacaagtaagatgtaaccagtgtggatcactattaatggtttcagcagagactcgtgtcgttgagtgcacagtgtgccatggcatgacccagattcgaccctccattacaggtgcatggagtgaagtagtctacaactcctttcatcagtttggaggtcgtctcagaagctttgcaaataccataatgcctggttctggttcagttaacaatagcaatccgcggggttattatgggacacctcaaattgcgtattatcctccacctcctcagtcactaaggccatcatacaatgcatatggcccaaagcgggctgtgctatgtggaatttgctatcatgggaaggataaccagctaaacggcaccgtgaatgatgttaaaaacatgaatatctttctggttaaggagtgtgggtttcctagggaatccattctcattctcacagatgatatggaggagagaaacccacaaaaattcccgacgaaatataacattctgaaggccatgaggtggctaattgagggtagccagtcgggggattcattggtgttccagttctcaggacatggttgtcaggaactggatacgaatggggatttcgatgagcttgatgagcgtgacgaagcaatatgtccggttgattgggaaaagcagggaattatactcgatgatgatattaatgctgcaattgttaggccactaccatacggtgctaaacttcatgccattattgattcatgcaatagtggcactgtccttgatttagcttatgtgtggagccagagggacacatgggattatcaatatggaggtcctgataaagacacaagtggagggctagcaatttgcatttcaggttgtggcgattatcaatcgtccaaagaaatccctgtcttaagtggtggtggcggcggcaatgcggtcactggcgtttttacttatagtttcatctataccatgctaaatgaaccagctggactaagttatggtggcttgctcagttccatgcgttcaaccatccgtgggatgctaaataacccaaatgcttcgctgtttaatacagattttaccttggccccaagacagatgttcactctaactcacattcttactcgcaactatttctcgctcaacactcgcaactatggttattttttatcgatattggctaagatttttttagatgatgttggttag

SEQ ID NO: 1345 - DNA, 867 bp, Glycine max
  Peptide Sequence Number=SeqID_93030
atggcgtgcagcatattcgattttcgcccaaaatttgctctcatgcgcgtgtcgaagaagccccgacaagataatggaaaaccagatcacaccatccatctatccgtcatagtaccgtttgaattgaagaccaacccagttgaagcatttttttccaaactgagtcagcaaagcgtctggcttctttgcttcataaatcataccctcactgtaccgcgtgtcgtgcttcacccaagctctcgccgtggcctcattggacctcgcgacgtcgccctcaggtcggtagctgtacccaggaacgaggccgatgaacgcgcgcaggaggctcaggagcgtgcactcgagttcgaacgcgatttgtgcttgttggagcaggaattgatcaaatacaagcagcagaacgaatcgatatgcttacccaggtttctggattttggtttgctctgtcaaatggacaaaaggcatcagcttgctatgctggcttcaattattcatatagtaaatggtgactgggcatcccttgtccgtgctctggttgatatggatgttgtgaggccagggacaaatatcagactttttaccctcgaactggaacaagccttgggagaagtagaatttaaagaaggaattcctgatgtgaagtttagcagggttctgggaaagatttggactgtagcactcaagcatcatttccccatgccaccgtatattacacttgtcttgcgatccctagcttcattggaaggtttggctatagctgcagatacaaatttcaatacttttgaagctgcatatccttatgttgttcggaaacttctcacagacaactcagctgcaacaaggaatatattgcattgggtattataa

SEQ ID NO: 1346 - DNA, 186 bp, Glycine max
  Peptide Sequence Number=SeqID_93031
atgcccatgtttgatcaatttcatccatgcattcatgatttcattgaaaacattgtcgatgtcaaagatgatggtattggtgaagattcatggtctttggttcataaccatttgctgaaagaacttgcaaaatggtctgacgagtatatgaacctacttggtggcatagacagatttgaggagtaa

SEQ ID NO: 1347 - DNA, 765 bp, Glycine max
  Peptide Sequence Number=SeqID_93032
atgataagaagctgcagaggagagaatccagccaggacagcagcccaacaggtacagatagcaaaaggaggggtgccaatagcagaaatcaagtgggctgcacgaagagccgcgcttagcgcgagacctcgcgctaagcgcccaggtatcatcacgctaagccttgcgcataggcttagcgggagcaaaccaagtgaagaacaacacgaggagcgcgctaagccgctgcaagtcacaggagctaccacgaagcgctcgcttagccgcactgtcgcgctaagcgcgctcaactgtatcagtgaacgcgctaagcgagtgcgagcggcgctaagcgcgtgccagcagcagcgcgcagggtggcgccaagcgcgaggctgggccttagggccaccagtcctcatggcttctcgcaagcgccgtgccgtgcccacaccaggggaagcgtccaactgggacacttcccgcttcacatctgagattgcctggcacaggtaccaagacaacattcagctccggaacatccttccggagaggaatgttgaattgggacccggtatgtttgacgagttcctccaggaactcaggaggcgcagatgggaccaggtgctgactcaccttccggagaagcggattgacgtggctctggtgaaagagttctattcgaacctttatgatccagaggaccacagtccacgattctgcagggtgcgaggacaggtcgttcgttttgatgctgacaccattaacgacttcctcgacgccccg

SEQ ID NO: 1348 - DNA, 1035 bp, Glycine max
  Peptide Sequence Number=SeqID_93033
atggggatacctggtgttgatggagaattgaagaagattttgaacgctaacatggacgaagttggtgctagaaggcgtgcacgtgaggctttcaaggatattcagcttggaattgatcatatattgtttaagccaaaggggatccttgggaggggggtgttgaccccatgtgatggaataaaaatggaagagtcatatgagaagagctcaaagggcctagaaatcttctgcaaaagttggcttcctagtgcatctaagccaaaagcagcagtgttttactgtcatggaattgctagaaagctggcatcatctggatatgcagtttttgccatggattatccaggatttggtctctcagaaggactccattgctatattcccagttttgatggacttgttgatgatgtcattgagcattactcaaaaatcaaagaaaatccagagttccattctcttcccagcttcctatttggacagtccatgggtggagctgttgcattaaagatacacctgaaacagcctaaggcatgggatggtgcaattcttgttgcgcctatgtgtaaaattgcagatgacatggttcctccaaaattcctcactcatatcctgattggtttagccaatgttttaccgaagcataagttagttccaaacaaggatttagcagaggcagcattcagagatttgaagaagagggaactgactgcttacaatgttattgcttacaaggataaaccacgtttgcagagtgctgtagaaatgcttaaaactactgaagaaatagaacggcgactgaaagaagtttctctaccattattcatccttcacggggaggctgacactgtgacagatccatcagtgagcaaagccttgtatgagaatgcaagctgttcagacaagaagcttcagctttacaaggatgcctaccatggtcttcttgagggtgagcctgatgaaataataactcaagtttttggtgacatcatatcttggctggatgagcacagcttgaaacacaatcaatcttcctcttaa

SEQ ID NO: 1349 - DNA, 654 bp, Glycine max
  Peptide Sequence Number=SeqID_93034
atgctgggaggggagggacaagcctcggggatagaggggagcttgggggagaaggagggagtggggtggggaccaggtgcccttaacgggctggagggggcgttctactgtggaaaaaaggtgattttgaagatgaactgttatggtcttcagcagaacgcctttgcagcctgtgaagagatgagaggctctgtgaatttcgttgatcagaaggagcctgtcatttgccctaagccgcgccgagttggggttgcatctaacatgcctacgaggcatttcagatggcatttcaatccacaggctgagggttctgacacaaaagctggggcagaactattagagataatgtttaagaaggagagtcatgggcaggaatatgcaaatcaggtagcttcatctcctccatttttttgcgggtctcctccagtccgggctgcaaatcccttggtccaggatgctcattttggtgatgaaaaacattgtccgtcattattaatttcatcgccgtcgggtttactatctccatcttcggcgtcacgcaaaggagggtgtgttaggatgactttcggacttaaacctgctgcagttagagtagagggatttgattgcctcaacaaggattgccagaattctagaatcactgttgttgcttaa

SEQ ID NO: 1350 - DNA, 162 bp, Glycine max
  Peptide Sequence Number=SeqID_93035
atggggacaatcaatgatcctgaaagaagtcaagcgatgtcagagttggttgtcaaggcagagaggaaggcctttcaagcacttgatcacagtgcggacaacgacgatgttgaagggaattggttcaaggaagtggaggtcataggatttgtaaagaagtga

SEQ ID NO: 1351 - DNA, 1146 bp, Glycine max
  Peptide Sequence Number=SeqID_93036
atggccatggtgattctcacaacccttttggtgatttttgtgactgtgctattgaaggttgcatatgacaccatctcatgttactggctcactccaatgcgcataagaaaaatcatggagagacaaggagtgcatggccccaaaccccgctttcttataggcaacatcatagacatgacatcccttgtttcaagagcagtttctcaagacatgaaaaccatcaaccatgacattgttggtcgccttttgccacattttgttgcatggtccaaccaatatggaaagaggttcctatattggaatggtacagaaccaaggttgtgcctaacagacaccgaaatgattaaggagtttctgtcaaagtacagtaccacatctgggaaatcgtggcagcaacaacaagggaccaaacatttcattgggagaggcttattgatggcaaatggtgaagagtggcgccaccaacgtcacatggttgcccctgcattcatgggagacagacttaagagctatgctgggcacatggtggaatgcacaaaggatatgcttcaatcactacaaaatgcattagaggttggccaatctgaggtggagattggagagtgctttactgaactaactgcagatattatatcaagaactgagtttggcacaagctatcagaagggaaagcaaatattctatctcctcacacagctgcagagtagagttgctcaagcaactcgccatcttttctttcctggaagccggttttttcccagcaagtataacagagagataaagtctatgaagatggaggtggagagactcttgatggagatcatagagagtagaaaagattgtgtggaaatggggaggagcaattcttatgggaatgatttgttgggtatactcttggatgagataaagaaggagggtggtaccttgaatctacaactagttatggatgaatgcaaaacatttttctttgctggacatgaaaccactgcactcttgctcacttggacagctatgttgctagctagcaatccacattggcaagacaaagtccgagctgaagtcaaagaggtcttcaagggggaaattccatcagttgatcaactctctaagctcactctggttagtactttctttggattcatataa

SEQ ID NO: 1352 - DNA, 552 bp, Glycine max
  Peptide Sequence Number=SeqID_93037
atgccttgcttgaagaatgtgtttcattgtttgtttggtccatggcagcaaaaaataaatgaaggatattctaatttggctcttaagggggtaaaatatatgaaaagttttgttacttctgaagaatcatttaaagggttcaaggataaatacgtgtttttgagaccaacaaaaaatgtttggaatgatctttttgaggttgaacctagtggggagaacaaatatagaagttggttcccattgtattggagttatacccattatattgagaaggccaaggcttatgtagtaaaagaagaagatttaaacccagaagaaaaagatgctaaaaaaggcttgaatatttgtctaacgaagtcgggctttatatcccttaggaagcggctcaagccggttgcaaaagcaaaggccgttgttactacaaaggcaccagcttttgattgctcttctaaaagtggctatgctcatgaaaagcgtattcctccaatttcttctccatcaaaaaggcagaagcataatgctaaccgacttacttcaatagtcattgtttag

SEQ ID NO: 1353 - DNA, 513 bp, Glycine max
  Peptide Sequence Number=SeqID_93038
atgaagggtagggcgtggatccccgagttcattgtggccatgacagtagcttgtttattgtttgggatcggctccgtcgtagatgctgtcgatgtcacggtcgtcgtcggaatacctcccgacggcgtcgatgtattaaacagtgatatcgaatccggagaaagttcagaacccgaactttcagagttaccagccgtaccgtcaaggtcgggccggaccattttgatgactctagtcttgggtacctcgtacgccactcatgaatggaattgtgacatcgtgatggcagaatggacgaaaaggatgagaaatataaacatgagagttgtggctattgataagatctgcattgtggctaagaagagtttacacgcatttggtttaccaatgaatgatactagcatcaaactaaatgtgttctctgatgacccagtaacttgcacaaagcccctaggagggtgcaatgagatgttgaccacgaatgtaaccatgaatgccgcacaacacatgtag

SEQ ID NO: 1354 - DNA, 681 bp, Glycine max
  Peptide Sequence Number=SeqID_93039
atgcagctaagagatttcattgttccagtagttgctaggcctatcgtcgaagttgaggtacaagaggcacttggtgatgatgacagtgtggatctcagtaccaaagctttgggactacttccgatagtggcccatgaacttgtcgttgaggatgttgttggcgaatccagggcagttcttgacgttgctatatatgaagaagaaagtattgtctccctcatagtcacgtctcgtcgccactttgggtctaaggtgtcatcgtgtctcatcgccactacacgtttgcatcaaggagaaagtctacctcagaggactctttcaccatctttgagcactcattgcagtcaattgcatcctcatctccgtctcagtccccgacaacgtgttttctgcgccttagcagcccactccgtcatctctcgtgccctccgtgttgacatcgcaaccagttcgccgtttctcgtgccaatccgtcgtcatcttgctttgactactgtttggtccgctgtcatcgcgacctacctagctgtgaatgtgcgtggttcccgtgaagctctgccccaatttagagatcagtatactttgggtgtttacgatgaccaacttgatggatcaagtgacctcagaataattaagaaggggggtggaggtgggggtgaattaatgattaatgtgtcttga

SEQ ID NO: 1355 - DNA, 342 bp, Glycine max
  Peptide Sequence Number=SeqID_93040
atgcccatagcaacctcaaaaagaacatatggcatggagacctttgtattccacattataccaatcaccatcaagcatgaaacaccaccagaatgtttaaatcaatttcaacaacatccttgcaatgcgaccattgagatccaccttaattggtctatagataaaccactttctgggtgtcagatgataacaatcctcctagagcatcgtcaaggatccaataatggtcgtggtcaattcgtgagggttatggtcaaccaagagggttgtagtcaatccataatagccaaggcttcagcgccacttccaacaacgagtatggtggattcaccatggccatag

SEQ ID NO: 1356 - DNA, 2157 bp, Glycine max
  Peptide Sequence Number=SeqID_93041
atggctattacagcaatctccaactcgagtcagaatatgaacgaggttgctgccggaggcgtgaaaccgaagcgctccaattctcgcggagttcgaatagtgggaagcagaatctacgattctgcaaatgggaaaacttgtcaccaggtgcttttcttttttgagattttgagaatacccgtttctttttttcttgtgtttttgcgttgtggggtgtgctggtttgtggagagtgctaaatctgaatgtggggtggaatctggatgtgggaattgtgtgaaaaagggaaactgtggtggatggggttattttgaggtttgtttggatgataacatttttgtttgcttggttttcacgttgaagtgtcggcaaaaaaccagggattttgctgtttcttgtatggggagaaggcagaaaaggtggagcagttgggtaattggatgtgtccaaaatgtagaaacttttgcaactgcagtttttgccgccaaggcatctggtttcaagtcagtgtctgaaatgcttgtttcaaaaactgctgaatctaatgatttggaatcgaacaaggtgaatagggtttttccttcaaaggaagctactgaggtaaagaagcaaaaacgtgttaataaatcaagttccgacaaggttccggtgagcaaagctgtttcacctatgaagcaaattgcatcagataaggagcttgtagtacttctctcaggagaaattggaaaggaaaattcttcagatggaaaacttgaccctgtgatcagtcagaaggcatcaaccaaaaaatctaagaaaacaaagcgtgaagaattaaaggaaatatctaatgagaacaatgttgagagtgcaggcaaaaagaagagcctgaaaaggcctaaaatttgcaaagttccaagtgaggaagcaaaaggaaaagcaaatgatgaaactaaagtttgcaacggagtctctaaaaaggaaacaaaagtagatagaaaacatgatactgctcatatattgatggacagtccagaggctcaggctgcaaatgatcttttactgtttggaaaatatgccaaaggcaaccctttctctgaggtgcaaccacaaatgcataaaaatcctgacactatttttgaagatccagcaaatgatcccattgtccctgtgactgtggctccaaaacattatttattcaattctaaacatccagatatgaaacatatgcatggtgaaaattggaacaacactgtacttgtagatggtaatgctggtgccaagttccaagtaggaatagcaacgttcccaagtattggtatgaatttagtggtggaaaaaattgaagaggaaattcctttgccccctggaactgagttaacagaaatattggacactgagctcccacctgaagatgttggaaatgcgttgcagcttttagagttttgcagagtgtttggaaaggctcttgatctcaagaagggagaagctgaagccatcttaagagaattagtgcgtaaacaaaatttgcgtcgaggacaaaacactttagtggttcagtttcaaattagagtgttgaccttgatactaactgattcaggaaatgagtctccatccttgactactagcaatggaaataattcatggttgaaaccattggaggatttaattgctggatctgatcatatattaaaagattttcctttggattggcttcaagaaggcgttggtggatattacaatttggatttatctaaaaagctcacactgctgaattttctttgtgatgaagctttaattactgacaaactgaggagttgtattgaagatcaaaattcaaggcatgcagaagaagtgaaggaagcaaaaaacaagattgctgcagctaaggaaaaggaaaagggtcttaggcagaagttgcagaatgagatggttaaagctgttctgtcaaatgcggctccccttcgaatggagaagcatgatgctcttcttaaaatgatgaaaagtgaagtggctcaagctcatgctgtggtgcttaagctaaagggcacaattccaaaaggcctgaagttcttcaatctcattctaatgtcagaatatttagctgatggtacaaaattctgccatttggaagactatccatgttgcaaacaagtaataattaacacaggaaaatga

SEQ ID NO: 1357 - DNA, 306 bp, Glycine max
  Peptide Sequence Number=SeqID_93042
atggctcagcctggcttctacaatttgagagttctggggagagatgagtttgttgaagtaaatggtaagagggttgtggtggatgaggtggtgagtgatgatcttgtggtggtaacaggtttcacagagaaagaggagatggttctcaaagcaaaggttggggatgatgccattattggggatgatggtgctactactggtgttaaagacttggaaatgtgctatgataagtggggcagtggggccactgagagaatgagtggacggttgcagattgagagtgagagaggaagtgtgaaatcatga

SEQ ID NO: 1358 - DNA, 210 bp, Glycine max
  Peptide Sequence Number=SeqID_93043
atggagaataagatgaagaacaaggaattaagtcaattgaccaaacaaaaagatagaggaagtaaaagaacatcacacgaagatgctctgataccacatgatgtagctccatgtggagctttggaatggagaaggaagaaagatgattggagacgccacttcaaggagaagatgagtcaagaagaagctcaccaccataggaagccatag

SEQ ID NO: 1359 - DNA, 333 bp, Glycine max
  Peptide Sequence Number=SeqID_93044
atgccattttcgatcaaaggaaaaagaaaccctaatggagtagaggaagaggatgcatgggttggaaagaacaagctgaaacaagggctgaaacgtgcccagaagaacacgacgaggcgtttgggactggtccggcaagctttcagtggccggacggcggcgcgtggactgcacgcgtcggaactggcgcgaactggggtgagtcgcgctcctcaaggtgcacccaaccctgggttcgccggaagatatggtggctggcggcagctggtggtggacaatggtggatggtggcagacggtagcggacggtgatcagaacggttacccgctctga

SEQ ID NO: 1360 - DNA, 1098 bp, Glycine max
  Peptide Sequence Number=SeqID_93045
atgttgtgtatgtatggtttgggagtgggatttatcagtcaagcagcctatggctctagattgtgttgtgtttttttttcccagttgacctcagcttcttggcatattgttggtctggagattattgatgctgctgctaggtgtttcaattgtggttcttacaaccactcattgagagagtgtccaaggccccgtgacaacactgcagtcaataatgctcgcaataaacacaagtcccgacggaaccagaattcttcttcccggaatccgactcgttattatcagaattctcctgctggaaagtatgatggtttgaggccaggtgctctggatgatgcaacacgtcaacttttgggcttgggggagcttgatccacctccgtggctcaacagaatgcgagaattaggatacccacctggatatcttgctaattttataacctatgtttggagtttagatgtggatgatgaggatcagccttccggcattacaatatacactgatagggagattgctgaccaagaggatggggaaattatggaagcggatgcttccaaaccaaagcgtaaaaagactgtcaaatttcctggaataaatgctcctattccagataatgctgatgagagattgtggggcactagggctggaccctcgagttcagatatttcaagaaacttgtcattgccacagcacaggtcgaattatagtactgattatggcagccgtggatatcatcgcgaacatagattaggggatcttagggatgatggtccaccaggggaccctggacatagttcatctaagttcagttttcatcctaggtttggtggccatgattctgcactaagaagtccttcaatggcaaggtctcaatctgacaggagtagaagtccgatgcatgatgaagaatccccaatgcctttttctttccattctcttcattattcgtcttcagagaggcatttttcacccttggacccagattctggtagaccagggagtcggacctctgaaagtatgtattatgacagggaccgcgatctttcatctcgagttaaggacaggccagatgatcgtcaccaccgcagttggaggtga

SEQ ID NO: 1361 - DNA, 523 bp, Glycine max
  Peptide Sequence Number=SeqID_93046
ggagtcagtgcttcccttcctcttgtatgagggttgagctgatgacttcgttagctactgagagatacaagagcaggggtgctcctggcttgagtcaactcaaaattagcgatgtggcaatggtcttcttgaaagccaagaaggcttcttcacaattctcgtcatatggtgtgaaggtgttgcttttgggattggctggactgtcctccataggaaaatcctccattgatggcgatgatcatggaatgcaatactacctcaagattgagatttcggatttggatggctatgcacccaaatatatccatgaactttctaagggactcgtcctctgcttgtcgcagattggtcaaggcaaccaaggtcatgcgaggagacctactagtggtgtactgtgcactgaatcgttcaataaaggtgtcaaagctgtctatagacctagtgtgaggaaggtgtacaaatgcttgtctggatctgttgtctcgtcgtaccacttgaggttatgtggtttccacccacaagg

SEQ ID NO: 1362 - DNA, 102 bp, Glycine max
  Peptide Sequence Number=SeqID_93047
atggggataatggcttcaaacgaaatccccaaagcgggtaggctttctgatggtcctactgggcctggtatgttttgtcctgccggttgtttgggtggttga

SEQ ID NO: 1363 - DNA, 266 bp, Glycine max
  Peptide Sequence Number=SeqID_93048
gaagggtcttactttacaccaagtaccacaatgtgaaacctggtgtgtccttggaggaaaaaaaactacccaaaggagaaacttggtctgttcacaaatttggtggaacctgtgtgggaacctctcaaagaataaaaaatgttgctgacataattcttaaggatgattcggggagaaaattggtggttgtctctgcaatgtcaaaggtgaaaaatatgatgtatgaccttatccacaaggctcaatcacgcgatgagcttatatag

SEQ ID NO: 1364 - DNA, 2074 bp, Glycine max
  Peptide Sequence Number=SeqID_93049
atgttgaaaaaacttagacgcaaggttagcacagctctcacaagtggtttcaaaaaaggctccaaacccgataaaaacacaaccttcaaaatcaaaaccccatcaccaccacgatcaccttcaaccccattgccaccacttctatcaccaccacgaagattaacaatgtctcacaccagaaagcactctccttttctgttcccaaatgttgattccactgttgtccctgacccctccaatttcttctccccaaaccttctctcaaatccactccccacaaactccttcttccaaaactttgtcctaaaaaacggtgaccaacctgaatacattcacccttacctcatcaaatcctcaaacttttctctctccctctcatacccatctcgcttcttcaactcctccttcatctaccaagtcttcaaccctgatctcaccatctcttcctctcaaaaatcccacctttcccatttgaaccacaccatctcttcccacaatgatctcagtgttacattggatatcccttcttccaatttgaggtttttccttgttaggggaagcccctttttgaccctctctgtgactcaaccaacccctctttccatcaccacaatccatgcaattctctctttttcctccagcgagtcactcaccaaacacacttttcacctcaataatggccagacttggtttttgtatgcttcttcaccgattaggttgagtcatggactctctgagatcacttctgatgtcttttctggcataattaggattgccctgttgcctgattctgattggaagcatgaggctgtgcttgacaggttcagttcttgttaccctgtgagcggtgaggctgtgtttgcaagaccattttgtgtggagtataagtgggagaagagagggtggggtgatttgttgatgttggcacaccctctccatcttcagcttttggctgatagtggttgtgaagatgttagtgttttgagtgattttaaatatgggagcattgatggggagcttattggggttgttggggattcttggctcttgaaaactgatcctgtttctgtgacttggcattctgttagaggtgtgagggaagaatcccgggatgaggttgtttcggcgcttgtgaatgatgttgaggggctgaattcgtcggcaatagcgacgaattcgtcgtatttttttgggaaattgattgcaagggctgcaaggttggctttgatagctgaggaggtgtgttttcttgatgtgattcccaaggttaggaagtatttgaaggaaaccattgagccgtggctggaggggacttttaatgggaatggatttctgtatgataggaaatggggtggcattgtcaccaaacaaggatctactgatgctggtgctgattttgggtttggaatttacaatgatcaccattatcatttggggtacttcctttatggaattgcagtgcttgttaagattgatccagtgtggggttggaagtataagcctcaagcctattcactaatggcagattttatgaccttgagcagaagatcgaactcaaattacacaagactaaggtgttttgacctttataaattgcactcatgggctggagggttaactgagtttggagatggaagaaatcaggagagtactagtgaagctgttaatgcatattatgctgctgccttgatgggtctggcttatggtgacacgcatcttgttgctattggatcaacactcacagcattggaaattcatgcagctcaaatgtggtggcatgtgaaagaggaagataatcagtatgatgaagaatttggaaaagagaacaaggtagttggtgttctttgggctaataagagggacagtggactatggtttgcacctcctgagtggagagaatgtaggcttggcattcaactcttaccgatactgcctatctctgaggtcttgttttccaatgttgattttgtgaaggagcttgtggagtggacattgcctgctttgcatcgggaaggtgttggagaaggatggaaggggtttgtctatgctctgctgggtatttatgacaatgaag

SEQ ID NO: 1365 - DNA, 738 bp, Glycine max
  Peptide Sequence Number=SeqID_93050
atgtctggtgaagctatgtttagagaacctttttgtgtggaatataagtggcagaagaaagggtccgagaatttgttactgttggctcaccctctccatctcatgcttctctctaatagagacagtggtatcactgttcttggtgattttaagtacataagtattgatggggatcttgttggtgttattggtagttcgtggattttgaaaatagatcctgtagttgtaacttggcattcaactaagggtgtcaaagaaaattcctgtgatgaaattgtttcagccctttgtaaagatgtgaatggcctaaattcatcaataataacaacaacttcgtcctatttttatgggaagttggttggaagggctgcaaggttggcattgattgctaaggagatgagctatctcgatatgattcccaaggtttccaaatttttgaaggaaaccgttgagccatggttggagcagaaatttgacgagaatatggatttctacatgataaaaaatggggaggcaatattaccaaaaaaggtgcttacaaagcttgatccagcatggggtaggaaatataagcctcaagtctattcacctgtgcaagatttcatgaacatcgacacaaaatcaaaacccaaatacacttggttagggtgttttgatctttatgttctacagtactcttgggctggagggttaaccgagtttacaaatggaaggaatcaagagagcacaagtgaagtt

SEQ ID NO: 1366 - DNA, 396 bp, Glycine max
  Peptide Sequence Number=SeqID_93051
ggagattgttcaagcggaagatttttaccaacatatggagcagcgtggccatggaatgtattacacgccaccaacatttgctcagtatccttcgcagatgtatcagtatcctttcgaaggccatgacactgatatgtctgcaagcaaacattcgtttggtggtgttgcggaaacacaacctcatttttcatggccgaccatgaccccttcgcagcaacatgatgccccaatggcaatatctaatgccccattaggtcagcaatgggatgtacccggagcaatccatgctatgggtgacttattaggtgttgatttgcgtcacgagttttctgcagaggctgaggaacaagggcggagacagcgcgcaagaagaaatccggatcgtcaagcccgaag

SEQ ID NO: 1367 - DNA, 318 bp, Glycine max
  Peptide Sequence Number=SeqID_93052
atgtctgttttgatttttaatgagttaaatttctctgattggagcgaacaagttcaatttcacttaggtgtgttggatcttgatttggctcttcaagttgaaaaacctgctgctattattggtgctagtagcaatgaagagaaaactcattataaggtctgggaaagtatgttagttcaggaggaaaccagacttaagaatcaaggaaaccactccattcattatgtgaataatcagggagttggaaagaaagtcaataagaaacatggaaaggacaaaggatcattaaggattgtcgagtcctctactaagatctaa

SEQ ID NO: 1368 - DNA, 195 bp, Glycine max
  Peptide Sequence Number=SeqID_93053
atgggtctgggaagattgatggtgactctgaaatctaagataaggtctttgaagattttgaagaagcctgattatgataaggtggagaagagtgagagcatgagaatggagattaggagcaggaaggccagaaagctcattgaagagaccctcaagggaatgtctcaaatactttgtgtaatagataaagaataa

SEQ ID NO: 1369 - DNA, 1392 bp, Glycine max
  Peptide Sequence Number=SeqID_93054
atggctcaatctcggtacttgtttgcgatatcttgctttcatatggatcttcttagcgaagctgaagctgcattacgtcctgccgatgagcctggtgcagaggttccaaacggtgcagctggtcattatctattagggctcatttacagatgcactgacagaaggaaaaatgccatacaacatttcaagcaggcactgtcaatggatcctcttatgtgggctgcatatgaggagttgtgtatattaggtgctgctgaagaagcaactgtagtttttggtgaagcagcagctttttgcttacaaaagcaatacctgaattgttcaacctctccaaactcacatatgtcacctgaacatagtaatgaagttgccgcaagaccttgtatgtctgaagaagcgagtccaaggcaactcaaacaaatgcaaagtctcaaggatattgctacatatcatcatggagcatctattttaggaggagctgctggtcaacctattaatagcagttcatctaacatgtcatattataacaccccatctccaatggttgcacagttgtcaagtgttgctccaccgccgttgtgtaggaatgtgctgccaaatggccaaaatcttactacacttagtactgacagttctcctaagtcaacagtaaactctcctattcaagcccctcgaagaaagtttgtgggtgaaggaaagttacgaaagatttcgggtagattgttttctgattctggtcctcggcgtagttcacgactttctagtgactcaagtgtaaacacaaatgctaattcaactgttgtatctggaaatggaaccaataactcttacaagggaggttcaaagctaaaccatatggcatttcgtaccatggcaattcgtaaagggcagtcatgggccaatgaaaacattgatgaagatgattcttctttaaatcgtacatctataaattcttgttcatctcctgtcattgaagccaaatcttatgagcaagaagcagcaacttttcacattggtgggcaagtaacaagtggttctaaggtcatcactggcacttcagaaatattaacccttctaagagttcttggtgaaggctatagacttgcctgtttatataggtgccaggatgctctggatacctatctgaaacttccacagaagcattacaacactggctgggttctttctcaggttgggaaagcatactttgagctagttgattatttagaagctgattgtgcctttagtcgtgctcgtcagattacaccttatagtttggaaggaatggatatacactcgacagtcctttatcatttaaaggaagatatgaagctaagttacctggcacaggaactgatttcaactgatcgcttagctcctcaatcttggtag

SEQ ID NO: 1370 - DNA, 168 bp, Glycine max
  Peptide Sequence Number=SeqID_93055
atgtggtgtctgcatcaacaggataggggaagaagggagagagtggtggtgatggttggtgataaaccatcggatgcagtggagtgggggccagagatggtggtgactggtgagggagggagagcaaggaggatttataataagagtgcatttcttagattaatctaa

SEQ ID NO: 1371 - DNA, 189 bp, Glycine max
  Peptide Sequence Number=SeqID_93056
atggactcccaaaacatgagcaacaatgctggacaagcaaagggccaagctcaggaaaaggctaacacagtgatggacaaggctagcaatgctgctcaatctgctcaagagtccttgcaagagcccctaaaagctaaagcacaaggagctgctgatgctgtgaagaatgcaacaggaatgaacaaatga

SEQ ID NO: 1372 - DNA, 291 bp, Glycine max
  Peptide Sequence Number=SeqID_93057
atgctccccatgttactcgtgatcttcctcttcgccctcctcttcaccgcattttgctccatcttcattcgctactgctcccacgaagaacaaccccaggcgcttccacaagccacgcgcgtgctcgccacgtgtcccgtcacgtcctactccgcagtcaaaatgaggacaccgcaaaaccctgcatttcagtgtgcgatgtgtttggcggagttcaacgacgccgacgacgcgctccacttgctacccaagtgcggtcacgtgttccacgcgcactgcatcgatgcgtag

SEQ ID NO: 1373 - DNA, 990 bp, Glycine max
  Peptide Sequence Number=SeqID_93058
atggtgttagaggataagttaaagagttgtcagaggtcaaagagaagtttgacagagcagttgagaaaaacagaagagaatatgttgataatcattgatcaatataaggagaaggtgaacctaactactagtcatgggcagatgctggaagatgaacaggcaaaggaaagtttgacagagcagttgagaaaaacaaaagagaatatgttgataatcattgatcaatataaggagaagattgaaagggaagcaagagaaggggtgatagagttattgcacaaggaagccatgaaatggatgaatagattcgctctcactttgaatgaaagtcaagagcttccaaggttgttagccagagccaaggcaatgactgacactcattgtcgtcatcaaaaagtaatcatagtaactaaaaagaacgaatgcgctttacgacacccttaccaaacacgtgacaaggctagaatcatgagcaagataaaggaactgcaggaacagatgaaggccgacatggaggtcatgaaagaccaaataaccaccatgatggaggccatgatgagcatgaggaaaatgatggaggtcaacgcagctgcagtcgccactacaagtactgccattgaggtcagggaggcgaagtattgggaagtatgggcagcccccattttgcgtaggtccagagcaagcatccttcccccccatatggcctgcctcccaactaggcaccatccaatgctgtacatgtgcctgatgagaacgtcaaccactccgctcctataccccttgagagccaacaacctcagtttgggcatgcacaggtcgctcaacccatgggggagacacatgaagtaccccgagaccacactctggccgacttcgagccttaccccggatatgtcgttgaggggcaagcatttggtggcataccccagccaaacaccttggggggggcctcagtatcgcctacaaccacaactacaacccttttactga

SEQ ID NO: 1374 - DNA, 360 bp, Glycine max
  Peptide Sequence Number=SeqID_93059
atgagttttcaatatttttacgccgaatactatggtgttgttgttgatggttctttcagagtggcattattgcttccaactgaatgtaatacatacgcagatattgatgctgcatataaatgcctaaaagagcaatacggggtgaaagatgaacaattgatattgtatggtcaatctgttgggagtggtcccacacttgatcttgcttcacggataccagaattaagaggtgttgtcttgcatagtccaattttgtctgggcttagagtactataccctgtaaaacggacatactggtttgatatttataagaatatcgacaaagttggtgcggtcaaatgtcctgttttggttatacat

SEQ ID NO: 1375 - DNA, 441 bp, Glycine max
  Peptide Sequence Number=SeqID_93060
atggctgaatctaatcctcatccttctgctcctcttccttttcttcatcttctgcttttgcgcattcaatcactgagaagctcactgattcaaacttcttgttgtagaggcatcaactatgcgaatgaagctgttcaggattcaggcaccgtgaatcctgcatacactacgagggagatacaggatcaaatgctcctcacatggcttcaatcatctctttgtagatcaattttatcacgcttactagagtctgttcatgcgtttcaagtgtgggagaaaattcacaatcattttcaaaagttaactaaagcaaaaacttgtcaacttcgcacagagttgcgatgtactactcttaataacaaatccgtctcaaaatttcttctgcgtatcaaagctttggttgatgatgtgctagcttctgtcgaagatgaaatcacatag

SEQ ID NO: 1376 - DNA, 111 bp, Glycine max
  Peptide Sequence Number=SeqID_93061
atgaaagcaccaaatgatgggaagggaaatgatgctcctgaattcgagctcaggaatgaagatccgctagacagattcggagaatgcaagcaatattcgagaaggatctaa

SEQ ID NO: 1377 - DNA, 906 bp, Glycine max
  Peptide Sequence Number=SeqID_93062
atgaggaaaccttatatgatggaaaaagacaaaatgaacaacaacattaagagcaagctaaggaagggattgtggtcacctgaggaagatgaaaaactcctaaggtacatgatcactaagggacaagggtgttggagtgacattgctaggaatgctggccttcaaagatggtctcagattgcggcacgtctccctggtcgcacagacaatgagatcaagaatttctggaactccactctgaagaaaaggttgaaaatgaacaacaatattaacgccacttcatcaccaaacaatagctactcatcatcagagcctagagatgtcaatgtcatgggtgggatcatgcccatgaacgagcatgacctcatgaccatgtgcatggactcctcctcatcaacatcatcatcatgcatgcaatccatgcatacaaccaacatggtactaactgaccaatttgatccctttcccttgttgtccaacaaccgttacgacatgaccggcgcaaccgatttccttgacaacatggctgcatgcttaacccaagttggcatggtagatcatgatcatggggttgttcatgatggttatgggacattggagcctaacaaaacgggtttagaaagtgacttttcccttcctccactagaaagtagaagcattgacgacaatagtagtaccccaattgatcatgtgaaaagccataacaacaacaaccacttcaagaatagttgcttcaataacactgatcatcaccatcatatccaatgctccaacaacgtagttgtagaggatttgtttgggtttggaaatcatggacatggagaaagctttagaatggaagaatgggactttgagggtttgattcaagatattccctatttttcttcccttgatttccaagtttaa

SEQ ID NO: 1378 - DNA, 324 bp, Glycine max
  Peptide Sequence Number=SeqID_93063
atggtaaaaagtagctctagaagactgttgagactgatgaggtaccgaagaagacttggatcaactgttgagaaatgtaacacgttgtctaacagtaaatctcaaccaaacgttcgaaaacttttggatattatatatgtggctattggcactgctaaagttgttgtttctgctcaagaccaaattatgtgcattcagagggagagggaagcactcctcgaattcaaggctgcccttgtggatcaccatggaatgctctcatctaggaccactgctgattgctgccaatgggaagggattcgctgcagcaacctcaccggccat

SEQ ID NO: 1379 - DNA, 374 bp, Glycine max
  Peptide Sequence Number=SeqID_93064
gtaaatatattgcactgcaaatttgtgacgatgaagatgttgaaataatgattcaaagttttgaacaacaacaagaaatgtctgtcatagaattatgtgttgaagttgatgttgcgggtgcttctgcaattaatttgacaaattcattgttatcatgcggaaataatatgtctcacaatgaatcaagtagtgcaacagttggaacaaattcagaagaagattttgatgatgatgattatttaatatctaattcatacgttgatgactcattagatgaggatgaggatattgatgaaatgtctaacacagatgatgaagctgcccgtttgatcgaaccgtttgaaatgtctgacacatattatgtcctacaataa

SEQ ID NO: 1380 - DNA, 291 bp, Glycine max
  Peptide Sequence Number=SeqID_93065
atggaaatggctatcggttccgactttcctaactcgaggtccaaatcaggtgatttgcatccatttaatcctgaaatagataagacatttcataggcagagtagaaataataggagtagaagtgtagttgtgcttgatagtgtagttgtgcatgataatgtagttttggataatagtgtaatgcatactgaattcattgttgattctatttctgattttgttcctgagcttgtttttattgcttctgattctagaaaaaatagtgttggtataatggctgataacaattga

SEQ ID NO: 1381 - DNA, 1539 bp, Glycine max
  Peptide Sequence Number=SeqID_93066
atgtctctaagtctagccatcaaactacacctggcttcttcttctccttctttttccctccttaccctcaacaaccaccaacatgcaaacaagttaacaacttccgaaacttgttccaacaccaaggttcgtcccaaacccatttatagcaccaaccctttgatcattcccacgtgtaaagtgaggccaagagtgcaatactgtggcaccatgatcaagagttctttgatagagcctgatgggggggcattggtggatcttgtggtgcctgagggtgagaggggtgctaagatcaccttggctgagtcactgcctaaggtgcagctcacaaggattgatcttgagtgggtgcatgtggtgggggaagggtgggctagtcccttgaaagggttcatgagggaggatgagtatcttcagagtttgcatttcaattcccttagggtcaaggatggttctgtggtgaacatgtcccttcccattgttttggccattgatgatgagaccaaagagagaattggatcctcttcccatgtggggttgctcgggcctgatggagattgtgttgcaattcttcgaagtccggcgattttggtcgcaacattaaggtttttgaactctgtgactgcaattcgggccacattggctgcatttgtcccctgtattgaaatctacaagcataacaaggaagaaagaatagctagaacttggggaacaactgctcctggattgccatatgttgaggaggtgattactccggcaggaaattggcttattggaggagatttggaagtgctaaaacctatcaaatataatgatggcctagataactacaggctctctcccaaacaactccgtgaagaatttgacaagcgtcaagcagatgcagtttttgcctttcagttaagaaaccctgtacacaatggtcatgccttgttaatgaatgatactcgtaagcgcctattggaaatgggctacaaaaatcccattttactgcttcatcctcttggaggttttgtaaaggctgatgacgttcccttggatgtcaggatggagcaacatagcaaggtcctagaagatggagttcttgatcctgagactaccatagttgccatatttccatcacctatgcattatgctggtccaactgaagtacagtggcatgcaaaggcacggataaatgcaggtgcaaatttctatattgttggtcgtgatccggctggtatgggccacccaactgagaaaagggatttgtatgaccctgatcatggaaagaaggtgcttagcatggctcccggtctggagaagcttaacattttgccattcagggtggcagcttatgacactaaggtaaacaagatggcatttttcgacccaacccgtgctaaagatttcctctttatatctggaaccaagatgcgggcttttgcaaaaagtggggagaatccgccagaaggtttcatgtgcccaagtgggtggaagagtgttaaaaacacatttctgggagtgccaatttttatgcctggtcttccagcttcatga

SEQ ID NO: 1382 - DNA, 1137 bp, Glycine max
  Peptide Sequence Number=SeqID_93067
atgggagcggtgacgtcgtcgatggcggcgaagttcgcgttttttccgccggatccgccgtcgtacacggtggcggaggaggcggaggggagggcgcggatggcggaggtggctctgagggagaacgtggacgtattgaaggtgagaacggagagggggaacatcgttgtggcgatgtacataaagaacccaacggcgtcgttgactttgctttactcgcacggaaacgccgctgatctgggtcagatgtacgagttgttcagcgaactcagtatccacctccgagttaacctcatgggttatgactattctggatatgggcagtcgtctgggaagcctagtgagcagaacacttatgcagatatagaagctgtttataaatgcctgcaggagaagtatggggcgaaagaggaagatattgttctgtatgggcaatctgttggtagcggacccactatagatttggcttctcgtttaccaaaccttagggctgtgattctccacagtccaatcttatcgggccttcgtgtcatgtattctgtgaagcgcacatactggtttgacatttataagaacattgataaaatccccttagtgaattgtcctgttcttgtgattcatggaacagctgatgatgtagtggattgctcccatgggaagcaactttgggaaaattgtaaacaaaagtacgagcccttatggattaaaggaggaaatcactgtgatttggagctttaccctcaatatataaagcacctcaagaaattcatcacagtcattgagaagtcaccgcatcaaaaaactggatctgatcttattccggatcaacttgacaaacctaggaacagcatagactttcgagagaaatccagactcagcatggatcaaaaggagaatttgaagagtattgatcagaaagaaaagcctagtgcaagcacagaccgtaaagagaagtcaagagccagcgtagacaggagagataaatcaagaaacagtatagatcaccctgagaagtcatttaatggatcagatatacccgaaaaagctagaaatagcattgaccgttttggggagatggtgagatcggttggattatgcaatattgattgtttcaggcccacagcgactcatgcataa

SEQ ID NO: 1383 - DNA, 516 bp, Glycine max
  Peptide Sequence Number=SeqID_93068
atgggctctaatactttagaacttgagttttggcttaactcaatcttacaaaactggcttagtgtgatgctaacgctcctcattagtgtgaaaggtcttatgctagggactgcagatgaagttgtggatgtgtcccatgggaagcagctctgggagctttgcaaggtaaagtacgaacccttgtgggtaagtggtggtggacattgtaatcttgagctttacccagaattcattaaacatctaaagaaatttgtacagacaattggaaaatctaaagcaactgcgaatggttctaaaaaggatactgtagaatctgagaatcaaggcaaagctagcaaagaatctgaaagtggaacttccggtacttccgaattgagtacagaaatccctgaagtttctagaaacagtttagatagccgtctcgagaagtctaaaaaaccaggcaaaccggaaaaatctcgtatgagcacagaccatgttgataggtttaggagaagaaaggggttagtttggtag

SEQ ID NO: 1384 - DNA, 1434 bp, Glycine max
  Peptide Sequence Number=SeqID_93069
atggctaagtacgatccagagatagtaatggatttctatgccaacgcgtggcccacagaggagggagtcagagacaagcgctcctgggactttgcccagagcatggcaggaaaacaggtgcggatcatgcgcactagcatgaccaccctcatgcagatttggatgacgttactgctcaacaacatcctctccagagaccataattttgacctccccttgccgaagtgccagctggtctatgccatcctgacccaggtgagtgtccatgtagcccaattgatctcagacgctatatatcagtttgcagggatcacaccgcttagacacccagtggactcggagaagtccaacagggcactggggtttcctgctttgatcacaggcctttgccaattctatggagtgtcggtcactcccaccaagcttatccggcctcccatcagcagagccttcatagagaaatattgcatgcttaagaaggcacaacagcagcaagaggagggccagcagcagcccgccgcaagtgcaccgtcgtcgcctctacaagaagaaacatttgattgttaccaagtgtttcaaaattctgctttgattgatttcatgactctgaaactgccctactttcctgaattagttaaggttttctatactaatttgaaaattcaggatggtattctttactctgaggtgcataatattctcattgttattgatcggtccttattttattctttgactaaactgcccagtcaaggtgttccttttgagggcacccttgttaatgattggaaatttgattattctagtcatgatgctcgcagaatggtctacaatgatcaggctgacatgaccggtaaattacttgctaggtcattaactttcgattgtcgcatcatgcattatatcattgttcgtattttgcttcctcggtcttcaaaacttgcccaagcctctaaggaggatttgattatgatgtgggcctttcaaactggttgtcagatcgactggggccatttagttcggtaccagatgcataaggcattacgggccaatgtacctctgtcttatcctcaccttgctactctttttcttcatcatttcaatgttcctttggatgatgaaccatttttcaaggtcaaaaggtctttctctattggtgttggtgcgattacctcctttggttaccgaaaggatgttgatggtcagtgggttcgcaaacaggacttgtcattgcctattcccgacgaacgtaccccatctcctccaccacaaaggactgattccacttctcttctgactgaagtactcacagagctccgcgaccttcgagcttttgtggatgagcgcttcgatgccatggacacccggattactaggcttgaagatgatatgagcttcatcaggcgttgcttcaatccccctgtcaactcttag

SEQ ID NO: 1385 - DNA, 471 bp, Glycine max
  Peptide Sequence Number=SeqID_93070
atgctaagggatgcacttgggttaatcactcaaaaggtgaaaccttctgggagtaaagagccaactggggggaagagtggtggtgggcttaatggttgcaatggattaggaacctggggagggagaaatggggttggagggagaaaaggatttggagggagaaatgggattgggggtaggaatgggattggaggaaactggattggtggaagaaatggaattggaggtagaaatgggattggagggaaagggaaaaagtttggctttttggtaggcttgaatgagaacaacccagctgagaatatgtgttctccttgcttcattgccttaagactcactagagaagaggtagcaagtgaggccacagaacaatgtggctcactgctacttatcaatttgaaagtgcatcccttgattctctttgcatgtttccacactttgaatggtagcttcactttgaattcaccatga

SEQ ID NO: 1386 - DNA, 342 bp, Glycine max
  Peptide Sequence Number=SeqID_93071
atggaaaaatcaccttggccacaacagcagatgcctagtctctatgaccgaaccacgaagctggaagaaactttagctcaattcatgcaagtgttaatgtctaatcagaagagcacagagtctgctatcaagaatctggaattggttgctcaaccgacatcaatatcaaggtcgcgtgctaagcacgagatcagtgcgctaagcgcaacagttgtcctcagcaggctcaacgcacgattggcgctaagctcaaatccacttacttgcgcaaaggcgtgggtggcgctaagcgcaacgtcacagattcggagtctatttaaagcctattttgtgcagaattag

SEQ ID NO: 1387 - DNA, 828 bp, Glycine max
  Peptide Sequence Number=SeqID_93072
atggaatttgtggtagacatttgcagatcatggcaacgggttgttgctcctgctactgaggatgaccctgtcattgctgtagacgtacatgaccctgttggtgaggatgaccctgttggtgatgcagatgagcctatggtagctgcaagcgctggtgcagacgtatatgcacctggtgcagacactagagcagaggctggtgcagatgagcctgagggatttccaggtggaccgagcgacccatcagtgcttaccgagtatgctgagcatgttgcagccagcgtatggaccaaagaggtatttataattttcaatttaagttatttgttaaaacatcctgagttgaagttatcctcccatgggaggaaggtgcagaaattaggtaggtctgtccctacaattgaagggctagttgttggcacaggactaagtcctttgatcgcgtgttcagtagacactggtgatcggagacttatatcctcgtttgtggagaggtggcacggggagactagcagtttccatcttcccgtgggggaggttaccatcaccctggacgacatggcacctcttcttcatctgcccatcattggcaacttccataccttccagcctctgcacgtcgacgaggcggtgttgatgttggtttacttactattggtctcagcagatgcaaccagggtcgagacaggacattgtcatggaccatacatgctttacgtgattgttcaaagtccgacaaatgcatcggatcgcgcaagtagtataaaatggagaattataagcaattgggcttggattcggaattgggctgaaccgacttggacttga

SEQ ID NO: 1388 - DNA, 250 bp, Glycine max
  Peptide Sequence Number=SeqID_93073
atggctactcagttgaaccaagctcagtcccaaaattctgacaaactatctttacaaactgtgcagaatcagaaaaatgtgagtgccatcaccttgaggtctggcaagaaaattgaagtgcctccaccagtagcagcacctgcacctgaacctgtcaagcttcattctacacctgaaaaagaggatgagctagctgcacaaaagagaaagcttcttgattatgagggagctaacaaaaaatttcatgcag

SEQ ID NO: 1389 - DNA, 166 bp, Glycine max
  Peptide Sequence Number=SeqID_93074
atgaaggttgaacaactctttgcttaccatcatacaagtgaggaaaggaaggttcctttggctacccttagcttccaagggtatgcactctattggtggacttcccttgttaggaaaagaatgattcttgggatccctccagtagagtattggaatgacttgaaaa

SEQ ID NO: 1390 - DNA, 390 bp, Glycine max
  Peptide Sequence Number=SeqID_93075
atggccatctgcccaaacttgaaaaagggtaatgctggaattatagaaaatttgtcggcaaaacgccagaacccgtccatgcgtatggttatgaagccattaaagctcattaatgaatcaacagaagcccaaacccatgtacttgctaaacagacttacatggagtttgacttaggtgttacttccaccaatggacctaaagttaatggtggtcaattagctggtggtggtcaaccaccaaccaccatgccaatgattgaaggcagccaatcatatgtggccccaacacctgatgacccacaacctgcaaaggagccttcaagtgtagattcccacaatgaagttgataggagacttgttatatttgtggaagaagttgacgacccataa

SEQ ID NO: 1391 - DNA, 69 bp, Glycine max
  Peptide Sequence Number=SeqID_93076
atgatgcagtcctctgttgctggtgaagattggaaggagaaaggtgataacaaaacgcaaacccaataa

SEQ ID NO: 1392 - DNA, 270 bp, Glycine max
  Peptide Sequence Number=SeqID_93077
atggaagcattgaaagaaacagagacttccgtgtgtattgttggaaatagaaaagattttgctgaaggtgcaaaaaacattgaatattttgacgagacgactttgcttttgagcacaatactgtggcgctggcctccttctaggtcacctgttgctagaaaacgtatagaggatggagaagtatttccacaaatgtttgtgcaggcgatgggaaaatcagacccccatgctgttcggatagaggtgtttaggcttgctcaatgtctatag

SEQ ID NO: 1393 - DNA, 162 bp, Glycine max
  Peptide Sequence Number=SeqID_93078
atggcttcgaatatttggagtaagagtattagaagaaaacacaaagagttgttggcacatttggatatatggggtccagagtatgaagctggaaaagtgaaaaacgggttcttacagagtgggtatgttcttgtgaaatcaagaatgcagagactcttgtga

SEQ ID NO: 1394 - DNA, 345 bp, Glycine max
  Peptide Sequence Number=SeqID_93079
atggttagtcttgtagcatgtatgaatgtagttatgtgggacatgctgttatggagtgaatcagcaggactggaggctatcaggttcagattattatgtgtgagcaaagtttcggggaaggctactgttattgctgcaatagttgtcaggtatacaaagaaatatgccgatgggggatatacaatctctggtcacatctatagagaggacaatatttgtgcagacaaactagcccgttttgcttcttctctaaatgatttttgctggttgaattctgctcctattttcattgcagcggaattgaatgggaatagaataggtttgcctaactatagattctcttga

SEQ ID NO: 1395 - DNA, 549 bp, Glycine max
  Peptide Sequence Number=SeqID_93080
atgctcaaaacacttgaaaggtaccaaaagtgcagctatggtgcagttgaagtcagcaaacctggcaaagagcttgagagcagctaccgtgagtacttgaagctgaaagcaagatttgaatctcttcaaaggacccaaaggaaccttcttggtgaagacttgggcccactaaataccaaagatcttgagcagcttgagcggcaactggattcatctctcaagcaagtgaggtccacaaagactcagttcatgctggaccagttagctgatcttcagaataaggagcatatgctggtagaagcaaacagatctttgaccatgaagctggaagaaatcaattcaagaaaccagtataggcaaacatgggaagctggtgagcaaagtatgtcatatggtacacaaaatgctcactcccaaggctttttccagcctttggagtgcaaccccacattgcagatagggtacaaccctgaagcctcagagcagcagctagctgccacaactcaagctcaacaagtcaatggatttattcctggatggatgctttga

SEQ ID NO: 1396 - DNA, 375 bp, Glycine max
  Peptide Sequence Number=SeqID_93081
atgtttgccaccactttcaacactccaccacttgcatataatctagcaccatcaagttcttgttatcgtccatcattacctattcaaatacgtgacatgggtcacgaagatgaggacaaggatgaggataacaacaataacaacgataaagatgatgacaacagtggtgatcatgttcctcaacagcaacgcacaattacacgtgagcatcctagaataagaggaggtagagaccatagaccaagaggacaacaaacacaaacaaatccagtccaacaagatgagagacaaatacaaacaaattcagtccaacaagatgagagaccgagatgcatatctaaaagaactccctgtgggacatcatctcatcattag

SEQ ID NO: 1397 - DNA, 1059 bp, Glycine max
  Peptide Sequence Number=SeqID_93082
atggcggctggattggtcactggaaagttcttcataacaacccaaaacataggggcgactttggcaatagaagcgcagcccaagatggtgtgccacgtgcctgcatgcgctagagaagtgcactgtttgactaagtctggcgcacaaaagaagctccagcggagaacaacagctgcttctggaaaaggggggaaatcacctgatagaggggcagcaagtagaaagcagccagaaaagtcactggagaaggagaaagggttgtctgaaagtgctggaataagtgcgacaaacagaaagcaaggcaaaatctctgaagctgaaaaggctattaaaacactctatggacaagaaagagttgctgcagttatgaatgacttaacaacagcaagtcaaggttcatcagaacctgaagcagggtggcttgatctgtttagtagtcgatattggaaagttgtcagtgttggggcagcacttttcttgttccagcagttggctggaataaatgctgtagtgtattattcaacttctgtgttccgtagtgctggaattgcttctgatgttgcagcaagtgccttggttggcgcatcaaatgtttttggaacttgtattgcttcctccttaatggacaaacaaggaaggaaaagtctccttatcacaagctttagtgggatggctgcttctatgttgcttctttctctgtcttttacatggaaggttcttgctccatactctggcacccttgctgttcttgggactgttctctatgtcctatccttctctcttggtgctggtcctgtgcctgcccttcttctaccggagatatttgcttctagaattagagcaaaagcagtttctttgtcattaggcacacattggatctccaacttcgtcatcggcctctacttcttgagtgttgtaaacaagtttggtatcagctccgtgtacttgggattctcggctgtctgtgttcttgctgttttgtacatagctggtaatgttgttgaaacaaagggtcgatcattggaggaaatagaacgtgctctcagtgcttcaacatga

SEQ ID NO: 1398 - DNA, 339 bp, Glycine max
  Peptide Sequence Number=SeqID_93083
atgtttggcttctccagtggatgcgattcactccatcaggataggggtagcttccacgtacatgcaaaaacaaaggttataagtaatactccaacaacacctacaatcaagggcagaattataggcaagctctccaacatacaagcccttctatctaaaagagctttttgcacacttccttcccagactaaagctaatcctaaggaggaagtgaatgttgtgagtactaagagtggaaggcctatggcaaagtttaaaaagaagaagaagaaaccactccaccaccagaaaaaaaaggctcttactgaagagagccaagaggtactgacacctccttaa

SEQ ID NO: 1399 - DNA, 1014 bp, Glycine max
  Peptide Sequence Number=SeqID_93084
atggagaccttggatcagatgcttgtgtcaagctggtacaatgttcattccttggtgcccccatcctatgtacaattaccggaaaacaggcctagcaaggtggttagttctttgcataaggcaatacccgtgattgattttggaggacatgatcgtgttgataccacaaaacagattttggaagcctccgaggaatatggctttttccaggtgatcaaccatggagtttccaaggatttaatggacgaaacactgaacatttttaaagaattccatgccatggctcccaaagagaaagtcaatgaatgctctaaggacccaaatggaagctgcaagctttatacaagtagtgagaattacaagaaagatgcgattcattattggaaggactcactaacacatccttgtcctccttctggggaatacatggagtattggcctcaaaaaccatccaaataccgggagattgttggaaaatacacaagagaattgaagaaactagcgcttaaaattttggagctgctttgtgaaggattagggcttaacctagggtatttctgtggtggactaagtgaaaatccatcagtgttggttcatcactaccctccttgccctgacccaagtttaacattgggcttagctaagcacagggaccctactattatcaccattttgcttcaagataaggaggtgcagggacttcaagtcctcaaggatggagaatggattggagttgagcccattcccaacgcttttgtggttaacatcggtctactcttgcagatcataactaatggaaggcttgttggcgctgagcaccgagctgtgacgaattcgagcagtgcacgcacaagtgttgcctatttcgtctatccatcatttggaagcatcatagaacccgcacaagctttgatcaatggaagcactccagcaatatacaaatccatgagatttggagagtttcgtagaaatttctttcacaaaggtcccaagattgaagaagaattgcagtaa

SEQ ID NO: 1400 - DNA, 339 bp, Glycine max
  Peptide Sequence Number=SeqID_93085
atgtcactagcgacagtgttgatgtcatcttggatgatgttgatgtggaatggaggtctttttagcactttaggcatgatgataaggtttctgctaagggcattggtgaaatgtgccattgagcttggcatagctgatgccattgaaagccacaaaagccctatgacactgtctgatcatcaactcttggaggacagagtaacgttcttgttagcaagccatgctactgcagccataaatgtggaagcaatgcttttcaagattattttgatgatgccaaagaatcaagagtcaagcaagtttcaagaatcaagatcaagattcaagattcaagaataa

SEQ ID NO: 1401 - DNA, 420 bp, Glycine max
  Peptide Sequence Number=SeqID_93086
atggtggatatttcagaagttgaggctgagcaaaagatgcttgaggaggccattaagaactctcgggagagagaaaggagatccttattgcgtgctatgaacaaagacaaatctaaaagttcaaatagcgccccaactgatactaaaggtaacaaagttggacaattatttccaaatgcgtcacttgaagactatgccaaactgaatagagttaatgtgggtcatgacgatggtgaaatatgtgatgatagtgagggtgaagtttgtgaagatgaagatgataacagtgacaatgaagattgtgatgaagatggaaacagtgacgatgaagacggtgacagtgagaatgaagattgtgatgagaatgacgacaaaaatgatgaaaacactcctgatcatactagtgccaaccatgaatga

SEQ ID NO: 1402 - DNA, 537 bp, Glycine max
  Peptide Sequence Number=SeqID_93087
atggtgggggttcatactccaaagaaagacaatgaaccattgctgcagtgcactcatcacatgtgtccaatcagggtccactggcatgtaaagactaactacaaggactattggcgagtcaaggttgctataacaaacttcaattacaggatgaatcactccctctggtctcttgctgttcagcatccaaatctcaacaatctcacccaagttttcagtttcaattacaagcctcttcttccctatggatccataaatgacactggcatgttctatggcatgaagtacttcaatgatcttctaatggaagctggaccaactgggaatgttcaatcagagttacttcttcagaaggacaaggatacattcacattcaagcagggttgggcatttcctcgcaaggtctactttaatggtgatgaatgcatgctgcccccacctgacgcctacccttttctccctaactctgcacctgcaagcctacttaacttccctgcattcattttcttgttgcttttcttgctatcagtttggtga

SEQ ID NO: 1403 - DNA, 849 bp, Glycine max
  Peptide Sequence Number=SeqID_93088
atgtcagggaagcaaaggtgggtccagtttgtggaatgttcaaatgatatcaatggcctgatagatgcgacaaagtttgtcgatctagaacttcttattgatggaagttatggttttgaaatggttgtggagaagatgtacgcgtccacatttgcaaaacaactttttcatattcaccttggttatggagttcatacagagccgcgtggagctgtggatgaaggaccaacgggcgtggctgctggggctgaaggagaaggtaaccctaacagagcaaccagaggaggagctctagagagcaccagagacgccaccattgctaatagagaatatttaagcgactacatcgaggtgaggcccaaacggattcttcggaatctaggccttgggggtaaagatactcggtttgagtactcctttaagcccatgttgatcccatgtggttggggcattctcgcaaaacagagtaaccctgactggtcaccttatgatggtgtcacctcagatgaagtggtcgtgggcttcgcaccgcgagcacaagaagcggatccaagaagagtaccagtgcctccggaacatctgtcgcgccctcaaggcggaatccgtctccgatttgcaggaccttctctgttatatggtgctctccaaggtgatgcatttcatattgcttatggagtgaaggaggaggatcatttcagtcttcaagccgtgggcactctcaatgagaagctcttgtgcggttgtaatgatgtccaattgtccatgcatgtgagcctggatctacatcacaagcttgctaagcgcagaaagcatagcaacaagcttctggaactgtttgaggctttttaa

SEQ ID NO: 1404 - DNA, 309 bp, Glycine max
  Peptide Sequence Number=SeqID_93089
atgcttagtatgatgcatgaacctgacctcaactctcaaatgcaatgtggtaccattcatcaaggaaatagcctaagcatgtccacacgacactctcacttaggaaaactaggtaggaagtgtcgaggtcaccctgtcgtgcacaggcaactccctccctcccatggtgataagcctgagtctcaagggaattccaaaccgagtaacataccaccaagtacaagaggggacctatcaccagagccatggctaacagactccaagaagattgggccagagatgcaggagaaggccctagggttctcatga

SEQ ID NO: 1405 - DNA, 332 bp, Glycine max
  Peptide Sequence Number=SeqID_93090
atggtgaatggtgaattggtacctaaagaatgggaagggatgaaagatgatgagaaaagaaaagtgcaagatgatcaaaaagctaaaaacattttaaattctagtttatcttctgatgaattctttcatattgcaaggaagattacaaagaaagttccaatagtgaagaagaggcaaagtgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgagatctacgaactttttagtgaaag

SEQ ID NO: 1406 - DNA, 363 bp, Glycine max
  Peptide Sequence Number=SeqID_93091
atggtaaataagtttggtaaatttctcaaaaagtccaaagacaaaaaattctctaaatctacaaagaagattgaaagcaacaacaacaccttcacatgctctgaatgtggtaagcaaggtcatatcaaatgtgaatgtcctatctaccttagaaaacaagtcagtgaaaagaaaggaaagaatgatagaaaacagaaaaaggcatacatagcttgggaagataatgcatctacatcctccaactcttctagtgatgaagaagttgcaaataagttttggaagcatttaatgaaatgcatgaagaagctcaaaggcttgtgttggacaagtggcctcaataacttaagaggggaggaggggtga

SEQ ID NO: 1407 - DNA, 270 bp, Glycine max
  Peptide Sequence Number=SeqID_93092
gcttcctctagaagcttcattaagaggcgtatagcacactccagatatcttctcaaagatcccaacggtcagctcatggacaattgtcttgtgaagttgaagaccaaatttcgagaagatccaacggttaacgaaggctgggaagcgtttttaccgaggcagctccatgtagctttctctagaagcttcattaagaggcttcctctaaaggcttcctccaaaagcttccccgtggcttctttgagaagctttctcaagaggcttctttga

SEQ ID NO: 1408 - DNA, 285 bp, Glycine max
  Peptide Sequence Number=SeqID_93093
atggttacttccatacttcaaaggaggaaagatgcgcggagtcactaccaacgtgcccttttgcggggagcgaggcgaggctcacaggtgcgcttttcaaaggaggaaagatgcgcggagtcgccaccaacgtttatttgtggaaaacgtcgggaaaaccgaaggaaaccggtcaaaatgaaaattctaagttcgggagttgtatttacgcttgaggaaggtcgacaaaagcggggctcttgctcctacgtaccctccatcaaagaggaaatcagacctacatag

SEQ ID NO: 1409 - DNA, 300 bp, Glycine max
  Peptide Sequence Number=SeqID_93094
atggagaaaaccaataataaagtactatggattgtcttgaaccggagaatcatgttgatggtagttaacatgttgatggagatcttagcaattattgttacgaacccctacacactgagtctccttagggatccccctattgatgttgtaatagataataatttgggaactatctcacttgaaaaggatggggcagtcaacaacaatgagtttgtttctcctattgttcaacaagacttgagaattgtgtctcgactttgggttaatgaggttgaagaggaggatataggcacttcttag

SEQ ID NO: 1410 - DNA, 198 bp, Glycine max
  Peptide Sequence Number=SeqID_93095
atggatgacgaggagctaccatcacccgtgaactccgatgttgtcaagcggagcagaatcgtgttaggcgatggtcaaataccaggccaaatccaaaggcagagaccaatcaaggtaaacggtaacgcggccacagtttgccgtgcaatgtcgtttcctgctttcaggtacttagggatggacccaagtagaggctag

SEQ ID NO: 1411 - DNA, 942 bp, Glycine max
  Peptide Sequence Number=SeqID_93096
atgcaggacttacgcgatgccgtggtgacggcgttgatcgaagagcagctggcgggggcagatctgagcgtgatggtggcggactccacgtccacgtcgaaaatcgcgccctttgagcaggcttatccggagcgtgtggtgaacgtcggcatcgccgaacaaaatatggtgggcatggccgccggcatggcgctcagcggccgcacggtctttaccgctaacgccgcgcctttcctgttcgcccgttctaacgagcagatgaaaaacgatgtttgctacacggaaaccaacgtgaaaatgctcggcctgaatgccggattcggctatgggccgctgggggcgacgcaccattgcatgaacgatatcgccatcgcccgcacgctgggcaatctcagcgtctatgcgccggcggatgcgcgacaagcggcagagattgtccgttatgtcatcgcgcaacccggcccggcctatatccgtatggacagcgacaagctgccggtgctgaacgcgagctatcacttccgccccggagagccggaggtgctgcatcaaggatctgacagcctggtgttttgcctggggacggtggcgcacgagtcgatgaaggtgctggaattgggcgataacccgaccatcgtctcgctgccttcgctctggccactcaatgaggcggcggtagtggcgttgatgcgttcgcaccgccgggtgctgaccatggaggagcacgccctcagcggtggcttgggcaccatcatcggtgagctgttgctgcggcatcagctgccgcggccgtttaccgcgctgggcgtgccggcttatgaatttacccacagcagcagccgggcggcgctgcggcggcaatacgccatcgacgccgcagggttgcatgctcagttaacgccatacggggaatgcgatggagcggaacgaatacgacgttaa

SEQ ID NO: 1412 - DNA, 369 bp, Glycine max
  Peptide Sequence Number=SeqID_93097
atgacgtggctacttagcaacattctgccagtgaccgcaatgccgatctccccctgcagaaggatcacgcccacaagacacccagtggacccggaggagcccaatagggccctggggtttcgaactctagttacgggcctctgtcagtcctacagggtgcctgtcaccccaacaaggtcatgccatcatgacatagggatcgcgctcgcaggacacccagtagacccgaagaagtccaacagggtcttggagttgccagctctgattacgggcctctatcagttctacggagtgcctatcgtccccagcaaggtcatcaggccccctactaatcaagctttcatcaagaagtattgcgcctccaggtag

SEQ ID NO: 1413 - DNA, 184 bp, Glycine max
  Peptide Sequence Number=SeqID_93098
tcctttcgctaagcgcaagcctcgcgctaagtgcatctttggtcatgcgctaagccgagagtctcaagcgcttagcacccaacccttgcatctgaggctgatttggtccgctaagctagccaaggatgagctaggccaacttcaattcgatctgaatttggctaagcttcatcctgatcgctaa

SEQ ID NO: 1414 - DNA, 734 bp, Glycine max
  Peptide Sequence Number=SeqID_93099
ctctgacaaagtttgtctctgctgataatggtacttatgatgtcatcaatgcatatctccaccgagcttctgcatctttcaacgagctcaaccacctccacaaggagcttggatcatgtgactctcataacaagcacaaaacgcatagaatagagaatggtaatgacagtgggaaggtagtgggaaattctattcaaagtgttgatattaacaaggagctgagccttcggcatgtgaattttgatcagttcaaaaggcaacaaagtgagagtaggaatgctgatggtgaaaattttagtcaacaagaagaagaagaaaatgtggatggggttgctgatggaaagcatgttagttcttggttggggcctgaccttgtcattggaggtttagtgattttgtcatctgagtttgtgaatgaaactaaaaaggcattaaatggagggttgggggcggagaaagggttaaattttgggaggataagtggatacatgatgaggtttcattggaagccattgttcgacaatgagataacaatggctgtcaatttcctaaaagatgttgaaaggtcagttattcagcaaaatggaagagacgcatgggtgtggatggcagatccaagtgggagctactcggtgcaatctgcatacaaggtaatgagggggcctatagttgatgggatcaaggacatggcttttgaggagctgtggcagctgaagattccaaccaaatatgca

SEQ ID NO: 1415 - DNA, 144 bp, Glycine max
  Peptide Sequence Number=SeqID_93100
atgaggggcatcgtgcatgagcctcaataccctggtcttcagaggactacacgtcctcaccatcagagggctgcacgcccttacctccagaggactacatgtcctcgccttgagagggctacacgccctcaccttgggtactag

SEQ ID NO: 1416 - DNA, 189 bp, Glycine max
  Peptide Sequence Number=SeqID_93101
atgaaggtcttaaagggttataccaagaatcaataccgactagaagcttccattgttgaaagagaaacaatctttgttgataatagtgcttccaaaacattaagattgtttgctgttgggccaaatctcaatgtcccttctttgaagggatatgatataaacaactattccttctacatgaagtcatag

SEQ ID NO: 1417 - DNA, 456 bp, Glycine max
  Peptide Sequence Number=SeqID_93102
atgaaggaaatgaaaagagaaaaacatgcctcctatagtagacataactcttgcaagagcctaagtgaagaacttcgtgaccattatgaaggaaggcataggtcacatcttagacctcactcctataggagagaaaatgaaagaaagcctcaagaggctagcattaacctcccatacttccatgggaaggacaatgtagagacttacttagattgggaaataagggttaagcaaaaagttaaaagaaagtctactttaaaatcttatggctctcattcttatccaaagaaagaccaaggtttaggcatcttaggggcaacaccttctaagcccaaagatgataaggggaagacaatagaaaagcaaccccctaaggctagtatgcaagaaaagactactttaactgtcttgaaagatgacaaattacttctcaatgccccaccaagaaaatcatga

SEQ ID NO: 1418 - DNA, 219 bp, Glycine max
  Peptide Sequence Number=SeqID_93103
atggctcaagcaccacaaccattggcacgcatagagccaccagcccaacaggtcgaaccaaaccctggtgtagtattggagcaattcgaccaaactgttggcacgatcaagttcgaccgcttcgacggttatgaatcagacaggggtaacttctcccatgaccaacatgacgttggcaagttcgaccacgtcagcgtctgcttttgccccatggaataa

SEQ ID NO: 1419 - DNA, 216 bp, Glycine max
  Peptide Sequence Number=SeqID_93104
atggcagggctcaaggactcaaaagtgagtgagtcagggaccactcctctagtgatgcatagggcagtgatcaaagctgggaagccgagccgagaggagttggattgggccatctgtgagatctatccagagatgatggagcccaagtccatgtctatcttcatcaccaacccgtataccaacctcgccctatcaatgttcatatcagaagtatga

SEQ ID NO: 1420 - DNA, 219 bp, Glycine max
  Peptide Sequence Number=SeqID_93105
atggagatgaacatgttggcctatctattttggccttttcgcacccccgccgaacggagtggagatcgatctgtgatcattgtcgcaacgtgcccttcgcgggcgagcgagggcgaggctcacgagtgcgctttccaaaagaggaaagatgcacggagtcgccacccacgtttatttgtgggaaatgtcggaaaaatcgaaggaaaccggtcaaaatga

SEQ ID NO: 1421 - DNA, 204 bp, Glycine max
  Peptide Sequence Number=SeqID_93106
atgactcactataatccttaccctcggaagcaaaaaaggaaagaaggaaaatttccaatcaaagagaaagcaaaaagaaaagaaaggaaattcccaatcaaagagtgggagaaagcaaaaagaaaagaaaggaaattcccaatcaaagagtgggagaaagaaaaaagcaaagcaagaaaattcccaacccaagaatgggagaaa

SEQ ID NO: 1422 - DNA, 366 bp, Glycine max
  Peptide Sequence Number=SeqID_93107
atgaccaccacaccccccgttttgttgaaaaatgggattacaggggcttccgggacacccagtgttttttggaggaagcaacccagctcgcctgggcgagctgggcggcaacctcctccccctttttcctataaaaaggctgaagggggctgttctaaggatccctcagccccttggctatgtatttcagctattttgggtgaaaaaaattgtttccgtgaagaaaatccaagccgaggtgcttccgtaacgcttccgagatgtttccgtaagcaaatccgtgaaggttttcgtccgttcttcaccgttcttcgttcttcaacggaacaaaatctaaccgatcgttcacactataacctcggttaa

SEQ ID NO: 1423 - DNA, 316 bp, Glycine max
  Peptide Sequence Number=SeqID_93108
ctccttctacatcaactccttctacctttcctctccctccaacaccagcaactctagttcttctggatccttcttctcagagcttcaagccattcttctcaatgctgtagagcctacatcagggccaactcctgatcatgcaaagcttgtagaatgtggtccaccagcggccggagtccagccttctcctttgggagggggtgaggcctatgcagcccaggagcctcaacaggaccaggagaacgacattccagagaccgcagagcctacacctcctaaggcattcactttagagtctgatccagttgttgtatag

SEQ ID NO: 1424 - DNA, 537 bp, Glycine max
  Peptide Sequence Number=SeqID_93109
atggtgcaggattcgcggctgctggcggccctcggcgcctgccgcactaagctcagcgcctttattcgcggccgcagcgagcggcacgatgaggccgaagatatcctgcaggagatcagctggaaactgctgcaggtggaacagccggtggagaacgtcagcgcctggctgtttcgcgccgcgcgcaacgagattaccgatcgatcgcggaaaaaacgcgaactctcgctatttaacgccgccggagacgaggattttcccgaggatgaaattgccgaaacgctgtttggcgtggcgcagacgccggaggatgagtatctgaagacgctactgtgggaagagctggacgatgcgctcgcggaactgcctgctgcgcagcgcgagatatttgaaaagaccgaactgctcggcttcagctatcaggatctggccgccgaaagcggcgacagcgtgcaagcgctgctgtcgcgcaaacataaagctgttctgtttttgcgcacccggctgcgcagcctgtacgacgaactcacggcctga

SEQ ID NO: 1425 - DNA, 235 bp, Glycine max
  Peptide Sequence Number=SeqID_93110
atggcaacccgtgggggcgaaagaaaagctgagaagaagatggaggaacataaacatcagttggctgatgaactggcgctggaaccagttgatgatttagttgaacatgaagaaattgttgaggaagtagaaggtgatgaagaaggagagataccaataaaagacagtcaagagagaataaagaaggaagaaaaagaaaaagaaaaagaaaaagaaacaaaaaaaggaagaaaaa

SEQ ID NO: 1426 - DNA, 375 bp, Glycine max
  Peptide Sequence Number=SeqID_93111
atggaaaggcgcagaatgatcataatttgtctctgcgtgccatcggacacgatcgcctctggatggcaaaaaggattgcctctggatggcgaaaaggtgtgcggaatgaccataatttgtctccgcatgacatcgggcccgccgcctctggatgacaaatggcgcagaatgaccataatttgtctctgtgtgccattggacacgattgtgtctgaatggcaaaaaggcccgccgtctctggatgacaaaaggcgcagaatgaccataatttgtctctgcgtgccatcagacacgattgtgtctgaatggcaaaaaggtgagcgcaatgaccataatttgtctacgcatgtcatcgggcctgccgcctctggatga

SEQ ID NO: 1427 - DNA, 540 bp, Glycine max
  Peptide Sequence Number=SeqID_93112
atggaggctagtctgtgcattccgggcaaaggctttattctaaacacggagggccaaccatggaagctcctcagaaaagatcttaccaccctagctcaaacatggagcatcttctcatactcaaacctagctcctacctcccgcacttcagatttgaacacagacagagctaggtcggtctatggcttaatcacaaggatggacatgaacattggcggtttgatctctggacaaatgaccatgatggctcagcctaactcttctcgcttaggcttcccagctttaatcacaaccttgtgtagatcgaggggagtgggatctgatgcccttacctcctatgaaaaccaaaggttggccattgacttagcttatatcataaggaactgttggaatgcgaatgaccaaacagttaattttccagaggcaaggaagaccaagctcagagcatatcatgttccctcttcctttgcactaatagctggcatccctgcatcttctacttcagccccacttccagctttagtagacttatctgcctag

SEQ ID NO: 1428 - DNA, 459 bp, Glycine max
  Peptide Sequence Number=SeqID_93113
atggccgagacaggccaatgtggtggaccatatgcgttccgtgacctcactcttgttgggtggtatgcatggggagctgctggcctcgtccatatgtatgatcagcttaatgatgccagtctcagcaccaaccgacagcttgctggttacatcaccttgttacagtactggatatacgagcacttttcgtcagttgcggagtgcaatgttgattcagactacgacgaggtgtcatcacgtgcgtgtcggtggattgcgatgaagaagactgtgaagaagatgtctgctggacgccatatgcggcgcaccgacctgtgtaggactttcatccgatttcgtgcttctcgggacagctccgctggggcatgttgccagatacagaccggagagggttatgcaccagttcagctacgtccagtgcattcctgcacaccctatccattcatgggtgtcatatga

SEQ ID NO: 1429 - DNA, 282 bp, Glycine max
  Peptide Sequence Number=SeqID_93114
atggttgccgcccagctcgcccaggcgagccaggttgcttcctccagaagcaacagccttctggaggaatcttctgcagggcccaagaactcagttgcttcttcagcggatattccctttttgctaaagccatcttcttctttgtcaaaccttccaactgggacctcatcattcggaaccaggctcgccttatcgctctcttccacgcccgcctttgctttcccctttgggtctttggatcgcaccgatggctcaggtgctacaaagatccacccactatga

SEQ ID NO: 1430 - DNA, 216 bp, Glycine max
  Peptide Sequence Number=SeqID_93115
atggaggacaaggaaaaatttccagtgatcatctctgcctcccttgctgctgagcaagaggagaagttgttgcgagatctcaagaagcacaagaaagtcattggatggactttagcaaacattcctggtattagcccatctacctatatgcataggatacttttagaggatggagctaagccactagtgggtgagtccagtccaagtggttcataa

SEQ ID NO: 1431 - DNA, 87 bp, Glycine max
  Peptide Sequence Number=SeqID_93116
atggagaggtatgaacgtcctaagctgaagctatcttcccatggaaggaagatggctaagttcgggaggcttgctccagagatttaa

SEQ ID NO: 1432 - DNA, 239 bp, Glycine max
  Peptide Sequence Number=SeqID_93117
attatggtcaaaatcagaggtttgagtcgagctttaagcaagattatatgaagagccttatggagggaacatttgcacgtaggcaacgagaagttgcacctgttgctgaggatgttcagcatgtggatcatgcagatgatgaggaacgtcctaagctgaacttatcctcccatggaaggaaggttgagaaatttggcaggcctgctccagagattgaaggcttagtggctggcacatga

SEQ ID NO: 1433 - DNA, 516 bp, Glycine max
  Peptide Sequence Number=SeqID_93118
atggaaaccatatctaaaagatttgaggaacttgatgtttgtggtgaagtaactctaaagagtaaactttgggaaattgcataccctgatcaaaaatctatgtgtgttcctccgtcaaaggtcaacactaaagatgcaccgaagaaatcgatgaacaaaaaccaaagatcaacaaacaactcttcagtgaagcgtagtgcatcatcttctgaccagccgaatccaagaaggatcatgtcgatgttggatcaatttcagccatttatacacgatttcattgacaacattgtggatgtcaaagctgacagtaactttttatatcagtcgattgccactttattaggtatgggtgaagattcttggtcattggtgtgcaaccatttgcttaaagaacttgccaaatggttagaggactatatcaagctcttcagtggcacagacagattcgaggaattaaggaggtccctacttgttgttggttatccaaggttactgtggataagtggatggatataa

SEQ ID NO: 1434 - DNA, 540 bp, Glycine max
  Peptide Sequence Number=SeqID_93119
atgtcagatccctatttcatcaaattgcaccttagcaaatctgctgcgaaggacgatttggaacaccttcaactaatgaaaaatgtctgcatcggatccatccctgaaatccacatggaatcgtgtgatcgaaataccagatggataccgtgtttgtttatggaacaaggagacaagggtgattccagagaattgccaacgctgtctttttccccggacattggtcgtagaacaatgtttgggtttggctatgatccgtcaagtgacaaatacaaggttgtagcaattgcattgactatgctttcacttgacgtatctgaaaagactgagatgaaagtttatggcgcgggtgacagtagttggagaaaccttaaaggttttcctgttctttggactctacctaaagttggtggagtgtatctgagtggaacccttaattggattgttattaagggaaaagaaaccattcattctgaaatcttaattaattctgttgacctggagaaggagacttgcactatggctaatatgtttcattga

SEQ ID NO: 1435 - DNA, 225 bp, Glycine max
  Peptide Sequence Number=SeqID_93120
atggctagtttatcgtattatcacgagggatcgggatctcccacaggcaatttagttcttctagacttggagattgaagctatgttaaaaaggaacaaggccgagaggagaggaaaattactgcaagacaggacagtagcttccattctagaggaagaagctcatttttttattctacatcatctgactcaccatcatcaagggaatccacgacatatttactag

SEQ ID NO: 1436 - DNA, 420 bp, Glycine max
  Peptide Sequence Number=SeqID_93121
atggcatcaagaaagagagtgaggactgaggacatcccttcatcatacaacccatttccttcgacagagttggctcacaacaggccaatcatatctatggagcagtttctggaaaaagtggcctggcctgaagctcagctccctctggaaagatcccatgaggttgttcctcccaggcctgtagcatctaggactgttgttcctcccgggcctgtaccagctaggactattattcctcctgggcctgtaccagctaggactgagccaacatcagctgagccacaacctcctttagtagatccacctgcttttctagaacttgagatattgtctcctccagcaccacctatgataatcatccccgatgacttagctgatgaagctgctgctcctcctgattcacaccatcttgcaacatag

SEQ ID NO: 1437 - DNA, 569 bp, Glycine max
  Peptide Sequence Number=SeqID_93122
ctttgtgtaaagctaaaggagtcacatcagattctagatccttggagagcctcagacctaccattaacttggcatacattaagaagaattgttggaatctggatgatccaacagtaacattcagagggactaggaagaccaggggcaagagatcagaggccccaactacttcagctgcaccagagacaaccgcaccttcttcatccactcctccagcaccttcttcttctactccatctactcagataccacttctagctccttcatcttttggaccctcagattttttgtttactccagagatgcttcattctatgctccagagcttacacagagggcaggtcattatcatgcagagtctccaaagcttaggcctgccatttattatgagcacaaatgagttccttgctcaggtggcttggccaggagtccagccttctctttctggagggggcgaggcttccgtagcccaagaacctgtgcctacagaggagcagatactagtagaggagcatgatcctactcctcctgagccctttgaatttgtttctgactcagtggtggcttag

SEQ ID NO: 1438 - DNA, 63 bp, Glycine max
  Peptide Sequence Number=SeqID_93123
atgtggtggaattacgatcctgtgatgatcttgaactttgtgttcggaggagcagatgactag

SEQ ID NO: 1439 - DNA, 276 bp, Glycine max
  Peptide Sequence Number=SeqID_93124
atggataagagcttgaaggaaggagaagatgagtggagggagagggagagaaggagcacgaaatttagtgctgcaaaagagaaggctgttgcttctggaggaagcaaccttgctcgcttgggcgagctgggtggcaagctcctcccctattttgctataaatagggggaggagtgaagggagaaggggttcagccttcttggcacttcttattctctcgaaattgctgaggaaaattatttccgtgaagaaaatccaagtcaaggcgcttccgtaa

SEQ ID NO: 1440 - DNA, 171 bp, Glycine max
  Peptide Sequence Number=SeqID_93125
atggtgggtatgcacatgttgtacctaaaactctcaagtaatctaagtgtagttgttgttgtgagtaggcatgttaaggtctttgcaagcattatcgagggatgcacttgggttaatcgctcaaaggtgaaactccatggagtcgagtttgtctttgaggtcaatgattga

SEQ ID NO: 1441 - DNA, 588 bp, Glycine max
  Peptide Sequence Number=SeqID_93126
atgacactaaagattgagacactcatgagagctaaagctcaaatccccatcactacacctccattcccaacttgtgataaatgtgggattgtgcatgggtcaggagaatgcactgttgatgacaagctaagtcaagggatgtataggtctcaatccatgcaaaatcaaaggcctagacaagaggatagacaacctacccttcaagagatcatgcttcaatatatgacccagaatgatcagagaatgaagctggcacctaggaaagttgaggttcctactaatagaaatctagtggcaagcaaagaaggggaggaagtgtttaaagtgtttgatccggcaattaactcctcttcctcccctacatgtaattttgtgcaagccaccaacaagatgaagactattgtggctaagccccacccaagtgtggggaaagatgaccttccaaggaagaaagtcattccaaaataccctagatggagtaagaaaaagggagataggatcaccattcaagctcttgattatggagtagatgattatattggaggatcagtgcaaaaagggaaaatcaccttgtttgagggtgattga

SEQ ID NO: 1442 - DNA, 453 bp, Glycine max
  Peptide Sequence Number=SeqID_93127
ggaatgatgagaatcatgaaactggccaaatacaggctaaaggcccaagtggagaagaacgaaggcccaagtggagaaggacaaagcccccgagtggagaaggatgaaggcccagaggcagagacactatcaagactattaattgttgctgaaggcccaagtaatccttgtggcgtctaccctgacttatcttccttcaccggaagtggcgtctactcagacttatcttccttcaccggaagtggcgtctaccctgacttatcttccttcaccggaagtggcgtcatccaaatcttcgtaacctgtatcaagcgatccgctcctactcagcacaaggttcctttaagcacttcacctagccatctgctcccccgaacacaaggttcaagatcatcacaggatccaaacacaaacaacaaaccgggagtgagttatcacattcctaactactag

SEQ ID NO: 1443 - DNA, 645 bp, Glycine max
  Peptide Sequence Number=SeqID_93128
atgagaaaaagagagggagttctttgctttttctttcttctcctcctccattgttggaagctcatgtccttggaggtgtacattggtcccttttctcatgcgtatcaccattttcttctcctcttaaagctagagtgcttatcttctctttcattctcgatcttcatgttaggaggaactcaaggatctcttgctacccacactcaatcctttgcttcctcgagtcgacgaagagatttagaggccaagtgtagggcattttcgaaatctgaccaaatgagagtggaattgaaggattttgattccaaaattgaattccttacatccaaaaaccttaagaaacatatatggaactacatgaggatcatcatgcattatgaggaaaggacggaagacaaggttatgtgtgggacacgatgtccgtgtttgtggttccaaaagggatggagtacttactccttacaccaatattttcaggttcggatgatgagcatcagaatagatctttgctcgtgggttagcatctttgagtgtagaaggatccccccaagagtttttcatcggattcttattggtgggttcactttcatctggcatgcacaattattccatagggcttggatagatgattgctctgagacttag

SEQ ID NO: 1444 - DNA, 156 bp, Glycine max
  Peptide Sequence Number=SeqID_93129
atgactagacatgacttctatgacaaaactacaataggtttctgtcgcaacctaccctacgatggtcgtgcgggcgaaaagaaagcaaaagaaaataaaagaaggcatcttctaaaaaaagaaaacgagtgggagttgccaccaacgtttatttaa

SEQ ID NO: 1445 - DNA, 276 bp, Glycine max
  Peptide Sequence Number=SeqID_93130
atgccttacttggagtcattgaagaaatctaagatcttgattatattcaatttagggtgcctgttttcaaatgacagacctttcattatggtaagaacaagccagacaggaagaccaattggtattagtggccataatgatgaatcaacacttgacatttgtgagatgcctgtgtggacaaaggatcaagctaaatgttttgatgatgccaaagtttcacatgcgtctcaaagctttattcaagacaaagaaattaaagatattcaagatggatga

SEQ ID NO: 1446 - DNA, 122 bp, Glycine max
  Peptide Sequence Number=SeqID_93131
atgtgggacacattagctttgatgtatgaaggattgtcacaggtaaaatgcaataagcttagcttgttgacacgtaagtatgaactcttcactatggatgatggtgaagatatacaagccat

SEQ ID NO: 1447 - DNA, 453 bp, Glycine max
  Peptide Sequence Number=SeqID_93132
atgagtgaagtagaggagatacaagagaagatgaaggccgacatggaggccatgaaagagcaaatggccacaatgatgaaggccatgatgagcatgaagaagataatggaagccaatgcggttgcaattgccgctaccagcgttgttgctaaggcgaacctgatgtccccatccggcatcaaccaaatgaatcatccaacctcagatatggcacatatctctcaaaccatgggggagacacatgaaattccccaccacaatctagctgacttcgagccttggctcggatatgccactgaagggcaagcagttggtggaatgggaaagttggatcatctagaggaaaggctcagggccattgaaggaggtgaagattatgcctttgctaacctagaagagttgttcctaatacccaaacatggtcattcccaagttcaaggtgctggactttga

SEQ ID NO: 1448 - DNA, 417 bp, Glycine max
  Peptide Sequence Number=SeqID_93133
atgaccatgattacgccaagctcgaaattaaccctctctaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 1449 - DNA, 285 bp, Glycine max
  Peptide Sequence Number=SeqID_93134
atgccaagtctctatgaccgaaccacaaagctggaagagactctagctcaattcatgcaagtgtcaatgtctaaccaaaagagcatcgagtctgcaattgagaatctggaagtccaggtgggccagcttgcaaagcagttagctgaaagaccatccaacagctttacagaaaacacagagaaaaatcctaaggaagagtgcaaagttgtgatgactagaagcagaatggcgattcaagagaaggaaagtaaagctaatcagaaggtggagggatttaaacaatag

SEQ ID NO: 1450 - DNA, 509 bp, Glycine max
  Peptide Sequence Number=SeqID_93135
ttcctgggccaccccctgatattggagggcgaccaactgtgcaagcacaaccagagagggaggctatcacgcagctactatgcataccggggcaagatttcactcgtgccgctgcaaagagacgagtgcgggtcatgcgcaccaacatgaccactcttgcacagatatgtatgacgttgctacttagcaacattccacccggcgaccataatgtcgatctccccttgcggaaggatcgtgcccgcagacaccctgtggatccggagaagtccaacagggtcctagggtttccagctatggttacgggcctctggatcgcgcctgcaagacacccagtggacccggagaagtccaaccgggtcctagggtttccagctctgattacgggcctatgtcaattctacggagtgcccgtcgcccccagcaagttcatcaggccccctattaattgggctttcatcaagaagtactgcgcccccaggcaggcgcagggcgagacaccacaatag

SEQ ID NO: 1451 - DNA, 486 bp, Glycine max
  Peptide Sequence Number=SeqID_93136
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatcccctcctccctggcttggtagcccccagatgtaggaagtggtgcgcctccatgaactaccaagaagcatcgctttggaccgagacattaagttccttagtcactttcgaagaacattatggggatgcacatgctaaagttgaatatgtgaaaaaattgcataagcaagtgaaggctcaaattgcaaagaagactgaaagctatgacaagcaagccaaaaagaacaagaagaaagtggtacttgaaccgg

SEQ ID NO: 1452 - DNA, 293 bp, Glycine max
  Peptide Sequence Number=SeqID_93137
atggcttctacaagtggagatgctactccaccatctccaaaaaccgcaaggctcatggcgcagatgattaaacttggtaatcaaatgagaagaatgagttatgacaatgaagaaaggatagagagaatgagaaagaagaatgaagagagtttgggaagaatacacaggagtagtgaagctttaagtgtgaggattgaaaatataaagcgaagaagagaggtaagatcatctaattcttctcatggagaagatgagggatataaaaaggatgaaggaggatggaggaatgagag

SEQ ID NO: 1453 - DNA, 1008 bp, Glycine max
  Peptide Sequence Number=SeqID_93138
atggcaccaaagattgcctgggcgctggagaacaaaccgcgcattccggtggtatggatccacggtctggaatgcacctgctgtaccgaatcttttatccgctccgctcacccactggcgaaggacgtcatcctttccctgatttccctcgattacgacgatactttgatggctgccgccggaacccaggcggaagaagtctttgaagacatcatcacgcaatacaatggcaaatatatcctcgcagtagaaggtaatccgccgctgggcgagcaggggatgttctgtatcagcagcggtcgaccgtttattgagaaactcaaacgtgccgctgccggagccagcgcgattatcgcctggggaacctgcgcgtcctggggctgcgtgcaggccgcgcgacccaatccgacgcaggcaacgcctatcgacaaagtcatcaccgacaaacccattatcaaagtacctggctgcccgccgatcccggatgtgatgagcgccatcattacttacatggtgacctttgatcgcttgccagatgtcgacagaatgggccgtccgctgatgttctatggtcagcgaatccacgataaatgctatcgccgcgcccacttcgacgccggagagttcgtccagagttgggatgatgacgctgcccgcaaaggttactgcctgtacaaaatgggctgcaaagggcctaccacctataacgcctgttcctccacacgctggaatgatggcgtttctttcccaatccagtctggtcacggctgcctgggctgtgcggaaaatggtttctgggatcgcggttcgttctacagccgcgtggtcgatattccgcaaatgggtactcattccaccgccgataccgtcggtttaaccgcgcttggcgtggtggcagcggctgttggtgtgcacgcagtcgccagcgccgttgaccagcgcagacgtcataaccagcaacctacagaaaccgaacatcagccaggcaatgaggataaacaggcatga

SEQ ID NO: 1454 - DNA, 210 bp, Glycine max
  Peptide Sequence Number=SeqID_93139
atgtctttgcgtggtcatattgtcgcaacctacccttcggcaggagggcgacgcgtgactcgcgggatgcgtgttccacgaaaggaatatgcgcgaagtcgccaccaacgtttatttgaggaaaacgtcggaaaaaccggaaaagacgcgatctacgaacttttaagtgaaaggttcgggagttgtatttacgcacggggaaggtgttag

SEQ ID NO: 1455 - DNA, 664 bp, Glycine max
  Peptide Sequence Number=SeqID_93140
ttgttgggccacctcctgatattggagagcgtccaactatgcgagcacaactagaaagggaggctatcacgcagctactatgcataccggggcaagatttcacccgtgcggctgcaaagagacgagggcggatcatgctcatcaacatgaccactcttacacaaatatggatgacaatgctacttagcaacattctgcccaacgaccacaatgcggatctccccctacggaagtatcagttggatcgcgcccacaagccacccagtggactcggagaagtccaacagggccctaaggtttccagctttggttacgggcctctgtcagtcctacaggggatcacgcctacaagacacccactggacccggagatgtccaacagggtcctagggtttccagctctgattacgggcatttgtcaattctacggagcgctcattgcccccaacaaggtcatcagggcccctactaaccgagctttcatcaataagtactgcgcccccaggcaggcgcagggtgaaacaccacagcagcctggggacggccggcagcgggcaatagacacaccgccgccacctccagagctcctcaactcatctacaaaggctggagcgttgcctacgacccgtggtcgaccagcaggcgaccaagtccaaagccaaag

SEQ ID NO: 1456 - DNA, 273 bp, Glycine max
  Peptide Sequence Number=SeqID_93141
atgcaacgtttgttgaaacgtaacaatgaagagctctacaggagaatagaaggactagagcaccaaatgaatccaaatcctgggagaccttatggtggcaacagaagggtcaatgatggatcgaaccgaatagaggggcaagacagaattgagggagtaaaactcaatgtatcctcttttaaaggtaggagtgacccagacgcctaccttacctggaagatgaagatcagcatgcattctcctacaatgattatccggaagagcagaaggtga

SEQ ID NO: 1457 - DNA, 684 bp, Glycine max
  Peptide Sequence Number=SeqID_93142
atggcattcttaggagaaacatcctctaagacgatcgtcaactcaaggttggccttcatttttccaaatggatccgttattcacaacgagtgtggggtttattttcagagttcaagttcagtgcccatgcgagtactaaacatgtgcgatttttcaactcttaaaagcagaatacacaacaaccttcagctaaacgacaatcaagttgtggatgtgaacacaataacaccagatggaattataaacttacttgaactcactatgatccctactcatgatgtggttctgtattacaacggaaggtggaacatgccatgccaaaacaactttgtaggttacacgttcacaggaaaaaatccccaaaaatttgatattccaaaaggatgtaccataaatgaactgaagtatttgatcaagcaagtagaacctaaagggaatcctcctcatgggattcatgaatcccaacttgtaaggcgtttgttttttcgacaacctgctcatttggagtattctaacaacgttttaaaatttgaaattattgagctaaaatctgacgacgacgtgttgaaggtgttggtagagtccaattactggaaacaatttgtgccaatagaaattttggctctctttagtaaaccggttatggaaaatgaggacgaggtcgttacgccgttgcaggattga

SEQ ID NO: 1458 - DNA, 654 bp, Glycine max
  Peptide Sequence Number=SeqID_93143
atgatagtgaaagggtcacctgctactgatgagggattccctagtgagccacgcgacccatcagttttgactggctttgctaagcacgtggcacatagcatttggagtggagatgaacgacacgagctgaagttggtctcccatggtagaaaagtagataaatttgggagaccagcgcttgagatagaaggcatgattgcggcaaccggattgagtccactgatcatgtgttcgataatcaccactgatcttggacttatatccgccttcgttgagaggtggcatagggagaccagcaccttccacctgccagtaggagagttgacgatcactctggatgacgtggcgtcactcctacatattcccatcactggcgcactgcaaagcttcgagccactggttacttccgacgcagtcgtgctgttgacagagctgcttgaggtcatccctgaggaggctagagctgagacccatcaggcatctgggcctcatgttcggttgtcctggctttgggaggtgtaccagagcaggtgtcgggccagacggtgggttgtagcactcttttcgctaacaagagtgcaacacatgttcacgtcatgcacctggaggcttttagggacctggcctagccagggggattctcttggggagtag

SEQ ID NO: 1459 - DNA, 510 bp, Glycine max
  Peptide Sequence Number=SeqID_93144
atggttagaacaagaaggttaggtcgtgcctcaggaactgtacataggcaactggttcattttcctcatgtgactgaggatgttactcagacacctgaggatgtgcctcagttgaatgaggatgttcctcatgtgtctaacgctactccagagatgacaggcaccgtcgatgctgcagatgcagagggagtggctactgatggtagtgaagggtcacctgctactgatgagggattccctagtgggccacgcgacccatcagttttgactggctttgctaagcacgtggcacatagcatttggagtggagatgaacgacacgagctgaagttggtctcccatggtagaaaagtagataaatttgggagaccagcgcttgagatagaaggcatgattgcggcaaccggattgagtccactgatcatgtgttcgataatcaccactgatcttggacttatatccgccttcgttgagaggtggcatagggagaccagcaccttccacctgcca

SEQ ID NO: 1460 - DNA, 461 bp, Glycine max
  Peptide Sequence Number=SeqID_93145
atggcttctccacctgcctcccctcctcctcctctttctgctcctttggacgcatcggcttcaccgtctgccataaagcggacacgcaaagcctcacgtctacgatcgttgtctactagaccacctagtgctgagagaccagtgatccatgaagaaattaagaacatatctgggattatggcacgtgataaagtggacgtcacctacgagaactggaacgaggtccctactgctcagaaggacctgatttgggaggatattcaggtagaatttgaaatcccagaggcttctgacagtaggacgaaaatgaagttacttcagaccgtgggggagagatggaggcagtttaaatcagacctcacgaggaaatgggcccttgcagccgatcaggacggtgtggaggacactgtctatgagaaatacggcattagcaaggaaaaatgggcccagttttgccagac

SEQ ID NO: 1461 - DNA, 267 bp, Glycine max
  Peptide Sequence Number=SeqID_93146
atgagctgtacaggttcgctaagcgcactgctttatctctctaagtgcaccgcttcagttcatccgctaagcgagaaaggcactaagccaaaaatcattaacagaccagagcttgaagcaggagccggtttgagagcttcagatgagtttgtgagtgattgtgagatcctagaggtgaaggagacatccttaccacttgtatttttgcaatctttcatcttgttcttctctttgttgttaagaaggcttcctggtatggaaagctaa

SEQ ID NO: 1462 - DNA, 585 bp, Glycine max
  Peptide Sequence Number=SeqID_93147
atggcaggagctggtgacaatggtggtgtatatcatcaactggacggatctcaacgcttattactggatgcgatgactacacaaatgcaacgtttgttgaaccgtaacaaagaagagctttgcaggcaaatagtcaaatcttccttgtttactcttaaacctctatcccctagagaagtgtgtgatgaccaaatcagaatgagagaaaagagagaacaagagaaagaaaatagtgaggcaacacagaggaataggaaaaagaagagtgatgcacccgagggaaagagagattcctcatggactgccaccttcaatcctggagcttcattgcttaacaggctaacttacaaaagcaatccccaagagactcaacgtaaggatgcacatgccaaagttgagtatgtgaaaagattgtatgaccaagtgaaggtgcaaattgcaacgaagaatgaaagctatgccaagcaagccaacaagaaaaggaaggaagtggtacttgaacccggtgatgatcctggacatttgagggcaaatgttttccaagaaggagggaatgatgagaatcctgaaattggccaaatatag

SEQ ID NO: 1463 - DNA, 381 bp, Glycine max
  Peptide Sequence Number=SeqID_93148
atgaacacctcaatttctcttaagaagaatttcaagaaattcttccattccacaatagattcaccccgtaatctatgggtcttctcaaagactctacctttcattggtggtttggttgcaagctacacatttgttgaaatatcggtggtgtttatattgatggattacctcacagattcaaggggcaacgatcagcggatagctgctgttgttacgaatctgcaagatgttctatcatctatcctttttatttttgtatcttcaatatccaaagaatatacgggttgtttcactatgatcacattttgcgctgcagcttccatcgagctatgtacctcacaatcagaacttgacaatactactaaaaacgctcactgttga

SEQ ID NO: 1464 - DNA, 189 bp, Glycine max
  Peptide Sequence Number=SeqID_93149
atgggtttaagacaattttgccccaaatttgggggagttggtttgatggataattttaaagaaaaatgggcaagattggtgaagtacagaatttatgaactcactgagccacaccacgcactaggcgagccatccactaagcgcactatccttcggctaagcgcacagaagaatctagaagaaggatga

SEQ ID NO: 1465 - DNA, 321 bp, Glycine max
  Peptide Sequence Number=SeqID_93150
atggaagaatgtccttccacagtattcactttcaactgtgaaagaagttcttctgcaggaatgcacggaagaaggttcctctgcagttgtaaaattaactacaaaagaaccttcttccatgcattcctgcgaaagaacttcttccgcgagagtgcatggaagaaggttcttccgcagttgttaatttcaactgcagaagaaggttcttccgcgtatgacaatacggtgtctgaagaagttgatatggattttgaagatgaacaacattgtggtgtgaatgaaggacatgttgattgttcagatgcttttaatacttctcag

SEQ ID NO: 1466 - DNA, 351 bp, Glycine max
  Peptide Sequence Number=SeqID_93151
atggctccattgccgtcactccaaaatggtcaagttggacccttgggtactagtacctatcaccttcagaggactgtacgtcctcaccttaagagggctacacgtcctcgccttcagagggctacacgccctcaccgtcagaggactacacgtcctcgccttcagaggacttcacgtcctcaccttcagagggctacacgccttcaccttcataggactagacgtcctcaaattcagaggactgcagtcctcacctttaaaggactatatgccctcgccttcagagggctacacgccctcgccttaagagggctgcacgccctcgccttcagaggactacacgtcctcgcc

SEQ ID NO: 1467 - DNA, 848 bp, Glycine max
  Peptide Sequence Number=SeqID_93152
ggggagcggttaatgccgttgagtctgataggccgcacaggtctaaacctttaagggatgtggcaacccctaggaggtttatctttgaggccctacaaaagggaggtgtgattccccatagtgggcgtaaggaggattcctgtttgctgcattccggcgagctgcatgacatggaaacgtgtttgggagtagaggaattgttacagcggatgatagatcaaggtcgactggaagttggcagtgaaggaagagaggagcagcacatatgcatgcagtccacggatgggagcactgttgcgaagcccaaacccttggtgatatacttcaccaagggcacagcttcgcaaaagcccggacaccccttggcagctaaacctgtccctttcccgtaccaaaatagacttgcgctcccggttaagggaccagtagtttccttttatcagttcctgggccaccccccgatcctggaagagggccaactgtgcgagcacaatcagaggaggaggctatcgcgcaactactatgcataccggggcaagatttcacctagtcgctgcaaggagacgagtgtggatcatgcacaccaccacaactctgatctccccctgtcgaagatcacacccgcaagacacccagtggacccggagaagtccaatagggtcctgggatttccagctctgattagaggcctttgcgcagggcgacacaccacagtagcctggggatggccggcagcggacaatagacgcactgccgccacctctagagcccctcagctcatctacaaaggctggagcgttgcctacgacccgtggtcgaccagcaggcgaccaagtccaaagccaaag

SEQ ID NO: 1468 - DNA, 185 bp, Glycine max
  Peptide Sequence Number=SeqID_93153
gctgttgcttctagaggaagcaaccctgctcgcctgggcgagctaggcggcaaccatcttccctattttgctataaataggggaggaagtgagaagggaaagggttcagcccctgagaatttcgcaaaggtttcgaccgtcttcgacgtcttcattcgttcttcatctttcttcgatcttcaaca

SEQ ID NO: 1469 - DNA, 284 bp, Glycine max
  Peptide Sequence Number=SeqID_93154
atggggttgaatcaatttagatttttcaacatggttcatgacatcttggtcaaggtgaaactggaagtaaccaagacatcaacagtcctaaatgtgtttggcagtagacaaagcagtgatgtaaatcgatccatcttttgccctaatttttgcaagatggttacttccatatttcaacttgacttgatgaaccttttcgtaaaagctggagcttggttcaaccctataatccaaggaatgaggaaaatgcaaggatcatgcatgagcaaacatgaaaacaaaag

SEQ ID NO: 1470 - DNA, 184 bp, Glycine max
  Peptide Sequence Number=SeqID_93155
aggtttctgggcaatttcttgcttaaggtggaagcaacctagctcgcctgggcgagctaggtggcaaccacctcccccgctgaaggcggctgttctaacagtccgggatccccctggtgagcaaatccgtgaaggttttcctccgttattcaccgttcttcatccgttcttcgttcttcaacag

SEQ ID NO: 1471 - DNA, 249 bp, Glycine max
  Peptide Sequence Number=SeqID_93156
atgggatttcgggacacccgtaatgcttccgtaaaattccccataaccctaaataactggattgcttctggaggaagcaacccagctcgcctgggcgagcttggcggcaacctcctccccctttttcctataaataggctgaaaggggctgttctaaggatcccggatgcccctggtgaggtatttcagctgttttgggtgaaaaaaattgtttccgtgaagaaaatccaagtcgagatgcttccgtaa

SEQ ID NO: 1472 - DNA, 291 bp, Glycine max
  Peptide Sequence Number=SeqID_93157
atgggttctccacttgcctccactactcctcctcctcctcctccttctccttctcctcctcgtccttctcttacttcggacgcatcggcttcgatgtctgccgtgaagcggaaacgcaaagcctcacgtctacgatcgttgtccactagaccacctggtgttgagagaccagtggtgcatgttgatcctgctaccgggaaggccgacggttcccacaggaagaaattaagaacatatttggggattgtggcacgtgataaggtggacatcacctacgagaactggaaggag

SEQ ID NO: 1473 - DNA, 174 bp, Glycine max
  Peptide Sequence Number=SeqID_93158
atgacatacgagacctgcaaagaagtccctgctactcagaagaatttgatatgggaggatattcaggtggaatttgaaatccctgaagcttctgacagtaggacaaagaagaaagttcttcagactgtcggtgagtggtggaggcagtttaaatccgatttgaccaggaaatag

SEQ ID NO: 1474 - DNA, 195 bp, Glycine max
  Peptide Sequence Number=SeqID_93159
atggattcccctggcacctctcttccacagcttggcacgtttaaagaaggtgcctacactataatgagggacaaaagagagatgctttctatcagtcaaaagcagataccgcccccccctcatgctcccacggtccgcttaccgaggaatagaaagggaggaccgggggccagagcaagttgggttggggtatag

SEQ ID NO: 1475 - DNA, 168 bp, Glycine max
  Peptide Sequence Number=SeqID_93160
aggatcccccgcacacttcagcagcctgtggagtggatactacctacgcctactccatatcgactagttgagtctgttcaattgatagaggtgtcatcctctgaagaagatcttgaagaggacccagaggagttatctcctgaacctgctatggatgccagcatctga

SEQ ID NO: 1476 - DNA, 234 bp, Glycine max
  Peptide Sequence Number=SeqID_93161
atggcagcggaatggagaaagggagagagagagaggagacgccacttcaaggagaagatgagtctagaagaagctcaccaccataggaggccatggataagagcttggaggaagaaggagatgaatgaagggagagggagagaagagcacgaaattttgtgctcaaaaagagctctgaaatctgaacccactaatccaagatcaattacaagattctccactaagtgtgcttag

SEQ ID NO: 1477 - DNA, 792 bp, Glycine max
  Peptide Sequence Number=SeqID_93162
atgcaatacagtgacgcactgcgtcagcgttcctcttcacttcaaggtacacacagaatgggcagaatcgcattattgtttgcgatgattcttatgccgctcctgagctgggcaatgacgcctgagccaatgcagccgctggctccggtgagcaaagagttaaagaaacaattactgggtacaccggtatttattcagatcttcaaggaagagcgtacgctggaactgtacggcaaaatcggtaatgaatatcgtctgctggacagctatcgcatctgtaacttctccggcggcctcgggccgaaacgtcgtcagggcgattttaaaagtccggaaggcttttataacgtgaagatgaatcagcttaagccggacagccgtttttatcgcgccatcaataccggattcccgaatcagtacgatcgcgccaaaggctataacggtaactacctgatgattcacggcgattgcgtgtccgtgggctgctatgccatgaccaacgcgtcgatggatgagatcttcacttacgtgaacgccgcgctgcgtaacggccagcaggatgtgcaggtcaacatcttcccgttccgcatgaccgacagcaacatgcagcgtcatcgttactcgacttacatcagcttctggcgtgaactgcagccgggctatgcttacttcgccaaataccacgtgccgccaacggtcaacgtgacggcaaccggtcagtatgcggtgaacaacacgccggtcatgaccacgccggaagcggcgtcgaaatcattcctggcgctcacccag

SEQ ID NO: 1478 - DNA, 601 bp, Glycine max
  Peptide Sequence Number=SeqID_93163
gaaggataaagcggctgaaggaaccagttccgctcccaaatatgacagccaccgttttaggagtgctgagcaccagcagcgctacgaggccattaagggatggtcattcctccgggagcgacgcgtccagctcagggataacgagtataccgacttccaagaggagatagttcgccggcggtgggcatcactggttacccccatggccaagttcgacccagacatagtcctcgaattttatgccaatgcttggcctacggaggagggcgtgcgagatatgtggtcctgggtgaggggtcagtggatcccgtttgatgcagacgctatcagccagttcctgggataccctttagtgctggaagagggccaggagtgcgagtatggccagaggaggagctggtccgatgggttcgatgaggaggccattgcccatttgctatgtataccggggcaggattttgcccggactgctgccgggaggcgggtgcggatcatgcgcaccaacatgaccaccctgactcagatctggatgactttgctgctcagcaacatccagcccagcgatcataattccgacctccccctgccgaagtgtcagctg

SEQ ID NO: 1479 - DNA, 116 bp, Glycine max
  Peptide Sequence Number=SeqID_93164
attcaatgctggttgggtattgtgatgctgattgggctggacagttcaccgatacaaataattctggtggatgcttctatcctgagaaactggttcccagaagacaacagaactga

SEQ ID NO: 1480 - DNA, 402 bp, Glycine max
  Peptide Sequence Number=SeqID_93165
atgggtaaagtagaggaggtgcaagagcagatgaaggccgacatggaggccatgaaagagcaaatggccacaatgatggaggccatgatgagcatgaagaagataatggaagccaatgcggttgcagttgtcgctaccagcgctgttgctaagatatggtgggcaaagatttgggaagtcggacggccccatgatgtgcaaattcaaaacaagcatgccttcctgccatatggcttgcctcccaaggaggatgtcaataactctgctcccatactcattgaaagccaacaacctcaatctgatcatgcacatgtctctcaacccatgggggagacacatgaaatgccccaccacaatctagccgacttcgagccttgcctcggatatgccactgaagggtaa

SEQ ID NO: 1481 - DNA, 417 bp, Glycine max
  Peptide Sequence Number=SeqID_93166
atggatagagctaggttggcctatggcttggtgactaacatggacatgaacatcggagctcttatctcaggtcagatttcttctattgctcagagtaactcctcttggctcggattttcagccttgatcactgccttatatagagctagaggagttacctttgacagtctgacttatgagagcctgagcccggccattaacttggcctacattaagaaaaactattggaatgtggatgatctaacagttaatttcagaggggcaaggaaggcaagggttcgatcagctgatgttccttcttcttctactccactagctccttccacttctactactcctctaccagctcctttaggcctatctgcttatgattctcggcgctttgaatccatgcttcagagtcttcatcaaggatag

SEQ ID NO: 1482 - DNA, 690 bp, Glycine max
  Peptide Sequence Number=SeqID_93167
atgaatacatcatcatcgaatgtgtctgatgctggcccatcaaatttacgagtaccgagaattgtgcaccaatttgacgcgtcattccatcttgagcagaacgtcattgaggttccttttgcttatcatagacaatggtccgaaaattatccaagttatgtgttattcgactacgaaggagacaaacactttataaagcttcataaatatggtaaccgattcttttttggtgatggactgaaggaacttaggagaacccatggcattcatgaaagtgttctgatgcgttttgttggaagggacaaaaatactactttcagtgtggacgttgtgggacctctacaccaaagggcagccacaaccataaggcaccatgtttttaccattgatgtctctaaagatatgatacaacacaattatcaattggttctgccactagaggcttcaatttatttaactacatcaaaaaaatatatgattgtagatcgtggtagtggtaggcatcacaaatggatgatcaccacgaataatggcctatcatgtgttgttgacgcgtggatccattatttaggtgactgtcatttgaagcctggagatgaggtcatcttcttctacaacattgaccaacatgtatgggaggtcctctataggaagcaagttaaatgggatgacgaagaggatgaagcttaa

SEQ ID NO: 1483 - DNA, 853 bp, Glycine max
  Peptide Sequence Number=SeqID_93168
atgaggcatgcttgcccgctagaaggtcatcgttcatgcacagaaaaaggaggcgcaaattgggaccaactcttagcaaacaaagaaggagcgtctgtcaactgttataatcccgttcttgctataaggcaacttggctaccctatgagaggggcatcactagaggaagagctcgcgcctgtcatttcacgaggtttcaataagaccaacctggaggcacttcagaaggtccgcaaggcatgggaggtggtgcaaaagaaggacaaagaactcaaaggcagtaacaatgggacactcggtggctaccgtaaaactgctaaaagggaggaagttgaggcaacggaggaagacgaagaggtgcaggcccttagggcagaactcgagcaagcccaaacagtcaaagaaaggttcaaatcaacaactcttaagatccaaaaggagaatgccgaactaagagatataaatatagctaccaccaaggccttggagcaagagaccaaaagggctcacagtttgatcttgaaggatgagctaaaggtttgcctaaggtccaagagaagcttgtctcagcatttatgcgagacagagaccaacatgttagcaatcattagcaagtaccaagaagaattaaatctagccacggcccacgagcacaaagtggcggacgagtacgcagaaaaggaagctaggggaagggtgatcgactcgttgcatcaagaggcgacaatgtggatggaccgatttgctcttactttgaacgggagtcaagaacttccccgattactagccaaggccaaagcaatgggtgacacctactccacccccgaggagatccacagactcctcagctatt

SEQ ID NO: 1484 - DNA, 390 bp, Glycine max
  Peptide Sequence Number=SeqID_93169
atgagtgacatagagcaagtacaggagcaaatgaaggttgatatgagggccatgaaggagcagatgacaataatgatggaagcaatgatgagcatgaggaagatgatggaggtcaacgtttctatagctgttgctgccagtactattactaagagggactcgattcacccacccggtttcaatcaatcttcttttccaccatatggtttgcctcctaattatacactacctactattgtatacgctcctagtgagaatatcaataattccacacccgtattcattaagaatcaacaatcccaaccagatcatactcatgcacatgtctctcaacctatgggggaaacacatgaagctgatgcaatcctaccccgcaagggcattggatag

SEQ ID NO: 1485 - DNA, 486 bp, Glycine max
  Peptide Sequence Number=SeqID_93170
atgacaaagatgatgacaaaaagcccaaagaatgatttaaatattgagtcaacaaagttcaagatcaagtttaatttcaagtttcataaaaagaaatcaagaagattcaagaatcaagagaagatgaattcaagattcaagagaagaaatcaagaagacttcacaagggaaggtatatcctttgtggtacaagtagagggtacatctacttgggttgttgtaactgagaacaagagagggtatgatgcaagctccattggagcttgtaggcctaggatcttcttcatcaatggattcctttgcttcttggaagatgaatggcagcggaatggagaaaggaagagagagaggagacgccacttcaaggagaagatgagtctagaagaagctcaccaccataggaggccttggataagagcttggaggaagaaggagatgaatgaagggagagggagagaagagcacgaaattttgtgctctaaatga

SEQ ID NO: 1486 - DNA, 387 bp, Glycine max
  Peptide Sequence Number=SeqID_93171
atgggcgttgcacaggccaaaggacatcctcctataggcaaaagtgccaaagggacagtaatgggacttacctgccaagtgctcaagcatttgatcaatgaaaggcaggggaaaatgatcttttttggttacctggttcagcctcctataatcaatgcagactcgccagctgttttgcactcttgtggggataggctcatccctttcattcttaatcactgtgaggtttgtcttcttaggaaccacttggactggactcacccactagctgtcagaaatggggtagatgggctaataccaggaatgtctgctaaagtccattcaatggctttcttgtgcttcttgagcactagcaacaacttctcttcttgctcagcagcaatggag

SEQ ID NO: 1487 - DNA, 350 bp, Glycine max
  Peptide Sequence Number=SeqID_93172
atgcctaatgaagctcatatcatcttcgagtcgagtgatcctcgtattcgtcccatcaaagtgagtatccattgcatcaagtcagaagagaagtggaatcaccccgttgtggtggaggagatggggtacttcttcaggaataggcaggggcaagtcttgtttgcgaacccactgaccatcaacgtcctttcggtaaccaaaggaggtaaccgcaccagcaccaatagagaaagacctttttactttgacaaatggttgatcatccaaaggaatattgaaatgataaagaaaagagtaacaaggagaggattaggtagaggtgcattggcccgtaatgccttatgcatccg

SEQ ID NO: 1488 - DNA, 1050 bp, Glycine max
  Peptide Sequence Number=SeqID_93173
atgacggcttacgtggagcgatctagagaccatgaagattctgctaatgacttgccttggcattttgacaaaggaaaaggctatagtggcggtagccgtaggtgctacggtgaagttgacgtggttggtagagttgtatcattgatatttgtcgacaagtcatcaactcacgtccatgtcgcgtacctcctttacctcagtaacttggatgattgccatgagtatgcgtggggaatcgctgcattggtgtactatacgaccatctcttctatgtcagccagtacaccagcaagcaatattgtgaggaggaagatcaattttatgtgcctacaagaaactaagtggacaggtgaaaaagcgaaagaattagacaactcgggatttaagctgtggtataccggaaaaatcagatcaagaaatggggtagggattattgtggacaaggagtggaagaaggatgtcgtggatgtaagaagagtaggagatcgtatcatagtcttaaaattggtagtgggacaggacacctttaatgttattagtgggtacgcacctcaggttgggttagcagaacactttaaggtaaaattttgggaggatctagaaggggtacttcaggatataccccaaggagagaaagttttcctaggaggggatctcaatggacatgtaggtagcgtggctagaggttttgagggggtgcatgggggttttggcctaggggagatgaatggggagggtaaatccatcttggagttttcggaggctttggatctttctatagccaatacatggtttaagaaaagagaggaacatcttatcacttacaaaagtggagggacatgttctcagatagatttcttccttatcaggaagtctgataggaagtattgcttgaactgtaaagttatcccgggagagagcttgactacccaacatagagttttggttatggatgtaagaattagagatagggcaaagagaagaagtcctctggtagcaccaaggatcaaatggtggcacttgaagggtgagaaacaaggaatctccaac

SEQ ID NO: 1489 - DNA, 419 bp, Glycine max
  Peptide Sequence Number=SeqID_93174
atggctaaatatgacccagagatagtcatggaattctatgcaaatgcttggcccataaaagaaggagggcatcgttgtgagttcagagagagaagaagccaggtctcaggatttgatgaggaggccatgggacaactgttgtgctccatgggacaagactttgcacaaagcgtgacggggaggcaggtcagtgttcatgtagcccaacttatcttggatgtcatttaccagtttgtaggtatcatgcctccaaggcacccagtggacccagagaagtccaacagagcattaggattttcagccttgatcacatgtctttgccagttctatggggtgtcagttacgcccacaaagctcatttggcctcccattaacaggtcgttcattgagaagtattgcattccaaggcaggcacagga

SEQ ID NO: 1490 - DNA, 794 bp, Glycine max
  Peptide Sequence Number=SeqID_93175
atgaatatcaagagtcatgtgagtgaaatttcctcacacttaaattcaagttggcatcagtgcgggttccgaccatcaccgtcgccgccgccaccgtccgttgcctccggccaccgtcttccgccgccagtcgccacctccggccaccgtccgccacctccaaccaccgtccgccggaatctcgccggaattttttttttggtcaaaatggctacttctggtcctgttttttcattttctggaaccccaaccattgcaactgccaagctcaactggaaaaattatttgtcgtggtctgcttcagttgagttgtggtttcttggtcaagggtaccatgaccacctagagaaaaacgtcaatgctgttccaaacgacaagaaacttgaatgggagaaggtagattatcaactatgtgctgttctgtggcaatcggtcgagtcagatgttttggaaattctcagatcttttaaaacatgtcatcttttttggaagaaggcccaagagatcttcgccaacgatattcaaagcctatttgatgcgactgtgaaagttacagctctcaagcaatctaagcatgacatgattgcacatatgggtaaagctcgggcagcagtagaagagctgagaaggtttcttgtggctgattcgttggaagaggtgaataggaaactggacaagttctacatggtccttatcttgaggagtctacactcagattttgatcaggtcctagctggagatcaagtcccatcgatggattctctcattactaggcttctccgtgtacctcatgc

SEQ ID NO: 1491 - DNA, 74 bp, Glycine max
  Peptide Sequence Number=SeqID_93176
atggctctgagaaagctttccacaaagaggtctaggaaggacgctgcggctgaagggactagtgccattcccga

SEQ ID NO: 1492 - DNA, 802 bp, Glycine max
  Peptide Sequence Number=SeqID_93177
atgatacccggagataccttacggttatccgccccccctttgccattcagacacagtcgtgttcgatggcaagcagagaccaagtttggtcattctgcacacatgatacccggagataccttacggttatccgccccccctttgccattcagacacagtcgtgttcgatggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccgccccccctttgccattcagacacagtcgtgttcgatggccaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccgcccccctttgccattcagacacagtcgtgttcgatggcaagcagagaccaagtttggtcattctgcacacatgatacgcggagataccttacggttatccgccccccctttgccattcagacacagtcgtgttcgatggcaagcagagaccaagtttg

SEQ ID NO: 1493 - DNA, 400 bp, Glycine max
  Peptide Sequence Number=SeqID_93178
gaaggaccaagcccaaggaattttgggggctgcacctttgaaacccaaggaagataagggtaagaccatagagaaaccaacccctaagactagttcccaagaaaggactagcaacattaaatgcttcaaatgtcttgggagaggtcacattgcctctcaatgccccatgaagaaaaccatgataatgaggggtcaagacatttatagtagtcaagaggatactatttctttcccttcctctagtggaagtaaagatgaagcaaggggtgaagaatctagtaaggaagtctacccccatgaagaaagtgacctcctaatggttgaagcaacagctcgcctgagcgagctactgttcaacctcatcccttcattttctataaataggcgtgagggggatgag

SEQ ID NO: 1494 - DNA, 467 bp, Glycine max
  Peptide Sequence Number=SeqID_93179
atgggggccctatacccgggttcatgggaatctatggagtggaggtggatctatgatcatgctagccttaaggagttgggacggttgatgggacccttccaaaggcaagccttccgcaaagtgtacggaaagattttagatttgaccgcagtggaggtatttacggaagctgttgtatccctcgcccaatactatgaccagccgttgagatgcttcacgtttggggacttccaaatagtaccgactgttgaagaatttgaggagatattaggatgccctcctgggggaagaaaaccgtattttttctccgggtttcttccctccttgagaaagattgcagctgtggtcagagattcgacgagagagttggatcgtatgaagaaaactcgaaatggcgtagtgggcctaccgcggaaatacttggaaggcaaggcaagggatatggcaagtcaagaagagtgggtccc

SEQ ID NO: 1495 - DNA, 217 bp, Glycine max
  misc_feature (29)..(29): n is a, c, g, or t
  Peptide Sequence Number=SeqID_93180
tcatctgaggccaccatcctagagtcatntgatataggagaagaagtagaggagacacaggtgagacaggtagctactgccactcgtgagcgatcccttgaggctacttcagagccttctgcaccagtcatgccagaggacccgactacaccagtcctagctgtggacacttctcctccaactactccagtgcttcagctgacatatgaggaggatg

SEQ ID NO: 1496 - DNA, 978 bp, Glycine max
  Peptide Sequence Number=SeqID_93181
atgtggtatgatgaaagaatatcaaaagataaaaattttcagaatccaagccaatattctggaattcagagccatattgtttcaggtttaagtcacatgctcgatcaacacaattctcatgctaaaagttttagaatggccagggatagattggcaggtgatcaaaccaataatatcaaattgcaactgatagctgctcgaggaaaagatggtcgtgtatataatatgcctaatgttccaaaaattgttgcgtttattgttggcgattttcatccaggctcaaaaagagatattattgttgaaactcaaaatggagaattacaaagaatccatgaacttcacgctagctatctaccactacaataccctctactctttccttatggagaagatggatatagagctgacatacttcaccgttctacttcatccagcaaaaaaagaaagcgaaatcgtctgacaatgagagagtggtttgcttatagacttcagtccaggtcaaatgaagcacagactttattgcattctcgaaaattatttcaacaattcattgttgaaggttataccatggttgaatctgataaacttagctacatcagaaacaaccaaaaaaagcttagagttggtaagtattctagcttacaaagttcattggatactggaacagctaaaggcttaaccaagggaaaaagagtcatcttaccttcaacgtttgttgggagcccacgttatatggatcaactttactttgatggtatggcaatatgcagtcatgttggttttccaaatctttttattactctaacctgtaatccaaattggcctgaaattcatagattactttcacctttgaatctcaaaccaacagacagaccagacattgtatcacgaattttcagattaaaatttgaacacatgctgtcaaacttaacaaaaggtcaattactgggaagagtggttgcatatattactggctaa

SEQ ID NO: 1497 - DNA, 216 bp, Glycine max
  Peptide Sequence Number=SeqID_93182
atgagtaagaggaatttgccacgcaagcacgcgcccagcacgcaaccagctcgcccagcgagtcatctgtctcttctggcgcttagcgcgcctggctcgcttagccaaagatcattcactcgcgctaagcgcgaaaatggcgctaagagcgccttcaaggacaaaaagccctttttaaagcctgaagtgaaagaaaagagagagcttggcagatag

SEQ ID NO: 1498 - DNA, 96 bp, Glycine max
  Peptide Sequence Number=SeqID_93183
atgccaagaccagacaaacccaattggcctacgatgcatgtgttaccctttcccaagcgattaacccctaaaactgatgcatgcattgaatcttaa

SEQ ID NO: 1499 - DNA, 1047 bp, Glycine max
  Peptide Sequence Number=SeqID_93184
atggacggcacgcatctgttcgaactcgtgatcgcgatgttcctcgccatcatcgtgctgcactacatcgcacatcgcatgggcctgccgccatccgtagcgctagtggtgggcgggggaacactggcgttccttcccggtttgcccacgatcgctgtcattccggaactggttcttgttatatatctaccgccactgctgctcgacggagcctggtcgatcgccgtggatcgcctgaaacgacacgtcttcggaattgcatctctcgcgatcggcgcagtgctgttcacaacaatcgtcgttgcggttgttgtccacttcctgatgccgtccctgccgtgggctgcctgcgcagcccttggtgccatcgtttcacctcccgacgcagtttcggcacgggccgtgctcgaacgggtgaagattccgagacgcctccatatccttctggaaggagaaagcctcctgaatgacgccagtggactcgtactctttcgttttgccgtagcggctgcggctggcggtacgttcagcacaacagacgcactcggtgaattcatctttctggccgcaggtggcgccgcaatcggcgcggtggtcggcttcgcatgggtaaagcttgtccggcatctgggtgacgaatatctgatgatcgccgcgacggctattctgtcgtgggccgcctatcttttggcggaacggatgcacacatccggtgtgatcgccacggtgaccgcggggttgattgcatcatggcatcagcacacggtgctgtctgcagcgacacgcatgcgcggcacgtcattctggaacgtccttgttttcctgatggaggcaatggttttcatcctgataggactgtcgctacgtgacgtcgttgaacgtggcggcggctttggctcactggttggttccatggccctccccgcggtgacggtcctcgttacgctcgtcatcgcgcggttcgtgtggatattcgtatcggatttcgtcatcgggttatttcatggcttgaaactcgctcgctccacacccctcggagcaggaggg

SEQ ID NO: 1500 - DNA, 729 bp, Glycine max
  Peptide Sequence Number=SeqID_93185
atggccgatgcggggcaggcgatgttatcgctggggacctccggcgtctatttcgccgtcagcgatggttttctgagtaaaccggaaagcgcggtgcatagtttctgccacgcgctgccgggccgctggcacctgatgtcggtgatgctcagcgccgcgtcttgtctggattgggcggcgaagctgaccggccttggcagcgtaccggcgctgatcgccgcggcgcagtcggcggatgacaatgccgacccggtgtggttcttgccttatctttccggcgagcgtacgccgcacaacaatccgcaggctaaaggcgtgttcttcggccttacccatcaacatggtcccgccgagctggcgcgggcggtgcttgagggggtgggttacgcgctggccgacggcatggatgttgtgcactcctgcggtgtgaagccagacagcgtcacccttatcggcggcggcgcgcgcagcgcatactggcggcaaatgctcgccgatatcagcggacagcagctggatttccgcaccggcggcgatgtcggcccggcgttaggtgcggcaagattggcgcagctgggcgtacatcacgatgcggctttttctgacctcctgccgcagctgccgctggagcaggcgcatctgccggatgctcaacggtttgcccgttatgcgccgcgtcgtgaaacgttccgccaaatttatcagcagcttaagccgctgatgtcataa

SEQ ID NO: 1501 - DNA, 387 bp, Glycine max
  misc_feature (75)..(75): n is a, c, g, or t
  Peptide Sequence Number=SeqID_93186
atgcctaaggagaaatcccgcatcaggcgccattcgccattcaggctgcgcaactgttgggaagggcgatcggtncgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccaatttcccgcagaaacccaaaactgtctcgggagagaaaggaatcgcatgaagacaatacaagtgaaggtttcaatctcttctacgtctctctgacgtttgagaattctattagagcagtcggaggaataactgaaggaatctcagggaaccactggtga

SEQ ID NO: 1502 - DNA, 399 bp, Glycine max
  Peptide Sequence Number=SeqID_93187
atgaattccggcatagccctgctcacgcagatcctcacctttgatgatgcgatagctcaccgcgtcaccgcctacttcgctgatcagatcgatggcgctgtgcgccagctgctccggactgagatcttccgcaggcaggtgcggaaacctgtccagaacgcccagcatagttctccagaatcccagagaaaccttcgccgccagcgcgacgtggcggatgccctgaccgtccagctgcgtcctggcacgttgaatgctcatcagcgcatcggcaccggtggttgcagcaaggctttctcgccccagcgcgcatctgcggcctgggagctgagcgtatcgtcatgggttgtgttgaaacatcgcgtggctaatccgtttgcgtttgttactgcgcactga

SEQ ID NO: 1503 - DNA, 1008 bp, Glycine max
  Peptide Sequence Number=SeqID_93188
atgcttgactcgcgtgaatgcggtatcaaaagcgtggaagagggccagcaggcgccggtggcgctggtgtttggtcgcgagcgcgtgggcctgaccaacgaagagctgcagaagtgccactatcatgtcgccattcaggccaacccggagtacagctcgctcaacctggcgatggcggtgcagattattgcctatgaagtgcgcatggcgtggctggacgcgcaggagaaagccagtccgcagccgcagtatgaagcctcaccgtatccgctggttgacgatctggagcgcttctatcagcacatcgagcagatgatgctgaacagcggttttatccgccagggcacaccgagccaggtgatgagcaaactgcgtcgcctctatacccgtgcgcgtccggagcgcgatgaactcaacattctgcgcggcatgctgtcgtcgtttgaaaaacccaaaaacgacaaggataacccgccgactcgctggcggacgcttacgaggttgtatgctatgagactgacatccaaaggacgttatgccgtaaccgctatgctggacgttgccctgcactcgcacgagggcccggtaccgctggccgatatttcagagcgtcagggcatttcgctctcctatctggagcagttattctcgcgtctgcgtaagcacggtctggtggccagcgtgcggggtccgggcggcggttatctgttaggcaaagacgccggcgcgattgcagttggtgcggtgatcaccgcggtggacgaatccgttgacgccaccaaatgccagggtaaagagggttgccagggcggcgagcgctgcctgacccacgtcctgtggcgcgacctgagcgagcgcatcagcgatttcctcaacaacatcacgctggcggaactggtgaataaccaggagatcctcgacgtggccgatcgccagaacagcgttgataaccgtcgcttccagcagcatcgcgtgcaggaaaccatcaacgtcaatctgcgcgcctga

SEQ ID NO: 1504 - DNA, 180 bp, Glycine max
  Peptide Sequence Number=SeqID_93189
gaattggaaaggaggattagtgccatctgtcgcaacctacccttcggcgggagggcgacgcgtgactcgcgggatgcgtgttccacaaaagaaatacgcgcgaagtcgccaccaacgtttatttgaggaaaacgtcggaaaaaccggaagagacgtgatctacgaacttttaagtgaaag

SEQ ID NO: 1505 - DNA, 1245 bp, Glycine max
  Peptide Sequence Number=SeqID_93190
atggcagaggtctccacagaggccattgcctccctcacccagtattatgaccagcctttgaggtgtttcacctttggggacttccagttaacactcacggtagaagagtttgaagagatcctgggatgctctctgggaggaaggaaaccgtatcttctcttagggttttatccctccttggctagaatttccaaaatagtcaaaatctcggcacaggaattggaccgggggaagcaagtcgaaaatggggcggttggagtaccaaggaaaggtttggaagcaaaggcgagaaccttggcaagtcaagacgaatgggctctgttcatggacgtcctgacgctcttgatcttcgaagtggtcctctttccaaacgtagatgggttggtggacttggcagcaattgatgtttttcttgcctttcacgaccgcaaggaaagcctggttgttgctatcttagctgatctatatgacacatttgaccaaagatgtgagaagaacagtgcaaggatcgtttgctgtacaccggtcctctatgtatggttggtttcacaccttttctgccaagaggtgagacacatttgtccactagaaggccaccgctcatgcaccgagaagaaggaggcaaactgggatcgactcttagcaagcaaagaaggaccgtctgtcagttggttcccccgatggaaagaaggaagaaccaggattcttatttcgtgcggaggatttccaaatgttcccttaatggggacgaggggttgcattaattacaatctcgtcatcgccataagacaacttggctaccctatgaggggggcaccattagaggaagacctcacaccttttattgcgcgaggtttcaatagctccaacgcgggggtgcttcagagggtctgcaaggcatggggaatggtgcaaaagaaggatgaagaacttatgggaagtagcaacgggcccattggcggttaccataagtggttgaaagcctacgcacaaggtctggattggctcccgaatttgagagccattaaagaggtggaggttgaagctccggaagaagacgaagaggtacaagccctcagaacagagcttgagaaagccagagcaatcaaagaaaagttcaagtcaacagccgttaggatccgaaaagagaacgccgaactgagagacgtcaacataaccaccaccatggttgttaactcgcgattctacgtagaatcgtggaggttccgtaaacttgactcgtag

SEQ ID NO: 1506 - DNA, 354 bp, Glycine max
  Peptide Sequence Number=SeqID_93191
atggaacttggctttagatgggaagcattaaacggtaatttctccaaagtgcttttgggcattacgtttaaactggaaccgttatcgatgagcaccttggctacgacgttgtccatgaacttgactgatacatgcaaagccctgttatgccctctcccctcagcaaggatttcttcttcggggaagagaaactcgcttgcttctgtcgcaacctacccttcggcgggagggcgacgcgagactcgcgggatgtgtgttccacgaaaggaatacgcgcggagtcgccaccaacgtttatttgaggataacgtcggaaaaaccggaaaagacgcgatctacgaactttttagttga

SEQ ID NO: 1507 - DNA, 222 bp, Glycine max
  Peptide Sequence Number=SeqID_93192
atggaaagtattaccggacatacccctgtctccacattgggtcaagaacagggtcagagggatcaaaaactgctaattcatatagagccatcgaaccggcccaaccagcaaccagagctgtgtgcattatatgaacagaaagcaaacggcctggatcatttaatacaacagtatgaacacgataccaagaggtggtatccagattattactcgaaattatga

SEQ ID NO: 1508 - DNA, 771 bp, Glycine max
  Peptide Sequence Number=SeqID_93193
atgggtgaagcagaggaggtgcaagagaagatgaaggccgacatggaggccatgaaagagcaaatggccacaatgatggaggccatgatgagcatgaagaagataatggaagccaatgcggttatagttgccgctactagcgcgatcgctaaggtgaacccgatgctcccatctggcctcaagcaaatgaatcatccaacctcaaatatggtaggcaaagatttaggatgtacggatgaccccatgatgtgcaaattcaaaacaagcacgccttcccaccatatggcttgcctcccaaactatacaccacccaatgtggcgtacattcccaatgaggatgtcgataactccactcccatactcattaagagccaacaacctcaatctgatcatgcacatgtctctcgacccatggaggagacacatggaatgccccaccacaatctagccgactttgagccttgcctcggatatgccactgaagggcaagcagttggtggtatacccctgcaaaacactttggagggccctcagtgtcacccacaaccacaacccttacattcctcagcggttaaaaaccctcatgctatggcagaaatgggaaagaggaaaggctcacggccattgaaggaggtgctggactttgacaagtacaaggggactacttgtcccaagaaccatctaaagatgtattgtcagaagatgggggaatacgcaaaagatgaggaattgctgatacattccttcccaaggaaagtcttactggggtag

SEQ ID NO: 1509 - DNA, 192 bp, Glycine max
  Peptide Sequence Number=SeqID_93194
atgacgaaagataacaattggtacctcaaagccttacactgggcaatgaggggcatcgtgcatgagcctcaagtgaacatagggaaaggatgtcatgaacattatacaactttccattgccttgccattgtttcatatgaggtcagcattaccaagtttcacaacaaaggttgcatgcgtctgcatccctaa

SEQ ID NO: 1510 - DNA, 318 bp, Glycine max
  Peptide Sequence Number=SeqID_93195
atgacacatcagtcacatcccgcaccatttttgttgttaaatgagcctcaaataccaccgatcaccctagaggcacacattacaaatcacatccctttcaattgggcaacccactgcgattctagcaacagttctttgggcatgatgctaatgggtggaccactagatctaccttttgccaagaccatcaaagtctacgaggacgtgggagattttagcaatgatgaggatctcacaccatccatgatcgcattctatcggggtgtttgcggtgaagagatatccaagggaaaggtggtttcatctgacaaggaatga

SEQ ID NO: 1511 - DNA, 159 bp, Glycine max
  Peptide Sequence Number=SeqID_93196
atgagaatcctgaaactagccaaatacaggctaaaggcccaagtggagaaggacaaagcccccgaatggagaaggatgaaggcccaagtggagaaagatgaaggcccggaggcagaggcactaccaagactattaattgttgctgaagatacactataa

SEQ ID NO: 1512 - DNA, 483 bp, Glycine max
  Peptide Sequence Number=SeqID_93197
atggtggccaaggtgaacgcaagaatggagacacgcatggaagctatggagaaagcaatagacttaggaaatccttttcaagaattgctggcactgcaacaagaagagacagtgcagggatccataggtttggaggagccatttctagtggaagtgttccttaagggattaaaggaagagattagcattgaagtaaggcttcatgaaccaaagaacttgatggaagccatggttaaggctcaaagagtggaggataagaataaaattttagggaagttacccgtgggtaatgggacaagtggttggaaaggtagaaggacgttccacaacttgtctcctgcagaggtaaatgaaaagatgatgaagggagaatgtttcacatgcgaggaaaagtataatcctacacatgtgtgcaaaaatagacaattcagattgatgattatggaagaagaggaggaaggagatcctcagagccaacaatga

SEQ ID NO: 1513 - DNA, 612 bp, Glycine max
  Peptide Sequence Number=SeqID_93198
atgtggcaatggggtgtagcaagaaaatgctcagatgccaataaatatgataatgtgaaaggaaggcagatgctaactcattataggcccaaaaagcacaattactttacagtagcatcaactattgctacacaaatttcccatgttgttggagctacttattccttaaagatggataaaaaggatgcatgtgttgtcacttactttggtgatggtggctcaaggacatttccatgttgccttaaattttcagcagttttggaggccccagttatttttatatgttggaacaatggatgggctatcagcacacccatttcagatcagtttccaaggaaagcatatggagtccgtagcattcgtgatggcaatgatgccctagatatctatagtgctattcaagctgctcatcaaatggcaattactgaagagagaccaattctaatagaagctcttacatatagagtgggacaccacaccgcatcagatgactctaccaagtatcatcccgtgaatgagattaaatggtggagattgacacgtgatcctatggctagatttagaaagtggatagaaaagaatggttggtggaatgatatggctgagtcataa

SEQ ID NO: 1514 - DNA, 276 bp, Glycine max
  Peptide Sequence Number=SeqID_93199
atgaaagatgtagaaatacaagtagtagggatgtctcctccacctctaagacctcacaatcactcacaaactcatctcaagctctcaagacggcttcctcttcaagctctgattcttcctcgtgctcatccgaggattgttgcgctcagcggatggctcgctaagccgacaggttggcatagcgagagggtgaaaatcagcactatacaaactcacctaattcacctgaaattgagagaaaaaatgattgttaaacacacaaaatggaagtactaa

SEQ ID NO: 1515 - DNA, 330 bp, Glycine max
  Peptide Sequence Number=SeqID_93200
atgcccttatttcatcttaccattaaggtagtagcttgcatacatggtgagggacgacatgactcacgcaagtgtagaagcaaagactttgcctttgatgttttgatgatgccatatgatcatgatgttttgatgccttatgaaaatgtgcttctcaagtttaattcaagacaaaaatccaagaatacaagatacaacatcaagaagatctctagtgctttaggaagggaattccaaattgaagcagcaaaaggtttggccaagaaatttaagcaaaaatgtttttttcaagagatttactctctggtaatcgattaccagaggatgtaa

SEQ ID NO: 1516 - DNA, 330 bp, Glycine max
  Peptide Sequence Number=SeqID_93201
atggtagttgtagttcaaacctacattgttactttcataagaagaggtaatccatctgacttacaaccctttgatcctgagatagataggacatttcatagattagttagacatcatttagtaccttttgagcatcctgagcattcagttattggtgattttgagcattatagttttgaacattctgattttgaacattctgagaacatcgcacaacctccaccccgtgagaggactctaagggaaatggctgcacctgatttcacctatgaagcttgtgcatccaataccctgatgaggatgtcccgtatgttcttaaaactggtctga

SEQ ID NO: 1517 - DNA, 460 bp, Glycine max
  Peptide Sequence Number=SeqID_93202
atggctacctcaccaaaagaaacttcagcttctggttcaccctctgtaccatcatctccgcaccagggacaacctgaactcaacatccaacccatacaaataattcctggtcaagcccctgttccagagaaactggttcccaaacgacaacagggagtaaagactgctgaaaaccctagccttgcaactagccctagggaagtagacccggagatggataagaagatccgcagtattgtgagtaacattctaaaaaatgcttctgtgcctgaggctgatgaagatgttccaacatcctctaccccgaatgtttctgtgcctgatgttgatcaagatgttccaacatcttccgctccaaatgctgaagccctcccttcacccagtgaagaggaatcaacagaagaagaggaccaagcctcagaggagacccctggaccacgggcaccagaatctgctccag

SEQ ID NO: 1518 - DNA, 636 bp, Glycine max
  Peptide Sequence Number=SeqID_93203
cggacggccggtgcggcgatcgaggcagcgcagggtgttcggttcccagtacgcattaacgttgtagcttttttcgcacgcgtcgcgggtatcaaaggcccggtctgccttgtcgaactctttctccacgcgggtattcaccttgttacgcaggttgcgcgtatcgttccactgctctttgctctgacgcgccgcctcgttgctggccgcgttgttgccatcttcaataatcaggcgatccgtcttagcgacagccagcggcgcagtcagcatcacgctggcggtcagcgtggtagcgagcagggcggaaaacaagagactttgtatgctggtgaaaaccgcgctgctgttttttatcactgcgattgccgagatcaccggctgttttctgccgtggctgtggctgaagcgcggcatgagcgcctggctattgttaccggccgcagccagcctggcgctgtttgtctggctgctgaccctgcatccggcagccagcggccgggtatatgcggcttatggcggcgtgtatgtgttaacggcgctgatctggctgcggctggtcgatggcgtcaaactgagtgcgtgggattgggtggcggcatgctgattatcgttatcggctggggcaaggcctga

SEQ ID NO: 1519 - DNA, 120 bp, Glycine max
  Peptide Sequence Number=SeqID_93204
atggaagctctcgagaatattcaaatggtcataacttttcacacggaggtgccgattcaggcgcatcatatatcgagacgctcgaaattgatcaatggaagctctaaagaaattcaaatg

SEQ ID NO: 1520 - DNA, 201 bp, Glycine max
  Peptide Sequence Number=SeqID_93205
atgacgtttgcgactgaggggaaggggttcagcacccttggagcaaaagccctgcttttgtcgaccccaaaaatcaagagatcgttaaaggtccaacgccttaacgtttctctcctcccaaaaatcaagagatcgttaaaggttcaacgccttaacgtttctctcctcaatcaagagatcgttaaaggtccaacaccttaa

SEQ ID NO: 1521 - DNA, 831 bp, Glycine max
  Peptide Sequence Number=SeqID_93206
atgtcaaggttccttcaggtttcttcttttttcgaggatgagggtgagagccccgtcgagtctgatgaaataaaagtccaaacttggagcaaccaacactacaggaacgaacctgtggttgttgttgctgctccacggttgcaaaagtattctagttttcatgaacagagtggggagccgcctctgcttttgcccattcgaagcttgaaatctcgcttatccgaagaagatattgatgttcaatctctgaacatgttaatgagttctaaaaggttttcaagcaattcaaatagaaatgcagaagttgaagctgatgttgttgatacagatgttcaatctctaaataggtcaacaatttctcaaggattttcaagaaattccaatagaaaagctgaagttataatgttgtcttcaaacacttatgttataatgttgtcttcaaacgcagaggattcggtgaggaagaagggcttctacaagtcttgtcctccaccacctccgccaccgccaccaacaatgtttaagaaatcagtgttcatgaaaccaaggttcgatggttcatccaacgaagcaccttccttcaataaggagttgaagagaagcttcacaagtgagagaaccacaccagtgggaaagaaaagtcatgaagaaaataaatccaagcaaggcacattgtttagaaataacaagttcatggggcatgcaagcgtgcctcttgtgtcacaaccagctgagaaagaaagccttcttgtggaatctaacgatgatgacgacgatgatgacacagaaaccgaggaccaagacgttgaaggaggaagaaccgttgcttag

SEQ ID NO: 1522 - DNA, 111 bp, Glycine max
  Peptide Sequence Number=SeqID_93207
atgacagctcgcccaggcgagctgttacttcattttgaagcaaccttgctcgcccagacgagccagaggctagcctgggatagccagggcttagaaacagccttaaaatga

SEQ ID NO: 1523 - DNA, 240 bp, Glycine max
  Peptide Sequence Number=SeqID_93208
atggccggctctctcgatgagtcaatctcttgctttctcataagggtggacccttgggtactagtacctattgcctttggaaggctgcatgcccttgccttcagaggactacacgtcctcgccttaagagggatgcatgacctccccttcaaagggctacacgtcctcgccttcagagggctacacgccctcaccttcagagggctacacgtcctcgccttcagagggctgcacgccctc

SEQ ID NO: 1524 - DNA, 48 bp, Glycine max
  Peptide Sequence Number=SeqID_93209
atggagcttacatcattcgcccaggcgagctgtagctcgcccatgcaa

SEQ ID NO: 1525 - DNA, 405 bp, Glycine max
  Peptide Sequence Number=SeqID_93210
atggaggccatgaaagggaaaatgtccacaatgatggaggccatgatgagtatgaagaagataatggaagcccatgcgattgtagttgccgctaccggcgctgttgctaaggtgaacccaatgcccccatctgatctcaaccaaatgaatcatccaacctcagatatggtgggcaaagatttgggaagtacggacagccccatgatgtgcaaattcaaaacgagcacgccttcccgccatatggcttgcctcccaactatacaccacccaatgtggcgtacactcccaatgagaatgtcaataactccactcctatactcattgagagccaacaacctcaatctgatcatgcacatgtctctcgacccatgggggagacacatgaaatgccccaccacaatctag

SEQ ID NO: 1526 - DNA, 408 bp, Glycine max
  Peptide Sequence Number=SeqID_93211
atgagtacgaccgggcgtgggaggcactcggtcctccggattttcaagggccgccgggggcgcaccggacaccacgcgacgtgcgaaaagataactctttccggggcccccgccgacgtctccggactccctaacgttgccgtcagccgccacgtcccgatctgcaccgacgaccgctccgcccgggctcgcgccctgggttttgcagcgaccgccgcgccctcctactcatcggggcttggtccttgccccgacggccgggttagcgcgcagttgggcaccgtaacccagcttccggttcatcccgcatcgccagttctgcttaccaaaaaatgggcccacttggagctctcgattccatggggcgggctcaacagaagcagccggcacccgtcctacctaatttaa

SEQ ID NO: 1527 - DNA, 1419 bp, Glycine max
  Peptide Sequence Number=SeqID_93212
atgctgcaggcggcgcggctggtccacgtgatgctgcgcgaaatcggtttgcgcagctggctcaagaccagcggcggcaagggcctgcacgtgttggtgccgctgcgccggcagtacgactgggacacggtcaaggtgttttcgcaggccatcgtgcaacacctggcgcgcacgctgccgcaggtgttcgtggccaagagcggtcacgaagaaccgcgtcggcaggatcttcgccgactacctgcgcaacggcttcggcgccacgacggtggcagcctggtcggcgcgcgcgcggccgggcatgggcgtgtcggtgccgctggcctgggacgagctggacgaggtccgggccagcgaccagtggaccatcgccaacatccacacccgcctggatgtgggcgacgcgccctgggacgactacacgccgcaggcgctgggcgcagccatgaaggcgatggacttcaagccggattcgggcgggtagggcgcctcggcgccccgatccagccattgaccgacgccggggccggtcaatgggccggggcttggggctggcggcctactcggctcccgccggcgccagatcgaggtgtagaccacttcgttgcggtaggtgccttcgatcaccatggtgacgagcgctgcgacaatgcagacgatcaccgcgtacgtcagccacggaaacagccacatcctgaattccagccgcacgccgcgcgcctgcaggcgctggcgcatgcgcagctgcgagaaggcgatggccaggtagacgaacagcgcgatggtgcccgtggcctgcatcaggacgtcatagacgtccatcttcgaggtggccatcatccagaccgcggcgaaggcgaacaggctggagatgagcacgcccacatacggcgtgccggtcttgcgcccggtgatctgcatgacgcgatgggcgtcgccgcgccgggcgagcgaatagagcatgcgcgaggcggtgtacagcgccgaattgaagcagctgcataccgaggtcagcacgatgaagttgacgataagttgcgcgtgcgggatgcccagcgcgtcgagcgcgacgttgtaggtgccctgggtcggctccgtgaggcccggcgcgttgtacggcaccaggcagaccacgatgaagatcgatcccacgtagaacaggcagatgcgccacaccaccgagcgcgtggtcttgatgatctcgcggcccgggtcggccgattcggcggcggccacggtgacgatctcggcgccgatgaaggcgaacatcacgcccagcagggccaccaccacggacttcgggccgttgggcatgaagccctggctggtcaggtggctccatcccttggcgtcgccccacggccacaggtgcgccagcgccaggctgcccatgaccaggaacagcgtgggatcctctag

SEQ ID NO: 1528 - DNA, 249 bp, Glycine max
  Peptide Sequence Number=SeqID_93213
atggttacttccatacttcaacttgactcgatgaaccttttcgtaaaagcacgagcttggttcaaccccataacccagagaatagcaattttgatcgccaatactttaacaacatttcatagggatgaaagactcgagaatacgcatgctatgcatggaaaatgtaattatgagattgagatgcccgaagggacatcctttattagaaatgggtttatgatcccaacatggttggctcatggtacctaa

SEQ ID NO: 1529 - DNA, 669 bp, Glycine max
  Peptide Sequence Number=SeqID_93214
atggacacggagttcttttctgatgaaatgtttcagtgtgttcaagcgtttcagaactccggtctcattctgtttatgtctttaaaaattcctgtttatcctgagttagtgaaagttttttattcaaacttagaaattcaagaaggttccttgatttttgaagtatatgggattaagatggtcatagaccaatcccttttctttgaactcacccaattatccagtgatggtgtaccgtttgaaggtacacttgatgatgattggaagttcaatttttctgtttctgatgcccgccggttggtttgcatcaaccaagcggatatgaccagaaggctttttgccggctcattgacatttgattgtcgcatcctccactatcttattgttcgcattttgcttccgagatcttcaaaccttgcacaggtttctgaagaagatctcattatcatgtgggcatttcttatcggtcgtcaaatcgactgggctcacttagtccgttatcgcatgaataaggcattgcgatcaaacgctcccttaccctatcctcatcttatttatctctttcttcaccatttcgaggtacctcttgattttgaaccttctgttcaaatcaagaagtccttttccattggggctgcagtggttgcctccttcggttatcgcaaatag

SEQ ID NO: 1530 - DNA, 108 bp, Glycine max
  Peptide Sequence Number=SeqID_93215
ggaattggagctgaggaatgttgccatcccttgaagaatactgaagtccaacaaggggccaaccaccttaagagctattggactaaagaagcactccaaattgagtga

SEQ ID NO: 1531 - DNA, 192 bp, Glycine max
  Peptide Sequence Number=SeqID_93216
atgcccacccaaaccctaacaccttcttctccaccacccacgaccatcggtggccaccacgaaccgccgttggttgccactgaaccaccacaccaagaagaacattttaatcggagcaaaatcctcagaatccacctcaaggattcggtggacagcaatccctcaaatcctttctttcatagcttctttgag

SEQ ID NO: 1532 - DNA, 264 bp, Glycine max
  Peptide Sequence Number=SeqID_93217
atgttggtgaaaggtttgatgctttggaacaacaagtggacatgtgatttgatgcaatggtctcaaggatcacaaaggattgtcatcatcaaaaagggggagattgtggaagcaatgacttccaaggttattttgatgatgccaaagaatcatgagctaagcaaattccacagattcaagaatcaagtttcaagaatcaagattcaagaattcaagattcaagaattcaagaatcaagtttcaagaatcaagattcaagaataa

SEQ ID NO: 1533 - DNA, 327 bp, Glycine max
  Peptide Sequence Number=SeqID_93218
atggcaagttcaacatgctttcaacaaatttcttcacaaataaccatcatgaagcagaaacctagcaagactacccatcatatctcccaaaacccaatacccacgaaaatcaaagatgtgcttcacgactccgaaaatgccctcctttcgcgatttggagcagaaatgatgaccaaaggttggagctttgttggagcttcaatggtggaggaagaagaagagaatggcaacctatgccacatgtctccatttgagtggagcaaaaagggcccactttctcttttgattgtgacccatactcagccacaaaaagtgagaaaattctga

SEQ ID NO: 1534 - DNA, 597 bp, Glycine max
  Peptide Sequence Number=SeqID_93219
atgaccagccctctcgatgagtcgatctcttgctttctcataaaggtggacccttgggtactagtacctatcacctttagaggactatatgtcctcgccatcagaggactgcacatcctcgcctgcagagggcttcacaccctcgcctttagagggctacgcgtcctcatttttagtgtgatccatatccacaccttaagagaatataagggatcgcgcccacaagatgcccagtggacccgaagaagtccaacagggccctggggtttccagctctggttacgggcctctgtcagtcttacagggtgcccgtccccccaggaggaatcgtacccacaaagacacccagtggacctggagaagtccaatagagccctggggtttccagctctggttacggacctctgtagtcctacagggtgcccgttccccccggcaaggtcacgtcatcatgacatagggatcgcgcctgcaagacacccattggacccgaagaagtccagcagggtcttggagttgtcaagctctaattacgggtctttgtcagttctacggagtgcctgtcacctccagcaagggcatcaggccccctactaa

SEQ ID NO: 1535 - DNA, 318 bp, Glycine max
  Peptide Sequence Number=SeqID_93220
atgaagttcatgtcatctgcaagctggtcgatgtggaggtccatcgcgtcaaagcgtgtgttgataccatccatgcggtcatcaacatgtgcttggaatcctcgtaactctgtgagaagatcattcagaagaacaaaagaatcatgtcatggaggagaagctgtatgctcatctgcaggctgtggcgatgcatctttcttcacccaagagccaggtaccgagctcgaattcgtaatcatggtcatagctgtttcctgtgtgaaattgttatccgctcacaattccacacaacatacgagccggaagcataaagtgtaa

SEQ ID NO: 1536 - DNA, 159 bp, Glycine max
  Peptide Sequence Number=SeqID_93221
atgagtaaagtcatgacaaaagacaacaatagatacctcagagccctacactggggcaatgagaggcaccatgctggagcctcaagcgacctaggggcagatcagaagttctcacccagtaggtcgaaaacccgaaaaggtggcctaggcaaaaattag

SEQ ID NO: 1537 - DNA, 303 bp, Glycine max
  Peptide Sequence Number=SeqID_93222
atggacgaagagcagtggatgtatgatagtatgatgtctgaagaagttgatatgaatgttgaaaatgaggaagatgctggcattaaagtagaacacgttgattgctatgatgcctttaatacttctcaattgtttgctagccatgatgaagttttacaatgggctcgattgttggctcatgacattagattggttgttgttataatgaggttagacactgatactggtgttcgaggaagagcctcatttctgttgatagcttgtgaaaggagtggtgagtataggcctaagaaacataatttg

SEQ ID NO: 1538 - DNA, 342 bp, Glycine max
  Peptide Sequence Number=SeqID_93223
atggagtggttttttcggatttcacacccgttcatcacgcgggccgaggagactgctgagccgagacatccacctccccctcatgatgaggagttcgtcgagccacccatccccgaggttttagtcgcatccgatctctctacgcattcagtggttgactgcgaaggatgccaggggatggctaaggatttaggagcgattgctgaggatttggagcgggtcatcaacctccaaatggtcactgaaggcacagacttatatgacatcatgactcgttgtctgaggagagctagaggtgacgcgcagatggaagtcttaggccgcgacagagatgccgcatag

SEQ ID NO: 1539 - DNA, 405 bp, Glycine max
  Peptide Sequence Number=SeqID_93224
atggggttacagttttttgaaatggagaacgaaagccggggagaacgaaagcctgtggaggagaagaagggaaccaaaatggagaagcaaatgacaaagaaagcttgcgcagaggaagaacgaaagaagacgaagggagggagattgctgggtgcacaggcgaagaagaagtgcggaagaagaaaagtatatgaggagcctctaaaaggacaaatcgccatacaaagctctaacatcattaatcatgagcagcaagtggatccgaggttgaacagtgaacatgtaaatgaaaaacacctaaagggttcttggctattacaaagcttcaacattcctaactttgaatggcaagtggatcataggatgaagagtgaaaacacttgtagcaaaacaataaagctctga

SEQ ID NO: 1540 - DNA, 207 bp, Glycine max
  Peptide Sequence Number=SeqID_93225
atggcacgtcttctcatgaagaaagcacgtggagttgccaccaatttttattcgaggaaaacgtttgaaaaaccaaaagatgaagcaaaagatggcattgggggtcatggcagctcgcccaggcgagctggagctcgcccaagcaagctgttgcttcaacctgaagtaaccttgctcgcccaggcgagtcggttacttcacccctaa

SEQ ID NO: 1541 - DNA, 582 bp, Glycine max
  Peptide Sequence Number=SeqID_93226
atgaatagtaacatgtacatgatttcatttggtatagtggaaattattttctctcaaatttcgagcttcgatcaattgtggtggctctccattgtagctgttgtcatgtccttcacatactccactattaggctaggccttggtattggaaaagttattggtatgaattcatgctattcacatgtccatcatgatgatatttgttcatcttcaatcactgaaaatagaggagtcgggggaagcctaaccaggataacagttggtaccgtgactcaaactgaaaaagtttggagaaccatgcaagctcttggtgacatagcctttgctcattcatactccctcatccttggagaaccatgcaagctcttgggtgtaaaatgtggtatttatggtgccaattctgcagaatggattatgagcatgcaggcttacaatgctcatggactttattgtgttcctttatatgataccttgggtgctggggctatagtgtttattatatgccattcagaggtctcaattgcatttgcagaagagaagaagatacctgaggttctcctatctaaaccctatgttttatag

SEQ ID NO: 1542 - DNA, 1131 bp, Glycine max
  Peptide Sequence Number=SeqID_93227
atgatggaaaaccaaatccctctcatagttctcaaaaggatctctggaatactttttcccgaaatttttacagacggtggtacagacaaattgatacaaaatcttgcactttctatattgggctacaacgctccggattccgatttcaaagcctctcatttactcgagtttgttcaccaggatttgaagagttctataagcagtggagaagttccaaataccagacatggaaaacaaaatctacagcgctgcgctactaggctcgaagcagctggggttacaatcggacctccacaggcacagagcgagaatgcaaatatggaagctggggtaacagctgaacctgcagaggcacagagcgaggttacaacacaaccttcagaggcactgagcgaggctgcaaatatggaagatggggttacagacaaaccgccaaaggcacagagcgaggttacaactcaatctccagaggcactgagcaaggctgcaaatatggaagttgtggttaatgtcagacctagggttgcagctgagaccaggtttgacttgaaggtaacattcagcgacgggaaactagaaattccgcaactacatattactgaaaccaccgaagctaagtggagaaacttcattgcttgggagcttaacagaactaccctagaaaaacagcgcggggttaggaatgaagatagaattagctgccaattcatttcttatgctttgttctttcaaagtttgacttgttccgtccacgacgttaaactgcttcgggatagaaatgtcatagtggtacataaattaatgagcgacgaagatttgctgaatttatttcataacatcatagagggagttcctgatgctgagatcgagatggattcctggtttgctcaggtgattgagaatttgaactcgcacccaactactgtagatcgtgtcacgacaaccagtaaaatcatgtggcatattttcatatgctttctaacatggagctggtaccaatgtagaggcacatatcgggggttgagacgtgtttattttccttcgggatggaaactaatagcactgcttgcagctgcactgggacttggtctaaccatcgcccagactgttttttcggcactcggtcaataa

SEQ ID NO: 1543 - DNA, 360 bp, Glycine max
  Peptide Sequence Number=SeqID_93228
atggagaagagattaatgattgttttggggattggcagaagtggagcttggaccaggcaggcatgcatgtgggagattttggagaagaaggagtggagcgcaacatcgacgatgaaggcgcacttggtggatttgacaccaagctggggttctaaagggggtgaaatgagtccaaccaagggtggtgttgtgaggcttgatggagggagactggcgaggagggggacgaaggagaggacttctaggaggaggtggggtcagaggaaaggaaggtggttagagttttcaaaagcatcgaatgagagtgagagtcagagggatagaataagaagggagagaggaaaggacacttacatctaa

SEQ ID NO: 1544 - DNA, 222 bp, Glycine max
  Peptide Sequence Number=SeqID_93229
atggattgtccagttctaataaaaccaagatccacctttgaatgtgggtcaattgatttgggaatcactccaaaccttcaagacgttctcatgcaaggacatgaagggtggaaagcgagtcaattaaatgataaggaatggtgggtgataacgacatcgttgttccaatggcattgttgttccagcatggtgagattccacaacagtgatgttccaatgtaa

SEQ ID NO: 1545 - DNA, 195 bp, Glycine max
  Peptide Sequence Number=SeqID_93230
atgatgcgtcaaactagtgacgttaaaatagcacttacggggagcttagctcatcagtgggctaagtgtgcatccaccgctaagcgtagcttcagagtgcttagcgtgacagaagaatttggcagagcatcaatttcaaggtggcgtgctaagcacgagatcagtgcgctaagtgcagcagttgtcttcagctag

SEQ ID NO: 1546 - DNA, 345 bp, Glycine max
  Peptide Sequence Number=SeqID_93231
atggagaattgcaataagcaatcactacacatgtctccaaactcgtgggtggaggatgctttaacgaaaacgcaattcatggggctccgaaaagagggacgcatgaacgaaaacgcaattcatgggtctccgaaacagggtagagaatggagaattgcactaagcaatcactacgcatggctccaaacttgtgggtggaggatgcatgaacgaaaatgcaattcatggggctccgaaaaaaggggtagagaatggagaattgcactaagcaatcactacgcatggctccaaactcgtgggtggaggacgcataaacgaaaacgcaattcatggggctccgaataa

SEQ ID NO: 1547 - DNA, 192 bp, Glycine max
  Peptide Sequence Number=SeqID_93232
atgtggatgcaagccattggtctgtttgctcaagcgacctgtgctcctgagtttggacttccaagaccgttcaatcagagattactcgtcttgcgcgttggtggggttgacggacaacccttcctttgtgttcaagaatcccctacaacaagagacccacggtctcttaatcccttttcagaaataagatga

SEQ ID NO: 1548 - DNA, 261 bp, Glycine max
  Peptide Sequence Number=SeqID_93233
atgtcattgtcttgcatagatttcatctcatccttcatgccattgatccatttgtatttgaggaagaacctcatcattttcttgttcttgaacaatatcatcaacaatagtttgaaagttttctattactggagttgtttcttgaataacaataggtatgaggacttgagcactgccaataatagaacaattccacactctttgagaaaaagcacaaaaggtcctgaacgttgttctcctgatccatcatatctaccatag

SEQ ID NO: 1549 - DNA, 468 bp, Glycine max
  Peptide Sequence Number=SeqID_93234
atggcacatcaaaaccccccatacttagccttttgcactcctgggcaaaatgaaacaaagaacaaaatccaaggatatcaaagaaagacaaacaaaaacatttacatatttctcaatgaacatcaaggaatgaaaggaatggaagcacatgaggatcaaaaggcttgtagtaagcttcaaaacaaggaaagggaaacacgactcaaaagggctatcaaaggaattaattcaaggaagcatcaagaagaatcaagccaaggcaattgtgcaagcaatcaatggggcaaaacacaccaaactattattatgatggatggctcaaattctcacaaagttatatcaccaaactccatagatagtgtgcctgcatatacaactatcttagttctagaagttttcataaaaggtttgcctagaatgatgggaactgatcctctagaaaatccctcccccatattcaaaatataa

SEQ ID NO: 1550 - DNA, 156 bp, Glycine max
  Peptide Sequence Number=SeqID_93235
atggcttcttttgcaatgtacctctcaacaatagatgcttctggacgatatagattctttgtatacccttttaagatcttcatgtatcgctcaaccgggatcaacgactttgctacatatggcatggaagagaaagcacaggcgagttatggataa

SEQ ID NO: 1551 - DNA, 87 bp, Glycine max
  Peptide Sequence Number=SeqID_93236
atggctaggaaactccaagaagattgggccaaggatgcaagagaatgccttaggattctcatgagccttatgggctctatagtgtag

SEQ ID NO: 1552 - DNA, 279 bp, Glycine max
  Peptide Sequence Number=SeqID_93237
atgagaattgtcggaattggaaatgcaaagttcattgaaaatagtgaaataagtgggagtgaagttccacgagaagtggatattaaagaatttagagtgcaagtccttttagcctgtgcctttagctgtaagaattaccaaagggttgtaagagagttggttgtaagtgggtcttcaagactaaacgtgactctcatggctgtggaagcaaagcttcatgatgaatcaacaatgattcaaaagtgttttgatgataacaatgatgacaacaaaagatga

SEQ ID NO: 1553 - DNA, 306 bp, Glycine max
  Peptide Sequence Number=SeqID_93238
atgcggagacaaaatttggtcattccgcacccctttgccattcagacacagtcgtgtccgatggcgcgcagagacaaaaatttggtcattctgcaccctttgtcatccagaggcggcgggcccgatgacatgcggagacaaaatttggtcattccgcacccctttgccattcagacacagtcgtgtccaatggcacgcaaagacaaaatttggtcattctgcacccttcgtcaatcgcggccgataagcctgttgacacgcggagatttacatcatcttccgcactcacaagatctgtcatactga

SEQ ID NO: 1554 - DNA, 261 bp, Glycine max
  Peptide Sequence Number=SeqID_93239
atgacccacaccaagaacattgggcaaatgacttctgaggcaacaaaggaaattgctggcaagattatgcaatcacagggactcgcactacctcttaagcctgaggttggtccttcagctgctcgtgttagcacaaaggagagttgtgttgatccctcaggaacgatccagacatgtgtgactcggagaaaatgttggttgtacattgaagaaaatccctcctgcttggttgccataggagactttatgaggggtccataa

SEQ ID NO: 1555 - DNA, 399 bp, Glycine max
  Peptide Sequence Number=SeqID_93240
atgccagtttcggccgaagcaaaacatcagttgagctcgcatgaaatgatgagaatcatgaaactggccaaatacaggctaaaggcccaagtggagaaggacgaaggcccaagtggagaaggacaaagcccccgagtggagaaggatgaaggcccaagtaatccttgtggcgtctaccctgacttatcttccttcactggaagtggcgtctacctagacttatcttccttcgttggaagtggcgtctaccctgacttatcttccttcaccggaagtggcgtctaccctaacttatcttccttcaccggaagtggcgtcatccaaaccttcgtagcctgtatcaaacgatccgctcctactcaggttcacatcatctggtatcagagcttcagctcttga

SEQ ID NO: 1556 - DNA, 246 bp, Glycine max
  Peptide Sequence Number=SeqID_93241
atggggggttacctaatggttacccgcacctttcgtcaacccagggcaaacgagcccgttgacgcgcggagactaacatcgtcttctgcaccttttgtcgtcttgacccgtgaatcaggtgacatgcggtgttacctaatggttacccgcacctttggtcaaccagtggcaaacaagcccgttgacgcacggagactaacatcgtctgctgcaccttttgtcatcctgacccgtgaagtcaggtga

SEQ ID NO: 1557 - DNA, 149 bp, Glycine max
  Peptide Sequence Number=SeqID_93242
atgttgtatgcaaagaaggtggaaaaacacattaaagttgcgatttatctcaaaaacttcatgggttcagcgaaggtggaagaagacactgaagctgccattttttactccaaaaagcttccatttttatctgatttttatgtcaaaag

SEQ ID NO: 1558 - DNA, 189 bp, Glycine max
  Peptide Sequence Number=SeqID_93243
atgaggacgcgtagccctctaaaggcgagggcgtgcagtcctctacaggcgaggacatatagtcctctaaaggtgataggtactagtacccaagggtccacctttatgagaaagcaagagatcgactcatcgagaaggcagacgcatgcaacctttgttgtgaaatttggtaatgctgaccgcacatga

SEQ ID NO: 1559 - DNA, 177 bp, Glycine max
  Peptide Sequence Number=SeqID_93244
atgtctcaaggaaattttcaatggggagttttctcaccggaaagtgcaccgggtcgtcagcctaaattacaaaaccctcgatccctcgtcaggatgaatatccaagcttcgtccgcagatccctcatgtaagactacacccgatttagacaaccccattaggtttagactaacttaa

SEQ ID NO: 1560 - DNA, 249 bp, Glycine max
  Peptide Sequence Number=SeqID_93245
atggaggcaaaaccttcacgttgtggatgtgtcatgaggagtacccatagtcttccctgtgcattgaaacatagtgcatcatcatctgaggaaccaatacagagatggaatattccaatgctggatcaatttcatccgtgcatccaggattctattgaaaacattattggtgtcaaagcgaatggtaactgtggttatcgggcaatagctgccttattggtgtgggtgaagaatcatggtcattggtga

SEQ ID NO: 1561 - DNA, 366 bp, Glycine max
  Peptide Sequence Number=SeqID_93246
atggcttcagacttagaactggtgggatttggtaagatggatttcttcatgcttatcacgacttatgggaagctaggagacttcaatggtgccgagaaggtcttaggcttgatgaataagaatggttatgcacctaatgtggtgtctcagactgcacttatggaagcttatggaaaaggaggcagatataataatgctgaagcaatattccgaaggatgcagaaatggggccttgaaccttctgctttcacataccagataattcttaaaacatttgttcatgaagttgcggagaggttgtggacaggttgggaggatgaaaggatcgagaaaaatgaaaatagtgggactgctgtggacatagat

SEQ ID NO: 1562 - DNA, 360 bp, Glycine max
  Peptide Sequence Number=SeqID_93247
atgttggtggcgactctcgtgcattttcctttattggaagatgcacccttgagtctcactcgccctcccgccgaaggaagcaagcttcatgatgaatcaatattgattcaaagaagttttgatgataacaaaggtgataacaaaaagctcaaaggatcaagaaagaataagttcaagatgttcaagattgaatcaagaacacttcaaggttcaagaggaaatttgatttcaagaaacaagaatcaagtttcaagattcaagttccaagaatcaagatcaagattcaagactcaagattcaagaatcaagagaagaattaatcaagataagtatgaaaaagttttttcgaaaactgagtag

SEQ ID NO: 1563 - DNA, 873 bp, Glycine max
  Peptide Sequence Number=SeqID_93248
atgacgaatatcttcgagcgtgcaaggcgagttcaagacccagcatcgggtgctacaacaataaagtgctctaggagaattaccaagcaagcagctgcacctattattgaggatgttgagcatgtggatcatgtagatgacgagggttttccaggtgggccccacgttacatcagttttcatggactatgttcatcatgttgtagtcacagtttggaatggaaaggaacgtcctgtgttgaagttgtcttcccatggaagttgtcctcccatagagaaaattggcaggcctgctccagagattgaaggcttggtggaaactagtagtttccatctttcagtaggagaggtcactatcaccctggatgatgtggcattgttgctacatctgcccattataggcgccttctatagctttgaggctcttcatgtagaccaagtcgtggacttgttagttgacttgcttgaatgttggatctacgagcattttcctactattgtttcttttattgctactgaagattatcatgagaggaaaccacgtgtttgccgttggaaatctgggaagacattaccagcgtcgatgtatcataagcgattggatagattgacgtttgatattaccattcctccacaccatgctgctcaatctttatctatagaggatattgatgatagatggattcagttttttgaataccttgcactggtgggtcagatttgtgttgctcctggacagtgtacaacagactacatcaagtggttctacttcatatctcatcccttcatgagtctgacacaacctggggatcctcctagacatccacctgtggtgcacgatgatacgtttattgaaccagatcctcctcagtag

SEQ ID NO: 1564 - DNA, 333 bp, Glycine max
  Peptide Sequence Number=SeqID_93249
atgaccaaacatcaaagatcaataaagtatgatctgtcttattgggataattcttcagtcaaacgtagtgcatcatcttctgagcaagcaaaaccaagaaggaccatgcccatgttggatcaattccatccatgcattcatgattctattgaaaacattgtcaatgtcaaagctgatgaacttgcaaaatggtctgatgagtatatcaacctgcttggtggtatagacagatttgaggaattaaagcggtccctacttgttgatggattatccatggttaccatgaataagtggatgaatataaccgacatgggatatgtgattgcatcatag

SEQ ID NO: 1565 - DNA, 1245 bp, Glycine max
  Peptide Sequence Number=SeqID_93250
atggcgtctgggtttatgccattctgttcctcattctgttttgtgaaccggtctggtcgttacccccttcctgccgggcgattcactgctgtttgtcgccgggggttgtcggcgttacccaccaacgatctgaacgtgcaccttatggtggaactgatggtgattgccgcgattgtcggagactcggtcaactacaccattgttcgcgtgttcggtgagcggctgttcagcaatccggattcgaaaattttccgtcgcagctatctggacaaaacccatgcgttttatgaacgccatggtggaaaaaccattatccttgcgcgatttgtgcctattgtgcgtacattcgcaccgtttgtggcaggaatggggcatatgtcctatcgtcattttgcagcctataacgtggtgggcgcgctgctgtgggtactgctgtttacctatgcaggctatctgtttggcgatctcccggtggttcaggaaaatcttaagttactgattgtagcgattattgtgctttccgtcctgccgggcgttatcgaaattattcgtcacaaacgtgcggcggcaaaacaagcgaagcaaaaatggcattattcgcctcttatagcaaaactggcatacgaccaggttcaggcagaaaggttatcaatgagctggattgaacgaattaaaagcaacattaccccaacgcgcaaagcgagcattcctgaaggggtatggacgaagtgtgatagctgcggtcaggttctgtatcgcgcagagctggagcgcaaccttgaggtgtgtccgaagtgtgaccaccatatgcgtatgtcggcgcgcaaccgcctgcatagcctgctggacgaaggctctctggtagagctgggtagcgaacttgagccaaaagacgtgctgaagttccgcgattccaaaaaatataaagatcgtctggcctctgcacagaaagagaccggcgagaaagacgcgctgatcgtcatgaaaggcaccctgcatgagatgccggttgtcgccgctgcctttgagttctcctttatgggcggctcaatgggctccgtggtcggtgcgcgcttcgtgcgtgccgttgagcaggcgctggaagacaactgtccgctgatctgcttctcagcctccggtggtgcacgtatgcaggaagcgctgatgtcgctgatgcagatggcgaaaacctctgctgcgctggcgaaaatgcaggagcgcggtcttccgtacatctcgtgctga

SEQ ID NO: 1566 - DNA, 438 bp, Glycine max
  Peptide Sequence Number=SeqID_93251
atggccttgggagagggaacgaacgctagaaccgacgtgagggcgtcgggacctcataggctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 1567 - DNA, 447 bp, Glycine max
  Peptide Sequence Number=SeqID_93252
atggaagctgatctccagtatacgcaggaaagattgagagccgctggaagggatttggggactaccgtttacccagaggcaaccatgacggatcgtttgctctgtacctcggatgtcaatatgtacttcgcaagatgggcttctcgggatgaaaagctattacatatagatagacttggccccagaaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaggtatgaagcagctcatggagaagacgcggccactgccgccgctgtcagttcggctgccgaagcagacccgactctcttggcactacgcaccatctcctcaaacatag

SEQ ID NO: 1568 - DNA, 613 bp, Glycine max
  Peptide Sequence Number=SeqID_93253
atgagtcatcattcatctagtgttaatggcgagggtactagtcataaggaccctttatctagactcttagatgagttgagtttcctcaagttatggaaagaaaaactagaaagaaaagaaaaaggagaagagaggagcctaagtgaagaactttgtgactattatgaaggaaggcataggtcacatcttagacctcactcccataggagagaaaatgaaagaaagcctcaagaggctaacattaacctcccatacttccatgggaaggacaatgtaggggcttacttagattggaaaataagggtagagcaaaaacttaaaagaaagtctactttaaaatcttatggctctcactattatccaaagaaagaccagggtctaggcatcttaggggcagcaccttctaagcccaaagatgataaggggaagacaatagaaaagcaaccccctaaggctagtatgcaagaaaagactagctctataaagtgctttaaatgtcttggaagaggacacaatacttctcaatgccccaccaagaaaaccatgattataaggggccaagacatttatagtagccaagatgaggctactacttcaccttcctctagtgaaa

SEQ ID NO: 1569 - DNA, 420 bp, Glycine max
  Peptide Sequence Number=SeqID_93254
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaaccgaaagacatgcaaagcaccactggcagcagccactggtaattgatttagaggagttagtcttgaagtcatgcgccggttaa

SEQ ID NO: 1570 - DNA, 417 bp, Glycine max
  Peptide Sequence Number=SeqID_93255
atgactaaagcacgtcaaaagggggtacggaaagggaaaagagggaggtggttgccacccagctcgcccaggcgagctaggttgcttccaccagaaggcaccgccttctgttggaagatcctggaaggcccaagtgggcctgattgctatttgtaccctctgtttactaaatacaccccctctgcccttttttgccgattctttttccgtaatgttacggaactttacgaattacgtaatgatacttgttttctttccgtaatgtcacgaaaccttacgaattacgcaatcatcccttctttagcttcgggaatgttacggaactttacggattgcctaacgatgggtgtcaagtatctcaaagtggtcaagcgcgggtcacatcccaacaaacagatggtccccagacgaaattag

SEQ ID NO: 1571 - DNA, 108 bp, Glycine max
  Peptide Sequence Number=SeqID_93256
atggtgtttgggcattgggcatgtggaatggcagtcatagcaagggtttctccctcattctcatccttttcatttgccccagttttcgcattcatcaaagcaggatga

SEQ ID NO: 1572 - DNA, 462 bp, Glycine max
  Peptide Sequence Number=SeqID_93257
atggacaaactcaagaaaagactacctggagatcggaccaatttggttgacctaggacgaaattatagatcagaccaatttgcttttgtaaactacactgtaatttacaaaacaaaagttgaaaggaaagatattgagctggtagacgaggaagaagcacagattggtgttgatcgttctagtgcaacctctaataaatctgagatttataaggaggaagcacggaatgcagcacaaaagcataaaccaaagagggtggaaagtgtcaatgctgatgcagaagcctttgctgaagcactagaacatatgaggaaaagagatgcaggccatcaaagtgtgtcattggagaataagacaggagattcaactgtgctgaagataggagattcggctaaagttgtgataaaacaagacgtgaagggaagaaagcataaatatgggtttaacaacaataagcgttag

SEQ ID NO: 1573 - DNA, 312 bp, Glycine max
  Peptide Sequence Number=SeqID_93258
gataatgatgagaaaaagaataaagaaggagttgaaaaagaaaacgagaaaaatgatgaagtggtggctagtgaaatagtggaagagaaagtggtaagtgaagaacagaagcagaaatcaaagaaacaagccactaacaaaggtaaagctatagtaaatcatccatcaattaagcatcttccttatccgcatgctccatcaaagaaagataaagaaagagctatcattgcattgcctggggacaggcctatttttcaagaggaggatgaagacatgacagatcttgttgattatttcattggaggagactaa

SEQ ID NO: 1574 - DNA, 324 bp, Glycine max
  Peptide Sequence Number=SeqID_93259
atgaaactaaggctaaaatcaactcgcaaagtcaagctcgtccgcaaaaaatcactaaaaaggattttaaggctgttgtcctttgggacaaacgtgagaggtgctaataccttcctcaaatgtaaatacaactcccgaatctggaatattcttcatgaccggtttccttcggtttttccgacgttttccacaaataaacgttggtggcgactccgcgcattttcctcctttggaagatacacccatgagcctcgcctcgctcgcccgcaaaagggtaggttgcgacagttggcgactccactggggattgtttttgtgagttag

SEQ ID NO: 1575 - DNA, 48 bp, Glycine max
  Peptide Sequence Number=SeqID_93260
atggaacacgcatcccacgagtcacgcgtcgccctcccgccgaaaggg

SEQ ID NO: 1576 - DNA, 123 bp, Glycine max
  Peptide Sequence Number=SeqID_93261
atggtgaatgagtccgagatcgtcatttttctgagacaggttaggtggcctgcgggaaaaagagagggttttgagagaaaagagaaaaaacgaaattgtgaggcagaggaggctgaggactag

SEQ ID NO: 1577 - DNA, 327 bp, Glycine max
  Peptide Sequence Number=SeqID_93262
atgcatatcgagaaaaatgtttgtgatagtgttattggcacgcttctgggcattcaaggcaagacaaaggacaatttcaatactctccaagatctagttgagatagtgaagcaaaaaactgttgcggtcccgtttatttggggtggcatgtacctggttaagcgatacatgaagaacttaaaagggagaagacgtgagaggaggcaccatctactagagaataagccatggaaggagaagcttcaacaccaagagagtgccttggataagaagcttagagaggaagcttcaatcgaagaaaagaatgagatagaggagggggcatga

SEQ ID NO: 1578 - DNA, 441 bp, Glycine max
  Peptide Sequence Number=SeqID_93263
atgtgggatgctaccatattcggggtgtttaatcaaaatttcccattgtatataaagcacgaagatctctctgaaattgcacacggtggtcaatgtctcagcatatctgttatacagttgtggattcttcatctgattgagacaagtgtgcgagcggggaattccgatgtgtatgaattcctcgagccacagtccaatcagagatctaggcaatcacaatttgaatccgaaagttacatcaagagttggatacagagttcaaaacgagatgtttaccttggagcctacctgaatgggtcagacaactaccttaagggaataattaacagtgctttgaaaggacttgatgatgctccacaaccgaaatcaaaggctgctgctaggtggattgttgttaagtgtatagacaaaaaggaatcactaaatgtggctactatatga

SEQ ID NO: 1579 - DNA, 516 bp, Glycine max
  Peptide Sequence Number=SeqID_93264
atgggttctccacctgcctcccctcctcctcatgctccttcgaacatatcggcttcaccgtctgccgtgaagcggacacgcaaagccttacgtctacgatcattgtctactagaccacctggtgctgagagaccagtggtccatgttgatcctgctaccggcaaggccgacggtccccacaggaagaaattaagaacatatttggggattgtggcgtgtgataaggtggacgtcacctacgagaacaggaaggaggtccctactgctcagaaggacctgatttgggaggatattcaggcggaatttgatatcccagaggcttttgacagtaggacgaaaaggaagttacttcagaccatgggcgagagatggaggcagtttaaatcagacctcacgaggaaatgggtccttgcagccgatcaggacggtatggaggacattgtctctgagaaatacaatattagcatggaaaaatgggcccagttttgccagactcgcagagacccttcttgggag

SEQ ID NO: 1580 - DNA, 366 bp, Glycine max
  Peptide Sequence Number=SeqID_93265
atgtcttacctagcgatcacaactccgatctccctctacctaagtgccagttggtgtatggcgcctaccaggcaccctctagacccagataagtccaacaaggccctggggtttccaatgctgatcacgggcctctgccagtcattcgaagttcccgtcacccccagtaaagtaatccgaccgccgatcacccgggccttcatcgagaagtactgcacacctaggaaggcgcagggtgatgccctactccgaagcagtttggggttgaggtcgcatggcccggagactagcccgaggcccaagcaggggaggagcctgcaagatccaccggtgaggcagatgaatccgatatggatgaagagatga

SEQ ID NO: 1581 - DNA, 96 bp, Glycine max
  Peptide Sequence Number=SeqID_93266
atggagcctctcaataacaagtttgatggtatgacaacttcaattgaaatacctaagacaaactctaaggaagctcatgctaaaggggttacttga

SEQ ID NO: 1582 - DNA, 921 bp, Glycine max
  Peptide Sequence Number=SeqID_93267
atggagataacagagagcttagaagatggaatcctggaaatgaacagtgtttttagccaaatgaatgattcatttaaaaatctgagtagtgatctggatgatgtcactaatgagagggatcagcttcagggtcaggtaatttgcctcaaaagcaggcttgaaaaagatgaagcacaagctgaagctaatgaagcaattgctaaagaagctcagaaaacttttacggatcaagttgattcgtatgagtgttgcggatcaacttggtccgtacgagtcttacggatcaacttgatccataagactcgtatggatcaacttgatctgtattatccttatttcatctgtaatcctacatactattacggatcatctatatcctacttgatccatctactaaatccctatgtggatcaacttaaacacattacaaaccaaaaaagaagcagaaaccaaaaccatggggagaataggcttacctcgacgtcgacggtggagcacagcccaattcacgtcttcaatgtcgtcaatgcaaagctccaaagcacaacgcagagacaaacgaggatgaagaagaagacaatgacacaagaagaagcagagtggcctaagaagaggtcaagaagaagagtcgcgagtagaggtagagttgaattagcactctatcaaactgatcttgcttatggaataaagaaagtattgaaaaaaactaaaagaaaaaagggtgggggctcttgtgatgatgatgacctatggaatggacatgtcatggtgacactgcatccatttccatattcgaccaattcgatgtattcgaagatcaaattcatggagataaagctttttcaaaccttcccatacttaatgaagatgatgcatgatgataaggatgaagatgttaaatacctagagagagaaaaataa

SEQ ID NO: 1583 - DNA, 183 bp, Glycine max
  Peptide Sequence Number=SeqID_93268
atgtgcttgatatatgacttatttaaagaaacaaaaatatgggatgacacaaaacggacatggttgggtatcagtttttttcatttctgtgaggaagggaagcgtgattcacaggatctcaaaagcaagcttccagagaaggaaaattttggctttccagtatcagatgttggagctttgtag

SEQ ID NO: 1584 - DNA, 237 bp, Glycine max
  Peptide Sequence Number=SeqID_93269
atgtgggccatcattgaccaatacaaggagaagctaagtctagcagcaacccatgaacaaaggctagaggacgagtatgcaaaggtgtcagtcttgcaagcagaaagggaagcgagagaaagagtaattgattcattacacagagaagcaatgatatggatgcataggttcattttcaccttgaatggaagtcaagagcttccaagattgctagccaaagctaaggcaatggcggac

SEQ ID NO: 1585 - DNA, 630 bp, Glycine max
  Peptide Sequence Number=SeqID_93270
atgagggcacacttgttgaagatgactggaaagggagttagaggttatcaaaaggtaacagttgacaaacttatagatttaaagaagacagtcaatgaggctacattgagggtggagaagtcaaaaacaaaatctatgtcattgcctccgatttctactcaataccaaatggatacaaacactcttggtgttgatccaaaaaagagaaagacatcaactatagaaagtgcctttaatttgcaagctagagagacacttaatcatgaaattgctaggatgttttactctttggggatgtcttttcatttagcaagaaatcctcattataggaaggcgtttacctatgctgccaacaatcatatcggtggttaccaacctccaggttataataaattaaggataacattacttcaaagtgagaggagacatgtggagaacttgttacaaccaaataaaaatgcatggagccagaagggtgtgaacattgttagtgatggatggagtgaccagcaaagaagatctcttattaatttcatggctgtcacggagagtgaacctatatttttaaaggccattgattgttcaaatgagattaaagacaagaatttcattgccaaacatatgagggag

SEQ ID NO: 1586 - DNA, 129 bp, Glycine max
  Peptide Sequence Number=SeqID_93271
atggataagagcttgaaggtagaagaagatgagtggaaggagaaggagagaaggagcacaaaattttatgcctcaaaagagcccactaatccaagatcaagtccaatattctccactaagtgtgcttag

SEQ ID NO: 1587 - DNA, 348 bp, Glycine max
  Peptide Sequence Number=SeqID_93272
atggtgcagcccaaaccaagtgctggccttaaggggaaacctcaccaacatgctctcactttcatgctttcttgtgtttcaacaaacaaaggcttgggcccccttggcctaagtcatgttttggcatttatcctaatcctcgcaagctgtccgcatccaaaaatggtgcaagagttctcgcccaggcgagctcagctcgcccaagcgagctcagctcgcccaagcgagctaaccctgtatttatattatttttttgggaaaacacaggatactaggctgcctcccagccgcgcttcctgcttgtccggagctgggcttgggacgacgatccatcgatcatgggcctag

SEQ ID NO: 1588 - DNA, 644 bp, Glycine max
  Peptide Sequence Number=SeqID_93273
tatcggccagctcctgggattatcctttagtgctggaagagggtcaggagtgcgagtatggccagaggaggaaccggtccgatgagttcgatgaggaagccatcgcccatttgctatgtataccggggcaggattttgcccgaactgctgccgggagacaggtgcggatcatgcgcaccaacatgaccaccttgactcagatctggatgactttgctgctcagcaacatccagcccagcgaccataattccgacctccccctgccgaagtgtatggcgcctaccaggcaccctctggacccggataagtccaacagggccctgggatttcccgccttgatcacaggactctgccagtcgttcggagtccccgtcacacccagcaaggcggccaaccaccgggctcatgtacaaacctatgattgtctttaccagatgagcctcagcctgcaaggccagggttttacttcttttccgtgccctactccagaccgtttcagggcagaggttgcatggcctgaggcccgggcaggagagccacccgtagaggcaccagcagaggctcccgacaaggcagatgaggcccgcgaggacgaggagatggccgatttacttgatttcttaggagggagcggggccacatga

SEQ ID NO: 1589 - DNA, 126 bp, Glycine max
  Peptide Sequence Number=SeqID_93274
atgtgcaagttagctcgcctgggcgagctgggctcgcctgggcgagctgggctcgcctgggcgagctgggctcgcctgggcgagccaccccctgcaccaaattataagaatgacgaaaggggggac

SEQ ID NO: 1590 - DNA, 173 bp, Glycine max
  Peptide Sequence Number=SeqID_93275
agcagttcagggctgaggtcgcgtggcctggagattggcccattgaggagggaacaggacccgctggatccccgggcgaagcggaggaagcccacatggatgaggatatgaccgacctgctcggttacctggaagagggcggagctacacgactgaggtcgccacacttgtga

SEQ ID NO: 1591 - DNA, 549 bp, Glycine max
  Peptide Sequence Number=SeqID_93276
atggtgaaagttggaacctcttacgtgccgatcaacgtctcattttcgccaaaagttggcccagggcttcccggtatcaacagggacaccaggatctatttattctgcgatgtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctagcggagtgtatactgggcttactatgttggcactgatgagggtgtcagtgaagtgcttcatgtggcaggagaaaaaaggctgcaccggtgcg

SEQ ID NO: 1592 - DNA, 513 bp, Glycine max
  Peptide Sequence Number=SeqID_93277
atgaagcacttcactgacaccctcatcagtgccaacatagtaagcccagtatacactccgctagcgcccaatacgcaaaccgcctctccccgcgcgttggccgattcattaatgcagctggcacgacaggtttcccgactggaaagcgggcacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 1593 - DNA, 168 bp, Glycine max
  Peptide Sequence Number=SeqID_93278
atgaaggatttcttgaagaaaagctggtacattgatagcggatgctctaaacacatgataggagatgcatcaaaatttactcatatatctcccaagaaaagtggacatgtgacttatggagacaacaacaaagtaaagatgatgattcttggttatggcatagaataa

SEQ ID NO: 1594 - DNA, 296 bp, Glycine max
  Peptide Sequence Number=SeqID_93279
cagaggtgatggcggtgcgtctgtttcccgctgccgaccatcccaatgctgctgtggtgtttcgccctgcgcctgtctggggcgcagtacttcttgatgaaagctcgattagtagggggcctgatgcccttgctggaggtgacaggtactccgtagaactgacagagacccgactgatagaggcccgtaaccagagctggaaaccccagggccctgttggacttcttcaggttcactgggtgtctttgtggggggagattggcattgcggtcgctgggcagaatgttgctaagtag

SEQ ID NO: 1595 - DNA, 333 bp, Glycine max
  Peptide Sequence Number=SeqID_93280
atggggttctcagttgaaggaaatgaacacatggtgtgcatactaaagaaatcaatatacagtcttaaagcaagcttctcgccaatggaaaatacatgtttatcggtgtatgtatctgaagctaacgatcttggtcttcttcatgagactaaaaaatttctctctagaaactttgaagtgaaagatatgggtgaggctaattggctgcggaactttatttcagggcttggaattgtcgacagtattgctaggccgctgaaaatgtattgtgataactccgcaacaatattttttgtaagaacgacaagtactctaagggtgctaagcatatga

SEQ ID NO: 1596 - DNA, 59 bp, Glycine max
  Peptide Sequence Number=SeqID_93281
atggatcaagggatctcccaatcatgtgactctgcatgccaccggtctcttgggacacg

SEQ ID NO: 1597 - DNA, 681 bp, Glycine max
  Peptide Sequence Number=SeqID_93282
atgcagctggccggtcccggcgtatttggcccgccaaaagatgaggcccgcgcgttacaggtgctgcgcgatgccgtggctgccggtgtgaatcacatcgacaccagtgatttttacggcccgcacatcaccaatcagctgatcaaaaaagcgctctatccttaccccgacgatctggtgctggtgaccaaagtgggtgcccgacgtgatgccaaaggcggctggctgcccgccagcacgccggaggaactgacgcaggcagttgaagataacctgcgcaatctcggcctcgacgtactggaggtcgtcaatttacgctcgatgctgagcgttcatggaccggcagagggatcgctggagccgcaaatcgaggcgatgattaagttgcagcagcgtggcctgattcggcacattggcctgagcaacgtgaccgccagtcaggtggcgcaggcacagcagatgacgccgattgcctgcgtacagaatctgtataatctcgccaatcgtcaggatgatgcgctgatcgaccagctggcggcgcacagggcattccctacgtgccgttctttccgctcggcggtttttcgccgctgcagtcggaacagctcagcgcggtggccagcacgctcaacgccagtacgctgcaggtggcgctcgcctggctgttacagcgtcagataa

SEQ ID NO: 1598 - DNA, 246 bp, Glycine max
  Peptide Sequence Number=SeqID_93283
atgcatgagaacgaatggcacggagcgtgtttgctctttgcccctattcgggaacctataggacaatatctaggggaaaaccgaaggaaaccggtcagaatgaaaattctaagttcgggagttgtatttacgattgaggaaggtattagcacctctcacgtcgacaaaagcggggctcttgctcctacgtaccctccatcaaagaggaaatcagacctacgtagttcttccttgtgcgtgaatcaa

SEQ ID NO: 1599 - DNA, 264 bp, Glycine max
  misc_feature (13)..(13): n is a, c, g, or t
  Peptide Sequence Number=SeqID_93284
atggagcagtatntacggcattggttcgccagcaggcagccaaccaccgagcacatgtacggacccatgactagccagggcttcgctcccttttcatgccctactccagaccagttcagggcagaggttgcatggcccggagattggcccgaggcccaagcaggagaggcatccccagaagctcccggcgatggagaagaagcccacgaggatgaggagatggctgatttgcttgacttcttgggagggagtggagacacgtga

SEQ ID NO: 1600 - DNA, 462 bp, Glycine max
  Peptide Sequence Number=SeqID_93285
gtgtggatgtcgagcacactgaaaatgaggacacgtagccctctaaaggtgagggcgtgcagcgcctctcaaggcgaggacagtcctttcaaggtgagggcgtgtagccctctgacggtgagggcgtgcaaccctctgatggtgaggacgtgtagtcctctcaaggcgaggacgtgtagtcctctaaacggtgagggacgtgtagtcctctcaaggcgaggacgtgtagtcctctcaacggtgagggtaactagtacccaagtacccaaggtgaggacttatagccctctcaaggcgaggacgtgtagtcctctggaggtgagggcgtgcagccctctgatggtgaggacatgtagtcctctcaaggcgaggacgtttagtcctctcaaggtgaggacgtgcaatcctctgaaggcgaggatgtgtagtcctctaaaggtgagggcatgtagccctacgaag

SEQ ID NO: 1601 - DNA, 699 bp, Glycine max
  Peptide Sequence Number=SeqID_93286
gccttcagccccgatgccgaacagttggcgacgctcgctgccaccaccagcgatttcgcttcgtctaccgatgacgccggaacagcagatggtgttgctgaaagtgtcggcggccgccaccttctccgcgctggtcggcaacgtgctgctggtcggcgggatgttgacgctgattcgtctggtgtcgcaagggcaacgcaccagcgccctgcgcgcgctcggcgcctcggcgcccgacttgccgcgcctgctgctgctgctgtttatctgcaccctgctgatccagcttggcctgacgctgtttgtggtgccgggcgtgctgatggcgatcgccttcgcactggcgccggtgatcgcctcggtcgacaagaaaggcgtgttcgcttcgctcaagctgagcagcaaactggccttcgccaatgcgcgcgtgatcgtgccggcgatgatgctgtggctggcggccaaactgctggtgctgtttttggtgagccatctgtcggtgctgacgccgaacgtcgccagcgtggtgttgaccgcgttgagcaacctggtgtctgccctgctgctgatctacctgttccgcctgtatatgctgctgcgcggctaacgccggcgtcagcgaaaatcaaggggcacgcttcggcgcgccccttttttgtttaccccatcacggcggcttccgcctgctccttactctga

SEQ ID NO: 1602 - DNA, 615 bp, Glycine max
  Peptide Sequence Number=SeqID_93287
atggccgtcgttggcgtcctcgcgctgcaaggatctttcaacgaacacatagctggcacgttaggggtgcaaggcgtggagattcgaaagccagagcagcttaacacaattagttccctcattatccctggtggagaaagcaccaccatggctaagctcgccgagtatcacaacctgtttcctgctttgcgagagtttgtacaaatgggaaagcctgtttggggaacctgtgcagggcttatattcttggcaaataaagctataggacagaagactggtggtcaatatttggttggtggacttgattgtacagtgcatagaaatttctttggcagccaggcccgtcatggaggtgccataaggtggaatggtgtgtttatatggcggaattttggccttccgccatccgccattgataacatttattacaactttgaggcagagctttcagtgccggagcttgtctccaaggaaggaggtcctgaaacattttgtggaatttttattcgtgcccctgcaattcttgaagcagggccagaagttcaagtgctggctgattatcctgtaccttctagcagattgttgagttctgattcctctattgaagaccaaacg

SEQ ID NO: 1603 - DNA, 117 bp, Glycine max
  Peptide Sequence Number=SeqID_93288
atggccaacgtccatacacagtctccaaagatggaaatgattgataatttgttcaagaaagcttctgacaaagaggatgaaggcatagtgagagagcttctacttgaattcatttaa

SEQ ID NO: 1604 - DNA, 303 bp, Glycine max
  Peptide Sequence Number=SeqID_93289
cttaccaagtgcatatgtgcaaatagaaatcctgcttatgtgactataaagatagacaaccagaagtttgcaaaaaccagccaagaaataaaccgtgtgtggaaccaaacttttcagattcactgtgctaatccagctgattcatgcatcaccattacgctgaaagcatcatgttctttggtattaggaaaattcgatattcaggctcagcagctattgaagaaaggaggcttcatcaacggcttcttcccgatcctcatggataatggaaaaccaaacccaaaacttaagttgaagttctag

SEQ ID NO: 1605 - DNA, 531 bp, Glycine max
  Peptide Sequence Number=SeqID_93290
atggatagtgttgttggtaaagagactagactagagagactagagaatgttgatgacttgatgagctaccaaatgatttttaagaagcacgacataagagtatgtaactacaaacattgcaatgaaattattaccaatgcatatgaaaagcgggatacattgtacatctgcacaagcttcaatgagaagtctccctatccaattgttgtgcttcaaacagtgatgaacctgatttggcagaagcagaactggatgatagtctttgcctccgtgctttatcagctttttccaagtaatgttgatgagattggtgtttggtccctgcaaggaataagaaaccatccagagaaaaatgttgtcaatctcaatctaaaaatgaatctcaatccattgtcattgaagcatcagattctccagtcaattcatctagagtccttagggatgatgggtctcaaagtttcaacattggatccatcggacagtgttctcttccacctccatatcatgaggcaaaactttagcagattctaa

SEQ ID NO: 1606 - DNA, 876 bp, Glycine max
  Peptide Sequence Number=SeqID_93291
atggcgactaataagaggtgtcaaaatgaaattgaaattgaagagcatcctgagtgggagattaagaatggtagtgtctttttccaaaaggcaaaagaatctgcaccttgcaaagaaataccctccctgcagctcatcaaccaaacgcttagttatgcttacacttttgggcaaccaaaatatggtcattttaaagagcttcatagggctatcaagatgtcttgtttactgatcctagctaacagtcaacatttcgaggctcatgtatacactacggaatctggagattgtactgcttttctctccaactatgactcaaaatcctctgctagagtgatgttcaacaatatgcagtatagcttgcctccttggtcagtcagcatcctcccagactgcataaatgttgtcttcaacacagcaaaagttggagtgcaaacatctcagatgcaaatgttgccaacaaatactcagttgttctcatgggaaagttttgatgaagatatttattttgtggatgaaagctcagcaattactgctcatggtctcctggaacagataaatgtaacaaaggatgcaagtgattatctttggtatataactagcgttgatataggtttgtctgaatcctttctacgtggaggtgaattccccactctcattgttcagtctacaggccatgctatacattttctgcctttggaacaagggagtataggagattcacatatactggcaagaatgtgggagaacactttgagtcgtgaagcacaggaatccttggtccagttgcactccatggacttgactagggaaaatgggacttgtcagggcagaaatggagttatcaggttgcatactcatactttagatacttaa

SEQ ID NO: 1607 - DNA, 234 bp, Glycine max
  Peptide Sequence Number=SeqID_93292
atggtttgcactaatagcaggaagaaattaagaaatattccccaattcaaccctaatcccatctttgacacccaacttgttccctttaaacccttaattttgaaacccatcaacccgccccgatgtggtagggttgcaattgcggcagaagaaggggtggtaggcattgcggtcgatggtggttgtggagttgcacaaagggacgttgtggctactggtggtgtgcgccgataa

SEQ ID NO: 1608 - DNA, 147 bp, Glycine max
  Peptide Sequence Number=SeqID_93293
atgtgggggataccttatggttatccgcacctttcgtcaaccaaggaaaacgaggtcgatggtttttacttttgtcatccggagacattcaagcccgacgacgcacgagattcttctctgctaggtggggacgatcaagttcgatag

SEQ ID NO: 1609 - DNA, 319 bp, Glycine max
  Peptide Sequence Number=SeqID_93294
gctagcctctagctcgcctgggccaccaaatgccttcaaggttaagaaaccagctcgcctgggcaagcttatgactttaggactaagccttagctcgcctgggcgagctgcaagtgccccaagtgacccttttcctataaataagcgtgctaggggggctgagagggggttccatcatagagtagtgaaggaaattgagagaattaagagagaagaagaagaaagaagaggaaacgaagctgaggcgctgccgaatcacgattgtgatcaatctttacgttgttccttgttcagtgttcttcatgcgaacgtcagttag

SEQ ID NO: 1610 - DNA, 488 bp, Glycine max
  Peptide Sequence Number=SeqID_93295
gcaatccatctgacatacaaccctttgatcctgagatagataggacatttcatagattagttaggcatcattttataccttttgatcatcctgagcattccattactggtgaatctgtgcattctgttattggtgattttgaacatcctgattttgagcattacaattttgagcattctgattttgaacattctgagaacatggcacaacctccaccccgtgaaaggactctaaggaaaatggctgcacctgatttcacctacgaaagcttgtgcatccaatacccggatgaggatgtcccatatgttcttaaaactggactgatccatttgcttccaaagtttcatggccttgcaggtgaagacccgcacaaacatctgaaagaatttcatattgtctgctccaccatgaaacccccagatgtccaagaggatcacataattctgaaggcttttcctcattctttagagggagtggcaaaggactag

SEQ ID NO: 1611 - DNA, 139 bp, Glycine max
  Peptide Sequence Number=SeqID_93296
atggtcataaatggtaggataggaatgtacaggaaatgtgggaaaagattaagaggcactaggataagcataagggaaacaatcttcatggaaaatgacatgtctagataccattatgactatagaggaaagatcaaag

SEQ ID NO: 1612 - DNA, 572 bp, Glycine max
  Peptide Sequence Number=SeqID_93297
atggggaattttgtggaagagagatgggaatggaagctaacatggagaaggaacttttttgaccatgaaattgacatggtagctgattttatagctgacatcgagtcaggcaacgtcaatcactccaacagggatttcctttgttggaagtctgatcctaatggcctatattccacaaagtctgcttacaaagtgctgcaggagggccatgctagtgctattgaggacagggttcttaacatcatgtcgagtctgaaaattccccaaagagctagtgctttttcatggagattattcaagaacaggctccctactagggataatcttagaaggaggcaacctatgagatgggttaatagagtgggtcccttccccactgacccaaagaatcattttctgcaattctctcagtggaataggccaagctacacagtcaagagatgggaatttctctggatagctttgtcagtgtccatttggcatcacagaaatggcatgattttcaataatcagccttttaatccagaaaaggtcatggatgaggctctattccacacctggtcctggctcaa

SEQ ID NO: 1613 - DNA, 303 bp, Glycine max
  Peptide Sequence Number=SeqID_93298
atgacaccggtaaaccgaaaggcaggaacgggagagcgcacgagggagccgcaagggggaaacgcctggggggcggagcctatggaaaaacggctttgccgcggccctctcacttcccctgttaagtatcttcctggcatcttcccaggaaaatctccgccccgttctaagccagtatacactcccgctagcgcccaatacgcaaaccgcctctccccgcgcgttggccgattcattaatgcagctggcacgacaggtttcccgactggaaagcgggcagtgagcgcaacgcaattaatgtga

SEQ ID NO: 1614 - DNA, 426 bp, Glycine max
  Peptide Sequence Number=SeqID_93299
atgaagaacgatgtagagattgatcacagtcgcaatctggtagcgcctcgacttcgtttcttcttctttcttctaattctctcaatttcgttcactactgaatgctccccctatcctcagctccccttcacgtctatttatagcaaaaaaaagcatttgggaccacggcagcttgcccagggaagtaaagataaggacactaattttgttcgagcgatctcgctatttgacaaggcaactggcgaaaaccaagtgtcgcaacctacccttttgcgggtgagcgaggtgaggctcacgggtgcgtcttccataggaggaaaatgcccggagtcgccaccaacgtttattgaaaggaaaacgttagaaaaaccaaaggaaaccggtcatgaagaatattccagattcgggagttatctttacgtttga

SEQ ID NO: 1615 - DNA, 387 bp, Glycine max
  Peptide Sequence Number=SeqID_93300
atgcggggttaccttatggttacccgcacctttcatctaccaggggaaaacgagcccgttgacacgcagagactaacatcgtctcctgctccttctgttgtcctgactcgtgaagttagtcaggtgacttgcggggttaccttatggttacccgcacctttcgtcaaccagggagcaaatgagcccgttgatgttcagagactaacatcgtcttctgcaccttttgccatccagggacagcgagtcaggtggcaggcggagataccttatggtcatccgcaccttcgtcaaccgaggggaacgaattcgacggttttactctcgttgtccttaaacattcaagcccaacgacgcacgagattcttctatgctgggcagggacgatag

SEQ ID NO: 1616 - DNA, 468 bp, Glycine max
  Peptide Sequence Number=SeqID_93301
atgattatgaggagccaagacatttatagtagccaagatgaggctactacgtcaccttcctctagtgaaagtgaagaagcaaaaggggaagaatctagtgaagaaatctacccccaagaagaaggacaacctttaatggttaaggaagagtgtaaggaggtaaatgtctcctccaagaggttagttaagaaggaaagtcattttgaaataaagacaaatattaaagaaacttcccctcttagacaacctccacatcttctcctttgtaaaaagacacttgttagcactgccacacctcttgggcttgaggttattcctcaagtaaaggagttgttggatgagggtttggttcgtaagagcttaaatccttgtgctttgttggtgcccaaaataggttttgttcaatgtatttacttgttggtcttcaatgaaatcgtcagttacttttggttgaatgtgtacttctaa

SEQ ID NO: 1617 - DNA, 117 bp, Glycine max
  Peptide Sequence Number=SeqID_93302
atgaagacgaagctggtgtttgctacccgtgatgatgttttgaattgggctcaagctgttgcttatgaaattggttttgtggcagtcattatgaggtcagacacaaacattgtatga

SEQ ID NO: 1618 - DNA, 836 bp, Glycine max
  Peptide Sequence Number=SeqID_93303
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgcgctacctgctgtacctgcggcttttcgtcgtactgttccggcatgttgttggcgatccgacgcatctgctcacggtcgagttttggtttgctggctgtcacgcctgcctgttgcttgttacggttgatttcgagttgggtccacttatcgcggagtttggccgggctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaa

SEQ ID NO: 1619 - DNA, 210 bp, Glycine max
  Peptide Sequence Number=SeqID_93304
atggatgtggccagtaaaggcagaaacttcaaggaccatcgtaaagaagatcggagaatgttgtcattgtcgaagaacagagaaagcatgtcattatcatcatcaagcaatgcctacaacgtgccatgggtagaaaagtatcgtcccatcaaggtcgctgacattgtcgtcaacgaggacgccatctccaggaaactgttctcaaactaa

SEQ ID NO: 1620 - DNA, 519 bp, Glycine max
  Peptide Sequence Number=SeqID_93305
atggctacgcgccctctccttcaaaggaatacatgtcctcgccttcagaggactacacatcctcgcttacagagggctaaacgccttcaccttcagaggactacacgacaacacgtccttgccttcagaggactacacgtcctcaccttcagaggaatacacgtcctcgccttcagaggactacacgtcctcaccgtcagagggctacacgccctcgcctttagaggactacacatcctcacctgcggaggactacatgtcctcgccttcaaaggactacacatcctcgccttcagaggactacacgtcctcgccctcagagggctacacgccctcgtcttgcctttagaggactacacgccctccccatcagaggactacacgtcctcgccttcagaggactacacgtcctcaccttcagagggctacacgccctcgccttcagaggactacacatcctcaccttcagaggattacacgtcctcgccttcagagggctacacgtcccccccttcgtag

SEQ ID NO: 1621 - DNA, 222 bp, Glycine max
  Peptide Sequence Number=SeqID_93306
atgagcaagaggcttcaagaggattgggctagagctgctgaagaaagccctagggttctcatgaacctcaggctattggagggtagcccccctctagcttctcaaggaaactttcttccttgcttcccaaggaagctcccttccttgcttctcaaggaagcttcctattgtattttcatgtattttagcatgggggtgagcttagctattggaagggtgtga

SEQ ID NO: 1622 - DNA, 417 bp, Glycine max
  Peptide Sequence Number=SeqID_93307
atggaggggcgtctgttaattggttccctcgctagaaggaaggaagaatcaggattctatcttcatgcgaaggatgagtgccatcagacgaaagcatcacgcctttcatcgcacggggtttcaatgaccacaacgcgagggtactccaaggagttcgcaaggcatgggatgcggcatgaagaaaggacagagagcttaggggaagcaactgtgagagacgatgaggttaaagcttcggaagaaagtgatgaggtacaagccctaaaggcagagcttgaaagagcccgggttgtcgaagagaagttcaagtccatagccatcaaaggcagcaatagtgagctcaaactccgaagagtgaaaggaatcatcacgggtcaaaggcatgatctggaaggacgagctaaaggcttgccttag

SEQ ID NO: 1623 - DNA, 489 bp, Glycine max
  Peptide Sequence Number=SeqID_93308
ggcgaattggagctccaccgcggtggcggccgctctagaactagtggatcccccgggctgcaggaattcgatcgtatctgtcactgctgctcctgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 1624 - DNA, 243 bp, Glycine max
  Peptide Sequence Number=SeqID_93309
atggatgctcatccgcgtcaggatggcgtacaccagctgacacttcggcagggggaggtcggaattatgatcggtgggcaggatgttgctgagcagcaaagtcatccatatctgagtcagggtggtcatgttgtaactgggcgatggcctcctcgtcgaacccatcagaccggttcctcctctggccatactcgcactcctaaccctcttccagcactaaagggtatcccaagagctggctga

SEQ ID NO: 1625 - DNA, 501 bp, Glycine max
  Peptide Sequence Number=SeqID_93310
atgaccggtagattgctggtcggatcattgacctttgataatcgcatcatgcactacattattgttagaattttgcttccccagtcttcaaatttggctcaagcctctgaggaggacttgattttgatgtgggcttcccttaccggttgtcagatcgactgggctcacttggttcggtatcaaatgcataaggcattacgggccaatgcacctctcccttaccctcaattgagtaaggatcagaatggtcaatggctgaagaaagatgcacttcctccacaagataagcgtactccttctcctcctcctcagcgagatgattcagcccttatgactgaagttcttttcgagttacggggtcttcgtacttatgttggtgaacgttttgactctttggataattgctttgcaggaatggatatctgtctcacacagcttgaagaagatgtgggttatattcgtcagaccttcgatcttccaccaccacctccaccttcttag

SEQ ID NO: 1626 - DNA, 276 bp, Glycine max
  Peptide Sequence Number=SeqID_93311
atgcacgtgaatcgtgaagaaaccgacctcaaaacgccgcaaatagatggatcaagctcgcacattaccaatccgaggatgcatgcactgacgatcaccactgacgaggaatcgagctcaatttcggaaaccgcgaaccgtgaacagacgtggtgttcgattcaaggaaaacggagccactcatggaaatcaccttcgaagctgaggctcggtaataaaaaccgaagctgggatggaggttcgggcgtacctagcttttccgtactggagtattga

SEQ ID NO: 1627 - DNA, 285 bp, Glycine max
  Peptide Sequence Number=SeqID_93312
atggcaactggaaaacagtttggtgatgttgtgacttctcaataccatgacaaatgcaattggggagaacttcatgaacttcatgaaacaaagaaggagaactttaacaagcttatctgccaggccatatggggggattctaatgtctcttgggacagtgttccctcagtccacacatctggtggcctgctttgcatgtggaacaactcagtttttgaggtggacaggagggtgaaaggcagaaatttcttaatgcttgtagggagatggactaaggataattag

SEQ ID NO: 1628 - DNA, 546 bp, Glycine max
  Peptide Sequence Number=SeqID_93313
atggctctcacaaagattgctgtaaagcaactcatgttgaattatttgttgggagatgctaggttaggttcggtgaaggtgaaggtgctaatgttcattgttgtgatggttggttcgtcagcagtggcaaacgagatggacgaaaatcagtggatgtatgaaagtataatgtctaaagaagtggatatgaattatcaaaatgaagaagaatgtggtgcgaatgaaccacgtgttggttgttccattgcgctcaatacttctcaggtgtttgacaaccgagaggatgttttgcggtgggctcgatccgttcttcatgaaaacggatttgtggtggtgattataaggtctgacacaaacactggtagtagaggaaggacttcgtttgtgttaattgactgtgaaaggagtgacgagtataggtgtaggaagaaagaatttgttagaagagatactagaactaggaaatgtgggtgtcccttcaagcttcatggcaagccaatagttggaggacaaggttggatggtgaaattgatgtgggattcataa

SEQ ID NO: 1629 - DNA, 1688 bp, Glycine max
  Peptide Sequence Number=SeqID_93314
atggttgggactagaggctcaggtcttgtcttaggtcgggttattgttagaggtctggggagaagggatcgtgatgattctaatgatgctccacagcgacgaaggcctaccgcatcggcacgcaggcaacggggacctgtccctgttgccaaggatgagccagtggacactggtgcagacaccggtgcagaggctgctgcagatgagcctgagggatttccaggtggaccgaccgacccatccgtgcttaccgagtatgctgagcatgttgcagccagcgtatggacgggagaggagcgtcctgaattgaagttatcctcccatgggaggaaggtgcagaaattaggtaggccaatccctgccattgaggggctagttgttgggacaggactaattcctttgatcgcgtgtgcaatagacactggcgatcgaggacttatatcctcatttgtggagaggtggcaccgagagactagtagtttccatcttcctgtaggggaggttaccatcatgctagacgacgtggcgtctcttcttcatctgcccatcattggtgacttccataccttccagcctctgcatgtcgacgaggcaatgctgatgttggtcgacttactactggtctcaccagaggcagccaaggccgagacaggacattgtcatggaccatacagtgcaacccatgttcatgttctgttcttggacactctgcgtgacctcagtcagactgggaggtatgcatggggagctgctaccctggtgcatatgtacgatcacctgaatgatgcttgtatcagcaccagccggcagcttgctaggtacatcaccctgttacagtgcaatgttgatccggactacgacgaggcttcaccacgtgcatgtcggtggattgctacgaagaagactgtgaagagcatatctatagagacgtacaagcaacacttggatcgactcaggaatcctgatgtcagcttcgttggtggcccgttgctgtcagataccgaccagagagggtggatgcaccactcagaccatcttgcgccagcaggtgagatgtgtgttcggcttccggcaagtgcaccgaattgcacaagtagtataaaacgccttcttaacaacaaagagaataacaagatgaaagattacaaaaatacaagtggtgaggatgtctccttcacctcttggatctcacaatcattcacaaactcatctcaagctctcaaaccggctcctgcttcaagctctggtggccttgttcgtgctcgtgcgcttagcgcacgtatggaccgcttagcgcaccggacgctcgctaagccaccatattggcttagcgagaaggtgaaaacaacactttccaaagttgtacagcacatttctcatccattcatgactgtggcacagacattatatcctctgcgagattcacctgctacgcagcccagacatatccctcaggtgctagagccacatatacctcaggtcccggagccaactgcaacatcgacacctggtaggtctgatgtggacgagcccaaacatgcagtggaggcttgttatgcgatcgttgagaggttggagtgtcatctcaacctatgggtagtcacgccaggcacatcgacacatgaggtcatcgaacaatgcctcaggattgtcaggggtgtcacaaaagaccgcattgtgtatgtgag

SEQ ID NO: 1630 - DNA, 642 bp, Glycine max
  Peptide Sequence Number=SeqID_93315
atgactgaggatgtatttgcacctgatgcagaagataattatgttgatgaaggagtagctggtgatggtactgagggatcagctggtgatggtgctgagggatcagttgctgataatgttgagcgattcccaggtgggccacatgacccatcagtgctgacttcgtttgctgagcatgttgcacatagcatatggaatggagaggaacgtcgtgaattgaagttggtctcccacggaaggaaggttgagaaatttgggaggccagctcctgagattgaagagctagtcactgccataggattaactcctttgatcgcgtgttcagtagacactggcgatcggggagttatatccgcttttatcgagaggtggcacaaggagactagcaacttccatcttccagttggagagctgaccatcacactggatgatgtggcgtcactcctccatattccgatcatcggcgccttccacagtttcgagcctctacatgtggataaggcagtcatcatgtgggtggagttgctagaggtcttgggtgaggaggctagagctgagactgcatatgtcatggtgcatatgtacacctgttgtggctacgagatatctatcagaggacatgcgaggcccgacagtggatag

SEQ ID NO: 1631 - DNA, 423 bp, Glycine max
  Peptide Sequence Number=SeqID_93316
atgcatgtgtgtccaaatatgcagattatcgttaaaactaaagggttaggtcatgtcttaggcagggttataggcagagccgtggggagagaggatcatcatcattcagatgatgttccccagcggcgaaggcctacagcatccgcacgtaggcaacgagaagcttcccttgttgctgaggatgctcctgacgtgattgatgatgtacatgcacatgctgaagatgttgttgatgatgctgagggatttccaggtgggccgcatgacccttcaatgctgactgagtatggttaccatattgcagtcatcgtatggaatggagagctatcctcctatggaaggaaggttcagaaatttgggaggcctgctcctgaaattgaagtaattaagttcagaaggaaaatcatcactatagagtcctga

SEQ ID NO: 1632 - DNA, 769 bp, Glycine max
  Peptide Sequence Number=SeqID_93317
atggggttgaaccaagaacatgcttttaaggaagggctcatcaagtcaaggtcaagcatggaagtaaccagcttgcaaaagttggggcagaagatggatcaggaaagaacgcgtgctagagctagagttatgggtgaaatagaggaggtgcaagagtggatgaaggccgacatagaggccatgaaagagcaaatggacacaatgatggaggccatgatgaacatgaagaagataatggaggtcaatgcggctgtagttgctgctaccagcgctattgctgacatggactcgactaccccatccggcctcaaccaaataagtcatccaacctcggatatggtagaacatgcatgccttcccaccatacggcttgcccccaactatacaccacccaatgttgtgcacactcctgatgaggatgtcaataactccactcccatacccattgagagccaacaaccccaatctattcatgcacatgaagcaccccaagatcacaatctagcagacttcgaaccttacctcggatatgccactgaggggcaagcagttgtccctcctgccgtggtgaaaaggggaaaatttgatcatatagaggaaaggctgaggggtattgaaggaggcggagattatgcttttgctaacatggcaaagttatacctagtgcctgatgtcgtcatccctccgaagtttaaggtgccggatttcgataagtacaaggggactacttgccctaggaaaattggggcatcgcaaaagatgaaaagct

SEQ ID NO: 1633 - DNA, 348 bp, Glycine max
  Peptide Sequence Number=SeqID_93318
atggttcaacttccccaatctactggaatcaaggttttctacacttgcgcacatgctaaccttgaaggtaacctcttctctactgttaatggagtagatatgatcattaatgttgttgtgtggaaggaagtagtcaatctagacatgggtggagtccgcaagtttgatgaaatgcctgatgggaacttgaggaatcacttaggagttagtggattgactgcaaaggatagaatgttagtatacctcatcacctacattctcacacctaggtcaagcaatcatgctcaagtaacggatgatgatctacggatagtttatggtatggaatcaggcatcaagatgaactag

SEQ ID NO: 1634 - DNA, 246 bp, Glycine max
  Peptide Sequence Number=SeqID_93319
atgatgatgaaggacaattaccagttgaaggggactcttctctccttcaaagtattttggacaggttcgatggactccaaacctatgttgctgaaaggtttgatgctttggaacaacaagtggacatgtgattcgatgcaatggactcaaggatcacaaaggattgtcatcataaaaaagggagagattgtggaagcaatgccttccaaggttattttgatgatgccaaagaatcaagagagctaa

SEQ ID NO: 1635 - DNA, 207 bp, Glycine max
  Peptide Sequence Number=SeqID_93320
atgggggttcaaatagcaaccagacccactagggccttccaggatgttcctctagaaggcggttgcttctggaggaagcaacctagctcacctggaaaatccaagccgaggtgcttccgtaacgtttccgtgagtgatttcgcgaagattttcaaccgttcttcgacgttcttcgttcgttcttcgtcgttcttcggtcttcaaccg

SEQ ID NO: 1636 - DNA, 162 bp, Glycine max
  Peptide Sequence Number=SeqID_93321
atggacgaagaccagtggatgtatgatagtatgatgtctgaagaagttgatatgaatgttgaaaatgaggaagatgttagcgttaaattgtttgcaagtcgtgatggagtttacaatgggctcgatcattggctcatgacattggatttgttgccgttataa

SEQ ID NO: 1637 - DNA, 306 bp, Glycine max
  Peptide Sequence Number=SeqID_93322
atttcaaagctcatttggagcacaaaatttcgtgctcttctctccctctcccctcattcatctccttcttcctccaagctcttatccatggcctcctatggtgtggcgtctcctctctctctccctttctccattccgctgccattcatcttccaagaagcaaaggaatccattgatgaagaagatcctaggcctacaagctccaatggagcttgcatcagtttgatttgggagcaacaagccatgtgtgcaaagatcgttgttggttcaaggaatttagaccaatcgatgatggctctattgtga

SEQ ID NO: 1638 - DNA, 519 bp, Glycine max
  Peptide Sequence Number=SeqID_93323
atgaccaccctgactcaaatctggatgactttgctgctcagcaacatccaacccagcgatcataattccgacctccccctaccgaagtgtcagctggtgtacgccatcctgacacggatgagcattcacgtggctcagttaatcgttgatgccatctatctatttgcaggtatggcgcctaccaggcaccctctggacccggataagtccaacagggccctgggatttcccgctttgatcacaggactctgccagtcgtttggagtccccgtcgcacctagcaaggtgattcggccgcccatcacccgagctttgattgagaacctgcagagccagggttttacttcttttccgtgccctactccggatcagttcagggcagaggtcgcatggcccggagattggccagaggcactagcagaggcaccagcagaggctcccgacgaggcagatgaggcccgcgaggacgaggagatgaccgatttacttgatttcttaggagggagcggagccacatga

SEQ ID NO: 1639 - DNA, 86 bp, Glycine max
  Peptide Sequence Number=SeqID_93324
atggaagatgcacccgtgagccctcgcgtcgccctcccgcaaaaggttaggttgcgacagttggcgactccactgggactttttaa

SEQ ID NO: 1640 - DNA, 1262 bp, Glycine max
  Peptide Sequence Number=SeqID_93325
atggcgctgttgctgaaaacggatgacaagcaacaatggcggatggcgatgaataacgaaccttactttgccacccgcaacccggaaggatttctggccttgcgccaggccacggcagttgatgcggccaccggcaagccggacccgcagcgtctcgcggactttttgaaagcctacccggaggcagagaaataccttaaatgggcggcgcagaaacccgcccccggcagcttcgccggggcgacgttttacagcatcaacgctttctaccttgtgaacgcgcagggggagcgacaacccgtgcgctggatgatgcgtccgcacgatccgttcttctccctgagcgatgaacagcgaaagaaagcggatgataatttcctgttcgaaagcctgcgccagcgcctggcacagaaaccactctactgggattacgttttgcagctcgcgcagccgggcgatccggtggatgacccttcccggccctggccggataatcgcaagcagatggtggccggcacgctggaagtgacgcgtgtcgaagcgcagtccgttggtgcgtgccgcgacgttaactttgatccctctatcgttccggcgggcgttgcggtgacggatgatcccgtcttaaacgcgcgttcggccgcttactcgcactctttcagtcgccgtgagcgggaaattggctatggcaaagccaccgaagccgtgcaaaagcaggagcatttcaaccctctggcgagatatctgcattggctgatggcaatcatgatcctggctatgctgttcatcggcgccgctatgatgacttcattacaccatcgcatttggttggtggatgtacatcgaccactggggatcgctattttgctgctggcgctcatccgcctggccaaccggttttatagccggcagccacctctgcctgcggagctctcacgctggcaggtgcgggcggcaaaagcgtcacactgggcgctatacgcgctgatgctggcaatgccattgcttggctgggcgcaactgtcggcagcgggcgttccgattgttgtgtttgaaggacttaaccttccggccattaccccgaccagcccgctgctttttgcctggtttcacgatgcccatcgcctgctagctaaactgctctttgcggtggtgttgctacatctctctgcggcattagtgcacgcatggattttccgcgacggcgtgtttgccagcatggcgaaaagtaccagccggtcaagtaaaccacctgtagagcg

SEQ ID NO: 1641 - DNA, 741 bp, Glycine max
  Peptide Sequence Number=SeqID_93326
atggagttttacgcaaacacctgtcccattaaagaaggagtcatggacaggcgctccagggtgcggggccaatggatcccatatgatagagatgctatcaaccaattcttggggcatccattggtcttagaagagcgacagcgatgcgagtacgctgagagaagaagtcaattttcaggttttgatgaagaggtcataggtcagctactttgctccctgggacatgattttgcacggagtgtagtagggaggcaggtgcggattattcgcactagcatgaccactctgactcaaatccgaatgttgctcctgctcagtaacatccttcccaatgaccataactttgatctctcgctacccaaatgccagttgatctacagcatcatgacccagatcagtgttcatgtggcgcagcttatctcggatgccatccaccagttcataggtattgcacctccgagacacctagtggacccagagaagtccaacacgacactaggatttctggcattgttcagaggtctctgccaattctacaggcatttccaggaccctaacccttacccgtggcctactcctgagtattttagagccactgtcacatggcctgggggtaggcccaattttcaggaggaggtaggtcctacagatgctcaaggagttgcccaagggagtgaaggtggagctaaggatgatggagacatggcagatttgcttgatttcttcattggaggagactga

SEQ ID NO: 1642 - DNA, 237 bp, Glycine max
  Peptide Sequence Number=SeqID_93327
atggaaaagatcggaggcaaacagaataattctcgatcaatgaaagaaaaagatcagagaaccttccgaccagataaattttcggcaagattgccattcaaggtcgttctcgactggcgatatcctaccccacctgaacaaagaggaaaagaccgaaacaaccagcttcctctccaaaaaaaaaacactaccctcgagaaaatcctattggtccgtgatcgtacgtttgatctttga

SEQ ID NO: 1643 - DNA, 219 bp, Glycine max
  Peptide Sequence Number=SeqID_93328
atccccagtggagtcgccaactgtcacaacgtgcccttttacgggcgagcgagggcgagcctcacgggtgtgctttccaaaggaggaaagatgcgcggagtcgccaccaacgaaggtattagcacctctcacgtcgacaaaagcgaggctcttgctcctacgtaccctccatcaaagaggaaatcagacctacgtagttctttcacatgcgtgaatcaa

SEQ ID NO: 1644 - DNA, 330 bp, Glycine max
  Peptide Sequence Number=SeqID_93329
atggccaaaagaatcctgattgcaagaccttggttgttgttttgtctccacctgatgagaatcatgaaactggccaaatacaggctaaaggcccaagtggagaaggacgaaggcccaagtggagaaggacaaagcccccgagtggagaaggatgaaggcccaagtaatccttgtggcgtctaccttgacttatcttccttcactggaagtggcgtctacccggacttatcttccttcaccggaagtggcgtctaccctgacttatcttccttcaccggaagtggcgtcatccaaatatccgttgcctgtatcaagcgatccgccccgtaa

SEQ ID NO: 1645 - DNA, 226 bp, Glycine max
  Peptide Sequence Number=SeqID_93330
tgctttaaaaggtcttgatgatgctccacaacataaatcaaaggttcctgctaggtggattgtcgtcaagcgtaacagacaaaaaggaagcactgagtgcggctattatgtcatgcactggatgtccaccatcattttaggaagttttaggaataactgggaagcatattttaacaatcctagaccattggagcttgagagattaaaggtgattctgatccagtag

SEQ ID NO: 1646 - DNA, 156 bp, Glycine max
  Peptide Sequence Number=SeqID_93331
cactctgtagaactgacaaagacccgtaatcagagctggaaaccccaagaccctgttggacttctttgggtccactgggtggttggaccttgtggcctcaataatcttaagagggataggcttagaatgcagaagaagcaacaacaatcaatttaa

SEQ ID NO: 1647 - DNA, 336 bp, Glycine max
  Peptide Sequence Number=SeqID_93332
atgtatttactcttttttagctttcgaagaagttatggaaactcacggattgcgcaacaacacctccttttggtttccgccacattacggaatttcacggatcgcgtaaccctgcttccttttgatttccggcgcgtctcgggacttacatattgtgcaacaaagggtgccaagtatcttgaagcggccaatcaaaggttgcatgtcatcaatcaaacaaatatataccagacaaatatggtcaataacaagacgtacgagtgggatcagagcagtggcaaaccaaacacaacaaagtcaactccgacgcttgtgaaacaagaatttacttcgtaa

SEQ ID NO: 1648 - DNA, 839 bp, Glycine max
  Peptide Sequence Number=SeqID_93333
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattgtcgatccgccacgtcggcccgaccgccgcccgggccctggccaccgagctggggtcgatggccgcgaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 1649 - DNA, 918 bp, Glycine max
  Peptide Sequence Number=SeqID_93334
atgtctgaaggctggaatattgccgtactgggcgcaaccggcgccgtaggcgaagccctgcttgaaacccttgctgaacgccagtttccggtaggcgaaatttatgcgctggcgcgcaatgaaagcgcgggcgaacatctgcgttatggtggcaaatcggtcatcgtgcaggacgccgccgactttgactggacccaggcccagttggctttcttcgccgcgggcgtcgaagccagcgcggcgtatgtcgaagaagccaccaacgccggttgtctggttatcgatcttagcggcctgtttgctctggagccggacgtgccgctggtggtgccggacgtcaacccgttcgtgctggccgactaccgtaaccgcaacatcatcgcggtacctgacagcctgaccagtcagctgctgacggccctgaaaccgctgatcgacgatggtggcctgtcgcgaattgccgtcaccagcctgctttccgtgtccgcgaacggcaaaaaggccgtcgatgcgctggcagggcagagcgcgaagctgctgaacggcatcccgattgacgaagatgatttctttggtcgccagctggcgttcaacatgctgccgatgctgccagataatcagggctccgtgcgcgaagagcgccgtatcgtggacgaagcgcgtaaaattctgcaggacgatggcctgatgatctccgcaaacgttgtgcagtccccggtcttttacggtcacgcgcagatggtgagttttgaggcgctacgcccgctggcggcggaagaggcgcgtgatgcatttggccgcggtgaagatattgtgctttccgaagagcgcgagttcccgacccaggtgggtgacgctaccggaagcgcgcacctctctgtcggctgcgtgcgtaacgattacggtatgccggagcag

SEQ ID NO: 1650 - DNA, 390 bp, Glycine max
  Peptide Sequence Number=SeqID_93335
atgcggcagtttggatacacccagaccattcctgctccgcttgtcgattcatgggtgtcgtatgatgatatacacgacaggtggatgcactattcgtatcatatggttccagcaggtgaggtgtgcgttgtgccaggtcagtgtgccagcgactacatggactggttcttccgcatctcacatcttttcatgacaccaggccagccatcagatcctctactagatggtcatgctccgcagccccgagttgccactcaggccccagagacagatatccctcacgtgccggaggcaggagcaccgttgacatctgcgaggcccgctgtggaggagcctagacatgcagtgaagtttgccatgggattgctgagaggttggagcgccatctga

SEQ ID NO: 1651 - DNA, 321 bp, Glycine max
  Peptide Sequence Number=SeqID_93336
atggagagtcaaatggaccagtcaaatcacttaatcaaacatgaggagtatcatgtttccaattacatcaaagcatccttttccatttccatgattcagttcctaatggtgaggaatcagtttctatatatgcttgataaagatcaccttgcaccattttcttggttgttggaaccgtacgcggataataagctgctttggcggggagaagaaaatgtgcatgcggaaaataatgcaggggaggagaaattgtatggtcaagaaagagttcaaataaagccaaagttaatgatgcatcctctgaacctgccactgtattag

SEQ ID NO: 1652 - DNA, 267 bp, Glycine max
  Peptide Sequence Number=SeqID_93337
atgccacgtgttttgctgaaggtggaggaagaaaccatgttttgtgaatgcggggatttcggctttcatataccagagtcaatgagtgtgcgctgtggatcattaacatttgttagaggaactaaacctgcccgcaacacaggatttgacatggatgaagatgacctccttgaaatggagcagtgtcacggcgtacttgttgcatcatttacatgtttaatctggcatcttgctaatgaattatatctgttgttcaggaaattttga

SEQ ID NO: 1653 - DNA, 1476 bp, Glycine max
  Peptide Sequence Number=SeqID_93338
atgggaaaagtgtcggtttggctacgagtagaagccaagtgtaccatatatctgcttaaggaagagtatgaaactgttccagaacaaaatgttgcagagcctgccaagtggggtgtacaggatgagcctcttttgcaaacagtccaatttgcagataatgataatccaaggcaaaagcaagagggtatgcagctaaatttgtaccatgtcaaaggacttgactcctctcaaacttccacatcaccattttcattctctgacatgatcacaaaagatgaggaacgtgtcaggtttcttcattcaagattaacaaacaaggagagtgtcagaaattctgccaccactgacaaattgagggggggacccagcctagtgagcacaacacctttgaaatcaggtttgtcaattggttcaggcaactactatgtgaaaataggacttggtacccctgccaagtacttcagcatgattgtagacacaggtagctccctctcatggctccagtgccagccttgtgtcatatactgccatgtccaagttgaccctatattcaccccttcaacatccaagacatacaaggccttgccatgctcatcatctcagtgttcctctctcaaaagctccacactgaatgctccaggttgctcaaatgcaactggtgcttgtgtctacaaagcaagctatggtgacacttctttctcaattggatatttgagtcaagatgtgctaaccttaaccccttcagaggcaccatcatcaggttttgtgtatggttgtggtcaagacaatcaaggcttgtttggaaggtcatcaggtatcataggtctagccaatgacaaaatctccatgcttggtcaattgtccaaaaaatatggcaatgccttctcctattgcctcccctcttctttttctgcaccaaactcttcttccctatcaggtttcttgtccattggagcctcatcattgacatcatcgccatacaagttcactcccttggtcaagaatcaaaagattccaagcttgtactttcttgacttgacaactataactgtggcaggaaagccactaggagtttctgcatcaagctacaatgttcctaccataattgactctggcacagtaatcacaaggctacctgtggctgtttacaatgcattgaaaaagtcttttgtgttgatcatgtccaaaaaatatgcacaggcaccaggattttcaatattggatacttgcttcaaggggagtgttaaggagatgtcaacagtgcctgagattcagatcatatttcgtgggggcgctggcctagaacttaaggctcataactcccttgtggaaattgaaaagggtactacttgtttggccattgctgctagctctaaccccatttccattattgggaattatcagcaacagacattcaaggtggcttatgatgttgccaatttcaagattggatttgcacctggtggctgccagtga

SEQ ID NO: 1654 - DNA, 1506 bp, Glycine max
  Peptide Sequence Number=SeqID_93339
atggctgtacaatacatgcggcgggttattgagaagaaggcgaagtttgatatcatggacctgaactgtttgctggttgcaccgaagacattcattcctgttttatttggacatggtaatgatgaccaattcattcagcctcaccactctgatctcatctctgaatcatatgcgggagataaaaatatcataaaatttgatggtgatcacaactcctctcgaccacagttcttttatgattcaatttccattttcttctacaatgtgctccgccctcctcacattcctagagttcgtaagcttgagaaatattttgatttaggggatttgaagattggttctactgtgaatgagtctgcaactactgatgctgcaagttcatcttctgctcctcctagcacttcaaattcaatcaaagcatcagttagtgaacttatttcaaaagttgctccagtaaccgccgctgagtccatgattagagaggaaccaaagcatggcaatgatgaacatggccatgatgagcctgcagatatgaaggatgagaaaaatggcctgactgaagattacttctcatactgtagctcaactagaggaaactggggcagatgttcttctttagtactcagcgatgaagaatcttatccagatttcagggatgatgataatgattctgaggaccaactaaatgggcaagccttggtggaggacatggtgtttgatgtggagaaaagtcaagaagagaagaaaaatctggaacagtgtctggtgattgattctgacagcgggaacaagacattaaattccccaatgatgggggattcagacaagaaatcgattgtggttgacaacacgcaattaatgaggagggaggtggaggcgttgaaaaaggagttggaatggttgatgaacttagatgatggtgattctgtagctttgttcaattcgaagaaggacaaacttgccaagcttcttgtccaagaagatcaacactggaaacaaagagccaaggctcactggttaaaagatggagaccagaatacaaaagggggacacgatcaaaagggtctttgtcaagtggcaaaagactattttataaacctcttcaagcaagaggtgagttgttacgagatggtgatagaggcagtgcatagcatggtaaccaagaatgaagtggaagttcttaaaaacgcccttcatgtgtatgaggttgcttcagaccaagctataaatctcaacaaatccgaagttcttttttgtgccaatattcatgacgagaagaagtttcaattatccagttcgttagggcatttggagttcccggttgtgcttgataaattgatatggagaattggtgatgggtctagcattaacaatgggacaaaacgtttgttcatgggaagcattcacctcatgggttttacactgtcagaacagttcttccagtggttctggaactgcaacgtggacgcaacatctatggatgaggaaggaaaattcgggttttga

SEQ ID NO: 1655 - DNA, 777 bp, Glycine max
  Peptide Sequence Number=SeqID_93340
atggtggcggttggttgcacaatgatggaggttggtggtgtgacaatgtgggttgtgcaatggtggttgggtgtagtgcttgtttgggctaagttcatggaggttgatggtgcaccgtcgtttcactttcaccatacgactcttgtcgccggaaccctaaccgattgcgcgccaaatcctctctgctcgttcagaaacaggacgcccaactctccgactccgactccgactccgtctccgtctcgcgccgcctcattctccttcgccatgctaagagttcctgggataatcgctctctccgcggtaacccactccttttcccaatttccactttttaattctccaacttttcctaagaaattggaattccatgaccatgaccggccactgagcaagtctgggaaagaggatgctgtgagagtttcccgcaggctccaacagttgggttggattcctgaacttatcttgtccagtgatgcagcgcggactaaggagacgcttaagataatgcaggagcaagtgcaggagctggtggaagccgaggttcattttgtttctagtttctattcgattgcagctatggatgggcaaacggcagagcaccttcaaaagattatttgtaaatattcaagggatgagatacttactataatgtgcatgggacataatagggggtgggaagaagcagcatcaatgttttctggggcctctgtggaattaaagacttgcaatgctgcactgcttgagtctgctggaaaatcctgggatgaggtttga

SEQ ID NO: 1656 - DNA, 2271 bp, Glycine max
  Peptide Sequence Number=SeqID_93341
atggagaaaaattctcttgattatagtcctttgctttctcctcgtggtgatgaaaatggaagtgagacaacagcatctcctcttgtgtcagctactaaatggactctcaagactttgatcttgatgatctttgttctatgggcagctttcatcttttttctccctgcaaagcctgtgaatgagttgttctcaaaatggaatgatctcaaccgtgacactccttttggagtcacaggaagcatttttctggtcttcactgctccaattctcataattgcatttcttgccattgcacaccaaattcttactggggaggatcagcttcatgagtatgtgatttcctcaaacttacctttctgtgcacaacatttcatcatcattatagcaaggttttcaattaccgtcacagtttcgacacaatctttgatattgcgggaaattgtggtcacagacagatttttgaaacctggcattatagtatatgttgagtactttgtttttgatttggaatttgatggcaggaagaagacttccaaacttccaaggttccgcctatggacgtttcctgtgtttgtgaagggaccatttggggttgtttctgccacagagcttattgggattgtcctcgttttgttgtatgttatctgggctctctatgcttacactgtgagggcgcttgattttatctctgaatttgatgtgccatcctttagagacaagagcataatcatgtttaaagtgatgggacttcgcacgggtgcaattgggttgatgtgtttggctttcctgtttatcccagtttcaaggggatccgttcttctccgctatatagatatcccttttgaacatgccacaagatatcatgtatggctgggacatctcacaatggtgctttttactgtccatggactcctctatgttattgcatgggcaatggaaggccaccttgtacaagaattaatacaatggaaagatattggtgttgccaatctcccaggagttatcagccttctagctggtttgttaatgtgggtgacctctcttcccggagtgcggacatggaactttgagttgtttttctacacccaccaattatatgtagtctttgttgtctttttggccttgcatgttggtgactttgttttcactatggctgctgggggaatatttttctttgtgctcgatcgatttctgaggttctgccaatcacgaaggacagttaatgtaatctcatccagatgccttccatgtggcactgtggaattggttctgtcaaaacctcaaagtttgagatacaatgcactaagtttcattttcgttcaagtccgggaactatcatggctgcagtggcatccattcagtgtttcttctagtcctttggatggaaagaatcaccttgctgttctcataaaggttcttggcaaatggacagaaaagttgagacaaaggattactgatgtcgatgcacaaaaagattcatgtgtcataacaacttcagttgaggggccatatgggcatgaagtaccataccacttaatgtatgaaaatcttatattagtggctggtggtattggactctcacccttccttgctatattgagtgacattctccaccgtgttagggaggggaaaccctgtcaaccgagaaatattttacttgtttgggcggaagagggatatagttacaaaccaataaaatcttcattctgtcctatggctagtgattgtggcatgtctgttttggttggtacaggagacaatttttggtctggactatatgtcatctcatctaccgttggctttgtgatattgctggctttgttgtatgtttactacgtaaccccatttcacatagaaacatggtggtacaggggactactatatgtaatctgcatggttgcaagtgttgttatctttggtggttctgtggttgcaatgtggcatatttgggaaaagcaaaattctttgaaggacaagtccaatgatacaaaggttgataagattcatcaaaatggctctttggctaccaaggatcaaagtcaagacagtagtattgcgaagtcaacggtcattcattatggttccaggccaaactttaaagaaatttatgactcgatatcagagaaatggggccttgttgatgtgggtgtcatagtttgtggcccttcaacacttcagacaagtgttgctgaagaaatcaggtcacacagtatgacaagacaacgccatcattccatcttccatttccacagtcacagctttgatctctag

SEQ ID NO: 1657 - DNA, 1764 bp, Glycine max
  Peptide Sequence Number=SeqID_93342
atgagtgggaagggcggtggcaaggcgctgtcggcgacgattccagcgtcgtcgcggaagatggttcagagcttgaaggagattgtctccaatttccccgaccatgagatctacgccacgctcaaagactgtaacatggaccctaacgaagctgttagtcgtctcctctcacaagatccttttcatgaggtgaagagcaagcgagaaaagaaaaaagagattaaggacccaacagaatccaggtctcgtgggagtgggacaaacaacacatccagtcgtggcggtggtagggctggcacagatcgtaatggtggacgtggtggtgccaaccaattcggcagcagtgattatggtctgcaggggaagcctgtatacaagaaggaaaatggggcacccacttatggagggtctacatcctctgcacctagtgtgctgggaaacaatgcgaacatgagaccggcatcctacagtgattctgtggttactgaaaaaacatacgcattcagcatcggtgatggaccatcttcatcatcacaacgtgctggagtgcaatctgcatgggcagggaatacgggccaagtatcaatggccgacattgtcaagatgggtaggccacaggccaggccatccatgcataattcttccatccagagtggtaatcatcagaatgtcttcatgcctccagcagcttcagataacaacttgcattcatcgcaaggttatgcttccaaagtttcagaaacaaatactaatcaaggccatgccattagcgacaatgttccacagaatgatgaatggccttgtattgagaaccaacatgatgttagagtatatgcagatgttgatgcccatgcaaattctgagtgctatgcaaactcgtcaagctttgctgaagctgattggcagcagaaaactcacttggatgaacatggagctgaagatggttccgttgagaatgcagacaatgctgaatctgcttctatatccgctaaaagtacttcagaggataacacaggagctgaagatgatgtttcatcagttgctgcaaacatagagcagctaaatatacagagagatgatcaggggacagcacaagaagatgacaatccttctgtagtaattccaaatcacctacaactccatactccagaatgcatgaatttgagctttggaagttttggatctgcaaaccccctttctggatctgggtcatttacatctaggcctttgaaaagtaacttggaggatacatctggtgcagcggatgcttcaacaattgaaaactcagacactagaaatcctgactattatggggatgagcatcttactactactacctcagatggaaatttagttcaaggaactggtgtgagtgctgggacctatgaacatacttccatttcacaagaggctttaaaacccgaaccccctgaaattgctcaggaaaatcagtattcatttccatcacattctcatggatttaattatgaaaatgcccaacagccggaggtcacatttcctgtttcacagaccagctcacagaatcagaatcttgctcccttctctggtgtaatggcacatacaaattctttgcccagtgctctgttgtcttcaccagttcaaacagcaagagaagatatcccatacttacccttccctgcaacacaatcgatgcctacaaaatatagtgacattgcttcttcaattggtggttccaccataaccatgtcagaggtgcacttctgctctaataagcttatttaa

SEQ ID NO: 1658 - DNA, 102 bp, Glycine max
  Peptide Sequence Number=SeqID_93343
atgatgaaacaagactctgacatgggagaggggtggcatgaggacaaaaaacgtagggctaaggctggacctgaaggacaaagggccacgacaacatcatga

SEQ ID NO: 1659 - DNA, 162 bp, Glycine max
  Peptide Sequence Number=SeqID_93344
atgaaagaagatggaaatgaagaaggaaaaggaagggagaatggtgaatggagtgttgttgggaagagagaagttgaacataaaaagatggtaaaaaggaaaaggcagaataagatgaaggtgaagcaagaggacgaagccaaaaaccaaggccaagtttga

SEQ ID NO: 1660 - DNA, 165 bp, Glycine max
  Peptide Sequence Number=SeqID_93345
atgtgtgaccttacatcatctttaaggacttatccgcgtgagcgtggtgttcccgtgtcctctagcatgaggttcttcatagtcatccacctattcatctgctcccccgaacacaaagttcaagatcatcacaggatccaaacacaaacaggaaaccgggagtga

SEQ ID NO: 1661 - DNA, 1419 bp, Glycine max
  Peptide Sequence Number=SeqID_93346
atggcggaatccactcgttcaaaggtgaaatccgaccgattggtggatgccatcaccaagctcaccactcaccaattatccctcagtgaaacccagcactccatgacccttaagctcgatgagctcatccacaaactccataccccagattcaccggctaactttctcagagatattgcagaaattaaaatccagcaacaggtttcagacaattgggagtggtctgcagatccagagggacactattcaactcgcagtgcctatgatttgataggagaagaagtaagagatagcagtcaggaggaatgttttgagaagctttggaggataaaggttccagctagatttctgaacccaacaagaggatgcatcccatcttttctttcactgcagcaaacttcaacccatatggtgggaaaccatgtcatggctgcaagattccgtttagaagaattaggtccactaaagcttaaaggagatcttgacatcaagcatctggggaatgtaaaaagtgtaaaggatgccgaaaaagctaatatgtcaagtaagcagctgaataatctgttgttgtcttgggacaaaaatgaggagtctgaatcacaagaaaatgttgaagaaattcttgaagtgcttcatcctgatacccaacaactttggagattagacgtggaaggatataaggggttccattttccacaatggatatctagttctcctctcaaacatctaatgcttaaagattgtgaaaactgtttacaactttcaccaattgcgaaactgccttctctaaagactctaagaatacttaacatgattcatgtagaatacctctacgaggagtcctatgatggggaagtagttttcagggctctagaagatctgtcactctgtcggctgccgaagcttaaaaggttatcgagggaggatggggaaaacatgtttccgtgtctttccatacttgaaattgatggttgtgatagatttttgggagaggaagtttttctgcatcggttgcactctctcactctaattaattgtggcaagatcaatgtgtcggcaggttttaactgccttgagaaattgtggatttcagaatgcagagtggaaagtttgcaggctttacaagatatgacttccctgaaggagttacgattaaggaatcttccaaagctagaaaccttgcctgactgctttggaaaccttcccttgcttcacacattgagtatttttttctgttccaagttgacatgtcttccaatgagcctaagctttagcggtctacatcaattgactatttttggttgccattctgagttagagaagagatatgagaaggaaacgggagaggactggccaaacatagctcacattccccatatttcagtgggcagtaatctttatgatcatatttccgattga

SEQ ID NO: 1662 - DNA, 591 bp, Glycine max
  Peptide Sequence Number=SeqID_93347
atgccaaacccaacaacaacaacaaaaccctctcttctttctcttttttctcttcacacattgcacctcctcgtcctatgttcctggttcaccacctcctcagccaaagcaacctcctacaacgtggtggatttcggagccaaacccgacggcacgacggatgccacgtcggcgttccttggcgcgtggaacaaagcttgtagttcacccaaacccgctggcatccacgtgccgcaagggaggttcttgataggaagagccgtaacctttagtgggcaatgttcgaaccgtgccatctccataacaattcgtggcaccttgctggctccttctcaatacaccttcctagggaattctttgtattggttcacctttgaccaagttactgggctttccattcatggtggggtgcttgatgctcgaggcagtttcttgtgggattgcaagtacaaagccatgcctaattgccctattggagccgcgggcttagatgcagaaaatggactgtggagaattgggcgaattaagcgtcttttcaatgtgtatttgcctaatcatttgtttgatatggtggaaatagtgaggaaataa

SEQ ID NO: 1663 - DNA, 750 bp, Glycine max
  Peptide Sequence Number=SeqID_93348
atgcaggaatccccagagccaagacatgaattttgggttggccaacgagtacatgcatctggtgactcacagagaattggtactgttaagtatgtggggcctgtagaaggctattcagatacatgggttggagttgattgggacaacggagaaggaaaacatgatggatccatcaatggtgtccgatactttcacgcaaagtcagaaagatcagggtcatttgttcgtgctcacaatctgaaccaagggatttcattgctggaatctcttgaaagtagatataaaagtgaatccacaaaagatgaagatgatgatatgtttgtcctttcaacaagcaaccagcgagtatctgttcaacttttgggtaaagataaaattcatgataagctaagtcgacttgaggagttaaccagtgtatcattgtcatatatgggtattagttcccctggaatcgcatctcacattaataatacagtgccaaatataaaagaacttgacctgactgggaaccttctttcggagtggaaggatgttggcacaatttgtgaacagttacctgctctaaggacaatcaacttatctaacaatttaatgtcaccatataaatcgaagcttctgctactgaaaaacatccaagttgttgttctaaataatactggtgtagattgggagcaggttgagctgcttagacaatcattgacaacaattgaagagctacatgtaatgggaaacagtataagcagaatactg

SEQ ID NO: 1664 - DNA, 2742 bp, Glycine max
  Peptide Sequence Number=SeqID_93349
atggctaacgacgattgctgcgccacgcaactcatcgacggccacgccgagttcaacgtcgccggcctcgacagcttcatcaggaccgtcaatctcgcctcctgcggcctctcctacgccgtcgtcgcaatcatgggacctcagagtagcgggaagagcacgttaatgaatcatcttttccacacaagtttcagggagatggatgctttcaggggaagatctcaaacgaccaagggcatttggatagccaagtgtgttgggattgagccaagcacaattgctatggatttagagggcactgatggaagggagaggggcgaggatgacactgcttttgagaaacagagtgctctttttgctttggcaatatcagatattgttctgataaacatgtggtgtcatgatattggtcgagaacaagcagcaaataaacctcttttaaaaacagtttttcaggtcatgatgcgtctattcagtccccggaaaacgacattgctttttgttatacgtgataaaacaaagaccccacttgaaaatttggagcctattctaagagaagatattcagaagatttgggatggcattcgaaaacccgaagcccatcaacatactcctctttgtgaattttttaatgtggaggttactgctttgtcaagctatgaggacaaggaggataagttcaaagaggaggttgctcaattacggcaacgtttcttccattctatagcacctggaggtctggcaggtgatcggcgtggtgttgtgcctgcttctgccttttctattagtgcacagcaaatatggaaagtcatacgggaaaacaaggatcttgatcttccagctcataaggtaatggttgcaacagtgcgttgtgaagagattgctaatgaaaaacttaaccaactacgctctgacaagggttggttggaattggaggaagctattgaattgggtccagtacgaggttttggggaaaagctgagctcaattattgatgcctgcctttcacaatatgatgaggaggcaatcttctttgatgaagctgtgagaaatgcaaaacaaaagcaattggaatcaaaggctttggatcttgtgtaccctgcttatacaacattgctagggcatatacgctctaaagctctagatgattttaagactaagctggaacaatcactaaacaatggagaagggtttgcttcatctgttcgcacttggactcagtctactatgcttgagtttgacaaagcatctgctgatgctgctataagacaagctaattggggtgcttcaaaagtgcgagacaaacttcatcgtgatattgattcacatacttcatctgtgtgcagtgcaaaactattggagataacaactaattttgagaaaaaattggccaaggcattggcggagcctgtggagtctctctttgaagcaggtggaaaggactcctggctttcaataagagaactacttaaacgtgagactgaaactgctgtatcagaattttctgcttctgttgctggttttgagctggatgaagaaacagttggaagaatgcaacaaagcttaagggactatgcaagaaaagtggtggaaaataaagcaagagatgaagctggaaagattctgatacgcatgaaagataggaagtgttccctcattagacatgctgagagacagaaattttgcattcatctgattaaaagtagcgaaagacataagaaagcattaggagaaaccattaaaacaagaccttgctttcaatggctttactgggattttggttttgattcatgtaatttatcccaccagttgtgtaaggcttggttattattgttgcttttggctgtttccttaggattcaagtgggatgttatatttgaaattgggacaaaaaggttctctacagtgttcaatcatgataatgattcactacctagagtttggactgggaaggaagatattagagctattacaagggatgctcgctctgcgtcgctgaagcttctatcagatatggctgctatacggttggatgagaagcctgatcgcattgaaagtgcactttattcatctctcatagataaaactagtgctgcaacatcttcacaatatctaactagggaagcttctgtagatccattggcttcaagcacatgggaggaggtttccccagaagacgtgcttatcactccagtgcagtgcaaggctttgtggagacaatttcagggagaaactgagtatacagttactcaagctatttcggctcaggaggcctacaagcggagtaacaattggttacctcctccatgggcaataatggcaatggtcatacttggttttaatgaatttatgatgctactaaaaaatcctctctacctgatgtttatatttgttgcctatctactcggaaaggcaatctgggtacaaatggacatagctggagagtttcgacatggcactttgcctggactactatccatttcatcaaagtttcttcccacagttatgaaccttattaaacgtcttgctgaagaagctcaggggaatcaaacccctcaagaatcacaagggtcaacttctcagacacagatcttcagaaatcatgtgcacaaacctgattcagtatcaaactcaatttccaatgtatcaagtgttgggtcgtctgttgatgataacgaatactcaacagcaaacttgtctcatagacgaagaacaaatgctcccgaagctgaattttcatga

SEQ ID NO: 1665 - DNA, 600 bp, Glycine max
  Peptide Sequence Number=SeqID_93350
atgttcaaaactttcttcattattttccttctctctttttcggtgttcactccagaacccttacttatatcagctacaccctcccttcaaaatcccgagaacattcaaaagggtgtgacactagaaagtgttgaaatcacaagaatattacaacctaaacgtgtcgggaaaactggattcagagaccatgaaactaatatcgttaccaagatgcgacacctaaggtacgtgttcgaatccggtacggaaggtgcaccgttagggtttctacggagggttttcagagaggcgtttcggcaatggtcgtttttcagcggagaccagggagatgagttttcgtttgacaagtttggaccggttttggcacatgcttttcaaccacccgatggaaggttgcatgttgatgcagataagccgtggagtgttgaagttccgatagagagggagtattatgattttgtgtgggtggccatgcatgagattggtcaccttcttgggcttggtcatagctcgcatcgtcgtgctgtgatgtatgcgtctgtgcatgctggagtgaataggatcggaggaaacttaatgtggatgatgttgcaagtataa

SEQ ID NO: 1666 - DNA, 1305 bp, Glycine max
  Peptide Sequence Number=SeqID_93351
atggcaacaatgtccgcatcttcaatgaaccttaacatgattgactctaacttcgaagtcgacaagctcacctacgaaatcttttccattttggagaacaatttccttttcggctacggccacaccgaaaatcgcaccaatttggttaattttccgctgaaagacgcgaaaccggtgaaacacgccgccggcaaggtccgcatcctctgcattgacggcgccggcgccaccgacggcatcctcgccgcgaagtccctcgcgcacctcgaggcttgcctccgccgcaagtccggcgaagcgaacgctcgtgtcgccgacttcttcgacgccgctgctggctccggcattggcggcgtcctcgccgcactgctcttcacgcgcggcaaggacggccggccgctgtgcaccgccgaggaggcgctgcggttcctcaccgacaaccgccgcaggatctcgcggcggtcggggattctccgtcgtgttctccggccggcggagaagctcttccgcaagacgtttggagagtgcacgctgaaggacacggtgaagcccgtgctgatcccgtgctacgacctcgtcacgcgcgcaccgttcgttttctcgcgcgccgacgcgctggaagtggacggcttcgatttcaagatgcgcgacgtgtgcgccgccacgtcagcggacccctcctctgcgggccccaccgagatgctgtccgtcgacggcaggaccaggatcgtcgccgtcgatggaggcgtcgccatgaacaatccaacggctgccgccatcacgcacgtgctcaataacaaacacgagttcccgttctgtaacggcgtttccgacctcctcgtactctccctcggtaacggagagtcagactttaacgccgttaagtcaccctctggcttcgtaaggatcgctggcgaaggagcttccgatatggttgatcaagccgtatcgatggcatttggtgagtgtcggatgagcaattatgtgagaattcagtcaaacggaatcatggcaaacaagggcacacaagccaagtcctgcaaaacggcgtcggatttgttatctatttcggaggagatgttggcacagaagaacgttgagtcccttttgttcaaggggaagaaggtggcggagaacaccaacatggacaagttggagttgtttgggggagagttaattaaggaacaagagagaagaaaaaccagcattttaccaacggtggtgttgaagaacaacaatgcctcaccttcccccagcagaacttcctctgccactaccttgtccactttgtcttcgactagttaa

SEQ ID NO: 1667 - DNA, 1146 bp, Glycine max
  Peptide Sequence Number=SeqID_93352
atggccaagcccctcaacttgaagctatctatgttttggcagggttgtgcaaagatgacatccaaaattggtggttctgttgctggggggaattggaaatatgctcatggaactgcacattatggacggaatttctctgttaaatggttgaagttatgtgaactgtcattccacaaaactcgccatttaaggaatccatacaatgagaacttaccagtgaagataagtagagattgtcaggagctggaaccctctattggagagcagctggcatccttgctttatcttgagccggatagtgaacttatggctatctcggttgcagcagagtcgaaacgtgaagaagagaaagcaaagggagtgaatccagataatggaggagaaaatccagatattgtaccatttgaagacaatgaagaagaggaagaggaagagagcgatgaagaggaggagagctttggtcatggtgttgggccagctggccaaggcagaggtaggggacgaggtatgatgtggccgcctcatatgcctctcgggcgtggagcccggcccatgcctggaatgcagggctttaaccctgtaatgatgggtgatgggttatcgtatgggcctgttggccctgatggctttggtatgccagatcttttcggtgtgggaccccgtggttttgctccatatggtcctaggttctctggtgattttggaggtcccccagcagccatgatgtttcgtgggcgaccctctcaacccgggatgtttccaggtggtgggtttggaatgatgttgaatcctggacgcggtcctttcatgggtgggattggggttggaggtgcaaatccaccaagaggtggtaggccagttaatatgcctccaatgtttccaccacctccaccactacctcagaatgcaaaccgtgctgccaaaagagatcaaagaactgctgatcggaatgataggtttggttcaggatctgagcagggtaagagtcaagacatgctcagtcaaagtggcggacctgacgatgacccgcagtatcagcaaggatacaaagggaaccaggatgatcatcctgatgatagtgaaagtgaggacgaggcacctaggaggtcaagacatggagaggggaaaaagaaacacaaaatatag

SEQ ID NO: 1668 - DNA, 1053 bp, Glycine max
  Peptide Sequence Number=SeqID_93353
atgagttcccttcgtctggctttatgctgtgtggtggtagtgcttggagcactaccacacttctcatatgcacagctagatccttcattttacgatagcacatgttcaaatgtgacttcaatcgtacgtgaggtgctctcaaatgtctcccagtctgatccccgcatacttgcaagtctcatcaggctccattttcacgactgttttgttcaggggtgtgacgcatcaattctgctgaacgacacggacacgatcgtgagcgagcaaagtgcagtgccaaacaacaactcaataagaggtttggatgttgtgaaccagatcaagactgcagtggaaaatgcttgtcccggcatagtttcttgtgctgatattcttgctcttgcagctcaaatatcttctgatctggctaatggtcctgtttggcaagttccattgggaagaagggatagtttgacagcaaatcaaacccttgctaaccaaaatcttccggctcctacttttaccattgatcaacttatcgaatcatttggtaatcaaagcctcaacattactgatctagttgcactttcaggtgctcatacaattggtagagctcaatgcagattttttgttgatcgattatacaatttcagcaacactggcaacccagatcctactctaaacacaactctcttacaatcattgcaaggaatatgtccaaatggtggacctggcactaatctcaccaatttggacttaaccactccagacacattcgactccaactattactccaatcttcaacttcaaaatggcttgcttcagagtgatcaagagttgcttagtgcaaataatacggatatcgttgccattgtcaacaatttcattagtaaccaaactcttttctttgaaaactttaaggcgtcaatgataaaaatgggcaacattggagtgctaacgggatcacaaggagaaatccgatcgcaatgtaattctgtgaatggaaattcttccggacttactactactgccaccaaagaatcatcacaagatagcatggttagctcattgtaa

SEQ ID NO: 1669 - DNA, 1491 bp, Glycine max
  Peptide Sequence Number=SeqID_93354
atgccgcgcaagaagaaggctcacgatccattcttcaccaacgattcgcgaaagcgccaaaaacagaacaaaaaacttgacgaagatgaagaagaagacgccgagatagaaagcgacttcgatgaagacggcttcttcgccggcggcggcggcggcggtgaggagcaggaggaggaagagaccggcgcggaggtgcggaagagactcgcgcaggaccttctccaaagggttcggaaaagcgcgcagaaaggagaggaagaagaggatgatgaagaagaagaagacgaagaaggagcaagagactcgctcgtagctcaaaagttgttaaaggagcaaaacgaggaaagtggacgcgtcagaagaagccttgcttcaagggtgaaagtgagtggtgatgaaggatttagggtgttggcgaagcaccggcatagtgtgacggcggtggctctatctgaggatgattcgaagggtttttcggcgtcgaaagacggaacaattatgcagtgggatgtgaatagtgggcaatgtgagaggtataagtggcccagtgattcggtgttgaagtctcatgggttgaaggatccgcaaggttcggctacaaggcaaagtaaacaagtattggctttggctgcgagctcggacggtcgctatttggcaaccggaggccttgatcgccatattcatatatgggatactcgcaccagagagcatcttcagtcttttccaggtcacagaggtcctgtttcctgtctgactttcaggcaaggaacttcagagcttttttctggttcatttgatcggacaattaagatatggaatgttgaagacagaacttacatgagcactctatttggccaccaaagtgaagtattaagtattgattgcttacgcaaagaaagggtactgactgctggacgtgatcgaagcatgcaattgtttaaggttcatgaagagtcacgtcttgtatttcgtgctcctgcatcctccttggaatgctgttgttttgttggtaatgatgaactcttttctggttcggatgatggaagcattgaactttggactgtaatgcgaaagaagcctatttacattttgaggaatgcacacgcattaccggtggatagcatgaaatctgaccaaaaggacagtgaaaaactccccaatggtaacttagaaaatggttacaaccatcccaaggatcatcattgtttgtcagtattctcttgggtcagtgcggtcagtgtttgtagaaacagcgaccttgctgcatctggggctggcaatggttctgttcgattatgggaaattgaaagtgataccaaagacattaagtctctttgtaatgtgccattggctgggtttgtgaattccttggcttttgcaaaatcaggagaattcttagttgctggagttggacaggaacctcgtctaggaaggtggggacgtaaccctgaagctcgaaatggagtttcaattcttcctcttaagttgtga

SEQ ID NO: 1670 - DNA, 2043 bp, Glycine max
  Peptide Sequence Number=SeqID_93355
atgtctagggcattgtttcatttgttgggtgttttgtggctgtgttggtgcttgacatcaattggagaagctcaaatagagtacctaagatacaaagatccaaagcaatcggttcaaactcgggttagggacttgatgagtcgaatgactttagacgagaagattggtcaaatggttcaaattgataggagtgttgccaatgctaatgttatgaaaaccagcttcattgggagtgtattgagtggtggcggtagtgaaccccttccaagggctactgctgaagattgggttaatatgataaatgattttcagaaaggagctcttgagagtagattgggcataccaatgatctatggtattgatgctgttcatggacacaataatgtctacaatgctaccatatttccccataatgttgggcttggatttgcatttatccacttgtttggttctaataatctttggatcggtgctgcaactgctcttgaagttagagctacggggattccttatgtttttgctccatgcatagcggtttgtagagatccaagatggggtcggtgttatgaaagctatagtgaggatcctaaaattgtgcaagaaatgacagaaatcatacctggtctacaaggaagtatccctgccaattccaggaagggatttccatatgttggtggcaagacaaaggtagcagcttgtgctaaacactttgttggagatggtggtacaacgaagggaataaatgagaacaacacagtgattgattggcatggattgttgagcattcacatgcctgcatattctgattctattattaagggggtctctacagttatggtttcatactccagttggaatggtgtgaggatgcatgcaaatcgtgatctagtcactggcttcctcaagaatacccttaaatttaagcctttctttttgccattgtcagatcctgatttaagcaacatggttcatattgtggatgctaacaacaaattttgttcacttatttatcaggggtttgtcatctcagattggcagggtattgatagactcacatcaccacccagttcaaattacacatactctgtgcaggcttccattgaagcaggtgttgatatggtgatggtcccattcgaatatgacaagttcattcaggatcttactctcttggtcaagagcaatatcattccaatggagcgcattgatgatgcagtggagagaattttgcttgtaaagttcaccatgggtctttttgagaatcctctagctgataccagcttagtcaatgagcttggaagccaggaacacagagacctagcaagggaagcagtgagaaaatctcttgtactgcttaagaatgggaaaaatgaaagtgctccacttctgcctcttccaaagaaagtcccaaaaatcctagttgctggatctcatgccgataatttgggttaccagtgcggtgggtggacaatcaaatggcaaggattcagtggcaacagtgacacaagaggaacaactattctcagtgccataaaatcagcagttgatacaagcacagaagtcgtctttcgtgacaaccctgacaatgagtttgttaggtccaataacttcgaatatgccattgttgtagttggcgagcctccttatgccgagactgctggggacagtacgacacttgcaatgatggaatctggcccaaatgtcatcaacaatgtctgtgggactgttaagtgtgtggttgtcatcatttctggcagacctattgtcattgaaccatacgtttcttctatagatgcattggtggctgcatggttaccaggcactgaaggccaaggcgtgacagatgtcctttttggtgactatggtttcaccggtaagcttgcgaggacatggttcaaatctgtagatcaactcccaatgaattttggggatcctcactatgatcctctttttccttttggtttcggactaacgactgaatccgtcaaggacttggtagcaaggttaagcacaatttatgggagctttattggagcaggaggctag

SEQ ID NO: 1671 - DNA, 546 bp, Glycine max
  Peptide Sequence Number=SeqID_93356
atggctaatcctgaagttattcaactcattggtattgctactcagaatgttcagtatgcaacaccttcacagcttggaactgggcatgctgtggtaccgcccacttacccatatccagatccatactacagaagtatctttgctccctatgatgcacaaacttatcccccacaaccctatggtggaaatccaatggtccaccttcagttaatgggaattcaacaagcaggtgttcctttgccaactgatacagttgaggagcctgtgtttgtcaatgcaaaacagtatcatggtatattaagacgcagacagtcccgtgctaaagctgaatcagaaaaaaaggctgcaaggaatcggaagccatacttgcatgaatctcgacatttgcatgcactgagaagagcaagaggatgtggaggtcggtttttgaattcaaagaaagatgagaatcaacaggatgaggttgcatcaactgacgaatcacagtccactatcaatctcaattctgataaaaatgagcttgcaccatcagatagaacatcctaa

SEQ ID NO: 1672 - DNA, 402 bp, Glycine max
  Peptide Sequence Number=SeqID_93357
atgtggaaaaagaaatttaattatcattggatacctgtgatcttcagggtccaagagcacggtggtgagactattattcctttcagctgtgccttggaaaggaatcttgcagatatgccaccagatgaagctgctaagtattgtgaggagaacaaaacacaaagtgctcttaccaaaataataaagactggattttcagctattaatctcatttactttttcactgcaggacctgatgaggttaagtgttggcaaattcgacgccaaacaaaggctccccaagctgcaggggctatccatactgattttgaaagaggatttatttgtgctgaggtgatgaagtttgaggatctaaaggaacttggtagtgagtcagctgtgaagcatcagattgataactag

SEQ ID NO: 1673 - DNA, 2049 bp, Glycine max
  Peptide Sequence Number=SeqID_93358
atgcctctgcaactttttgatggcagcgattccgaaaacgaggacatttcaaagatcaagatagacaaggagtatgctcgtaggtttgagcacaataagaaacgggaggacctccagcgatttgaggaattaaaaaagaagggtgttattgattcaccttcacactcgcattctgaaggtgaggaggaatctgagtccgagtcattggatgatgatgatgatgactatgagacgcttgtcaattctagaaggagggacaaggagttctttgatgccttaattaaggtgaagaagcaagatcctattcttaagcaaaaagatgttaggctctttgggtctgatgatagcagtgacgacgaaagtgatgagaaggagaaagttaaatcaaaagacaagaagggtgaaaagccaatgtatttgaaggatgtggtggcaaagcatttgattgaggagggggcagattttggtgatgaagaggaggagatagatgaaaaggaaaaacgtaagggtaagaaggtaatgcctttgaaagataaagactttgttattaaggatgggaagaagacttatggtgatgagcaagaggagttgaaaaaggcttttctgcaagcagtagaaagggagggtttggaagatggtgaagaggagtttttcagtgtgaaggagaaggtaggtgaggaagacaaagtagatagtgatgacaaggaacttgaggagaagctggatgagtattttggtggagatgtagaatcaaatgaaaattccaagtttctaagaagctatttcatgaacaaattgtggatagacaagagtgggaagaatttgaatgttggagaggatgaattggacgagatttcagaggatgaggtggagcttgagagacaggaagaatatgagtacagatttcaggaaaatccaggagatagggtgttgggtcatgctcggaaggtggagggatcagtgaggaagaagatgaatgcaaggaaagagcagagaaagagcaaagaggagagaatggctatagaacaaaaggagagagaggaggagttgaaacgtttaaagaatttgaagaagcaggagatacaggagaaggttaaaaagataatgaagactgcagggatccatggtgatgatattatcccattgtctatggcagaaattgaagaggaatttgacccagaggagtatgacagaatgatgaagaaggcatttgacgagaaatattataatgcagaggatgctgaccttgacttttgtagtgacattgatgacattgagaagccagattttgaaaaggaggatgaattacttgggcttcctaaaggctgggatgcatgcggatctaatggtgggtttttagctgcaagggaaaaagcattgaaagaaaagattgagaatactagtgatgacgatctccctgaagcagaagatgaaaacgaaaggtttgagaatactagtgatgacgatctcccggaaggagaagatgaaaaagaagagaaaattcctgaggaaggtagtcggaagaggaagcgcaaaacagcacttttggagaaagcaagacaggcaatgatggatgagtactataaattagattatgaggacacaattggggacctgaagacaagattcaagtatgccaaaacaaaatcaagtagatttggcttgagtgcctcagagatactattgatggatgacaaggaattgaatcagtatatttccttgaaaaagcttgctccttaccaggaggaggaatggaaactaagcaaacagaaaagatacatgctgaagatgagagccaaggagctccttcggatgtcaagtttggataagaagaaaaggaagaattcaaaggttgattctggcaagataacttcatcaaaaagtgttgagaacgaaaaaccaagcacagaagaatcaaatattaatacagataatctatcaaggaaagccaagcgaaggcgacaagtggctaatttgaagttatcacaatcaaggcttaaagcatatgggaagataccctcaaaatctaagcatggaggaaagcactga

SEQ ID NO: 1674 - DNA, 426 bp, Glycine max
  Peptide Sequence Number=SeqID_93359
atgctgtttgaaagaggatctccggcgaggtgctacatgacgccgccgccgcagcgaacttcgccgtggaagccgccacattcacggtcttctagtgtgccgttttcagagagaaaaatgtcaccaaattctgtgaataaaagtgatatttttcatataattcacaaggttcctgctggggactcaccttatgttaaagccaagcaagttcagttggtggataaggatccgggaagagcagtttcattgttttgggctgccatcaatgccggagatcgtgttgagagcgccttgaaggatatggccttggttatgaagcaactcaataggtcagatgaggcaattgaagctattcgatctttccgtcatctttgtccgtccgattctcaggattctcttgacaacatcttggttgagctgtataag

SEQ ID NO: 1675 - DNA, 3654 bp, Glycine max
  Peptide Sequence Number=SeqID_93360
atgaaggtatatacatgtgtaagtgaagctgtcctcacagagttcataccaacatcaacaccaaaattcaagttttaccagggcaatgaagttcaatctgtattatttgaagatttagcatttaaactgaagatgttaaaagagcagcatgaatccaatctaaaaagttcagatttcactaaatcagcagctgagtttgcacgaagaagaacaaaaaagattttttctgctttaatattttgcctggatgagcttggtgtttggttggctttgaaggctgcagaatctttatcttctaatgatattcaattattttcatggggacattctggggatacagttgttaaaaactttatttcagctggtgtgcaaacactcaaaacttacttaccatgtggtcctcagtggtcaattggtgacaatattaaatatgatgtggagatggagctgttatcctccaaagtttgctgtcttattgactctatacttgagtacaggggtttgactgacatgagatgcataatttttgtggaaagggtcattacagccgttgtccttcgggatctattaaataccttgcttccaaaatacaatagctggaagactaaatttattgcaggacaaaattttggattgcaaaatcagtctaggaaaaaacaaaatgaaatcgtggaagaatttcgaatgggattggtcaatatcattgttgcaacatcaattcttgaagagggtttagatgttgaaagttgcaatttagttattagatttgatccatgtcacacagtgtgtagtttcatacagtcccgaggacgtgccagaatgcaaaattcagattatatattaatggttaagagtggggattcagttacatgttctcgactagcgaaataccttgctagcggggatattatgagaaaggagtcattgcgccattcttcccttccatgtgatcctcttgaagaagatagatttgacaaggaaacttatcgcgttgcaagcactgaagcctttgcaaatcttagttctagcattagtttgatacacttgtattgctcacggctccctgcagatgggtactttaaaccaactctgaggtgggacaaagagactggaacattgtatcttcccaagagctgccctctacagcctattcgtgtagaaggagataaaaaaatcttaaagaatatcgcatgccttgaagcatgtaaacaacttcataagattggagctttgtcagataatcttgttcctgatattgtcatggaagaagcagaggtggaggaattagggaatgaaccttatgatgaaaaccaaccaacttttgtcccatttggattggtaaattctgtgtcaaataatagtcaaacggtctatcattgttatttcatggaattcaataacaaatttagctatgatgtatctgtccaagatatttttcttctcatgcgaattgagctcgatccagaaattggatgcatgcaatttgatatgggttttgacagaggtagcttgtcggtaaactttagatacaaaggaaccattaatctttcgcctgatcaggttcttttgtgtaaaaaattccaagttactatacttagaattctaatagatcatgatatgaataagttgactgctggtttggacagatgctatttggaagatgatcttgagattgattatcttctgcttccagctatgggtaaagggaaatatacagctattaattggttagctgttaattctgtaaatccatctgaagttagctgtaagtatcatgaaccccacataaggacaaaaagtggtttagtttgcagttgtaaactacaaaatgcattggtttgtacttcccaccctattggtaagattagcttctatattgccaccggtacaatggaattggatggaaattcacctatggaactaaggggtggtggggttactacgtacaagaagtactatgaacaacaccatggcattcaattgcaatttgaacatcaacgactacttaaagcaaggcacatttttcaagttaaaaatcactgtcatggacgcaaacaagggaaggaaggagaagtaagcaaggcctttgttgaattacctcctgaactgtgttcgatagtcatgatgccgatatcagatagtctcatttattcctactcatttattccgtcaatcatgcatcggtttgaatcattgcttggagctttcaacttaaaaaagatgcatttggatcattgtgcacggaatgaaattcaaacaatcaaggtgttggaagcaatcacaacgaaaaggtgcaaagaggcctttcattatgagtctctggagactcttggtgattcttttttaaaatatgctgcgagtcaacagctgtttaaaacctatcataatcaccatgaaggtctccttagtctgaagagggaaaagatcatttctaatgctgccctctgtaagttggggtgcagttctggacttccggaagagactagtatggagtgtaggcagaaaattgttgagtgtgtacagatagctaggctctgggctggtggtttcatacggaatgagccttttgatcctaatacctggattattcctggtgataagcctagaagttttaaattgaaagagttggttgccaaggggaaaacaatttatgttagtggaaaaagaaaattaagacagaagattgttgctgatgttgtcgaggcattaattggtgccttcctcagcactggtggtgaaaaggctgcattgttgtttatggattgggttggtattaaagtgagttttaataaaataccgtatgacagacactttgacattcaaccggagaagctggtaaatgtcagttttctagaatcgcaattaaattactcattccatgaccgttcccttttagtggaagctgtgacccatggttcatacatgctgcctgaagttcctagatgttatcagcgactagaatttctaggagattcagtattggattatctgattacttggcatttgtacaataaataccctggcatgacacctgggcagttaactgacatgaggtcagcttcggtgaataatgattgttatgcatggtccgccattaagcatgggttgcacaaacatgtactccatgcctcacaagaactgcatatgcatgtttctgctacactcaacaaatttgataagctatcttcattgtccacttttggttacgaggcagagacatcactccctaaggtacttggagacattgtagagtctctggctggagcaattcttgttgattcaggatacaacaaggaggttgtgtggcaaagcataaggccacttttggaaccccttgtgacaccagaaacattaaagctccatcccatccgagagttgaatgagctatgccaaaaaagaagttataagattatactagaggacgtgtcccgcaaagatggtctgacttattatagaatggaggtagaagctgatgggatcattcacaagtacgagtataaaggtgatgctcttagggacacagccaagaagatagtctgcaaggaaattttgaattccttgaaggatggcggtgctcataaggacacagccaagaagatagtctgcgaggaaaaattaaattccttgaaggaaggagaatcaaatggtgcataa

SEQ ID NO: 1676 - DNA, 732 bp, Glycine max
  Peptide Sequence Number=SeqID_93361
gcagagcatggcccagatagtcaggttgttcttgtgattgctggagatggtgtggatctgaatgcaatacaggaggaactcagcaagcagtgtgacagtcttccaagaggcgagtttgcctctaaagctctgagccatagtttttttgtgtatgcgtgtgatatgcttgaggctatcaatttctcaaacttatatgcacctgaacatctaattatcaacgtgaaggatgcagagaagtgggagagttttattgagaatgcaggttctgtgttcttagggccttggactcctgagagtgttggtgattatgcaagtgggacaaaccatgtccttcctacttacggttatgcaagaatgtatggtggtgtgtcattggactccttcctgaagtacataactgtgcagtctctctcagaggaaggtctaagaaggcttgggccatatgtagcaaccatggctgaagttgaaggccttgaagcccacaagcgagcagttaccttgagacttcagtacatagaagccaggcagaatctacgagaaaagagatttgtaacagaaagaaatgatactcctgttgattggactcccaagtggaaagtcccaaatcccaatgcgggaaaacttgagtttgtccccaacaaacatggaagtctaccaattctggagcatgctttagccactgcacttgaagcagcacatctagttgcaaccaagttcatcagatggccataa

SEQ ID NO: 1677 - DNA, 114 bp, Glycine max
  Peptide Sequence Number=SeqID_93362
atggaggtcagtccttgcatgagaagacaagaaactagcagtggtccattctgttgccccggggtaacatgtgctgatggccataacgtatctttatggggaagaaagaagtaa

SEQ ID NO: 1678 - DNA, 528 bp, Glycine max
  Peptide Sequence Number=SeqID_93363
atggtgctagttgttgcctttcttggtcaagaacttcgcaaggtgcttcctgcaattctctttgtgaaagcaaacaatgaagagtcgtgtaagaatactaggtttaagagactggccctggtggactatactgcaaggcagaagaaaaagaagatgaaagcattgattcctcagattatacaagctatatactttggagtcctttccatactcaagagccaatccagaatcacgcaggatgtagggaaagcttacaatgagtgctggcagggagaaccagctgctgaacgcttgcttgccatgagcaggttcaaaaataagcaacttcggtcattcttgattgctagcatgaatagtttacatctactgacacttttttcaggtacagttgctgcaaacattggctatagggatctgacaacaaaaattgacatggacagggtgaagcatgcatctgaaactgctcatgcagatgagtttgttaaaaaactaccagaaggatacaaaatcaatattggatatttataa

SEQ ID NO: 1679 - DNA, 1647 bp, Glycine max
  Peptide Sequence Number=SeqID_93364
atggcaacaaaacctcgtttggcttatctccctgccatttttgttcttcttctagttgtcttcacttctgtgacggcacaatccccagggccagaatcttcatcactccacgacaccttccttcaatgcctcaccaaatacacaaaaaactcctcatctcaactctccaacatagtcttcgctaacaccaaccccaagttccccactgtcctccaaaactacatccgaaacgcgcgtttcaacacctcctccaccccaaagccttcactcatcgtcactccccagaaagaatcacacgtccaagccactgtaatctgcgccaaaagcgttaacattcaactcaaaatcagaagcggaggtcatgactacgagggcatctcgtacatctccgacgaacccttcatcatcctcgacatgttcaactttcgcagaataacggtggacataaaaaacgaggttgcagtggtccaagctggagcaacactcggagaagtttattacagaatatggaaaaagagtaaagttcatggctttccagcaggggtgtgtcccactgttggcgtcggtggccatttcagcggtggagggtacggtaacatgctgagaaaatatggcttatctgttgataatgttattgacgctcaaattgttgatgtgaaaggaaatcttctaaacagaaaaacaatgggagaagatctcttctgggctattagaggaggtggaggagccagttttggtgtcatattatcatacactattaaactcgttcctgtgccggaaacggttaccgttttccgcgttgagaagactcttgaaacgaatgtcactgccactgatcttgttgtgcagtggcagaaagtggcgccaaatactgatgataggcttttcatgaggctgttattgcagcctgtgagttccaaggttgtgaagggaacaataactgttagagcctcggttgtggctttgttcctcggaggggctaatgaggttgtgtcgattttggctaaacaattttcgcttctaggattaaaaaaggagaattgcactgaggtgagttggattaattctgttctgtggtggaacgacaacaatagtttgaagaatggtgtcaaacctgaagccttattggataggaatttaaactctgcgggttttctcaaaagaaaatctgattacgttcagaatgccatttccagagatgggttggagtggctatttaaaaggatgattgagttgggaaaaacggggcttgttttcaacccttatggaggaaaaatgtctgagattccttctgatgcgacgccgtttcctcaccgaaaagggaacttgtataagattcagtattctgtgaactgggatgatcgatcacctggtgctgctctaaatttcacaaaccaggctaagaggttgttcagttacatgaccccttttgtgtccaagaatcccagaagtgcgtttttgaattatagagaccttgatattggggttaacagctttggtgagaatagctttcaggaaggggtggtttatgggaccaagtacttcaatgacaattttcagaggcttgtgaagattaagaccattgttgatccggaaaactttttcaggaatgaacagagtatccctgttcttcgtggcaaagcatag

SEQ ID NO: 1680 - DNA, 1602 bp, Glycine max
  Peptide Sequence Number=SeqID_93365
atggcgaaacctagtttattctatctttcagctgcttttgtttttctgtctgtttccagttcgttgtcggcacgacccccaaatcccccaatccatgacacttttcttcagtgcctcacgcaacatgcaaactccacaaccccacttgccgacatagttttcgacaacacaaaccccaaattccccattgtgctcgcaaactacatccgaaacgccggttttaacacctcctccacgacgaagccattactcatcgtaactcccatggtagaatcccatgtccaggctgctgtattatgcgccaaatctgccaacgttcaactcagaatcagaagtggaggccatgattatgagggcctctcttacatctccccgaaaccctttatcctccttgacatgtccaaccttcgcacgatcaccgtcgacgttaaaaacgagcttgccgtggtccaagccggtgccattcttggcgagctttattataggatctgggaaaagagtaaggttcacggcttctctgcagcggtgtgtcccactgttggcgttggtggccatatcagcggaggagggtatggtaccatgttgagaaaatatggcttatctgttgataatgttattgacgctcaaattgttgatgtgaaaggaaatcttctaaacagaaaaacaatgggggaagatcttttctgggctattagaggaggtggaggggccagttttggtgtcatagtgtcgtttacgattaaaattgttcccgtgccggaaacggttacctttttccgagttgacaggactttggaacagaatgccactgaccttgtgttgcagtggcagcaggtggcgccaaccactgatgacaggcttttcatgaggttactattgtcgcccagtgggaaaactgctacagcctcggttgttgctttgttcctcggaggggctaatgagcttttgccgattttggataagcagtttccgcttctagggttaaagaaggagaattgcactgaggggaggtggattgattctgttatctggtttgatgatgaagaggcttttgaaaagggtgccaaacctgaagtcctattggagcggaatcccaactgggctctttttcttaaaagaaagtctgattatgttcagaatgctattcccagagaagggttggagcttttgtggaagacgattattgaaatggggaaaacggggcttgctttcaacccttatggcgggaaaatgtctcagattcttcctgatgcaactccgtttcctcaccgtaaagggaacctgttcaagattcagtactctgtgacctggtcagatccatcacctgctgcggctcagaatttcttaaatcagactagggttttgtacagtgtgatgaccccatatgtgtcgaagaatcccagaagtgcctttttaaattacagggatattgatattggcactaacagctttggtaagaatagctttgaagaaggggaggtttatggggccaaatacttcaatgccaattttcagaggctggtcaaggttaagactgcggttgatccggaaaactttttcgcgtatgagcagagtattcctgtaagtcccaccaaagcatag

SEQ ID NO: 1681 - DNA, 915 bp, Glycine max
  Peptide Sequence Number=SeqID_93366
tagaggtatgtgcacaagaagattcaacaacgtggcctatagcaaagcctgggtgtgattcggggtgtggagatgttcccattccttatccgtttggaatgaaccgttcggattgctatgcaggaaaatggtttgaaatagaatgcagaaacagtactagaccttacctcaagtctataggattaggagtggaggtgttatcctttgatgtgaatagaggcacagttgatatcaacaatccgatttaccgcagtaacaactgcggaacaaaaacaaccaaacatcctgcggtcaacaacatatcgctggaaggaagccctttcgtgtattcccagagaaataacaaatttgttgccgcaggttgcaataacattgcttttctgaagggaaaagggtctgcagtaagtggctgtgtgtccatctgcgacaacgacgatgatgtcgggaacaccaaccttggaacaatcgaatgcaatggcgagtcctgctgtgagaattccctgcccatgtatctttcggaatataccccagagatcaaaggtttaaatgagaataaaaaaggtaaccactgcagttatgccatgattgtacaaaatcagccaaatccagatccatatcaatatcaatgtcgaaatggatatcgatatccatatccatatcaatatcaatatgggtactccaatttacttggtgttggcaaactgaaggatatagatttcgtgcctgcggtacttgagtgggagattgtgaatgctaccctcaaactccctacatctccatatgttgactgtaaaggcactaatattacatcttcacgatataattactctggtcggagatgttcctgcagatatgaagcatactactatattactccttctcctcgtaatccctacattgctgacggttgtccag

SEQ ID NO: 1682 - DNA, 237 bp, Glycine max
  Peptide Sequence Number=SeqID_93367
atgactgggggctctgaaatcccctacagagctctccatggagaaactgcaaagagaagaaagggatttgtggagggttgttgggagaaaggccatagcgagagaaaaccctgtcgtgaaggccgcgaagatcgtcaaggtctaaaaaccctaaatcggagaacaaaaatctccaagaaatcgaacaaattgctgggaaaaagaaggggataccacgaaaacgaaataataatctaa

SEQ ID NO: 1683 - DNA, 2823 bp, Glycine max
  Peptide Sequence Number=SeqID_93368
atggatacaaccaccacaatcgctcctctactcttctgtacctgtgcttgtctcatcttcttctccgcttcattgtcagaagcaacagtagttggttatggctacaccatctcaactgtcaacaattatcccataaagaattctttgactgcaaaccttaacctcatcaaatcctcctctgtttccggacccgacattccacacctctccctcactgccagttttgagaacaaggataggttgagagtaagaatcactgactccaatcaccaaagatgggaaattccacaagaagtgattccaagagactcatcttcccaacattaccctcttggcttcctcaataccaaacaaggttcccatcagccaaaagactctctgagcctcacacattcagactcagaccttgttttcagtctccacaacaccactccatttggcttcacagtctctcgcaaatcttccaatgatgtcctcttccacgccgcaccagacccttccaacccggaaacttttcttgtcttcaaagaccagtacctgcagctctcttcctcccttccatcgcaaagagcctctctttacggcttcggggaacacaccaagagctccttcaagctgcgaccgaaccagacccttacactttggaatgcagacattgcaagtgccaacctagacttgaacctttatggctctcaccctttttatttggacgtcagatcacactcctctgatggaaaagtgaaggctggcaccacacacggggtgttgctgctcaacagcaatggaatggacattgtgtatggtggtgatcgaattacttataaagtcattggtggggtttttgatctctactttttcgctggatcctctcctgaattggtgttggagcagtacactcaactcattggaaggcctgctcccatgccttattggtcctttgtttttgggatagctggtaaatggcacaagtgcacgacaccaaagcagttagctatgccattgatagagttgtgttctgttgctacacaaatacatacacgcactgcagattcttcaaggcagaggatcagttttcatcagtgtcgatggggctacaagaatgttagtgatctcgaggatgtggttgccaactatgcaaaagcaggtataccccttgaagttatgtggacagatattgattacatggatgcatttaaagatttcacattagaccccattaactttccgctggataagatgagaagttttgttgatactcttcacaagaatggtcagaaatacgtgcttatattggatccaggtatcagtgtaaatgagacatatgcaacctatgatagaggtttgaaggctgatgtctatataaagaggaatggaaacaattatcttggtcaagtttggcccggaccagtttattatcctgattttctaaaccctcgcagccaagcattttggggtggggaaatcaaattatttagggaccttctccctattgatggtatttggcttgacatgaatgagttatctaatttcattacttctcctcccattccatcttcaaatcttgataatcctccttataaagttaacaatgttggagatcaacgacccattaatgacaaaactgttccagcaacatctttacactttggtaatatcactgagtataatgtccacaatttgtatggactactagaatccaaagtaactaacaaagcattaaaggatataactggtaaaaggccattcatcctaagtagatcaacctttgtgagttctggtaagtatgctgcccactggactggagacaatgctgctacatggaatgatttggcatactcaatccctgcgatattaaattctggaatctttggaattccaatggttggagcagatatatgtggtttcgaaggaaatacaactgaagaactttgcgggcgttggatccagttgggggctttttacccctttgcaagagatcattcagtaataaactccatccggcaagagctttacgtttgggattcagtggcttcatcagctaggaaagtgcttggcctacgctatcgtcttctcccttatttctacacactaatgtatgaagcacatacaaaagggactcccattgcaagaccccttttcttttctttccccgaggatgtcaccacatatgaaataaactcacagtttctattaggtagaggagttctggtgtcacctgtgctacaatccggggcaaccactgttgatgcatactttcctaaaggaacttggtttgatctcttcaatgtctcaaattcagtgaatgcagaatcaggcaagtatgtcactcttgatgctccatatgatcacataaatgtgcatgttggggaaggtaatattttggccttgcaaggagaagcaatgacaactgatgctgcgcggaaaactgcatttcaacttgtggtggttatcagtagcagcagaagtagttatggacaattgtacttggatgatggggaggcacttgatatggcaggggcgaaagatcagtggacactggtaagcttttatggcgcgttacacaacaatagcgtttctgtaacatctaaggtcactaatggaaggtttgctctggaccaaaggtggatcttagacaaggtgactttcttgaggatacctaagctagcagggaatgagttgagtattgtgaatggaacaagttcaatgaagaaggcaattgtgaagtctcaatttgatagctcctctcagtttgtcaatgtacaagtttcaaaattgtcgcttcttattggagaggaattccagctggagatagaaatcaagtag

SEQ ID NO: 1684 - DNA, 312 bp, Glycine max
  Peptide Sequence Number=SeqID_93369
atgatgatgatgatgtgttccatgtggatgtgggttgtccttgtggccattgctggtgcccttttagtcctaagatctatcctcaagaatgtaaattggtggctctatgaatccaaattgggtgtgaagcagtactctttgccaccaggtgacatgggatggcccttcattggcaacatgtggtcctttctcagtgctttcaagtccaaggaccctgattccttcatctcctcctttgtctccagccgaaatccaaacacacctcaaagggtcaatggttcccgtgatcctcctctcacctcaggccactga

SEQ ID NO: 1685 - DNA, 1350 bp, Glycine max
  Peptide Sequence Number=SeqID_93370
atggtggcatcagacggtggcggtggagggagattgatgaagaaagttctgggcttggggttttgggtacaaggattcaggtgttttccatggttggtagtgagtttctacctcaaagatggtctgaatgtggacccttccactcttcaaattcttcagagttccgctaatcttcccatggttggaaaaccactctatggccttctttcagactctgtctacatctctggccagcaccgagttccctacatcgcccttggagccaagttgcacacttttgcaactttcctacagtttgttgttggttccgtgatgtggggattttggaatcgaggattggcactgtcgtggctagtcatagcaatctctccaacaaacatgtctattttcgcaatctccatatacctccttcttagtaatctaggtgcttcaatagccgaggttgcaaatgatgccattgttgcagagatggctaaacagactccttcctcaaccaagcacccccaaccatcctcctcaggcaatctccaatcatttgtttggatagcttcctctgcaggaggagtccttggaaaccttcttggcggaatttttattggccggctcccaaagagtccatctggtggaataaggaaacagctttcacagctattggttgctctaagaaagcctgaaattgcatattcaatatcatggtttacagcatcttatgccattattcctgcacttacaggcaccatgttcttttaccagacacagtatttgaaaatagactcgtcagtattgggtatctccaaggtgtttggccaggcaacaatgctcctatggggcatcatatataatcaatacttcaaatctgtctcatcaaggaaactgatatcggccattcaagttatgatggcattcttaatggtttcagatttcttgttcgtgcgaggtttttatcgacaaatgggcatgccggactcgctctatgttgtgattttctcaggattcttggaggttctatttttctttaagattctgccattcagtgtcctaatagcacagatgtgtcccccaggatgtgagggttctgtaatggcatttcttatgtcgtgtgttgcccttgcattcattgtgagtggataccttggtgttgcacttgcatcgtgtattaaggtaacaggaaatgacttttcaggacttccatttggacttctgatacaagctgcatgcactttggtgccaactttttggtcatcatgcataccagacaagtggtatgatgctgaagtgattgattctgtttcatttctttgccttcatgcatcagctggcagatacaagctatatcagtttgttttctag

SEQ ID NO: 1686 - DNA, 799 bp, Glycine max
  Peptide Sequence Number=SeqID_93371
gaagaaccaggccaaaaaggttgtttgtattcctgcaccagcagctgcaaacagcagacaaactggagaggtagttccgtctgatttgtgggcttggagaaaatatggtcagaaacccattaaaggttcaccttatcccaggggttattacagatgcagtagctcaaagggttgttctgcgaggaagcaagttgagaggagcaggaatgacccaaacatgctggttatcacatacacatcagagcacaaccatccatggccaaaacaaagaaatgctctggctggttcaacaagatcacagccatccaagaacaacaacaatgctgctgcttccaattcaaagaattcagaaggctcaaactcccaaaagggtacagcaacaaaagcaaaggatgatgaagagagcaacaattataacaatagcagtgagggcaatgtgtccccagttgtggctgggaactcatcaaacagtgtgaaggaagagaatatggaagacatagagaaacatcagattgagatggatgagggagaattcagtgatggaatcccttataagcctagtttgatggatcatcagagtactaataaccaacaatctgaggacttctttgctgagttgggagaaatagaagctgaccctttggaccttttgttcacacaaggttttggtggtgctgatgatcaaagggaatccaaggccttggatccatttcatctctttgactggtcaggaaacaacaacaacaacaacaacacaagtagttcatttgaagaacctaacaataagagaaggttataa

SEQ ID NO: 1687 - DNA, 738 bp, Glycine max
  Peptide Sequence Number=SeqID_93372
gcctagaagtcatgaacacagaaacaatgaagccagttcctgctgacggcgccagtgttggcgagattgtgatgcggggcaatgcagtgatgaaagggtacttaaagaaccgcaaggcgaatatggaggcctttgcagatggctggttccattccggggatctggccgtgaagcacccggacggatacatagaaatcaaagacaggtcgaaggacataataatctccggtggtgaaaacataagcagtgttgaggtagagaatgttctcttctctcatcctgcagtgcttgaggcatcagtggtggcaaggcctgatgagaagtggggtgaatcaccttgtgcgtttgtgacactcaagcctgcaggaatggatggtgctgcttctactaatgagaaaattttggctgaggacatagttaagttctgtaggtccaagatgcctgcttattgggttcctaaatcggttgtgtttggaccgttgcccaagactgctactggcaagacacagaagcagttgctgaggacaaaggcaaaggagatggggcctgctctgcttatgatggaccatgttaaacaagagctacccttggagcatgcattaggaacttcaagaacttggccgatacttgctaaaagtgtagatgatggagaagttgcacctatgcctagcttacagcctcaagatgcagaactagagtcacaaagcagcctctccctccctccctccctccctccca

SEQ ID NO: 1688 - DNA, 261 bp, Glycine max
  Peptide Sequence Number=SeqID_93373
atggtaaaacgtacctaccagagagaaaagctcacgacggtgcctccggagagaattggtgataatgatgatgatgacaataacaataatagtgatgatggtgaaagtggtggcaatgatggaggtttttgcgatgacggtggtggtactagtggtggcaggacaatggcgatagtagctaggagtgacattgatgatgatggtaataatgatggctactacgatggagatgacgataacagtaaccttgttgctttctaa

SEQ ID NO: 1689 - DNA, 522 bp, Glycine max
  Peptide Sequence Number=SeqID_93374
atgtactggaataaacaagaaggtcctaaaaaccatatcctgttatcccgaaaggtctggagaagaccatctatagggcaagcaggtccactaggaggtgacttcccagtagtcaccagcgaaggacataatattcctgatgttatctttacatctccaatagaaaaccttgctgaagtagcaaaatgccttgataaagttgatggtgttgtggaccatggtgtcgtatctaaagtcccatgcacagttgtaattgcttctcagactggactgaaaattttggacaaactaactgcagatatattcccatgtgcttctatcatcaccatgaataaaggatgggactgggggctgagggagaagaaggcaacaaaagttggtgacttggtgggaagagaaggaggaggggaaatggagggggtgaaaatagcaattcagagggagaatagcaactcccagattgcaatagtcatcaagttggagcccaagcctaataatagcccagaaacactgcaaggctga

SEQ ID NO: 1690 - DNA, 201 bp, Glycine max
  Peptide Sequence Number=SeqID_93375
atggcggaggaatattatgctattgttagcccatattttcgacgggctaaaatatgctctaagtatgcattggatgtcgtctcgaggttcaaggaggtatttgcgaagtacaaggctaggataagaaagagagctttcgaatcattgggtgattcgaattggtgtatgatcgagtcgaagtcgaggcaacaggagttctaa

SEQ ID NO: 1691 - DNA, 199 bp, Glycine max
  Peptide Sequence Number=SeqID_93376
atgacaatgtgggtcaaaagtggagaaaggaaggtcgttcgtcattgcaaaagagcaagcattgtaatgggtaaaggaaaggggaataggaatatgcctggtaaaggaaaagctaagaaaacagccaaaataacatggtgggtgtttggagggaggggatatttggtggctggaaatgcaatgtatgatgagtatgaca

SEQ ID NO: 1692 - DNA, 555 bp, Glycine max
  Peptide Sequence Number=SeqID_93377
atgaagcctatgcctaccacaagaaatttaaatgttctcctgatcttttggtcattgttcagtctctttatggcaggttatggtgctgaaagtgacatctattgcttgcaaaccatcaagaaattggaccggtttaataacttacctagctgggattttgagagcaacactgaaggtgacatatgtaaatttaatggtgttgaatgctggaatcaacatgatgtggaagatagagtaatcagtctcttgctttctaccactactgtcctattagctttcatgtactattatgaaccttggacggaattcaaaaagaggagtaatgccattcatcccttaagaaagaagcagaaccatcaaaaggagactagacaaaaagctgaattgctaccattggccttgcaagatcaaggaagcaaagagctagcaagattgttggagagattgattcctagaatgagcttcatggacttatgcaaggcaactgattacttcagcacaggaacaacagggattatgacaagtgcaagaggaaatttttacttgaaaccatga

SEQ ID NO: 1693 - DNA, 1077 bp, Glycine max
  Peptide Sequence Number=SeqID_93378
atggcagatctcaagtctacattcttgaacgtctattccgttctcaaatctgaactcctccacgaccccgccttcgagttctccgatgatgctcgccattgggtcgaccggatgctagactacaatgtgcctggaggaaagttgaaccggggactgtcagtcattgacagctacagattgttgaaagaaggacaggcattaaatgatgacgaaattttccttgctagtgctcttggttggtgtattgaatggcttcaggcatattttcttgttcttgatgacattatggataactctcacacacgccgcggccagccatgctggtttagagtgcccaaggttggaatgattgcagccaatgatggagttctactaagaaaccatattccacggatccttaggaagcacttcaggggaaagccatattacattgatcttcttgatttgtttaatgaggttgtacttgcacaaatgccgaagtttaaattatgtggagttcatcttgttgagtttcagactgcttcaggacagatgatagatctgatcaccacattggaaggagaaaaagacctttctaaatacacattaacactgcatcgacgtatagttcagtacaagactgcatactattcattttaccttccagttgcatgtgcattgcttatggcgggtgaggatctagacaaaaatgttgatgtaaagaacattcttgttgagatgggaacatactttcaagtacaggatgattatttggattgctttggtgatcctcaaacaattggaaagataggtacagatattgaagatttcaagtgctcttggttaattgtgaaagccttggaacttagtaatgaacaacaaaagaaagttctacaagagaactatggtaagccagatccagaaaatgttgctaaagtaaaggccctgtacaatgagcttaatcttcagggtgtatttgaggagtacgagagtgggagctatgcgaagcttgtatcctccattgaagctcatcctatcaaagcagttcaagctgtattgaagtcctttttggctaaaatttacaaaaggcagaagtag

SEQ ID NO: 1694 - DNA, 231 bp, Glycine max
  Peptide Sequence Number=SeqID_93379
atggaagcggaatggagaaggaagagagagaggagacgccacttcaaggaaaagatgagtctagaagaagctcaccaccataggaggccatggataagagcttggaggaagaaggagatgaatgaagggagaggaagagaagagcatgaaattttgtgctctaaaagagctctaaaatcggaacccactaatccaagatcaattccaagattctccactaagtgtgcttag

SEQ ID NO: 1695 - DNA, 243 bp, Glycine max
  Peptide Sequence Number=SeqID_93380
atgaagattcatgctgacaagttggtagccagaggcatcattggacacgcccttacacacacaaaagagcatggctggtcagattccaacaagaggcatgtggtggcacatcagagatctagtggccgcaccatttcacaaacaagcaaatctggacatgctagagttgatagcaatggcgatgaggtgatagcttgtgcagacaatggggaggggaggggagggaaggaaaggggaaattag

SEQ ID NO: 1696 - DNA, 384 bp, Glycine max
  Peptide Sequence Number=SeqID_93381
atggagaattggaggagagggacttatgtgttggaaccattaatgattgcgggaagaagacttgagttggagaagaagagaagaactggaaagcagggtggtccttcgttgttgtgtccattttggtcgaggcgcattgattacggtggttcattggaacttggtgtgcatcaacatgttgattgttctgatacctttaatacttctcaggagtttgctacccatgatgatgttttgcattggactctatctgttgcgtatgatattggttttgtggcggtgattatgaggtcatacacagatactcgaattaaaggaaggacctcatttgttttaattggttgtgaaaggagtgtaaaatatagggtcaggaagaaagattga

SEQ ID NO: 1697 - DNA, 666 bp, Glycine max
  Peptide Sequence Number=SeqID_93382
atgtatttgaaagggtgggtggtggcgagggcgaagatgatggggttgaagatgaagtcggtgggtgatctgttaactttctgtcgagtctctgtccacctacaacgcgtgccacgacatgagctccctaaatattcgtgcgaccaaccaggcaacttgttcgatgagacagtgaacgagacttccattagaggtgagattagaggtgtctttgtagatgtttttgaagagctagagcaaaaaagacatctcagagtgaaaaatggcgtcgtcgagcttcgtgacattgagcgttgtgtggtctttgagggacgtttgagcatgggcgagaaagtggtcgagggaggctacaaacgaggtttcagcattaggaaggtggaaatgggtgggagaaggagaagaagggttgcggagaggagaggagagagagagagagagagagagaaaaggaacaggaggagagagaaagcgaggaggaagaggaagagagccattcaggaattggatcgctggttgttcttccctatgtgtaatctcacgtgtaatctcactcgggcaacgaatacatgtgacaccacacgtcgcatgcctacatgtttggttaacggtcaccttaaatttggagaattaaggagaactaggcggaaatatatacttcaggtctag

SEQ ID NO: 1698 - DNA, 510 bp, Glycine max
  Peptide Sequence Number=SeqID_93383
atgcaatggaggttccaaaggcagaaaagatgcaaagacaagatgaaactaacaagaaacaagcatagaaccatggttacctcgaaagaaaacgaaagttggaagattccgcttcggttgaagggttcctctcggtgtgggttttcaatggagaacaatgatggtttgtggtggctaatggtggttgtgggtgatggagaaagttattggaactttagaaatggctttggaagaaagaaagaagaagaaatgacgtttttcctaagctacacgaaagcaaaggctgaaataagtttcattaagaggcttctagcacactccagacattttctcaaagatcccaacggtcagatcatggacaagtatcttgtgaagttgcagaccaaatttcgagaagatcaaacggttaatgaaggctgggcagcgtttttaccgagacaacttcatgtagctttctctagaagcttcattaagaggcttcctccagaagcttcctcgtggcttctttga

SEQ ID NO: 1699 - DNA, 498 bp, Glycine max
  Peptide Sequence Number=SeqID_93384
atggaagatattttaaagaggtggtctgagcatgttgaaagcatacaattaggggtcattcacccgccactggttttgatgatgccaaaagaacaagatttcttcaagcctaaagttaaaaagaggctaagtcatgaagtgctaaaagtgatagttgagctcagctcatcagttgggctaagcgtgcatccatcgctaagtgcagcgtcagtgactttagcattgggaaatgtactgttgcctcagaacttgattgaagcaggagtgaaacttagtcttaaaagatcaactgcaggtgattcaatccccattgatttggagattaacgccacttgtagaaggcgtaactcagagagaatcagaaattttttgcaggatttagaagcagtaacaactccaaaagaagaacctcgatcttccgaggcatcttctagttttcctattgcagggcattctcatatagaacctgttgaagacccaatcatggctgaagagtaa

SEQ ID NO: 1700 - DNA, 525 bp, Glycine max
  Peptide Sequence Number=SeqID_93385
atgaagtcacctctatctaacaagaggtcattgtatactccaccaacttcgacaatccaaaaagatgttcctcaaatcaactacattgctcgtggtgcaatcattgagggaaatattcaagagttgttgaatcaagctggggagtttaagggttacaccagtagtggcttagagaatacttgtaaagccaagagtagcagtggatggatgaacacattgttgtgtaccaatgaccaaccaatgtggttgcatcttgaccaggtgaatgctcatgatcatacctcgtccactcagcatgagtttggacgggggccttttgcttcaagagtcttggaaatctgtcaaagtgaagaagggatggtggtgaacgattccttggaggagaggatagatgataattgggcttggaagagttacccttgtcttcaacttcttgggcacattaacgcaagcataggttcctttccggtaggacctatgttggttaccttgggctttttgggggcagaaggagctggaggttaa

SEQ ID NO: 1701 - DNA, 915 bp, Glycine max
  Peptide Sequence Number=SeqID_93386
atggaagatctttttaggaggtggactgagcatcttgacaatatacactcaagagtcaaccaaccacccctgataacttgtgatttttgcggaggagagcatgctaatagtcattgtcatctctatttcacaaataactctgggtggggacaagagtcaagtccttatgatcaatatgaagaaagaggaactcttactcttgaaagtgtgtttgaagaattcatggcatataatactagctctaaagaaaatcaaaatgtaatgaacaatcaagaaattgacgtggccaagagctactccatagaaaagtctcaagggacacctgagttagaactctacaatcaaggtgaatcagaaagaggtgccaatttggataacttgttgatgcaattcgaagaaacaactgaatcaactcaattaacatttacaagtgtagaaattcaggctagtaagctggcaaaagatgtgacccaatgtgtggccagaatagaagaagatattgtagagattgaagctcaagaggaaatccctaccaaagagcatgaattaagagaaaaagatgaaatgaaaggtgaggaaaaaacacaacaatgggaagagtacttacaacaagatattcaacaagaaagtatgctccaaatcaatacccttcctcatcaattgattttcaagaagcaaaggcaaggagagcaaaagagcgctttaagtgtctttctcttcgggatcaccaacccctcttctgcaatgagttggcatacacttccagaatacatgaagttcatggaattcctagctaaaaggtggaactgtaaggaggatattgcttatccgctaagcgcaaaccttgcgctaagcgccatttcttcacgcgctaagccgagcttgctcacgctaagtgcaaagacccatgattga

SEQ ID NO: 1702 - DNA, 354 bp, Glycine max
  Peptide Sequence Number=SeqID_93387
atggtggtcatcctgcccaaggaacacttagttgtctggttttgttcattgcataacaggccagtcaactaccttaaggggattattaatagtgctatcaagggtcttgatgatgctccacagcctaaatcaaaggctcctgctgggtggattgtcgtcaagtgtaatagacaaaaaggaactactgagctcggctactatgtcatgcactggatgtccaccatcattttaggaagttttagaaataattgggaagcgtattttaacgaccctagaccattggagcccgagagatcattctcatccaatgctgaatattcaatgagaggcacacaatacatgtttgcaaaatag

SEQ ID NO: 1703 - DNA, 153 bp, Glycine max
  Peptide Sequence Number=SeqID_93388
atgaagtgttgccggaaaacacatccggaagaaggtcttccggaagttactgaaacctattccggaagaagtgcttccggaagacacttccggaaccacttcttccggaataggcctcagaaacttccggaagacggtcttccggaagtataa

SEQ ID NO: 1704 - DNA, 216 bp, Glycine max
  Peptide Sequence Number=SeqID_93389
atgaagttgcagatgctctccttgttcatgatgagactaaacataaggtctgaaatagggttcaaagctagctgtagatgttcacaggttgcgcatgctctccttgttcatgatgagactaaacataagaacacttgcaatgatattgaatacttgcaaaatttcatactgaaagagagtaagaaactgaagagaggaagaaagaggttcgtttga

SEQ ID NO: 1705 - DNA, 348 bp, Glycine max
  Peptide Sequence Number=SeqID_93390
atgtcgtcgaagtactggcgatcaaaattgccattccttgggttatggggtttagccaagctcatgcttttacgaaaaggttcatcaagtcaatttgaagtatggaagaaaaaacatgatttacggcacccttaccgaacccgtgctagagttagagtaatgggtgaagtagaggaggtgcaagaacagatgaaggccgacacggaggccttgaaaaagcaaatggccacaatgatgggggccatgatgagcataaaggagataatggaggtcaatgtggctgcaatagccgttatcagcaccattgttgaggtggacctgacctcccatatggcctcaaccaaataa

SEQ ID NO: 1706 - DNA, 576 bp, Glycine max
  Peptide Sequence Number=SeqID_93391
atggcgtcaactatctgcagcgtaaggcgataccggtcaagtgcaccgaggatccggtgcgctgctcagcagtgtgagtgcgctgggtattcgcttttatctggccagcaagccgctggcggtcaacagcacgttgccgattgttttccccggcacactcgatctcggcgcggtgccggtacagcagccgggcgtgacgctggagggtggggagttcaccgccagcgcggcgctgctgctggaatatcagtaaggagaggcgatgagagcgggagtaatgctggtactgggatggctgctggtgtcacaggcacaggcgatagagatgcagctgcacggcacgctggtggcggaaccctgttctctggagccggatcagcagcagctggagctcaactttggcgatatcgttgcgaaatcgctgtatcagaatccgcgcacgccggcgcgtccgctgacgtcgagctggtgttcaacggtcttgccgatgccgagcagcccgatctgctggcgctggccggtgatgccggtgccaaaggcgtggccatcggcctgagtgatgcggacggaacgctg

SEQ ID NO: 1707 - DNA, 213 bp, Glycine max
  Peptide Sequence Number=SeqID_93392
atgggtgaagtagaggaggtgcaagagcagatggaggccgacatgaaggccatgaaagagaaaatggccgcaatgatggaggccatgatgagcatgaagaagataatggaagccaatgcagttgcagttgccgctaccagcgctgttgctaaggtgaacccgacgtccccatccggcatcaaccaaaaaaatcaatcggacgtttctctttga

SEQ ID NO: 1708 - DNA, 453 bp, Glycine max
  Peptide Sequence Number=SeqID_93393
atgggttttccacctgcctccactactcctcctcttcctcctcctcctcctccttcacctccttcacctcctcctcctcctcctacttcggacgcatcggcttcgacgtttaccgtgaagaggacacgcaaagcctcacgcctacgatcgttgtccactagaccacctggtgttgagagactagtggtacatgttgatcctgctacagggaaggccgacggtccccacaaaaagaaattaagaacatatttggggattgtggcacgtgataaggtggacatcacctacgagaactggaaggaggtccctactgctcagaaggacctgatttgggaggatattcaggcggaatttgatatcccagaggcttctgacagtacgacgaaaaggaagttactaccgaccgtgggggagagatggaggccgtttacatcagacctcacaaggaaatga

SEQ ID NO: 1709 - DNA, 601 bp, Glycine max
  Peptide Sequence Number=SeqID_93394
attgggctcgccaagttaaaagtcgtcagcgaagagagttttgaagcaccggaagaggacgaagaagtccaagctctcaaaagcgagttaggaaaggcgaaacttgccaaggagaagttcaagttggccgctacacacatccggaaggagtgtgccggattacgggaagagaatgcaactaccgcgagagcccttgaacaagaggccaagagagctcgcaaggaagagtatggccggaacaaatttcgcggagctctgtggggtagcaacaatgaactcaagctgcgaagggaagagagggaccagtcgcgagcacatagcatgaccaacatgctagctatcatcgccaagtaccaagaagagttaggtctagccacggcccacgagcatagggtcgcggacgagtatgcccaagtatacgcggaaaaagaggctagaggaagggtgatcgactctttacaccaagaggcaaccgtgtggatggatcggtttgctcttaccttgaacgggagtcaagaacttccccgattgttagccaaggccaaggcgatggcggacacctactccgcccctgaagaaattcatgggcttctcggctatt

SEQ ID NO: 1710 - DNA, 456 bp, Glycine max
  Peptide Sequence Number=SeqID_93395
atggacaataaatgctctgagctaggagtggctggccctgggagaactggagctggggctgaagatgcgagagcagatgtagatggagcagatgtggaaggagctgaagaagatggtacctcggatcctttgcccctagatttatgggttccccaaaaagtgaccgaagggtcatctggattccaacaatttattttaacatatgccaaattaatggctgggctcaagctctcgaaagtcaaagagtcagagttgatcttagctcattattgggcaaagcgtgcatccaccgctaagcgtaacttcagcacgcttagcgtgatagaagaatttggcagagcatcaatttcaagaccgcgtgctaagtgcgagatcagtgcgctaagcacaacagttgtcttcagccaggctcaacgcacgcctgacgataagctcaaatccacttactcacgctaa

SEQ ID NO: 1711 - DNA, 426 bp, Glycine max
  Peptide Sequence Number=SeqID_93396
atgccgacgtcagctatcatttttttcgatcaatttctgatgagaatcgtgaaactggccaaatacaggctaaaggcccaagtggagaaggacgaagacccaagtggagaaggacaaagcccccgagtggagaaggatgaaggcccagaggcagagacactagcaagactaataattacttatcaaggtaatccttgtggcgtctaccctgacttatcttccttcaccggaagtggcgtctaccctgacttatcttccttcaccggaagtggcgtctaccctgacttatcttccttcactggaagtggcgtctaccctgacttatcctccttcaccggaagtggcgtctaccctgacttatcttccttcactggaagtggcgtcaaccaaaaactctacagcgtgtatcaagtgatccgttcctag

SEQ ID NO: 1712 - DNA, 264 bp, Glycine max
  Peptide Sequence Number=SeqID_93397
atgcagctcccgggagacggtcacagcttgtctgtaatcggatgccgggagcagactagcccgtcagggcgcgtcagcggctgttggcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 1713 - DNA, 540 bp, Glycine max
  Peptide Sequence Number=SeqID_93398
atggtggtcacagttcgaccggagagggtgctacgccagtttgggtacattcaaagcatccctccaccgcctgttagcactttgttgtcatatgatgatatagatgacaggtggatgcatttctcggaccacgtagcagctgtgggtgacatttgtgtagtgcctgggcaggtatctgtggattacatggagtggtttttccagatatctcacccattcatgatatcgacccaggaaggtgatcatccaagacatccacctgccacagaccatgaggactgcatccagtcggacatcccagaggttccagtggcatttgacccccctcgacatgcagtggatgattatgaaggctatgagacgatcgtagaaaggttggagcgtgtgctcaaccttaggatggccattgcaggcacagagttacatgatatcatgcaagattgcctcaggatcgccaggggggtgccagcgccgatggaagtgttagggctcgacaaagacgtcacacagagcattgatgatgttttttatgttttgtag

SEQ ID NO: 1714 - DNA, 276 bp, Glycine max
  Peptide Sequence Number=SeqID_93399
atggacaggtttgatggtcttcaaacctttgttggtgaaaggtttgacactttggaattacaagtggatatgtgcttcaatgaaatggagtcaagaatcacaaaggttgaagaatatatgataacaaaagatgatgacaaaggtgatgacaaaaagctcaaaggtcaatcaaagaatgagttcaagatattcaagatagactcaagaacacttcaagattcaagaggaaacttgaattccagaatccagaatcaagattcaagagatcaagattga

SEQ ID NO: 1715 - DNA, 213 bp, Glycine max
  Peptide Sequence Number=SeqID_93400
atgattatgaagggtcaagacatggatagtagacgagatgaggttgctacttcaccttcctctagtgaaagtgaagaagcaaaaggggaagaatctagtgaagaaattgactcccaagaagaaagggaccttttaatggtcagaaggcttctaggaggccaatcttgtcacttgtccaaccatttgaatgatgtgagaatagaccgtgattag

SEQ ID NO: 1716 - DNA, 339 bp, Glycine max
  Peptide Sequence Number=SeqID_93401
atggatttattaaacgtcaaatggctccattgtcgtcactctaaaatggtcaatacccccacctttagagggttgcacgtcctcgccttccgagggctgcatgctctcacctttagaggactgcacgtcctcaccatcagaggactacacgtcctcgccatcagagggctgcacgccctcaccatcagcgggccgcacgccctcaccttcagagggctacacgccctcacctttagagggttgcacgtccttgccttcaaagggctgcacaccctctcctttagtgggctgcacgccctcacttttagagggctggacgccctcgccttcaaaaggtga

SEQ ID NO: 1717 - DNA, 272 bp, Glycine max
  Peptide Sequence Number=SeqID_93402
ggtgttacacaaaatttcgtgctccttttctccctctccctccattcatcttctcccaccttcaagctcttatcatggctttctatggtggcgagcttcttcttaactcatcttctcctagaagtggcgtctcctctcaactcttcttcttctccattcccctgccattaaaattcaagaagcaaaggactccattgatgaagaagatccaaggcctacaagctccaaatggagctacatcgtgtggtatcagagcatcttcatctaggtga

SEQ ID NO: 1718 - DNA, 58 bp, Glycine max
  Peptide Sequence Number=SeqID_93403
atggctactgttttgttccttatgcattttccattttctgattctaataacaattccg

SEQ ID NO: 1719 - DNA, 630 bp, Glycine max
  Peptide Sequence Number=SeqID_93404
atggagcttgcatcacaagcctcactgaccagcaactcttgcacttgtccactctcgacaccgaacaactcatgttcatgtttggggactcaacaaactcacaaccctccttcttgtcaaggttactaccccaacatcaagcaagtctccctcaacacgagacaaactccttcgatattggacaacctttttctcccggtccagcaaatatacgtggcacgccacctggcacttagatacatgcgtcaaccctccatgtcatccctaacacaggagcacatatgtccaactcttagcagtcaagcactcaacgaacaggttatgtctaatctcttgtgtctagcaagggtttgtggcgatgacagaggaacaacagtttccattgaaaccgagtttgaagataaacctaccactgtggaagcaatgtcttccaaggttattttgatgatgccaaagaatcaagagtctagcaaaatccaaagattcaagaatcaagtttcaaaaatcaagattcaagattcaacaatcaagtttcaagaatcaagattcaagaataatcaagatcaagattcaagactcaagactcaagatttaagaatcaagagaaaactcaatcaagataagtactaa

SEQ ID NO: 1720 - DNA, 261 bp, Glycine max
  Peptide Sequence Number=SeqID_93405
atgaggtccaaatgtgttgttttccaagttaagaacttgaaggaggttggcctgctggagctcgaggtcgttgagctgctgctcgcagtcaatctcgacgatgagaggaacaacaaggacgaggaaggtggtgccggtgatccacgcggccttgccaatgctgcggaggagtttcttggtgatgaatgcggcatcatcggcagcttccttgttgcgggtgacgatggaggagcgcgagatcttcgtgaggatggagcttga

SEQ ID NO: 1721 - DNA, 229 bp, Glycine max
  Peptide Sequence Number=SeqID_93406
atgaagacaaaagctcgcaacataaacactaacaatatagtaagtgaaactaagcaaagggctccataccaagatgatgagcttgtagagcttcaagaagtgttggaagttaaccctgatgtcattaatgagtctcttgcagatgttgatggaggtggagaagagatagatgcaagtttactcaaacaactagacttggttgaactagatgaggatgaatgcctatcaa

SEQ ID NO: 1722 - DNA, 285 bp, Glycine max
  Peptide Sequence Number=SeqID_93407
atggatcgtcgcataactctattgtggttgggcgtgagatggattgagtgtgctttatcatgtctagtccttgggtatgagatggagttcattcttgatgtagctccatgtggagcttcggaatggagaaggagaagaggtgaaaggaggcatcatccactagggaataagccatggaaggaggagcttcaccaccaagagagtgtatttgataagaagcttagagaggaagcttcaatggaagaaaagaatgagagagaaagagagaggtggaaggagcactaa

SEQ ID NO: 1723 - DNA, 306 bp, Glycine max
  Peptide Sequence Number=SeqID_93408
atgagaggctacaagaaagagctggaaatcgtaggaatcggttacagggctcagcttcgggggaatacagtagtgatgaaccttggttacgctcatcccgttgtttacgagataccctctgatgtgaaaattgaagttcctgcaccgaacaggatagttgtttctggcatcgataaacagagggttggacaggttgccgctgagatcagagcgttcagaccactaaatgtctacaccggaaagggaatcaggtatgttggtgaagtggtgagacagaaagaaagtaagaaagcatatagggggtag

SEQ ID NO: 1724 - DNA, 342 bp, Glycine max
  Peptide Sequence Number=SeqID_93409
atggttaagaaggattcgagggttgaggagaagaacactagtgtggtggaggtagaaggtgagggtggaaggattatgaagcatggtccacacatgctttccaagaagcataacatttgcctcacgagaagttctaatactcagaccacctttagaacacaaagtggaaacaatattccaattaatccaatgattggaagggaaaccccaaacaaattgcctggaaattctgtcaatggaatcacaaaccccttggggcaaccaaaggttttgcatgaaccaaaatggagttcagaacagatttctcaagggtcacattgccagctctatttaacagcttag

SEQ ID NO: 1725 - DNA, 279 bp, Glycine max
  Peptide Sequence Number=SeqID_93410
atgaatttccctttcaagaatttaggtgcaaataatgataaacacataacctatgcaccctaccatttagttacaatgaatttccctttgaagaatttaggtggcagaattcaaagaacaagtttgggagacatagcaatctcaaatgatgtattgtgtactccgtccactagatcatgctctcattattgcattgccaacaaagaaatgacaagtaacatagaagcacaccattctattcaaaagaggcaacaaaacattcattcaaaatatagttga

SEQ ID NO: 1726 - DNA, 207 bp, Glycine max
  Peptide Sequence Number=SeqID_93411
atgaagatgctcttgataccacatgatgcaagctccattggagcttccgaatggagaaggaagagagagaggagacgccacttcaaggagaagatgagtctagaagaagctcaccaccataggaggccatggataagagcttggaggaagaaggagatgaatgaagggagagggagagaagagcacgaaattttgtgctccaaatga

SEQ ID NO: 1727 - DNA, 228 bp, Glycine max
  Peptide Sequence Number=SeqID_93412
atgagtcttcattcttcatctagtgttaatggaaggcatagggcacatcttagacctcactctcattggagagaaaaggaaagaaagcctcaagaggctaacattaacctcccatacttccatgggaaggacaatctagatgctaacttagattgggaaataagggttgagcaatgtcataccctaattttgtccggggattattacttgatgacatgcaataaatga

SEQ ID NO: 1728 - DNA, 303 bp, Glycine max
  Peptide Sequence Number=SeqID_93413
atgtcattgcctagcgctgttcatgcaacctaccctccggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcgcggggaagtggtcgacaagggtgtttccctttgctcctacgtattcctcaatttgcgatgaggaaatcagacctacgtagttctttcggaacaaagtgtttggtttaa

SEQ ID NO: 1729 - DNA, 412 bp, Glycine max
  Peptide Sequence Number=SeqID_93414
gattgaagaaatacaagtagtagggatgtctccttcacctctagaacctcacaatcactcacagactcatctcatgctctcaggatggcttcctcttcacgctccattctctgccagtggccttgttggtgcatgcgtgcgtagcgcaactctggctcgtttagcgtgcattagtgaatttcagcttagcgcgtatcttctcgctcagcggatggactcaagtggtgcacttagtggagctgatattaaggaggaggaactaatagatttgaggtcaaatcctcttcaagggggaggggatgatgcaatcctccctaggaaaggactagtcactagagccatgagcaagatgctccaagaggattgggctagagctgctgaagaaagccctagggttctcatgaacctcagg

SEQ ID NO: 1730 - DNA, 153 bp, Glycine max
  Peptide Sequence Number=SeqID_93415
atggggtgtaactcatacttagcccatgggtccgacatctaccctaaggctcatgagaaccctaaggccttctcttgcatctttggcctaatcttcttggagtcttctatccaatgcccttgtgggataggattgcatcaacttaacatctaa

SEQ ID NO: 1731 - DNA, 285 bp, Glycine max
  Peptide Sequence Number=SeqID_93416
atgttggaaccatcaaagaagcgaaagggttcttcgagtcgaagccaatggcattctgagactcaagatactccaattccttcctccatttcctcatcctcattgttctcaacagaagaacaacatacacggtacataaacctcttctcctctcgttctatcattgacgctaagttcatagatatggatttcttttctgatgagagtttcgaatgcattcaagcatttcataactcaaatctcattccctttatgtctttaaaactgcctgtgtattctgaattg

SEQ ID NO: 1732 - DNA, 168 bp, Glycine max
  Peptide Sequence Number=SeqID_93417
atggctggatctactactacctcgtccattgagtataacagagcaaatgatggtatagcaatgaacatcgggatgatactaggaaatatgtggaaatgccataaagcgcgaaccaagatccgtgatacgaaaaccaaaatcagaatgaggaagaaaaagatatcgtga

SEQ ID NO: 1733 - DNA, 428 bp, Glycine max
  Peptide Sequence Number=SeqID_93418
gaacactttaaatgagattgttggcaaggttgagcgtctacgttatctcgacaacaatccctcttcttgtggttgtgtgatgagaagcacattcggtcttccttgtgcataccaagggttatgtgaggtcgaagacagcatcaaggaagagattgagaccatatctgaaagatttgaggaacttgatgtcaacactaaaggtgcaccgaagaaaccgatgaaaagaagtcaaagatccacaaagcctgatccgtcttacttggagtatgttgatgcttttcattctgttcaaagcagcaactcttcagtgaaacatagtgcatcatcttctgaaccgccgaagccaacaaggatcatcccgatgttggatcaatttgcgccatttagacaggatttcattcacaacattgtggatgtaaaagcggacg

SEQ ID NO: 1734 - DNA, 425 bp, Glycine max
  Peptide Sequence Number=SeqID_93419
tgggagagttgatttgcgccatcacccgatcgccacctagtaccacatatgacggagtggtacctggagatatgtcgcaggggtcaggagaccttggggatgtcaggcgagctcctagcagtcaaccaataaaagaacaaagaccacaaaacaaggaggcttgtgtgggctttaaaaatggagacaggaagttaaaatggcctctggtaatcgattaccaaggggcactggtaatcgattaccagttaggtgtaatcgattacacagtgatccacgatgtcggatacaatgtccaggacatcctgcccgaaaatactggagttgctgcacaatgcacaaggcaagataaaagaattgaagctgcaggatccacgatgtcggatacgatgtccaggacatcttgcccgaaaatactggacacataa

SEQ ID NO: 1735 - DNA, 645 bp, Glycine max
  Peptide Sequence Number=SeqID_93420
atggctgaatcttcaaagaagcgaaagggatcatcctccaccaccgttgctactgcccattgtcgccacgaaccatctaaagcacctacagcaccaatccatccttccttatcatctccaagatcatctaatctattttcttcagatgatcaacgtctgcggtacctttctcaattttattctaggatcattctagaccctaagtacctagacatagatttctttaatgatgagacatttgactgttatcaagtgtttcaaaactctggattgattgatttcatgtctttaaaattgtcttactatcctgaacttgttaaagtcttttacatcaatttaaaaattctggatggtattatttcttctgaggtgcatggtgcaccttttgagggcaccattgttgatgactggaaattcgattattctagtcatgatgctcgccgtatggcattacgggccaatgcacctcttccatatcctcaattggtcactttctttctccgtcattttcaaattcctcttgatgatgaaccttttgttcaagtcaagcgttcctttgctataggtgctggtgcagtcacttcatttggttaccgtaaggatcataatggtcaatggctgaagaaagatgcactccctccataa

SEQ ID NO: 1736 - DNA, 309 bp, Glycine max
  Peptide Sequence Number=SeqID_93421
atgaggttgtcgtggttattggtgatgtcattaaaatggaatgttgatgatgttggaaatgcattgacaagtgcatgttgtgtatgttcgtggggggggggggggtgcattggccttgtcggatgtcccttgtgtgggaaaatagagtggttaaagaatctaagcattttcgaggggatgcttaggagctttaattcatccatggtcattgtacttgatggtgcccacgttcataagtctgtgtactttgtactagggtgtgtgtcacctggtagggaactgttagacaagtggcctcagatgtcttaa

SEQ ID NO: 1737 - DNA, 207 bp, Glycine max
  Peptide Sequence Number=SeqID_93422
atgggtgaagaatcgtggtcattggtgaggaaccatttgcataaagaactgactagctggtccgaagagtatatcaacctggttggtggcatagagagatttgaggaattaaagcgttctctacttgttgacgacttatctaaggttatcatggacaagtggatgaatattacggatatgggatacgtcattgcttcacgatacaac

SEQ ID NO: 1738 - DNA, 423 bp, Glycine max
  Peptide Sequence Number=SeqID_93423
atgcataaggcattgcgattgaatgctccattgccatatccacatttagtcacccttttctttcaacactttaacattcctcttgattctgaaccctatgttccaatcaaaagatccttccttataggcgcttcagtcatagcatcctttggttatcaaaaagagcatgatggctcttgggtgaaaaagggtgctcgacatgttggtgaaggacatgatggagaagattcatctcttctttcaaagattttggacaggtttgattgtcttcaaacctttgttggtgaaaggtttgacactttggaattacaagtggatatgcgcttcaatgagatggagtcaagaatcaccaaagttgaagaagatgtgtcttacattcgttcaagctttgatctaacaccgccaccaccaccatcatcttag

SEQ ID NO: 1739 - DNA, 6561 bp, Glycine max
  Peptide Sequence Number=SeqID_93424
atgggagatggaggcgtggcgtgtatacctctgcagcagcagcagcatgttattgagcggttgccgaatgcggcggcggagaaggcgcttagtgggaacgggttcggttctgggctgctcaaggcagctggcaagaggaagaagaagaaggtgaaggtgaagaagaaagtggcgcccgcggcaaagaaggtggtaaacagtgaattggcagtggagggagtaggcagccggggtgggaatgatgttgagagtgggggagtgtgtggggagatggatgaagtggaagagggtgaactggggaccttggggtgtgagctggagaatggagagtttgtgccgccggagaagccggtgatgctgacacggagaagtgaaattgagaatggggagattgccagtgagagatggaagaaaggggaggtggagaggggggtgtttgtttctggaaaatggagaaaggaggaggatgtggagaaaggggagatagttcctgagaagggtaggaaaggagaaactgagaaatgggaatatgggtcgtggagaggtggaatgaagaatgatattgagaagggagaattcattcaagataggtggcataggggagacatggggagggatgattatggctgtgctagaatctgcaggtacccgccaggtagggataaagggtggaaaaatgaacgggagcgtacaccaccttctgggagatattatataggtgatgagtatttcaggaagaaggaattgaatagaagtggaagtcagcatgctaaaagtgctcccaggtgggatagtggacaagagagaaatataaggatcagttcgaagattgtggatgaggagaaaaatgaacacagtaatagtaggacccatatgcgggattactcttctggaaatcggttgaagaggcatggtaatgagtcagaaggctgtgagtggaactatggagattatgccggtttaaaaagtcgaaggctttctgatgatagcccacgtcatgcttattctgagcactattctcgcccctctgtggaaagatcttatagaaatagttcttccaaatcatcagcagacaagtattcttccaggcaccacgagtctttgcctaccagatcagtttatgacaagcatggacgcagccctggtcattctgagcgatccccacatgaccgagccaggtattatgatcataaagatcgcactccagtgcgtccttcaccctacagtcgtgacagatctccatatagccgtgagaaatccccacatggtcgggagagatccccatataacaggaattgggatagaagtcgtcaccatgatcataaaatgagaagtcctactcatgctgagcggtccccacaagatcgaggtcgacatcaagataggagggacctcactccaaatttaatggagcaatccccacatgatcgaactaagtcaaacattcatcgagaagtaagtagtaaaaccttatcaagtggaaaacataactcacaacatagttgtaaggattctgaagataagcacatccaacaggaggcaaatctttctgatgttgaatctcatggtgaaagaaatgtgcataatggcaataagtctattgagaaagatgtctgcagtgaacctgaaaaggaacaacagtcctctagtccgactgtaagctgcaaagactctccttgcttggagccatctcctgaggagctaccttctatggaagaagatatggacatatgtgatactcctccacatgtccctgtggtgatggattcgtcatctgggaaatggttttaccttgattataacggtgtagaacatgggccttctaagttgtctgacatcaaggtccttgtggatgatggcgtacttatgtcagatcactttattaagcacatagatagtgacaggtggctaactgttgaaaaagcagtatccccagtggcagctccgagttttccaccagttgtgtcagacaccataacccagttggtaaaccctccagaagccccaggtaatctgttggctgatactggagatattcttcaatctggtcctgagaattatccgggaatcccggcgcctattctgcagccaatgttatgctctaaagacagtgggattgcatctgaattgttggaggacctccacattgatgaaagggttggagttctgttagagggttatgatgtcattccaggaagggagtttgaagcaataaaagaatctttgcaaatggattttgaatatgcaaaatgggagggattggaggagtgtgaaggttttcctggccatgatagcctgaggatggaacatgattcaagaattgattcatctagagaacatgagtctcaggtaagtataccctctggcaaggataatggatttactgttggtgttcctggtgactggtcttctgctcaatggtcatgcaaaggtggtgactggaagaggaatgatgatgcccaagatagattttgtaataaaaaacttgtcctcaatgatgggttttcactatgtcaaatgcctaaatctggatgtgaagatcctcgttggactcgaaaagatgacttgtattatccttctcatagcaggaggcttgatcttcctctttgggctttttgtactgatgagagggttgattgcagtactgtgagcaaaccagttcaaaccaagcttgcttctgttaggggagtgaaaggaaatattctttcagtggtaaggataaatgcatgtgtagtcaaggaccagggatcattggtctctgaggcatgccacaagacccaaggcaaggatagatatcattcaaggtcaactcggtctttctcttcaaccagtgatagcaagagatcatcaactgaagaagattctcagtcaaaagcttctaatgatcaaggttctctaggctcttgcaggagcatggaattcattaatattcctaaagaccataattgtactgtccatgacttgcaattacatttaggcgactggtattatcttgatggttctgggcgtgaaagagggccttcatcattttcagagctacagcatttagtagaccaaggaattgtaaaaaattatagcagtgtgttcaggaaatgtgataaactctgggttcctgttacgtcttctgctgaaacatatgatgaagatgtcaatctaagaagttatcaagaaagtagtacagtgtctggtgaatgttctggactaccatcaaagcaaattcatggtgcttcatttggtgaacacgactcaaagtcaaatttgtttaacagcttattccctcagtttgttggttatactcgtgggaagctacatgaattagtaatgagatcatataagagccgggagtttgctgctgttataaatgaggttttagatccctggatcaatgcaagacagccaaagaaagaaattgagaaacaaatatattggaaatctgaaggtgatggacatgcttccaaaagagctaggatgctggttgattatagtgaagaagatagtgattttgaagatggcagcctgacaaatgggaaagatgaatccacatttgaggctttatgtggtgatgctacattctccggggaaggaagtggcattactgatcccaaggttggaagctggggtttattagatggtcgtatgttggcacgagtcttccactgcttaaggtctgatttgaaatcacttgcctttgcatcaatgacttgcaagcattggagagctactgtaaggttttacaaaaaggtctcaaggcatgctaatttgtcatccttgggtcattcttgcactgattccataatgtggaacatcttgaatgcctatgaaaaagacaagattgaatccattgttctaattggttgcaccaatattactgctggcatgctagagaaaattcttctttcatttcctggtttatctacagtagacattagagggtgcagccagtttggagagctgactcctaaatttaccaatgtgaaatggatcaagagccagagttcacacataaccaaaattgcagcggaatcacataaaatcagaagccttaaacaaactgctgagcaaacttcatctatttctaaggtcagcagttttagtattagggatgattttggtgagctgaaggactattttgacagtgtggataagagagactcagcgaagcaattattccgtcaaaacttgtacaagcggtcaaaattatatgatgctcggaagtcctcgtctattctctctagagatgctcgaacaagacgatggtcaattaagaaatctgaaagtggttacaagaggatggaacaatttcttgcttcaagtttgagggaaattatgaaggcaaactcttgcgacttttttatgcccaaggttgcagaaattgaggctaaaatgaaaaatggttattacagtgggcatgggttgagctatgtcaaggaggacatcagtagaatgtgccgggatgcaataaaaacaaagaatcggggtgatgctggtaatatgaatcatgttatcacattatttattcagcttgcaacatggttggaggagaattccaagtatgtgaatagcagagatgcactagtgaagttgtggggaaataacccaccatcatctttatgttctacttcctctaagtacaagaagaatagattggtatctgagaggaagcataggagtaatgaaacacatggtggtttggataatggagaatatgcttctgatagagaaatcaggaggcgtttatcaaagttgaataaaaaatctttcgactcggagagtgagacatctgatgactttgatagatcttctgaagatggcaagagtgatagtgatactacaaccactgatattgaaagcgaccaagatgtccattcagaaagtcgaattggggactcgaggggagatgtgtatttcacacctgatgatgggttggatttcattactgatgagcgtgaatggggggctcgcatgacgaaagcaagtttggttcctcctgttactcggaagtatgatgtcattgatcaatatatcattgtagctgatgaagaggatgtgcgaaggaagatgcgggtttcattaccagatggctatgcagagaagctgagtgtgcaaaagaatggcattgatgagtctgacatggaactgcctgaagtcaaggattacaaacctagaaaacagcttgaaaatgaggttgttgagcaagaagtttatggaattgatccctatacccacaatctcttactagattctatgccgaaggagttggattggtctctacaagagaagcatttgtttgtagaagacaagctccttcggatgttgaataagcaggttaatcattttactggaactggaaacactccaatgagctaccctttgcagcctgctattgaagaaattgaaaggtatgcagaggagcagtgcgatgtgagaacagtaagaatgtgtcaaggtatcttaaaagccatagcaagtcgtccggatgacaaatatgtagcttatagaaaggggcttggtgttgtttgcaacaaggaagaaggctttggtgaagatgattttgttgttgagtttttaggagaggtgtatcctgtgtggaagtggtttgagaaacaagatgggattcgatctctgcagaagaatagtaatgatcctgcaccagagttctataacatctaccttgaaaggccaaagggtgacgcttatgggtacgacttagttgtcgttgatgccatgcataaggctaactatgccagtcggatatgtcattcatgccgaccgaattgtgaagcaaaagttactgctgttgatggtcattatcaaattggtatttatagtgttcgtgaaattcaacatggcgaggagatcacttttgattacaattctgttacagagagcaaggaggaatatgaagcttcagtttgtttgtgtggaagccaagtttgccgtgggagctatctgaatctgaccggcgaaggggctttcgaaaaggagtggcatggaattcttgatcgtcattatttgatgctagaagcttgtgaattaaactctgtttctgaagaggactataatgacctgggaagagctggtttaggcagctgtttgcttggaggccttccagattggctagtttcctatgcagctcgccttgtgagatttatcaattttgaacgaacaaaacttcctgaggaaattttaaagcataatcttgaagagaaaagaaaatatttttcagatatctgtcttgaagttgaaaggagtgatgcagaggttcaggctgaaggtgtatacaatcagaggcttcaaaatctcgctgtcactcttgataagaaaaatggcaaaggccaattttttggtaaggatcgttgctcacaagaattgatgggtcaacactgttttaagattgaaagctggttggcgtggcagtttatagttggtcaagaattttggatctcatattctgttaaggatctgagggcgagccctggtgcagcggtaaagttgtgccttggtgacttgttggtcatgggttcaaatccggaaacagcctctttgcatatgcaagggtaa

SEQ ID NO: 1740 - DNA, 252 bp, Glycine max
  Peptide Sequence Number=SeqID_93425
atgacatgcggggttacgttatggttacccacaccttttgtcaaccaggggcaaacgagcccgatgacgccggagagtaacatagtcttctgcaccttttgtcgtcctgactccgtgaagtcaggtgatttgcggggttaccttagggttagccgcacctttggtcaactagggggaaacgagcccgttgacacgcggggacaaacatcatcctctgcaccttttgtcgtcttgacccgtgaagtcaggtga

SEQ ID NO: 1741 - DNA, 116 bp, Glycine max
  Peptide Sequence Number=SeqID_93426
agagaaagatgttaggaacatcaaggccacaatttgtgctgtttgggtcttccattgttcaatacagttattatgaaggttggggtgctacactttctcacttgtatgctcgtaag

SEQ ID NO: 1742 - DNA, 99 bp, Glycine max
  Peptide Sequence Number=SeqID_93427
atggaagttggaagttggaagtggaagttactggaagttggaaatgaaagttattggaagttgaaagttgaaaatggaggttggaagttggaaggggaa

SEQ ID NO: 1743 - DNA, 252 bp, Glycine max
  Peptide Sequence Number=SeqID_93428
acatttgttagcattgccacacctcttaggcttgagtttattcctcaagtaaaggagttgttggatgaaggtttggttcgcaagagcttaaatccttgtgctttgttggtgcccaaaataggcctaggatcttcttcatcaatggattcctttgcttcttggaagatgaatgacagcggaatggagaaggaagagagagaggagatgccacttcatggaaaagatgagtctagaagaagctcaccaccatag

SEQ ID NO: 1744 - DNA, 392 bp, Glycine max
  Peptide Sequence Number=SeqID_93429
gattgacattctcaccctgggtcaaggtttatggcgagttaggattttggctcaaggcttgtagaatgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgagaaaaaaggctgcaccggtgcgtcagcagaatatgtgatacaggatatatttccgcttcctcgctcactgactcgctacgctcggtcgttcgactgcggcgagcgggaaatggcttacgaacgggggcggagatttcctggaagatgccaggaagatacttaa

SEQ ID NO: 1745 - DNA, 912 bp, Glycine max
  Peptide Sequence Number=SeqID_93430
atgatcaccggtgctgcgcagatggacggcgcgatcctggttgttgctgcgactgatggcccaatgccacagacccgtgagcacatcctgctgggtcgtcaggttggcgttccttacatcatcgtgttcctgaacaagtgcgacatggttgatgacgaagagctgctggaactggttgagatggaagtgcgtgacctgctgtctgcttacgacttccctggcgacgataccccaatcgtacgcggttctgcgctgaaagcgctggaaggcgaagctgagtgggaagcgaaaatcgttgagctggctgagcacctggatagctacatcccggatccagtccgtgctatcgacctgccgttcctgctgccaatcgaagacgtattctcaatctctggccgtggtaccgttgttaccggtcgtgttgagcgcggcatcgtgaaagtgggcgacgaagtagaaatcgttggtatcaaagcgactgccaagtctacctgtaccggtgttgaaatgttccgcaaactgctggaccagggtcaggcaggcgagaactgtggtgttctgctgcgcggtatcaagcgtgaagagatccagcgtggtcaggttctggctaagccaggcactatcaagccacacacccagttcgagtcagaagtttacgttctgtctaaagacgaaggcggccgtcatactccgttcttcaaaggctaccgtccacagttctacttccgtacaactgacgtgaccggtaccatcgaactgccagaaggcgttgagatggtaatgccaggcgacaacatcaagatggttgtgactctgatccacccaatcgcgatggacgacggtctgcgtttcgcaatccgtgaaggcggccgtaccgttggcgcgggcgttgttgctaaagttctgggctaa

SEQ ID NO: 1746 - DNA, 1380 bp, Glycine max
  Peptide Sequence Number=SeqID_93431
atggtttactcctataccgagaaaaaacgtattcgtaaggattttggtaaacgtccacaagtactggatgtgccttatctcctttctatccagcttgactcgttccagaagtttatcgagcaagatccagaaggccagtactttttggaattttccttccgttccgtgttcccaatctttgtgtgtggggggagctacagcggcaactctgagttgcagtatgtcagctaccgtctgggtgagccggtgtttgacgtgacagaatgtcagatccgtggcgtgacgtattccgcaccgctgcgcgttaaactgcgtctggtgatctacgagcgcgaagcgccggaaggcaccgtcaaagacatcaaagaacaagaagtgtacatgggcgaaattccgctcatgaccgacaacggtacctttgtcatcaacggtactgagcgtgttatcgtttctcagctgcatcgtagtcctggcgtattctttgacagcgataagggtaaaacgcactcttccggtaaagtgctgtataacgcacgtattatcccttaccgcggttcatggctcgactttgagtttgacccgaaagacaacctgttcgtccgtattgaccgtcgtcgtaagctgccggccagtatcatcctgcgcgcgctggattacaccactgagcagattcttgatctgttcttcgaaaaagtggtgtttgaaatccgcgacaacaagctgcagatggaactggtgcctgagcgcctgcgtggtgaaaccgcctccttcgatatcgaagccaacggcacggtctacgttgagaaaggtcgtcgcatcactgcgcgccacatccgtcagctggaaaaagacaacattcagcacatcgaagtgccggtcgagtacatcgcgggcaaagtggtcgcgaaagattacatcgataccaataccggcgaactgatctgcgcagccaacatggagctgtcgctggatctgctggccaagctgagccagtccggccacaagcgcatcgaaacgctgttcaccaacgatctggatcacggcgcgtacatctctgaaacgctgcgcgtcgatccgaccaccgatcgtctgagctcgttggtagaaatctaccgcatgatgcgccctggtgagccgccaacgcgcgaagctgccgaaagcctgttcgagaacctgttcttctccgaagaccgctacgatctgtccgcggtaggtcgtatgaagttcaaccgttctctgctgcgcgatgagatcgaaggttccggtatcctgagcaaagacgacatcatcgaagtgatgaagaagctcatcgatatccgtaacggtaaaggcgaagtggacgatatcgaccactcggcaaccgtcgtatccgttccgtag

SEQ ID NO: 1747 - DNA, 152 bp, Glycine max
  Peptide Sequence Number=SeqID_93432
tatttgaatgaagttagaccattggaagcagagagattcaaggcgcttcgcatccaatgtttggcaccctttgttgcacaatatgtgaagtcccgagacgtgccgaaaatcaaaaggaagcaggcttacgcgatccgtgaaaattccgtgat

SEQ ID NO: 1748 - DNA, 251 bp, Glycine max
  Peptide Sequence Number=SeqID_93433
atgcacgtgattgtggcggccgatgtgcttgtcatcggccgagccgatatccatcgatgccagcaccatgccttcgcctgccaggctctgcgtcaatggatagccgtcggcgtcgacgatcaccgagccgccgatccacgcaacgccgcgctccatttcgcaacgatcgcacaccgcgatgaacagacgattgacggcagcgttggcctgcgccttcgccaattccgccggccgatcgcactgggggcgcg

SEQ ID NO: 1749 - DNA, 171 bp, Glycine max
  Peptide Sequence Number=SeqID_93434
atggaggagatcccaccaaacctatctcagaaaaatgacgatctcggactcattaactgttggattgtcgtgacatttgagcaccacgttcgcaatccaattccaagaatttcaaccattgggaatttcgatatcatgtctgagctaagagaaatacccctcacattgtag

SEQ ID NO: 1750 - DNA, 372 bp, Glycine max
  Peptide Sequence Number=SeqID_93435
atgaccactttcggaagaaggtcttccagaagtaacgaaggccaattccggaagaagtgcttccggaaactactttcggaagaccttcttccggaattggacttagtaacttctggaagaaggtataatggtataatattaaatgatttaggtgtagtaaatttttggatgtggttatatgataatttgaatgtacttgtgtatgatgcatatgtccttaagatggacgaagatcaatggatgtatgactttgcgatatcacaagaagttcatatggattatgattatgataatgaagaagaatgtggggtgaatgaaccacatgtcgattgttcaaatgcttttaatacatctcaggtattcgctacttga

SEQ ID NO: 1751 - DNA, 48 bp, Glycine max
  Peptide Sequence Number=SeqID_93436
atggcggtgcatctattgcctgctgctggccatccccaggctactatg

SEQ ID NO: 1752 - DNA, 435 bp, Glycine max
  Peptide Sequence Number=SeqID_93437
gaaatggccccaaggaagcttgcctcaaagagatccaggaaggataaagcggctgaaggaactagttccgctcccgaatatgacagccaccgtttcaggagcgctgggcaccagcagcgcttcgaggccatcaagggatggtcatttctccgggagcgacgcgtccagctcagggacgacgagtataccgacttccaggaggagataattcaccggcgatgggcatcactagttacccccatggccaagttcgacccagacatagtcctcgagttttatgccaatgcttggcctacagaggaggtgctggaggagggccaagagtgcgagtatggccagaggaggaaccgagccgatgggtttgatgaggatgccatcgcccaattgttgtgtataccggggcaggattttgcccggactgctgttggaagacgg

SEQ ID NO: 1753 - DNA, 434 bp, Glycine max
  Peptide Sequence Number=SeqID_93438
atggccctaaggaaacttgcctcaaagagatccaggaaggataaagcagctgaaggaaccagttccactcctgagtatgacagtcaccgctttaggagcgctgaacaccaccagcgcttcgaggccatcaagggatggtcatttctccgggagcgacgcggccagctcagggacgatgagtataccgatatccaggaggagatagttcgccggcggtgggcatcactggttacccccatggccaaattcgatccagacatagtccttgaattttatgccaatgcttggcctacagaggagggcgtgcgagatatgaggtcttgggtgaggggtcagtggatcccgtttgatgcagatgctatcggccagctcctgggatatcctttagtgctggaggagggtcaggagtgcgagtatggtcaaaggaggaaccg

SEQ ID NO: 1754 - DNA, 245 bp, Glycine max
  Peptide Sequence Number=SeqID_93439
gttatcattactggaaaacccacatgcaaatcttcatagaggctatagatttaaacatctgggaagccattgaaatcagtccttacatccctaaaaatgacaagaaaaagaaaggaattgcacttaaagcctcatcttctattcaagaagaaagtgacaaagaggactttaatgaaatagaagaagatgatgatttcagtttcttcataaatgtagaagcaagcctcatgatgaatcaagattga

SEQ ID NO: 1755 - DNA, 156 bp, Glycine max
  Peptide Sequence Number=SeqID_93440
aggaaagtatcggtgtttcctgagtctcagaatgtcgttgactccgactcgaagaacccttttgcttctttgatggtcaagaaatgggtgagatatggcagaagggagaattggggacgagggtttttgaaaaagagggaagatgcagatttttga

SEQ ID NO: 1756 - DNA, 531 bp, Glycine max
  Peptide Sequence Number=SeqID_93441
atgttggggtacggctacgagcccggaatgggtttgggcaagaacaacggcggcagaaccagcttggtaagcaccaaaggaaaccgagggaagtttgggttaggctataaacctacacaagctaacataaggaaaagtatctcgaaaaggaagaacaaaggccaaagcccgcggttgggacagcaagccggaggggccccaccctgccacatcaatagaagctttataagtgcgggtttaagacatgaaggccaagtcgccacgatatgcgaggatgactccccgagaagatcggatttggtacggccatgtcctcctggtttccgactaggaaattggcgagtggaggagaacccagacgtttacacgacaagcataatatccgacgatgagtccctcgaaggtactaatacccgggacccggccgtcaatttcgagctagaagcgggtcggatggagagtgaagaggatgaggatgtggggcttcccccagagctggagaggataattgctcagaggaccgagagatga

SEQ ID NO: 1757 - DNA, 272 bp, Glycine max
  Peptide Sequence Number=SeqID_93442
ggatcgcgcccgcaagacacccagtggacccggagaagtccaacagggtcttagggtttccagctctgattacgggcctttgtcagttctagagagtgctcatcgcccccaacaaggtcatcaggcccctattaacagggctttcatcaagaagtactacgcccctaggcaggcacagggtgaaacaccacagcagcctagggatggccagcagcgggcaataagcgcgccgccaccacctctagagttcacctcagctcatccacaaaaag

SEQ ID NO: 1758 - DNA, 324 bp, Glycine max
  Peptide Sequence Number=SeqID_93443
atggtggtcatcctgcccaaggaatacctagttgtctggttttgttcattgcataacaggccagacaactaccttaaggggattattaacagtgctttaaaaggtcttgatgatgctccacagcctaaatcaaaggctcctgctaggtggattgtcgtcaagtgtaatagacaaaaaggaagtactgagtgcgactactatgtcatgcactggatgtccaccatcattttaggaacttttaggaataactgggaagcgaccattggagccagagagcttaaaggcgttgcagatcgagtgggcacagtattatctccgagttag

SEQ ID NO: 1759 - DNA, 1287 bp, Glycine max
  Peptide Sequence Number=SeqID_93444
ttcttcgccgatgcgatcaaaaaccgcaagcgcgtttggattatggcctacgcgcgcgcctgcatcgactgcgtgcatgcggcggctcgcggtttcgacaccggcgcggtcagcattgcgatggtcgaaggcagcgcgctggggggcggctttgaagcggcgttggcgcaccatttcgtgctggcgcagaacaatgcgcgcatggggtttccggagatcgcgtgcaatctgtttcccggtatgggcggttactcgctggtggcgcgcaaggcgggcatgcgcttggccgaggagctgatttggggcggcgagtcgcataccgcagagtggttcgagagccgcgggctggtggatcagctgttccagcccggcgacgcctacatggcgacgcgcacctttatcgataccattcggccgaagctcaacggcatgcgcgccatgctgcgggcgcgtcagcgcgtgttgcagctgacgcgctccgagctgatggacattaccgaagattgggtgcactcggcctttaccattgaggaaaaagaccgcgcctacatcgagcggctgccaatgctccagctgttccgggagcattggccgcgcaaacagaaagccctgtttttcgtccacgccgacctcgtcgaggaagtggttttcgctctcggtctccaccccttcggcgattacccggaaggccaacgcctccgccgccgcgacgatcgcgcgcaccagcgattgcgataccgggttgaaattcaccccgcgcacgaagcttttatccagcttgatggcgtccagaggaatgcgcgccagctgcgccagcgacgaatagccggtgccgaagtcgtcgagatgcacctgcgcgcccagttcgcgcagccgggtgatcaacgcgcgcgcgcggttctcgtcttcaatcaggctactttcggtcaactcgaagtccagcagacagggggccatgcggtgatagcgcagcaccccgagcaggtcgttgacgatgctgtcatcggccagctgacgggcagagaggttgaccgccacccgcagattcaagccctgttcttgccactgcgccgcctgcccggcggcggtctgcagcacccattggccgagcgggccgatcaggccggactcctcggcgtaggaaatgaactgcagcggcgggatcaggccgcgctccggcgaatcccagcgcaccagcgcttccacgctgtgcacttcaccgctgcgcgcgtcgattttcggctggtaatacagcaccagctgattttgctccagccctttgcgcag

SEQ ID NO: 1760 - DNA, 942 bp, Glycine max
  Peptide Sequence Number=SeqID_93445
atgatggcacatcaattacatattggtgactccaacctgatgaatctggtattgcttgaagttgaacagctgttacaagccaatcaaagatcacttaaagactatccttccatgccatatcttgagaacgcaaatttactaacacatgcagacaatggcctcattttgtctgagctgaatttcaacaatgaagaacttagatcggaattccttaacctttttttttctcaaatgaccagtttatttatcgtactaacttgccttgcttattttcctcctttgtgtttcgctctggaatttcaagttgttattaaaaccagaacaatttttatgcctacagaccaacaaacacaaatttataaccaaatcattcaggttgtcaataaaaatgaaggtggaatgtttttcttatatggatatggaggtacaggaaaaacatttttttggaaaacacttgtagcctcattgagagctgacaataaaatagttattatggttgcttctagcaacatagcttctttgttattgtctagaggaagaacaacacattcaaaattaaaaattcctattccgatatttgaagactcgacatgcaatattcatcaaggaacacaattggctaaattattgaatgaagcaagtcttatcatttgggatgaagcccccatggctcacaaattctattttgaagcacttgatcaaagtcaaagagatgttattaaggcgaaatcaagttctgataaaatctttgatggtaaagttatggtatttggtggagatttccggcagattctgtcaatcattcctaggggtagccggtctgacattgttaatgcaactataaattcatcttatctatggaattattgccatgttttgacactatcgaaaaacatgcgtttagaagtcaatatagatgcaacagacaaagaagaactttag

SEQ ID NO: 1761 - DNA, 141 bp, Glycine max
  Peptide Sequence Number=SeqID_93446
gtttggaatgtccaagatggtcgacctcgtcgtcggaagcacaaccaaaaagaatgtctcgcacatcaccatgtgccggtgaagggcgctatttggcgcatcaaggaaagaggtcgtgggagcgcatcagatgctagatag

SEQ ID NO: 1762 - DNA, 540 bp, Glycine max
  Peptide Sequence Number=SeqID_93447
atggaaagatgcaagaagattgaaggaagaggtacactacggtatagtggacatagaggttcaaagaacttgggggaattagcaagtggtgactactcggcatttggtgcactcatttggcacgaggaactcacaggcctcactttgctactcctaataggctctgagactatacattttggatttgggagctcgaggatcgatatacgttgtacctggcatcgagagtgttgttttcctagaaaaaccatatgccatggttataacaattcaagagttcaagataagaatcaagaagaattcaagactcaagaagaaagtttagagtcaagaatcaagattcaaggttcaagatctcaagaatcaagatcaagattcaagactcaagattcaagaatcaagagaaggcttaatcaagataagtatgaaaagtttttctcaaaaattgagtggcacatgatttttctcaaaacatgtttaccaaagagtttttactctctggtaatcgattaccagattgttgtaatcgattaccagtag

SEQ ID NO: 1763 - DNA, 303 bp, Glycine max
  Peptide Sequence Number=SeqID_93448
atgtgtcctcctccatcaaaggttaacaccaaaggtgcaccgaagaaactgatgaaaagaagccaaagatcgacaaagcgtgatccgtcatattgggagtatgctgatgcttatcattcagttcaaaatagcaacacttcaatcagacatactgcgacatcttctgaaccactgaagccagcaaggatgatcccgatgttggatcaatttgcgccatttatacagggtttcattgaggatgttgttgaagtgaaagcggatggtaactgtggttatcgatcagttgctgttttgttaggttag

SEQ ID NO: 1764 - DNA, 429 bp, Glycine max
  Peptide Sequence Number=SeqID_93449
atggatgtgaacacaatgttaatgtgtaatgatcgattttcatgtgttggaccgattgagttatgcaccgctggtagaaccccagatggaattttaaacttacttgaacgcactatgacccctactcatgatgcggttttgtattacaacggaaggtggagcatgccacgccaaaacaactttgtaggttacgcgttcacgggaaaaaatccccaaaaatttgatattccaaaaagatgtaccatagatgaactgaaggatttgatcaagcaagtaacacctaaagggaatcctcctcatgggattcatgaatctcaacttgtgttggtagagtccaattactggaaacaatttgtgccaatagaaattttggctctctttagtaaatcggttatggaaaatgaggacgaggtggttacgtcgttgtag

SEQ ID NO: 1765 - DNA, 519 bp, Glycine max
  Peptide Sequence Number=SeqID_93450
atgaatggtatcagcaaatatctctcgtacggtgtgattcgagaacaaaccagcaatgacttccaagattattttgatgatgtcaaagaatcaagagttaagcaagttccaaagaatccggcttcaagaatcaagtctcaaagaatcaagattcaagaacaattaagtttcaagattcaagattcaagattcaagaacaatcaagatcaagattcaagactcaagattcaagattcaagaaaagttgatttcaagattcaagagaagaaatcgagaagcaacaatcaagacttcacaagcgaagttataactcttccaatggttttcttgatcagacatgaagagtctataaaaagagggtacatctcttatggatcagttcaagtggagggtacatccacttggttgttcaaagagaacaagggagggtacatcccttgtggatctttggcttgtaaaggattttacaaggttgaaagaaatctcaagaactgttggttgcttggggactggatgtag

SEQ ID NO: 1766 - DNA, 348 bp, Glycine max
  Peptide Sequence Number=SeqID_93451
atggcacgtattgatgacaagataaaaaccattgatggatctaaagaaaatttgaaacttgctataaggataactgagctctggtttgttgggatgtcaggtaggtctgaacaagctgagatggtcatcattgactctgatccgttagttagatatttttatgattcacagggtgatcaaatccatgtggtctgtaagcaagagcagttaaagacatggaaaatggatttgaaggaatgttgtacttatgtgatgcacaattttagagtcagccagaatgatggacagtacaaagtttgtgatcatccatataaattgacatttattggagttacggttgtcagatag

SEQ ID NO: 1767 - DNA, 252 bp, Glycine max
  Peptide Sequence Number=SeqID_93452
atggaggttgatgaaccttggttagggttatggctaccattgaattatcaagtagatatgggagcaaggatggcctttgtggataactgggcggtgggtaaggagaaggttggttattggctgagtaatgacattgttgggttggtgggaaacttggctgtattggaatggcagtcacagcacgggcttctccttcatcctcaccctcttcatttgccccaattttctcattcgtccaagcaggatgactaa

SEQ ID NO: 1768 - DNA, 264 bp, Glycine max
  Peptide Sequence Number=SeqID_93453
atgaatgttttgagtggtgcaatcctcttttgtaaaatcactcgtgcacccaacatcttcatgatttgtgtacatagggacttattaggtagtgatcaaggggttcccatgaaccctaagagaataaaagtcattcctgagtggcccactccaccaagtgttgaggaaaaaagcccagagtttcaacaacctcgagatttgaagtcaaatccttttcaagggagagggattgatgcaatctcaccccgcaaggacattggataa

SEQ ID NO: 1769 - DNA, 827 bp, Glycine max
  Peptide Sequence Number=SeqID_93454
atgagctggattgaacgaattcttaacaagagcaatatcacacaaacccgtaaggcgagcattcctgaaggggtctggaccaaatgcgacagctgcggccaggtcctctaccgcgccgagctggagcgtaatctggaagtgtgtccgaagtgcgaccaccacatgcgcatgggcgcgcgcgcgcgtctgcataccctgctggacgaaggcagcgaagtggagctgggcagcgatctggagccgaaggacgttctgaaattcaaggattccaagcgctataaagatcgtctggtcgccgcacagaaagcgaccggcgagaaagacgcgctggtggtgatgaagggcacgctgtacggcatgccgatcgtcgcagcgtccttcgaattcgccttcatcggcggctcgatgtcttccgtggtcggcgcgcgtttcgtgcgtgcggttgagcaggcgctggaggacaactgtccgctggtgtgcttctccgccagcggcggcgcgcgcatgcaggaagcgctgatgtcgctgatgcagatggcgaaaaccagcgcggcgttggccaagatgcaggagcgcggcttgccgtacatctccgtgctgaccgacccgaccatgggcggcgtttccgccagcctggcgatgctgggcgacatcaacatcgccgagccgaaagcgctgatcggctttgccggcccgcgcgtcatcgagcagaccgtgcgcgagaaactgccaccgggcttccagcgcagcgagttcctgatcgaaaaaggcgcgatcgacatgatcgttcgccgtccggaaatgcgccaaacgttggcgagcattct

SEQ ID NO: 1770 - DNA, 919 bp, Glycine max
  Peptide Sequence Number=SeqID_93455
aggactacacgtccttaccttcagagggctacatgccctcgccatcagaggactgcacgtcctccccttcgtagggctacacgacctcaccttcagaggactacacgacctcaccttcagaggactacatgtcctcgccatcagaggactgcacgtcctccccttcgtagggctacacgcactcaccttcagaggactacatgtcctcgccttaagaggactacccgtcctcgccttcagaggactacacatcctcccgttcagagggcttcacgccttcgccttcagaggactatacatcctcgccatcagaggaccatacgtcctcaccttcagaggactacacgtcctcgccttcagaggactactcgtcttcaccatcatagggctacatactctcgccttcagaggactacacgtcctcaccttcagagggctacacgccctcgtcatcagaggactgcacgtcctcccattcgtagggctacacgccttcaccttcagaggacttcacgtcctcgccttaagaggactacccgtcctcgcctttagaggactacccgtcctcgccttcagaggactacacatcctcgccttaagagggctgcacgccctcgctttcagagggctacacgccctcgccgtcaaaggactatacgtcctcaccttcaggggactatttgtcctcacctttagaggactatacatcctcacctttagaggactacgcatcctcaccttcaaagcactatacgtcctcaccttcagtggactacacgtcctcgccattagaggactacacgtcctcgccttcagaggaatccatgtcctccccttcagaaagctacacaccttcaccttcgtacgactacacatcctcaccgtcagagaactacactccctcgccttcaaaaggtga

SEQ ID NO: 1771 - DNA, 435 bp, Glycine max
  Peptide Sequence Number=SeqID_93456
atggtgaagccaaggaatattctattgacgttgaaggagcacaatgccaacgattatacgacgatcagacaaatttacaatgccagacatgcttactgttcttccataagagagagtaacaccgaaatgcaaaaactcatgatgctgcttgatcgagataaatatattcactggcataggaggaaggattataatgttgtacgcgacttgttctggagtcatctcgatgcattttggggtcttttcatgagagttgatgcactcccgagggttattgtgaccgacaaagatttgtctttgatgaatgtagtgaaaactgtattcctggatgctacgaacttgctgtgtcagtttcacattgacaagaatgtgaaggcaaagtgcaaaaacctgattgctcaaaagaatgcatgggattatgtgatggagggttga

SEQ ID NO: 1772 - DNA, 694 bp, Glycine max
  Peptide Sequence Number=SeqID_93457
agggctacatgtcctcgccttcaaaggactacacatcctcaccttcagaggactatacatcctcgccttcaaaggactacacatcctcgccttcagagggctgcacgccctcactttcagaggactgcacgtcctcaccttcagagggctacacgccttcaccttcttaggactacacgtcctcacctttagaggactacacgtcctcgccttcagaggactacacgtcctcgccttcagagggctgcatgccctcaccttcaggggactacaggtcctcaccttcagagggctacacgccttcaccttcttaggactacacgtcctcacctttagaggactacacgtcctcgccttcagaggactacacgtcctcgccttcagaggactgcatgccctcgcctttagaggactacacatccgcaccttcagagggttgcatgtccttaccgtcagagagctacatgtcctcaccgtcaaaggactacacgtcctcaccttcagaggactacacgtcctcaccttcagagggctacacgccctcaccttcaaagggctacatgccctcgccttgccttcagaggactacacgtcctcaccttcagagggctacacgccctcagaggactgcacttcctcgcctttagagggctacgcgtcctcactttcagtgggctccatatccacaccttaa

SEQ ID NO: 1773 - DNA, 832 bp, Glycine max
  Peptide Sequence Number=SeqID_93458
ggacgatgagtacacagatttccaggaagagatagctcaccgacattggacatcgctggtgactcccatggctaagtttgaccctgatatagtcctggagctttatgctaatgcttggccaacaggagagggagtgcgagacatgcggtcatgggaaggcaaggagtgtgagttcagtcagaggaggaacagggccgacggattcgacgaggatgccattgcccaactattatgcacactagggcaggatttcgcccggaccgctgcaaggaggcgggtgcggatcatgcgcaccagcatgaccaccttgacccagatgtggatgacattgctgcttagcaatgtcttgcctagtgatcataactccaatctccctctgccgaagtgtcagctggtgtatgccatcctgacacagatgagcatccacgtggctcagttgattgttgacgccatctatttatttgcaggtatgccactcaccaggcaccctctagacccggataagtctaatagggccttggggtttccgacattgatcatgggcctcttccagtcattcggggttcctgtcacccctagtaagggtgatgcaccacaggctgcagacgcaccgccaccacctcatcaggacgatcccgctgggtcactaggcatggagtgttatcgacagccacttggttcgccagcaggcgcccaaccaccaggggcagattggcccgaggcccaagcaagggaggcacctgcaggatcccccgacgatgcagaggaggcccgtatggatgaggagatgacgaatttgctcggtttcttgggaggaagcggagccacgtga

SEQ ID NO: 1774 - DNA, 159 bp, Glycine max
  Peptide Sequence Number=SeqID_93459
atggattcaatcaagcacagaatgatgcatgcacctgacctcaactctcagatgcaatgtgagttcgtcgagaccacccagtcgtgcaccgtaacttctcccctaggtgatcagtctggggccacaaggagttccctaccaggtgacgcgcccccttag

SEQ ID NO: 1775 - DNA, 204 bp, Glycine max
  Peptide Sequence Number=SeqID_93460
atggccccgaggaagcttgcctcaaagagatctaggaaggataaagcgaccaaaggaactagttccgctcccgagtatgatagtcaccgctttaggagcgttgaacaccagcagcgcttcgaggccatcaagggatggtcatttctccaggagcgacgcgtccagctcatggacgacgagtatacttatttccaggaggagata

SEQ ID NO: 1776 - DNA, 216 bp, Glycine max
  Peptide Sequence Number=SeqID_93461
atgggtgaagtagaggaggcgcaagagcagatgaaggccgacatggatgccatgaaagagaaaatggccacaatgatggaggccatgatgattgccgctaccagggctgttgctaaggtgaacccgatgcccccttctgatatcaaccaaatgaatcatccaacctcagatatggtgggcaaagatttgggaagtacggatgaccccatgatgtga

SEQ ID NO: 1777 - DNA, 504 bp, Glycine max
  Peptide Sequence Number=SeqID_93462
atggagacgtgtttggaagtagaggaattgttacagcggatgatagaccaaggtcgactagaagtcggcattgaaggaaaagaggagcagcatatatgcatgcaatctacggaggggagcggtgttgcgaagcccaaacccttggtgatatacttcactaaaagtgcagcctcgcaaaagcccgggcaccccttaatggccaaacctgttcctttcccgtatcaaaatagtcacgcggtcccgtggagatatacacctccggggaagaaggaagaagaagtcactgacgtcagctttctgtcagctaaagtaacagatatcacggggctgagtggtgtgacccgtagtggtcgtgtgttcgcacctccggacctaccagtccaacccgccgacgtcaaaggaaaaggaaaagtggtggaggaacaagatggcgaagcaccccacgcttcgaataaagatattccagcaaaggggcccccagagaaaaaggatggtagaaaggag

SEQ ID NO: 1778 - DNA, 282 bp, Glycine max
  Peptide Sequence Number=SeqID_93463
atggggtcgagtcaggcgccttcgcttaaaaagaggttctatcgagtcaaggtcaagaacctaggaatcaccaatcaaaaagagttagggcagttgatgggtagaggcgaatgggccccattcatagacatcctcgcacttttgatcttcaaaggagtcctctttccaaatgtggatgggttggtggacctagtagcgatcgacacttttctcgcctatcatgaccgcaaggaaagctcggttatcgctatactagccgatctatatgacaccttcgactga

SEQ ID NO: 1779 - DNA, 420 bp, Glycine max
  Peptide Sequence Number=SeqID_93464
gccacttgtctaacaccatcctctacaccctatgttgaagctgcagaagagtcattggaaacatcttttcaagcgctagaaattgtgaacaatgcttatgtggaggctcctccggtgcaatcgtgtctatctaatgcctctttgatggtgtcctgcgttatgctaagggatgggtacgagcctgaaatgggtttaggctggagtagtaatggcacaacaagcttggtgaggttcgttgaaaaccgtggaaggttcggtctgggttacgagcctacacatgctgacaaaagaagggtcaccttagaatggaaagaaagaagcctagcgcatttacaagggtggggaccgcagatggaaagggtccttgtgtgccacattagcaaaagctttgtcagcgtgggatggatgcatgagaatcag

SEQ ID NO: 1780 - DNA, 201 bp, Glycine max
  Peptide Sequence Number=SeqID_93465
atggccataatcccagcaaagattcctcaatctccattttttcgaggatacaacttgaatgcaacatgtgcttatcatggaggagttctagggcattccattgagcattccacctgcactcctgagtttgacttcctagtctgttcaatcagaaattgctcgttctacacgtttggtgagggtgccgtaaacaacgagtaa

SEQ ID NO: 1781 - DNA, 564 bp, Glycine max
  Peptide Sequence Number=SeqID_93466
atggcacatcacgcccatggacatcaggatgtactgactactgccattgggccaccagaacatcttggtcgtgtgcatgctgctggagccgctatcacgatcaagcaatactttggatcggctccaacgacctcccgcacgtcttcgtccatgggtctcgaagacctggaccagatgcagtcccagtttcagtcgcacatgcaatcacatggactcgcactgcctcctgagcctgaggttggtccttcaggtgctcgtgtcagcacaaaggagagttgtttttatctatcagggaatgatccagacacgggtgactcagacaaatgcgggttgtacatcgaagaaaatcctccccgcctggttgccctaggaagactttatgagggatccacaaccgttcacaacattcctttgctgcatgatcaaatcaaggttggtgctgaggaggttagatatgcagatgctcccattcctatacccactgaagaggttaagttagtctggcaggcacttaacaccttccttgcttggatgacacatcttgtgaaacgtttatcagaatag

SEQ ID NO: 1782 - DNA, 155 bp, Glycine max
  Peptide Sequence Number=SeqID_93467
atgtcacggaacttcatggatcgtgctacaatgccttctttgacttccggcatgtcacgaaacttcacgaattgcctaacgatgggtgccaagtacttcgaagttgtcaacgagggtcgcatcccaacaacggatggtcccttggacgaaattag

SEQ ID NO: 1783 - DNA, 1558 bp, Glycine max
  Peptide Sequence Number=SeqID_93468
atgtcgcagagttcaaatgataccaagaccaactggcaattactcgccattcgtgcactgctaaaagagggtaaaacccagcgggcagccgaactgtttaaccagttgccaaaagatcttaacgacgcccagcgtcgtgagcagagcctgctctctgccgagctgaaagttgcgctgaaagattacgccgccgcgaagaagatcctcggtgatatcgacgtgagcgcgctggataaaaaccagcaggcgcgcttctggcaggcgggcattaccgctgagcagggacgcccttccctgaccttgctccgtgcgctcgtcgcccaagaaccgctgcttggcggtgctgataagcagaaaaatattgatgccacctggcaagcgctggcgtcgatgacgcaggaacaggcgcaggcgctggtcatcaacgcggatgaaaacgtcctgcagggctggctggatctgcagcagatgtggttcaacaaccgcagcgaccctaagatgttgaaagccggcattacggactggcagacgcgctacccgcaaaacccgggcgcgaaaatgctgccaacccagctggtaaacgtgcagaactttaagccagcttccaccagcaaaatcgccctgcttctgccgctcaacggccaggcggcggtgtttggacgtaccattcagcagggttttgaagcggcgaaaaacggcacgacgtcggtagccggcagcgccgttcccgcacaggcagcccaggcggctaatgtgaataatgatgttgtcagcccatccgccgcagagaccagcgacctgaccacggcgcaagcgccagcgcagggcacgatgcaaaacccggtgacggccccgacgacgccggcaccggtgccagcaactccggcgccggccgagacgcaagcgccgccagcatctgttccagcgcctgccacaacagcagaacagcctcaaccgcagcctgcacagccgactgctcaacctgccgcgcagccgcagtccgtggcaaccaccagcgccagcccgagcgctgaattgaaaatctacgataccagttcgcagccgctggaccaggttctggcgcaggttcaacaggatggcgcgagcatcgttgtcggtccgctgctgaaaaacaacgtggaagagctgatgaagagcaataccacgctgaacgtgctggcgctcaaccagccagagcaggttcagaaccgggccaatatctgctacttcgcgctctctccggaagatgaagcccgcgatgcggcgcgtcatattcacgagcagggtaagcaggcgccgctgttgctcatcccacgcagcgcactgggcgatcgcgtggccaatgcctttgccgatgagtggcagaagctgggcggcggcgtggtactgcagcagaaattcggttccgtctctgaactgcgcgcgggcgtcaacggcggggcgggtatcgcgcttaacggtagcccggtcaccgcgagcctgccacagcagcagggcgtgacgattggcggcctgacgatccctgcaccgccaaccgacgcgcagattagcggtggcg

SEQ ID NO: 1784 - DNA, 159 bp, Glycine max
  Peptide Sequence Number=SeqID_93469
atgtctttctcaagggatttcctttctgctaatcgattaccaaatgccctatcaccctgtgtaatcgattacacccagctggtaatcgattaccagtgccctatcaccctgtgtaatcgattacacacccttggtaatcgattaccagaggccatttag

SEQ ID NO: 1785 - DNA, 83 bp, Glycine max
  Peptide Sequence Number=SeqID_93470
atggaggagtaccgagaactactgaggcagttggaaccgacatcggaagaggagagtgatgattcttccgaggacacgtctta

SEQ ID NO: 1786 - DNA, 239 bp, Glycine max
  Peptide Sequence Number=SeqID_93471
ggccttttgttgtgaagagggctttttccggaggagacctggtgcttaccaacatggatggcgaagagctaccttcacccgggcaggatcatcttgagctaccttctggggtagggacaaaacatgaacagcagaaaccaatcaagggacggatgcgagtgggggtggggtcacgaccgactgatcgttgccccttctctgcgctaaacaagcagagaacgtcgctgcaaggcagcccc

SEQ ID NO: 1787 - DNA, 216 bp, Glycine max
  Peptide Sequence Number=SeqID_93472
atgttaggattcacaagcaattctcctcaaatttcagctagcccacatcaattggaccttgcaccttatgctttagggctctacaatgccccggggctcctctatgataagcacacattgtgttcgagtcgtatcctcgaaaaatggagattgaggaaacctagcaagggtatggctaccattgcagtatcagtagatatggagcagttagcatag

SEQ ID NO: 1788 - DNA, 353 bp, Glycine max
  Peptide Sequence Number=SeqID_93473
gagtacctctacctctacctctacctctaccttggtggtttgctttcttctgggttgtccagtcatcaattgcactcttcaagtttgaggcatcacagggatcgttcgtctcccatagacgtcaggatgtcctgattgctgccatcgggcaaccagagcaccctagtcgtgtccgtgctgctaaagccgatgccacaataaagcaatatttcggatcagctccacgaacgtcccacagttcttcctttatgcctcctgaagacctacaacatctgacccaacaaatcaaggaccagctagaggagtccatcatggaaaaagtgactccgcagctaatggcatccttcagctag

SEQ ID NO: 1789 - DNA, 762 bp, Glycine max
  Peptide Sequence Number=SeqID_93474
atgattgagttgcgaaaacttctggataggtatcctacatctgaactgaattctttctggttaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaaaaagacgtatattccttgctaattatcagacaattacttattcacaaaccttgcggggggctaatagttttcatttcccatctcatggaaaacccttttcgctccgcttagccctacctccccctagtaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgttaccttgatatggagccggagcttctaactatgatgaatacgctaactatggatatgatgccagaaatagcccgattttatatcacctttcaattcgaattagcaaaagcaatgtctccttgcataatatggattccaaacatccatgatctggat

SEQ ID NO: 1790 - DNA, 450 bp, Glycine max
  Peptide Sequence Number=SeqID_93475
atgaccaccctgactcagatatggatgactttgctgctcagcaacatcttgcccaccgatcataattccgacctccccctgccgaagtgtcagctggtgtacgccatcctgacgcggatgagcatccatgtggctcagttaatcgctgatgccatctatatttttgcaggtatggcgcctaccaggcaccctctggacccagataagttcaacagggccctgggatttcccgccttgatcacaggactctgccagtcgttcggcgtccccgtcacacctagcaaggcgattcggccacccatcacccgagcttttattgagaagtactgcacgcagagactggtccggccggatcatttaacacggagcagtatttgcggcatttggttcaccagcaggcggccaaccaccgggcacatgtacagactcatgattgtctttatcagatga

SEQ ID NO: 1791 - DNA, 513 bp, Glycine max
  Peptide Sequence Number=SeqID_93476
atgttctccggcccgccggatcagccgctgctgaatatcgaggcgatccgcaacccggaatccaccgaggacgatgtgaccgccggcgtgcgcgtgaccggcctggcggatgcgccgaagctggaagtgttctccgatccggccaaatcgcaacaggaagccctgtcttatctgctgcgcggccagggcttgagcagctccggcgccgacggcaacgccatgacctcgatgttaatcggcatgggggttgcacaaagtggtcaacttgtgggtaaaatcggcgaggcattcggcgtaagtaatttggctctggacactcagggggttggcgacagttcccaggttgtcgtgagcggctatgttctcccaggcttacaagtaaaatatggagtgggcatcttcgactccttggccacgctgacgttgcgttatcgcctgatgcctaagttgtatcttgaagcggtgtctggtctcgaccaggcattagatttgctctatcagtttgagttttag

SEQ ID NO: 1792 - DNA, 387 bp, Glycine max
  Peptide Sequence Number=SeqID_93477
atgggtgaagtagaggaggtacaagaacagatcaaggccaacgtggaggtcatgaaagagaaaatggccacaatgatggaggccatgatgagcataaagaaaataatagaggtcaatgcggctgcagttgctgctaccaatgttgttgctgaggtggacctgattcccccatttgtcctcaaccaaataaatcccccaacctcagatatggtaaggcagggaggcaaagagttgggaggtacgggcagcccccgttttgtgcaagttcaaaacatacaccacccaacatggcgcacactcccgatgagaatgtcaataaccccactcccatactcattgaaagccaacaacctcaatctaataatgcatatgtctctcaacccatga

SEQ ID NO: 1793 - DNA, 297 bp, Glycine max
  Peptide Sequence Number=SeqID_93478
atggggatgtctcctccacctctagaaacctcacaatcactcaaaatctcctccaatgctttgcaacatagcttcctcttcaagctcgcgccagtaatgttcactcagcttggaggttcaagtggtgcacttagtgaattgattctcgctgagcgcatcattgacaactcatctgcttccaggatcttctacgcgcttagccatgaactgctgcgctcagcgaatggctcgctaagccaaagaattggcttatcgagaggctcaaaatcagcacttccaccaaacttgcctaattag

SEQ ID NO: 1794 - DNA, 88 bp, Glycine max
  Peptide Sequence Number=SeqID_93479
atggagcaacaccatgaagatgagcttagaaacttgaaggccaaccatgaccagctagaggctcgtgtgacatgccccaaggcgacga

SEQ ID NO: 1795 - DNA, 222 bp, Glycine max
  Peptide Sequence Number=SeqID_93480
atgtttctcatattcaacactagtgctttgaaaggacttgatgatactccacaaccgaaatccaaggctgctgctagacaaaaaggaatccctgaatgtggctactacgtgatgcactggatgtccacgataatcttaggatctttcaggaataattgtgagacgtattttaatgaagttagaccattggaagcagagagattcaaggcgtatcgcatctag

SEQ ID NO: 1796 - DNA, 402 bp, Glycine max
  Peptide Sequence Number=SeqID_93481
atgtatgccagcggcgtgccggcacgcatcctggaagtcaccgacgtacagctggccagcatcaacgccatcgccaattcctggttccggttcgacatcaaggcggagacctacccgcgccagcccaaggcggtcgccaccatcgcgcagcccaatattctggtggccctcagccggctcgatgaaaagctggtgtacgacctgaccaaaacgatgttcgtaaacctgccggaagtgcaccaggtgcacagctcggccaaatacatctcgctggagaatgcgctgaaaggcgtttccgtgccgctgcacctcggcgcctatcgctactaccgcgaagccggcgtcgagatacccgattatctgatcccgccggaagccgccgcgctggccgccaacccgtaa

SEQ ID NO: 1797 - DNA, 1074 bp, Glycine max
  Peptide Sequence Number=SeqID_93482
atggacggggtgctgattgatgcccgggaatggcattaccgggcactgaaccaggctctggcctgcttcgggcgagcaagcacccgtgaagagcacgaggggggattcgatggcctgcccacccgggacaaactgcaccgtctgagcgaacggtacggtcttccggtcagcctgcactcgttcatcaatgagctgaaacagcagtacaccctgcgggaaatctggcagcactgctggccggtttttgcccatcaatatgcgctggcccgcctgaagcgcgagggttaccggaccgcggtggcgtcaaactccatacggcaaagtattgaaaccatgctgggtcaggcgaaactgctggagcttatcgagttttacctgtcgaacgaagacgtctcccgcggcaaaccggatccggaaatctaccagaaagcgatacagcgactggctttgcagccaaaggaatgcgtgattgtggaagacaaccctcatgctattgtcagacgctctccccccccgggcgcagtcattcctgcaggggccggacagcggcacactctattttccggatatccggacattccggcagtgcgcaaaacaggctatccgggctcacaatccggaaaaaggcgagccggtactcgaggaagcctggcatcagtatctgttacaggaaggagaaccgcattgaccccggcagcgatcatttcaatcctcgatgaaaatcactactttgcaaccgggctccagcatattttgttggcctggtttcagaggaatgggcgcacggtacaatttctggcgcccggagacaacacggaatccgcccatctggtgtttttcacgctacagagcctctcccgccacccgtcactgttactccgccccccttcccgggagcagcagcggatctgcactatcagccgccgtgacttctgtggtcatacctgcccgggactgccggagatcacggtgctgcaccgggagagttcgcgtaacggtgtcatcacatcgttactctcgctcaatgcggccggaaaaactcagctcccagtccccgtgaacgggaggtactag

SEQ ID NO: 1798 - DNA, 650 bp, Glycine max
  Peptide Sequence Number=SeqID_93483
tcccccatggacgtgaggatgtcctcactgctgccattgggcgaccagaacaccctggtcatgtgcgtgttgctggagtcggtgtaaccatcaagcaatactttggatcagctacatggacctcccacacttcttcctccatgactccagaagaactaaagcagctaactcaacaaattagggaccagctggaggagtcgatcacaaaaaaacctaaggttggtccctcagctgctcgtgtcagcacaaaggggagttgtgttgatccctcaccaactgatcatgacacgggtgactcagacaaatgcgggttgtacatcgaagaaaatccttcccgtctagttgccttaggaagaatttatgagggatcaatagcggttcacaacatccctttgttgcatggccaagtgaaggttggtgttgaggaggttaaagatgcagaggctctcgttcctgtacccactgacgagatagttgtgtctctagcaaaacctatagatgggccgaatcctcaggttatgtgggatgctaccgtgttcgaggtgtttaatgaacacttcccgttgtacataaggcacaaagatttgtctgaaattgcacacggtagtcaatgtctcagcatatttgttaaacagttgtggattctataa

SEQ ID NO: 1799 - DNA, 159 bp, Glycine max
  Peptide Sequence Number=SeqID_93484
atggcttcctatggtgtggcgtctccatttatctttctccttctccattctgttgcaatcagacctcaagaagcaaaggaatccattgatgaagaagatccaaggcctacaagctccaatggagctacatcatgtggtgtcaagagcctcttcatctag

SEQ ID NO: 1800 - DNA, 234 bp, Glycine max
  Peptide Sequence Number=SeqID_93485
atggatcattggaaagcaaccaaaagagttatgaggagctcgaccaagtcgaagaatattgacatcaaattcctagttgttaaggaaagggtacggagtggacaaatttccatagaacacttagggaaaaacttcatgatagcatatactcttactaaggaacttccacccaaggtctttcatgagcatgttgatcacatgggtgttttacagttcgaggaatctttggtttag

SEQ ID NO: 1801 - DNA, 49 bp, Glycine max
  Peptide Sequence Number=SeqID_93486
ggtgaacgctgtgaaaattttcccggacgcccaaaatggactcggataa

SEQ ID NO: 1802 - DNA, 357 bp, Glycine max
  Peptide Sequence Number=SeqID_93487
atggtgaaagttggaacctcttacgtgccgatcaacgtctcattttcgccaaaagttggcccagggcttcccgctgtccctcatgttcagctactgaaggggcggtgcgtaacggcaaaagcaccgccggacatcagcgctggcaagtgtagcggtcaccctgcgcgtaaccaccacgcccgccgcgcttattgcgccgctacagggcgcgtcccattcgccattcaggctgcgcaactgttgggaagggcgatcggtgcgggcctcttcgctaatacgccagcaggcgaaagggggatgtgctgcaaggcgattaagttgggtaacgccagggttttcccagtcacgacgttgtaa

SEQ ID NO: 1803 - DNA, 222 bp, Glycine max
  Peptide Sequence Number=SeqID_93488
atggtgatcaacccgggtctcaagggagttccaaaccgagtgacatgcccccaagtacaaatattcctcctcataagaaactacaaggatatccaacaaggtcactgcctagtgcccaatgtcgtcatacctacgaagttcaaggtgtcagattttgacaagtacaagggtactacttgccccacgaatcacctaaaaatgtaccgcaggaaaaactcttga

SEQ ID NO: 1804 - DNA, 215 bp, Glycine max
  Peptide Sequence Number=SeqID_93489
atgctttcttccgtcggtgctccccctcatggggactccttcttttccttccttccatcgggggaaccaactgatcattctacctcctatcctggccaagagctggtcccaatctattctcctcttttcagtacacgagcgatggctcaggagcggacatggatgtcttgcgtcttgttggaacaagtgcgaaaccaaccaaacacagagggcgg

SEQ ID NO: 1805 - DNA, 237 bp, Glycine max
  Peptide Sequence Number=SeqID_93490
atgagggttcactgtaatcaagcaagtcggagacctagcatgatcatagattcacctccactccttatgttcccacgaacccggagtcaccaactgtcgcaacctacccttcgacgggagggcgatgcgagactcacgggtgcatcttccaaggaaggaaaacgtgcggagtcgccaccaacgttattcgaggaaaacgtcggaaaaactggaaaaggtgtggtctacgaactttaa

SEQ ID NO: 1806 - DNA, 852 bp, Glycine max
  Peptide Sequence Number=SeqID_93491
ggcaaagaccttggaaaatcaaggcgaattgggaccaacttttagcaagcaaagaaggagcatctgtcaactggttccctcgatggaaggaaggaagaaccagagttcttatttcatgcggaggatttccaaatgttcccttgatggtgacgaggggttgcatcagctacaataccattcttgcaataagacaacttggctaccctatgagaggggcgccactagaggatgggctcgcgcctgtccgcaaggcatggggggtggtacaaaagaaagacaaagagctcgtagggaagttgagaaccgctaaaagggaggaagttgaggcaccggaggaagacgaagaggtgcaggctcttaggacaaaactcgagcaagctcaaacagtcaaagaaaggttcaaatcagtggctcttaggatccagaaggagaatgccgaactaagggatgtaaatgtagctaccaccaaggcattggaacaaaagaccaagagggctccaatagtgagctcaagctccgaagaggtgaaaggaatcatcacaggtcaaaggcatgatcttgaaggacgagctaaagggaatatgtgggccatcatcgataagtgcaaagagaagctaaatctagcggcgactcacgagcaaaggctagaggatgagtacgccaagatatcagcagaaagggaagcaagggaaagggtaattgattcattgcaccaagaggcaacaatgtggacggaccgatttgctctgactttgaacaggagtcaagaacttcccccattgctagccaaggccaaagcagtggcggacacctactccgcccccgaggagatccacggacttctcagctatt

SEQ ID NO: 1807 - DNA, 243 bp, Glycine max
  Peptide Sequence Number=SeqID_93492
atggagatctccaacatgtggacgaatccgtttgacgtgtctcttaagcatggtgcagcagcaactacagggcgaatccgcaaaatgacacatgtcaaagaaaaaccatcggggaaatatgtatgtgggggtcaccaccacaacatggagtttgtaatggctccggcttcatgtggattcacacatctatatatcctcaaggataccaatggtaccaccactagccttcccaacgctttgtag

SEQ ID NO: 1808 - DNA, 477 bp, Glycine max
  Peptide Sequence Number=SeqID_93493
atggcagaatcatccaagaagcgcaaaggatcttccttcatcaccaccgccaaggaacttctggagacccacccgcaccaagtcattctagaccctaagtaccttgacatcgaatttttttatggtgaaacatttgattgttaccaaatcgactgggcccatttagttcggcaccggatgcataaggcattacgggccaatgcacctctgccttatcctcaccttgttactctttttcttcatcatttcaatattcctttggatgatgaaccatatgtcaaagttaagtggtcattttctattggtgccggtgcggttacctcctttcattaccgaaaggatgttgatggtcagtgggttcgcaaacaagacttgcctccgcctattcctgacgagcgtaccccatctcctccaccacaaaggaatgattccacttctcttttgactgaagtcctcacagaactttgcattctttaa

SEQ ID NO: 1809 - DNA, 486 bp, Glycine max
  Peptide Sequence Number=SeqID_93494
atgtgtttcgatttgccacatgcattttggaataggaagaaacatattgtcgatcttccttatgagaaagattttagggaaaaacaaattcccacaaaagctaagccaattcaaatgaatgaagaactcctccaatactgtcaaaaggaaatcaaggatctacttgacaaagacctaattagaaagagcaaaagtccatggtattgcgctactttctatgtcaataaacaggctgagcttgagcggggagaagttgtcccatatctaaacaaaattgtcaaaccattgcatgataggctaaagaaaaatccgccttcctggtctgacttccatactcaaccagtcaaagatattaaactcaaagtccaatctataaaatgtctatatcttcctatcccacaggcatttaaaattgttgaaactgatgcattcgacataggttttggtggcatcctcaaaaaaacctgggcagatattgcctcataa

SEQ ID NO: 1810 - DNA, 147 bp, Glycine max
  Peptide Sequence Number=SeqID_93495
atggtgtggggtctcctctcaactcttcttctccattccactgccattaaaattcaagaagcaaaggactccattgataaagaagatccaaggcctacaagctccaatgaagctacatcatgtggtatcaagagcatcttcatctag

SEQ ID NO: 1811 - DNA, 372 bp, Glycine max
  Peptide Sequence Number=SeqID_93496
atgtcgtctttaccgttaccttatttgccagaatctttcaagctgcatttggtattttcaggcgcaaccatcatgattggtctttcattcaggagtgttcacccggagacccttataactaataactatgttatgcatattggtgctgcaactccaaggaaatcatctagccatcaacaaggtgattatatttggaatggacaacgagtaatgttgacagccgatcctggggttagattggaagatatcaagcactgctttggaggaacgatcatcgtcgtgttggagagcgaaaacaaaacatacacaagaaacccttcatggacatacaaagtgagaccaagagatttaggcaagatgttttcaatttaa

SEQ ID NO: 1812 - DNA, 678 bp, Glycine max
  Peptide Sequence Number=SeqID_93497
atggaatcactgggactcgcactacctcctgagcctgaggttggtccttcagctgcttgcgtcagcacaaaggagagttatgttgatccctcagggaatgatccaggcaggcacgaaaaatcctcctgcttggttgccatagaaagactttatgaggggtccaaacctgttcacaacatccctttgcaccatgatcaagtcaaggttggtgttgagaaacttacagatgcagatgctcacattcttgtacccactgaaaagggagttatgggaccggtgaaacctacagataggctggatcatgatgttgatgatcccctatatctgatgacattgatcatcccacagctttttcttaagccgttgcaggttatgtgggatgctaccgtgtttggagtgtttaatgacaacttccccttatacataaagcatgaagatctatttgaaatagcacacggtggtcaatgtctcagcatctctgttatacagttgtggattctgccaaacaactacctcaaaggaattattaacagtactttgaaaagacttgacgatactccacaaagtaaatccaaagctgctactaggtggattattgttaaatatttcaatgattgtagatcattggaaccagagagattgaaggcgcttcgcatccagttaaaatgggtttattaa

SEQ ID NO: 1813 - DNA, 219 bp, Glycine max
  Peptide Sequence Number=SeqID_93498
atgttttgtgagaatgctccaaccatatgggatcagcataagcttaaaggagcactcaaacccggtgacccccaaggcctacactccgaagagtccctcaaacgtgatatcgaaattcctaatggtgaaaatgctcggaattgggttgcaaacgtggtgctcaaatttcacgacgatccaacggtgaatgagtccaagatcgtcgttttcttgagacag

SEQ ID NO: 1814 - DNA, 318 bp, Glycine max
  Peptide Sequence Number=SeqID_93499
atgaaactggccaaatacaggctaaaggcccaagtggagaagaacgaaggcccaagtggagaaggacaaagcccccgagtggagaaggatgaaggcccaaacttatcttcctttaccggaagtggcgtctaccccgacttatcttccttcaccggaagtggcgtctaccctgacttatcttccttaaccggaagtggcgtctaccctgacttatcttccttcaccggaagtggcgtcatccaaatcttcgtagcctgtatcaaacgatccgctcctactcaggttcacatcatctggtatcagagcttcggctcttga

SEQ ID NO: 1815 - DNA, 237 bp, Glycine max
  Peptide Sequence Number=SeqID_93500
atgaatgtcgaagaacagttgaaatcttcgcgtaattacccacggaaacgttacggaagcgcctcggcttggattttcttcacgggaaacaattttcctcagcaatttcaagagaatacgaacaaaataggggaggagcttgccacccagctcgcccaggcgaagccagggttggttccctccagaagcaaccgccttctggaggaagaatctgggaaggcccaaggtgggccctga

SEQ ID NO: 1816 - DNA, 273 bp, Glycine max
  Peptide Sequence Number=SeqID_93501
atggcaagttcaacatgctttccacaaattccttcacaaataatcatcataaatgagaaacctagcaagactacccatcatatctcccaaaaccccatacccacgaaaatcaaaggagaaagaaacacgcacttcacgactccgaaaatgccctcctttcgtgatttggagcagaaatgggcaccaaaggttgaagctttgtttggagcttcaatggagaatgagggagaaaagaaaagcaacgtgagggagagggagaaaagagctgtctga

SEQ ID NO: 1817 - DNA, 270 bp, Glycine max
  Peptide Sequence Number=SeqID_93502
atgcatactgggtcaggattttgcccggaccgctgccgggaggcgggtatgccacccaccaggcaccctctagacccggataagtctaacagggccctggggtttccagcattgatcacgggcctctgccagtcatccggggttcccgtcacacctagtaaggtgatccgaccgccgatcacccgagccttcattgagaagtattgcacgcctaggcaggcgcagggtgatgcgccacaggccgcagacgcaccgccgccacctcattag

SEQ ID NO: 1818 - DNA, 234 bp, Glycine max
  Peptide Sequence Number=SeqID_93503
atgaatgagacaagtatgcgagcaggaaatgccgatgtgtatggattccttaagccacagtccattcagagatctaggcaatctgctttgaaagaacttgacgatactccacaacctaaatccaaggctggtgctaggtggattgttgttaaagtagcaatgcttctacttatattttattgtaatagacaaaaaggaagcactgagtgtggatattctggatgtcaattataa

SEQ ID NO: 1819 - DNA, 454 bp, Glycine max
  Peptide Sequence Number=SeqID_93504
gggattagagcatggtcctagaaagcagtatttctctacttggtgggctgacttaagggccatctttcaacatcagaatgtgatcaatgctgataatcaaattaggtggaagctggggagaggcgacaaattcctgttttgggaggatccttggggcgatgaaggagttcctctcaaggatcaattccctgaattattctctatttcttctcaaagggatttaacagtggcagaggtgggatcttggactgagaatggagctgaatccactggggtcttaacatctaaatctggttatcaagttattaaagctgacagggatgatgaaggtcagtacctgggcttcaagacactctgggagattaaacttcctcctaaagccctctcctttggttggaggttactatgggatagacttcctacgaaggacaatttgattaagaggcagattcag

SEQ ID NO: 1820 - DNA, 273 bp, Glycine max
  Peptide Sequence Number=SeqID_93505
atgcgggggtaccgtatggttatccgcactgtcgcaacctgcccttcggcgggagggcgacgcgtgactcgcgggatgcgtgttccacgaaaggaatacgcgcggagtcgccaccaacgtttatttgaggaaaacgtcggaaaaaccggaaaagacgtgatctacgaacttttaagtgaaaggttcgggagttgtatttacgcacggggaagggtgtttccctttgctcctacgtattccccaatttgcgatgaggaaatcagacctacgtag

SEQ ID NO: 1821 - DNA, 474 bp, Glycine max
  Peptide Sequence Number=SeqID_93506
atggctgtacagctacagtaccctatgaagagattttccactttttgtagagtagggttaccgcgctctctatctagaatcggccatgttagaagtcttaaggaggtggacgcaggattggcttcggtctgtccacaggtactggagtacagcaatggatccctgggtaaccatccaccaactattggatgcccccgtgttaagaggtgtattctcttaaagccggaagtgacgcagaacagctacaccgctagcaggaggggatattctttaaccaagaccggcattttagtggaagggcgtgctcctcaactcctatacccggaagtgggaactaacatgacttcaacagatgcggattctttagctgcttctaatcctacaaccaacataatattcggactctcccactgctttcgccataccacccagacccagggattagcccatgtccgctcccagccctccaagtag

SEQ ID NO: 1822 - DNA, 213 bp, Glycine max
  Peptide Sequence Number=SeqID_93507
atgaccccttcgcagcaacatgatgccccaatggcaacacctaatgccccattaggtcagcaatgggatgtacccggagcaatccctgctaggccgaggaacaagggcggagacaacgcgcaagaagaaatccggatcgtcaagcccgaaggtgggatcgaccatgtggcacatcttcgcgccatcatggacaccatgatgactgattttgat

SEQ ID NO: 1823 - DNA, 198 bp, Glycine max
  Peptide Sequence Number=SeqID_93508
atgacggagtggtacctggagatatgtcgcgggggtcaggagaccttgaggacgtcaggtggggtgctatttcccaagagcaagcttgatcaatcccgacccaacccgggcatagtcaggcttaagaatgaagacagtaagttaagatggcctttggtaatcgattaccaagggtgtgtaatcgattacaaggcttag

SEQ ID NO: 1824 - DNA, 195 bp, Glycine max
  Peptide Sequence Number=SeqID_93509
atgacagatgtaaatgcaaaatttgaaaacagttatcaagggcacaccggattccgacttacaaatcccaggttttcgcaagcaaggaaatcaaagcggcgacagagccgcacaggatcacacctatatcctcttgatgacctgaaatacgtctatgtgaaagggtgtctcacaatgaagatgaggactccttaa

SEQ ID NO: 1825 - DNA, 219 bp, Glycine max
  Peptide Sequence Number=SeqID_93510
atgacatccttcagccagatgcaatcccaacttcagtcacaaatgcaatcacaaggacttgcattgcctccggagcctgaggtgaaggttggtgttgaggaggttaaagatgcagaggttcccgttcctatacccactaacgaggttcaactaatggggcaggcactgaacaccttccttgcttggtcgacacatctcgtgaagcgtgtatcagaacag

SEQ ID NO: 1826 - DNA, 249 bp, Glycine max
  Peptide Sequence Number=SeqID_93511
gtagaaggacataaactgtacaggctcaaggttcaatcaaacaatcatactttcagctcaaactgggtgcaaaggataaatcattcatacacaagtaaagacgagataataataaaattgttcaaaaagtatggaaataaaaatcctgatcctgtcaatgatcctatgcatgctcattcaggtccagtgctggtgcagatgatggatcctaagaaagaggcaggtccaacactggtgcagatggcttag

SEQ ID NO: 1827 - DNA, 824 bp, Glycine max
  Peptide Sequence Number=SeqID_93512
atgggccacgacgagcacggcaacctatacgtcgcctcggaaatgaaagcactggtgccggtgtgccgcaccattaaggaattcccggccggcagctacctgtggagccaggatggtgagatccgcgaatactatcgccgtgactggttcgattacgacagcgtcaaagacaacgtgaccgacgccaccgccctgcgcaccgcgctggaagagtcggtgaaaagccacctgatgtccgacgtgccttacggcgtgctgctgtcgggcgggctggattcctcggtcatctcggcgatcaccaagaagtacgccgcgcgccgcgtggaagatcaggaacgcagcgaggcctggtggccacagctgcactccttcgccgtcggcctggaaggctcgccggatctgcgcgccgcgcaggaggtggccaaccatctgggcaccgtgcaccatgaaatccacttcaccgtgcaggaaggcctggacgccatccgcgacgtgatttaccacatcgaaacctacgacgtcaccaccatccgcgcctcgacgccgatgtacctgatgtcgcgcaaaatcaaggcgatgggcatcaagatggtgctttccggcgaaggcgcggacgaagtgttcggcggctacctgtacttccataaggcgccggacgcccgtgaattccacgaagagaccgtacgcaaactgctggcgctgcacatgttcgactgcgcgcgcgccaacaaggcgatgtccgcctggggcgtcgaagcccgcgtgccgttcctggacaagaaattcctcgacgtggcgatgcgcatcaacccgaaagataaaat

SEQ ID NO: 1828 - DNA, 711 bp, Glycine max
  Peptide Sequence Number=SeqID_93513
atgttggtgagctgcccctcctccgccccatacgtagaatcggcggaagaatcattggaaacgactttccaatccttcgaggtggtgagctgcgcctctgtggaaccaagtccgttgctaccttctctctccaacgcggccatgatggtggcgtgcgttatgctcaggaacggatttgagcccggaatgggtctaggcaaggacggcctcggaaatgccgacgtggtcgatatcaagggaaatccatacaaatatggattagggtatgaacccgggatgccggggaggaggaatgtgccgtcaagacttcgggcgaatagggaatggcccggccgtattagcgagtgtttcaccagtgccggaacggtgtccgaggaggaggtggccgcagtagaagaggagttccctcaagacccgccaagttttgtgcaaccatgccatcccgattctcaagtggggaactggcgcgtgataagccagtcggaggtctataccgctgattcaatatatgagggtcgattctttgaggatcctaacaacgagggtttgacaatcgatttcgatcaagatataagccaaacggtaaacgaggaagaggaagaggacgtcctttcaccagagttggagagggaccacggaggaaaagaaagaagtaaaggtaggaaccgatatgaccgcgcctatccgccaaggcttgataacccttcttga

SEQ ID NO: 1829 - DNA, 1449 bp, Glycine max
  Peptide Sequence Number=SeqID_93514
atgtcctcgcctttagaggactacatctcctcccctttagaggactacacgtcctcgccatcagagtgctgcacgccctcccctttagagggctgcacgccctcgcctttgaggactacacgtcctcgccatcagtggactatacgtcctcgctgtcagagggttgcacgtcctcgccttcatagggctacacgcctttaccttcagaggactatacgtcttcgccttcaaagggctacacgccctcatcttcagagggctacatgtcttcgccttcagagggctacacgccctcgctttcagaggactataagtcctcatcttcagaggactacatgtcctcaccttcagaggactacacgtcctcgccatcagaggactacacatcctcgccatcagagggctatacgccttcgcgttcagaggactccacgtcctcgccttcagaggactgcatgtccacgccttcagagggctacacgccttcgccttcagaggacaacacgtccaccccttttgaggactacacgtcctcgtaatcaaaggactacatggctacatgccctcgccttgaaagatcttcacgccatcgccttcagagggctacacgccttcgccttcagaggactctacatccttgcctttagaggactgcatgtcctcgcctttagaggactacatgtccacccctttagaggactacatgtcctcgccgttagagggctgcacgccctcgccttagaggactacacgtcctcgccttcagtgggctacacgccttcgccttcagaggactccacgtcctcgccttcagaggactgcatgtcctacccatcaaagggctacacaccctcgccttcagaggactatacgtcctcctcttcagaaggctacacgcctttgccttcggaggactacatgtcctcccctttacaggactacccgtcctcgccatcagatgactgcacaggactacccgtcctcaccttcagaggactgaatgtcctccttttgggagggctacacgcactcgccttcagaggactatatgtcctcctcttcagaggattacacgtcctccccttcagaggactacacatcctcaccatcaaaggacctcacgtcctcgccttcagagggatacacgtgctgaccttcataggactacacgtcctccccttcagagggctacacgccctcgccttcagaggactacacgtcctcaccatcagagggatacacagcctcaccttcagaaggatacacatcctcctgttcagaggactacacgtccacgctttcagagggctacacgccctcgccttcataggactacacgtcatcgccttcagagggttgcacgccctcgcctttgttgggcttcaccccctcgccttcataggactccacatctgcgccttcagagaactcgaggtcctccgcccttaa

SEQ ID NO: 1830 - DNA, 352 bp, Glycine max
  misc_feature (319)..(319): n is a, c, g, or t
  Peptide Sequence Number=SeqID_93515
tggacggtacatccacttggttgttcaaagagaacaagcaaagatccacaagggagggtacatctcttatggatcagttcaagtggacggtacatccacttggttgttcaaagagaacaagggagggtacatcccttgtggatctttgcttgtaaaggtttttacaaggttgaaagaaatcccaagaaccgcaggttgcttggggactggatgtaggcacgggccacttgatccaacacaaggcatccacctgatcaatctaggctttgattcaaccttcttcaacaggtgcctgaatgatagaggtggtagtcaccgnacgcttaaggcaatcaaaagcctctttgcaccg

SEQ ID NO: 1831 - DNA, 186 bp, Glycine max
  Peptide Sequence Number=SeqID_93516
atggagcttaagaaatctttacaggaacagctgtggacagcagctatagcttatgaatccatgatgaggcaagaatctagagtgaagtggataagagaaggggatacaaattcagcttattttcacagattgattaatcatagaaggaggctaaggagggatgaatggtctgatgagaaaagctaa

SEQ ID NO: 1832 - DNA, 519 bp, Glycine max
  Peptide Sequence Number=SeqID_93517
atggaggttgaggaaccttggttggggtggtgtttagcattggttgtgtggaaggtgggttttgtggttgatttagggatggcctttgtggataactgggtggtaggtaaggagaagggttgttattggctgagtaatgatgtttgttgggttggtgggaaacttggccgtataggaatggcagtcacaacatgtgtttctccctcatcctcgccctcttcattagcccaaggtccttccaagaatggactcaggaaggttcttacgttagtataccaggtgacagttgtcccagttagcaaaggcataatcttcacctccttcaatggccctaagcctttcctttcgatgatccaactctcccatttcagccatagcatgagggtttttacccggtgtggaatgcaaggggtgtggttgtgggtgatactgagggccctccaaagtgttttgcaggggtatatcaccaactgcttgcccttcagtggcatatccgaggcaaggctcgaagtcggctag

SEQ ID NO: 1833 - DNA, 138 bp, Glycine max
  Peptide Sequence Number=SeqID_93518
atgacgacgttagtctctgcgcgtcgatgggctttcttgcctctggttgacgaaaggcttgcttgcccctggttaacaaagggtgcagatgacgacgttagtctctacacgtcaacgggcttgtttgcccctggttga

SEQ ID NO: 1834 - DNA, 846 bp, Glycine max
  Peptide Sequence Number=SeqID_93519
atggacctcatcaaggctgctggactgctgaaaactgtcaccaagttgggagattgctatgaaagtctagtcagggaattcattgtcaacattccctctgacataacaaacagaaagagtgatgagtatcagaaagtgtttgtcagaggaaaatgtgttagattctcccctactgtaatcaacaaatacctgggcagaccaactgaaggagtggtggatattgctgtttctgagcatcaaattgccaaggaaatcattgccaaacaagtccagcattggccaaagaaagggaagctttctgcagggaagctaagtgtgaagtatgcaatcctgcataggattggcactgcaaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagaatcggctctgtccctgcattacaaactgtttgaggggacacatgtcccagacattgtctcgacatcagggaaagctgctgcttcaggtgctgtgtccaaggatgctttgattgctgaactcaaggacacatgcaaggtgctggaagcaaccatcaaagccaccacagagaagaaaatggagctggaacgcctgatcaaaagactctcagacagtggcattgatgatggagaagcagctgaggaagaagaagaagcagctgaggaagaagaagaagcagctgaggaagaagaagatgcagcagaggatacagagtcagatgatgatgattctgatgccaccccatga

SEQ ID NO: 1835 - DNA, 270 bp, Glycine max
  Peptide Sequence Number=SeqID_93520
atggagggctcattagcacaaaagggcatcctcaaaagtccagcactccttaagccacaaataaattccacctgtccaacaaacttgggcagggcagttttggtctggtgtacaagagactccaagctaagaatcatacacagagatttgaaggaaagtaatatcttgttagatgaagtgttgaatccaaaaataccagactttggtatggctagaatctttggaggaactgaagatcaggccaatactaacagggttgttggaacatag

SEQ ID NO: 1836 - DNA, 804 bp, Glycine max
  Peptide Sequence Number=SeqID_93521
atgagattgaatcaagcacccttgcttaagaaaaggttctatcacatcaaaattaaaagcctagaggttgctagtatgcaagaattggggcaattgatgggtcaactccaacgtcaagctttctgcaagacatacaaaaaaatatgggatctagctatgatagaagtctctattgaggccattgtagcccttacccagtattacgatcaaccgttaaggtgcttcaagtttggggactttcagctagtaccaaccgtggaagagtttgaagagatcttgggatgcccgctaggaggaagaaagccataccttttttctagaataccgaggaagcacttggaggagaaagcgaaggctttagcggatcaaggtaaatgggctttgttcattgacatcttggagctattggtatttcaagttgtcctctttccaaatgtggatgggctagtggacttagtggcgatcgatgccttccttgcttatcaccatagcaaggaaagtctgatcattgctattttggctgatgctatgacacatttgaccgaagatgcgaaaagagcggtgcaagaatcgtctgttgcacacctactctttatggatgactggtctctcacctctttcatcatgaaagtagacccatctgtcccctgcaaggtcaccacacatgcaccgagaaagggaaggccaattgggagcaactcttggctagtatggtggggacatccattaattggttcccccgatggaaggaaggaagagccagagtttcgtcctcatgcaaggggttctcaaacatccccttga

SEQ ID NO: 1837 - DNA, 702 bp, Glycine max
  Peptide Sequence Number=SeqID_93522
atggagggtgctaataccttcctcaagcgtaaatacaactcgcaaatctggaatatttttcatgaccggtttccttcggtttttctgaaaatttccacaaataaacgttggtggcgactccgcgcattttcctcctttggaagacgcacccgtgagcctcgcctcgcttgcccgcaaaagggtaggttgcgacaactggtcttggaggaaggccagcaatgcgagtttagccaggggaggagtcaggcctcgggctttgataaggaggctatcagccagttgctatgcatttcggggcaggactttgcccggaccgtagtgggtagaagggtgagtgtccatgtcgccctgctgatctctaatgctatttaccaatttgtagggattacgcctcccagacatccagtggacccagagaagtccaacagggccctgggattccctgctatgaccataggcctctgccagttctacggagtgccggtcacccccaacaagctcatccagcctcccatcaatagggctttcattgagaagtactgcatgcccaggcaggtgcagggtcaggtgccccagcagcagccagctgcagatgcgccaccatcgcctctagaggaggtaccatctctgaggtccatctctgatcacctgtggaggatagaactccagatgcacaggtacatgcagcacatgactagctag

SEQ ID NO: 1838 - DNA, 222 bp, Glycine max
  Peptide Sequence Number=SeqID_93523
atggctttgcagattgcggaggcgttgggatatggtgggtttgtcaggatgcttgttgatgctttgggacacgtggcagagggagaacacgttgaggagatgaagaagatgggatttggctctgaggctagatctctggcaacggtggttttggttgtggcgacagaggatcctgccaagagaaccatgatttccaccataacttgcgtgtcgtggttctag

SEQ ID NO: 1839 - DNA, 87 bp, Glycine max
  Peptide Sequence Number=SeqID_93524
atgaagggacgaaaggagcagagaaggtcacatgacagtgtctatcatgcagcacgtgctgctccaggtgggactgaactaagttga

SEQ ID NO: 1840 - DNA, 273 bp, Glycine max
  Peptide Sequence Number=SeqID_93525
atgtaccctcccttgttctctttgaacaacctagtggatgcaccctccactagaactgatccacaagagatgtaccctctcttgttcttagttacaacaaccccagtagatgtaccctctacttataccacaaaggatgtaccctccaatgtgttaagacaaagttctcaggcgggaaaagggagacacaaaagaattcaggcggttagtccttcgttcttttggaaaagggagaagaaagacacaaaaagaattcaggcagttagtccttag

SEQ ID NO: 1841 - DNA, 471 bp, Glycine max
  Peptide Sequence Number=SeqID_93526
atgcaggtactatgcataccggggcaagatttcacccgtgccgctgcaaatggacgagtgtggatcatgcgcaccaacatgaccactcttacacagatatggatgacgttgctacttagcaacattccgtccagcgaccgcaataccgatctccccctacagaagtatcagttgggatcgtgcccacaaggcacccagtggacccggagaagtccaacagggtcctggggttttcagctctggttacgggcctctgtcagtcctatagggtgcccatccccccagcaagggatcacgcccgtaagacacccagtgaacccggagaagtccaacagggtcctggggtttccagctctgattacgagcctctatcagttttacggagtgcctgtcacccctagcaaggtcattaagccctctattaaccagactttcatcaagaagtgttgcacccccagggatggccggtag

SEQ ID NO: 1842 - DNA, 105 bp, Glycine max
  Peptide Sequence Number=SeqID_93527
atgtcggtacggcacagaccaactgatacttccgcagggggagatcggcattacggtcactgggcagaacgttgcaaagtagcaacgtcatctatatctatgtga

SEQ ID NO: 1843 - DNA, 417 bp, Glycine max
  Peptide Sequence Number=SeqID_93528
atgaccactcttacacagatatggatgacgttgctacttagcaacatttcgtcctacgaccataatgccgatctccccctgcggaagcatcagttggatcgtgcccacaagacacccagtggactcggaggagtccaactgggccctagggtttctagctctggttatgggcctctgtcattcctaccggggatcgcgcccacaagacacccagtggacccggaggagtccaacagggccctggggtatccagctttggttatgggcctttgtcagttctacagagagcccgtcgcccccaacaaggtcattaggcccctattaatagggatttcatcgagaagtactgcgcccccaggtaggcgcagggcgaggcatcacagtagtgggcaacagcacacccgccaccatctctag

SEQ ID NO: 1844 - DNA, 531 bp, Glycine max
  Peptide Sequence Number=SeqID_93529
atgacggtgaaaacctctgacacatgcagctcccggagacggtcacagctgtctgtaagcggatgccgggagcagacaagcccgtcagggcgcgtcagcggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccgaaatcgggttttagcattctatttgctctcccttgaggagattccgctgtccttcgcttcgggggaaaggatgaggattcttttttataggccaaggttcaaaaaggtctaa

SEQ ID NO: 1845 - DNA, 411 bp, Glycine max
  Peptide Sequence Number=SeqID_93530
atgactagaggcaatccatctgacttacaaccctttgatcctgaaatagatagaacatttcatagattagttaggcatagtgtgcatcctactttcccagaacattttataccttttgagcattctgttactggtgagtctgtgcattctattattggtgattttgaacatcctgattttgagcattataattttgaacattttgagaacatggcacaatctccatcccgtgagaggactctaagggaaatggttgcacctgatttcacctgcgaaagcttgtgcatccaataccctaatgaggatgtcccatatgttcttaaaactggactgatccatttgcttccaaagtttcatggccttacaggtgaagacccgcacaaacatttgaaagaattccatattgtctga

SEQ ID NO: 1846 - DNA, 495 bp, Glycine max
  Peptide Sequence Number=SeqID_93531
tggctgctgccagtggcgataagtcgtgtcttaccgggttggactcaagacgatagttaccggattaaggctcagcgcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccaggcattaagcattaaacctactggcaaaactgtcacctaa

SEQ ID NO: 1847 - DNA, 209 bp, Glycine max
  Peptide Sequence Number=SeqID_93532
ttttccttcggtttttccgacgttttcctcaaataaacgttagtggcgactccgtgcgtattcctttcgtggaacacgcatcccgcgagtcacgcgtcgcccgcccgcaaaagggcacgttgcgacaccctctcataactaagctcacctccttgagaaacttccttgagaagctagagcttagctacacacacccatctaaaagctaa

SEQ ID NO: 1848 - DNA, 876 bp, Glycine max
  Peptide Sequence Number=SeqID_93533
atggttagtaccagaggattaggtcgtgacttaagtcacgttactggcagaggtgtgggcagaggagatcgtgatgatttcgatgatgctctgcagcatcgatggcctaccgcatccactcgcaggcaacgagtacctgtcactactgtgcataatgagccagtggtccctgtggcagaggctgacggagcttcgattgaggctaacgtatatgcggatgagccaatggcaggaggtgacgtacaggacactggggcagacatttctgcagacacaggtgcacaagctgctgaggatgagcctaagggattttcgggtggtccgagcgacccatccgtgttgatcgggtatgcggatcacattgcaggcaacatatggatgggagaggagcatcctgagttgaagttatcctctcatgggaggaaggtccatagtttaggtaggttcgtccctaccattgagggactagttgctgggacaggactaagtcctctgatcgcgtgtttgatagacactgacgatcggggacttttttcttcgtttgtcgagcgatggcatcgggagacttgtagtttccatctccctgtggggagtagatgcactggtgcatatgtggattgctacgaagaataccgtgaagagcatacgtacaccgacatacagggagcgcctggactgactctgaattccggatgtttgttggatcccatatggggagcaccgaccggttcgggacttccatatgatttcatgctattctggtctgttgcgttgggggcccgttgctgtgtactaccgactagagagggtcttgcgatagtttggattcacccagaccatttctgctctgcttgtcgattcatgggtgtcgtatga

SEQ ID NO: 1849 - DNA, 647 bp, Glycine max
  Peptide Sequence Number=SeqID_93534
atggatgatttaaccctgcgttattacgacgctgaaatgcgctacctgctggaagccggtgaagagtttgcccgtgctcaccccgagcaggcggcaatgctcaatctcgataaagcgggggcgcgcgacccgtacgtggagcggctgttcgagggctttgccttcctgatgggccggctgcgcgagaagctcgatgatgacttgcccgaattaaccgaagggctggtcagcctgctgtggccacattacctgcgtaccattccgtccatgtcggtggtcgagttcacccctgactggcgcgagatgaaagagccgatgcgcatcgtcaaaggtttcgaggtgaactcgcggccgatcggcgagaagggcacgcgctgccggtataccaccaccaaagagatgactcttcagccgttgtcgctggaacatgcccgtctgtcgactgaccctgacgggcgttcggttattactctgcgttttcactgcagtggcctggctgactggacgcgcatcgacctcagctgtattccgctgtatttcaacgccgacacgccgctggcctgtgccatgcatgaagccttcaccatgaatgtcgcccgcctgtggctgcgcctgccgggtgacatggacagaaagccgctcgacgg

SEQ ID NO: 1850 - DNA, 315 bp, Glycine max
  Peptide Sequence Number=SeqID_93535
atgggtgccaaatacctcgaagtggtcgaacgagggtcgcatcccaacaacggatggtccccggacgaaattaggacgctgaatgaccataatttgtctctgcattttgttggacacaatcgaacctgggtggcgagacacagaatgaccataatttgtctctgcgtgccactggacacgatcgcctctggatggcgaaaaggtgcgcggaatgaccataatttgtctccgcccacctctcgacttattctgaataacaaagggcgcaggatctgtctatgcgcatttatcactcgacttgcgaaatctgtataa

SEQ ID NO: 1851 - DNA, 267 bp, Glycine max
  Peptide Sequence Number=SeqID_93536
atggttaaggatgagtgtaaggagtgtatcctccaagagacacttgttagcactgccacacctcttgggcttgatattattcctcaagtaaatgagtcattggatgagggtttggttcgtaagagcttaaattcttgtgctttgttggtgcccaaaataggtgctgaggaaagaaccccagagtttcaagaacctctggatttaaggtcaaatccatttcaagggggatggaatgatgctatcctaccccccaagggcattggatag

SEQ ID NO: 1852 - DNA, 228 bp, Glycine max
  Peptide Sequence Number=SeqID_93537
atggggatcgcacccacaaagacacccagtggacctcaagaagtccaacagggtcctgggtttccagctctgattacgggcctctgtcagttctacagagtgcccgtacccccagcaagggcatcaggccccctactaatcgagctttcatcaagaagtactgcgcccccagacgggcgcagggcaagacaccacagtagcattgggatggctggcagcgggcaatag

SEQ ID NO: 1853 - DNA, 990 bp, Glycine max
  Peptide Sequence Number=SeqID_93538
atgaatccagcagcagaatacgtacaacgtctgaaaattgaacgacaggcggtagagacgctctatcaggccttcagcgacaacaaccccgatctggtcgatagcgtgctggctccgtcatgggaagacattccgctggcgccgggacaggcgcccgggccggaaggcatcaagccgatcattcgcatgctggcgcaggcttttccggacgtgcagatcgtggtgcatgacatgattcaggaacctggccgcatcgcggcgcgggcggaaatcagcggcacccatctcggcgaaattttcggtatcgcgccgactggacggccgtctgatcaccacctggcacatggaggattggtttggcctgttcctccagcttggccagtttccgccacaagcctgaatcagaccggagagttgataatgaaagcagcattgattgatacgtttggcaccgccgatgtgctgacgattggcgaacgtcaattacgcgccgccagtccggatgaggtgacggtgcaggttgaagcggcgagcgttaacccgctggatgtgaaaatcatctcagggcacatgcagcaggttttcccggtggacatgccttacgtgccgggcatggatttctgcggcgtgattacagcggttggcgatcacgtgagccatttaaacgcgggcgatcgcgtattcgggcgcacgccaccgggcgcaggcggggcttttgcacaaagcctggtgatcgccgccgatgacgtatgccttgtcccggcagcaatgagcgccgaacaggctgcggcgctgcctaccgcgtttgggctccgcgcagcaggcgctgttcgatgtgggccagctgcagcgcggcgagcgcgtgctgattcacgccgcagcggggggcgtcggcagcatggccgtccagctggcgcatcagcggcgcttatgtcatcgctacggcgtcggcgaaaaaccacgcgctgtgaccagtctgggcgccgatga

SEQ ID NO: 1854 - DNA, 279 bp, Glycine max
  Peptide Sequence Number=SeqID_93539
atgactaaagcaagtcaaaagggggtacggaaagaaaatgagggaggagcttgccacccagcttgcccaagcgagctaggttgcttcctccagaaggcaccgccttctgggggaacttcctggaaggccgaagtgggccagattgtgcaacagtactttcttttgacttccagcatgtcacggaacttcacggattgcctaacgatgggtgccaagtacctcgaagtggttaaacgagggttgcatcccaacaaacggatggtcctcggacgaaattag

SEQ ID NO: 1855 - DNA, 552 bp, Glycine max
  Peptide Sequence Number=SeqID_93540
atggaccatatcgtagccaaagtgctcatcgataatggttccagtttaaacgtgatgcctaagagcactttggagaaattaccattcaatgcttcccacttaaagccgagttcaatggtggttcgtgccttcgacggcacccgccgagagttgtctgttggggcgcctgtggatccactcagtaggagttgttccctcaacactccaccaaaagttgaaattcgtagtggaagggcatctggtcatcgtatcaggcgaggaagacatcttggtgagctgcccatcctctatgcttatgtggaagccgtagaggagtcattagaaaccgctttccagtattttgaggtggtaagcatttcctccgtggactccttctctgggcaagcttgcctgtccgatgcagcagtaatgatggcccgagttatgttggggaacggttacgaacccagaatgggcttaggcaaagacaacggcggcataactagcctgataaatgccaaaggaaatcgtgggaagtatggtttaggctataacccactcaggcggacatga

SEQ ID NO: 1856 - DNA, 332 bp, Glycine max
  Peptide Sequence Number=SeqID_93541
gcaggcgtagggtgacacacatcaggacgctggcgcaccgccaccacctcggcaggccgattcggctgggtcactgggcgtggaacggtatctacaccatttggttcgccagcaggcgaccaaccaccatcgacaagtgtagatacatgagtgtctctaccggttcagcctcagtcagcaggggcagggttccgccccttttgtatgccctaccccggagcagtttggggctaaggtcacatggcctggagactggcccgatgcctaggcaggggaggagcctgcagaatcccccggtgaggcggatgaatcccgtatggatgaggatatga

SEQ ID NO: 1857 - DNA, 426 bp, Glycine max
  Peptide Sequence Number=SeqID_93542
atgggaggaaaatgcgcggagtcgccaccaatgtttattcgaggaaaaagtcggaaaaaaccggaaaggtgtggtctacgaactttaatcgtgaaaggttcgggagttgtttttacgcatggggaagattcgatttcgggaacttaccggttgaagaccgaagaacaaacgaagaacggtgaagaatcttcacgaaatcgctcacaaaaacgtttcataagcgttacggaagcacctcagcttggatttttttcacggaaacaattttcctcactaatattgagagaatcctcaaatactagtgatgcaatcctccctaggaagggaccagtcactagagccatgagcaagaggatcgaagaggattgggctagagctgctgaagaaggccctagggttctcatgaacctcagggtagatttctga

SEQ ID NO: 1858 - DNA, 870 bp, Glycine max
  Peptide Sequence Number=SeqID_93543
atgtggagtcctgtatttctaaatggtcgccgcttgtcttctctcgagggaggacatgctataatacactggaaagagacgcagcattgctattccctagaagtggaaaccaaacgagcttgggattatgtgggagacaactatgttcatagacttattcaatccaaaactgatgggaagttggttgagctgaacactcagtgtgcacatgcagacaatggatgtggaagttgcagtagtgaagataatgccatgaatgaggctatacttaatagcaaacttgaagctgctatcagtcttaaacaccagaagattcagtccaagattgacagatgtaagaaagacaagaaatttctggatgatcttaataagaatcttgtgaaaaatgaggacatttggaaaacaaagatacttaggattgaagagaggaatgcttttttccgtcatgaggcttactatagtgatatttgtgttggagcaattgcatgccggctggagaagaaggaaggtggggggcaagttcgggtttacatcatgacgttaggtgttttggcaccttaccgtggacttggtattgctcttaactttgggaaagcagcaagtgaagagattcaggttctccaagagcaaatgaaacaagcacatgcttctaagatggattcaatcaagcagctttcatttgagacagaaaccgcaagaagtgaagaggaagaaatgacatccaaaacacaagagctgaagcaagaagctgaaaaatccaaagcaatggaaaaagaactagagaagaaactagagctttacctaaagcaagctgagggtgcaaaagcatcaaaacaaagagccattgagaagatgaagatgaacacatga

SEQ ID NO: 1859 - DNA, 909 bp, Glycine max
  Peptide Sequence Number=SeqID_93544
cttgggaggattgatggggacccggcgttgagaggaacgaggataagggctacgtgggagtacgtgagctcagttggaggtgagcaacaggagatgggtgagacttcctgcttttattcgttgaccacagagtggtacctggagatatgtcgcaggggtcaggagaccttggggatgccagcgagctcctggcagtcaacagataaaaagaacaaagaccacaaagcaagggggcttgtgtggtggctggccagcaatgaatcaggagtgagatttgggatatggcctctggtaatcgattaccaagggcttagaaaggagactggaatgttgaaggggcctctggtaatcgattaccaatgctgtgtaatcgattacacagaggagcaggccactgggcatttttgcaggtttcatgtcctgaggctgtgtaattcgagtttggcctctgagatgaaaagccttgagatacctcttttacttatcatgatggcggcgcaactaatccatgatcgagtggagatggagtgcctagagggagcttgggggaccctcgaaggcaacacgaggtgccaatttcggggcacgattcgattcacggttacttcattggtgcatccagaggaacccgcgcgcacgcttcagcgcactgtggagtggatattacccacgcctacaccatatcgtctagtggagccagtccaagtgatcgaggtgacgtcatccgaggaagaccctgaggagctacctcctgagcctgctgtagatgctcttgactttctagagggtgatgaggacccactccctgaggtggattctcccgaggacatcatgtcggcatctgaggcagactctacggaggagagcggccctggagagatggcgactagtggatgctcttcatcatag

SEQ ID NO: 1860 - DNA, 504 bp, Glycine max
  Peptide Sequence Number=SeqID_93545
atggctactactggatgtgatcgatttcaaaaccctttcaaccacaatctttgtttgcttcaccttgaatgtttcttgaagcaatcttgtttgattatactttggcatcatcaaaaacctatattcatacattcacagattggtgaaaaaggagattgggcttttgagcttcaaggtcataaagattttgtatcaagtttagattttaactatgatggacagtttcttgcatcagggtgcttccatggaattgttcaagtctgggatgcatctagaaatctgaaaaatgtatttgaaggtcttggagggggcattgagggtcatggatatcaaactaagggattaacatgcttagcaataagttcaaattcaactcttgctcttactagttccgaggatggatcttcatatattgtgaagatcgatggaggaaaaataacttccactaagaaaaatggtgctcaactccttacactggagagacgtcttctagaatctaactag

SEQ ID NO: 1861 - DNA, 177 bp, Glycine max
  Peptide Sequence Number=SeqID_93546
atggagtcaccaactatcgcaatctacccttcggcgggagggcgatgcgagactaacgggtgcgtcttccatgggaggaaaatgcgcggagttaccaccaacgtttattccaggaaaacgtcggaaaaaactggaaagggtgtttcccttgctcctacgtatcctcaattgcgatga

SEQ ID NO: 1862 - DNA, 114 bp, Glycine max
  Peptide Sequence Number=SeqID_93547
atggtggcccgggtgatgttggggcatggctacgagcccggaaatgggtttgggcaagaacaacggcggcaggaccagcctggtaagaaccagaggaaactgcgggaagtttgg

SEQ ID NO: 1863 - DNA, 369 bp, Glycine max
  Peptide Sequence Number=SeqID_93548
atggctccaaagaaactcttcacgaagaggtctagaaaggacgccactggagaaggctctagtgctgcctcagagtttgatagtcaccggttccaaagtgccgagcatcagcagcgcttcgaggccatcaagggatggtcattccacagggagaggcgtgtccagctcagggaagacgagtaccccgacttccagggagagatagctcgcaggcattgggcacggttagtgacccctatggctaaattcgacccggagatagtcatagaattttatgccaatgcctggcccactaaggagggggtccgggacatgcgctcatgggtgaggggtcactggatcccctttgatgcagatgccatcagctag

SEQ ID NO: 1864 - DNA, 373 bp, Glycine max
  Peptide Sequence Number=SeqID_93549
gcaggcacagggtgatgcacatcaggccgcaggcgcaccaccaccacctcggcaggccgatccagctgggccactaggcgtggagcgttatctagagcatttggtttgccagcaggcagccaaccaccgtgggcaggtgcagatacatgagtgtctctaccggttcagcctcagtcagcacgagcagggttccgcccgttttgtatgccctaccccggagcagtttggggctgaggtcgcatggcctggagactggcccgatgcccaggcaggggaggagcctacaggatcccccggtgaggcacatgaatcctgtatggatgaagatatgactgacctgctcggtttcttgggagggagcggagccgcgtga

SEQ ID NO: 1865 - DNA, 92 bp, Glycine max
  Peptide Sequence Number=SeqID_93550
tgagtaagagcttgggttcacgaagaacagtggcgaagttcggaaatgcggtgaggttgatgatgaaaggaataacgagtatctggaaatag

SEQ ID NO: 1866 - DNA, 572 bp, Glycine max
  Peptide Sequence Number=SeqID_93551
gcccgtctgttcgctacaaggtcaccgctcgtgcgctgagaaaggaaaggcaaattggaaccaattctttgctagcatggagggggcgtccattgattggttccctcactggaaggaaggaagaaccgatattttgttctcacaacttgcctctcatcgcatggggttttggtgaccccaacgcaaggatacttcaaggagttcacaaggcatgggatgcagtgcaaaggaaggacaaagagcttaggggaagtagtaatgggatcatcgggggctatcgtcagtggctgagagtccgcacacaaggcttggattggctcccaaagctaagggctgcaagagaggaagaggccgaagctccgaaagaaagtgaggaggtacaagccctaatggcggaacttgagaaagcccaagcagtcaaggagaagttcaagtcaacaaccatcaaagtccgaagggagtatgatgaactgaaggacatcaacatggacaccgctgaagccttggaacgggaaaccaagagggccctgaaggaagaagacggccgaaccaagttccgaggagctctatag

SEQ ID NO: 1867 - DNA, 171 bp, Glycine max
  Peptide Sequence Number=SeqID_93552
atgctccacccatatgagatccagcataggcttaaaggagccacttcaaacccggtgacccccaaggcctacacttcgaagagttcgtcagggcctctccctcctgattcagcttttcaaatatgggttataaaggtcaattcactttacttctacatcatattcaagtaa

SEQ ID NO: 1868 - DNA, 393 bp, Glycine max
  Peptide Sequence Number=SeqID_93553
atgccaatctcccctgcagatgtatcagttggtctgtgtcgtcatgacatagggatcgcgcccacaagacacccagtagacccgaagaagtccagcagggccctggggtttccagctctggttacaggcctctttcagtcctaccgggtgcccatccccccagcgaggtcatgccatcgtgacataggaatcacacccacaaagacacttagtggacctggagaagtccaacagggccctggggtttccagctctgggattgcgcctgcaagacacccagtggacccgaagaagtccaacagggtcttggagttgtcaagctctaattacgggtctctgtcagttctacggagtgcttgtcacctccggcaagggcatcaggccccctactaa

SEQ ID NO: 1869 - DNA, 774 bp, Glycine max
  Peptide Sequence Number=SeqID_93554
atgggtacctcaaagccttacactggggcaatgaggggcatcgtgcatgagcctcaaggtggacccttgggtactagtacactcgcctttagaggactactcgtcctcgccatcaaaggactacacgtcctcgccatcaaaggactacacgtccttacctttagagggctgcacgccctcgccttcagaggactacacgtcctcgccatcagagggctacacgccctcgccatcagaggactattcgtcctctccttcagagggctacccgccctcgcctttagagaactgcacgtcctcgccttcagaggacaacacgccctcgccttcagaggactacacatcctccccttcagagggctgctcgcgcttgccttcagtggattactcgtcctcgccttcagagggctacacgtcctcgcctttagagagctacatgccctcgccttcagaggactactcgtcctctccatcagagggctacacgtccccaccttgagagggctacacgccctcgccttcagaagactacatgtcctcaccttcagaggactacacgtcctcgccttcagaggactacacatcctaaccttcacagggttacgcgccctgacctttggaggactacaagtcctcggcttcagagggctgcacgccctaaccttcagaaggctacaggccctcaccttcagagggctacatgccctcaccttcagaggactacacgtcctcgccttcagagggctacacgcccttgccttcagaggactacaa

SEQ ID NO: 1870 - DNA, 186 bp, Glycine max
  Peptide Sequence Number=SeqID_93555
atgggacaccttagtgatcaatgggttcccacggaccctaagagaataaaggtcattcctgattggcccactccaccaagtgtcgagggaaggagcccagagtttgaagaacctctggatttgaggtcaaatccttttcaagatggaggggatgatgcaatcctatcccccaagggtattggatag

SEQ ID NO: 1871 - DNA, 432 bp, Glycine max
  Peptide Sequence Number=SeqID_93556
atggttgaatcgaaaagacttaactacatcaggaacaaccaaaagaaactcagagttgacaagtattgtagcttacaaaattcactggatgctgggacaaaccaaggattaaataaaggcaagagagtaatttttccttctacctttgttggcaacccgcactacatggatcagctatattttgatggtatggcgatatgcagccacgctggtttcccaaatctttttatcactttaacatgtaatccaaattggcctgaaatccatagattagttgcgccattgaatttgaaaccagcagatagactagacattatctcacgagttttcaagttgaaatatgaagaaatgctttcagacctaacaaagaatcacctactcggaaaagcagtggcatacaataaatatccaacttcaaatgaaattgactag

SEQ ID NO: 1872 - DNA, 393 bp, Glycine max
  Peptide Sequence Number=SeqID_93557
atgctagtaggagtgcagttggtattggaggtagcagctggagttccacggtcgtattcatcgaattcctgcagcccgggggatccactagttctagagcggccgccaccgcgggggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcggggaccgctacacttgccagcgctga

SEQ ID NO: 1873 - DNA, 438 bp, Glycine max
  Peptide Sequence Number=SeqID_93558
atgacaacagaggatgtgcactgcgctattatgggacacagacaacacacagagtggagacagggaaggaggaggtgtggcgacatatccgtatctggtggggttatagaagaaatgaaaacccaatataccggaacacacatcgattggtggctactaactactagtgctttttccccaacctctctctcgttgctcaggttgctgtgtgctccatttgccagagctagaccggtaactcagactcatgctgctagtgcatttgctgcttcttcctctctctgtatctcccccgtggtagagtgttcactagcttccgataatatagtatggtgtatgagtgctttgcttatcccacctcgtcgactaacatccaacctctcgactgctttctctctccactgcaagctagcctgtgctggtgttgtaagggtgtga

SEQ ID NO: 1874 - DNA, 456 bp, Glycine max
  Peptide Sequence Number=SeqID_93559
atgtcctttgacggttttcttttatatatagggagtgagagtttggttttatatccgttagcattggaggaggcacttgagaaactgaaggaggctctccaaatcttgaattctccttccccttcttccccagctggattccttaggtttcaggtggcgctccctcccagtcctaagaccttcactttgttttgctcccaaccccactcctcctcggtctttcctctcatttatgtttccaagaacgacgccgactctaaatcactctatgtcaatttggatgataatgtgagtcaccagaaagaaagccgctcccagattgagttagatgagctggaaagtgtttccattctgtcaatgacccttgcatgggatgaattttccttctctacttttcaagaagcccattattcgcttcaagattctctagaccaggtgcctgacatgcctttttga

SEQ ID NO: 1875 - DNA, 213 bp, Glycine max
  Peptide Sequence Number=SeqID_93560
atgaggaagatattgctagttgaggtccttgacactgttttcccgacctcaatgactcgaccatctaaggttgggatgattcctccacccgagattgtacctgttgctggagagcataagcttcaggttgttcaattgcttcagattgctgcacagaagggcaaaggtctgtgtggtggtcggcagaggagcataaaccacagagtctggtga

SEQ ID NO: 1876 - DNA, 338 bp, Glycine max
  Peptide Sequence Number=SeqID_93561
gaccttattgaagctcaaagatccagtttccatagaagattctcaagcaagcttccatcaagaagtattagagcacaagagcttcaaggtgagcttagctattgtgaagaaattagtgactattatggaggaaggcataggtcacatcctagacctcactctcataggagagaaaaggaaagaaagcctcaagaggttaacactaacctcccatacttccatgggaaggacaatgcagaggcttatttagattgggaaatgaacgttgagcaactctttgcttgtcatcatacaagtgaggaaaggaaggtttctttggctacccttagcttccaagg

SEQ ID NO: 1877 - DNA, 360 bp, Glycine max
  Peptide Sequence Number=SeqID_93562
atgggttacgacatcgacatcgtcggcgtgccgaccgtgcgcgccaaagacggcctggccctcagctcgcgcaacggctacctgaccgccgaagagcgcaaggtagccccgcagctgagcaaaatcatgaatgggctggcgcagcagttggccaatggcgagcgccatatcgaaacgctgctggaacagaccgccgagcagctgcgcgccgccggctttacgccggatgaactgtttattcgcgacgccgacagcctgcagccgctgacggtggacagccaacgggcggtggtgctgatggccgcctggctgggcaaggcgcgtcttatcgacaaccagcaggtcgacctgacgctgtaa

SEQ ID NO: 1878 - DNA, 2309 bp, Glycine max
  Peptide Sequence Number=SeqID_93563
atggatggtgaagaagtgatgatccgcgccaatcagctggagttcgagggcgatgaaatggaagaggggatgaattactacgacgaagaaagcctctcattctgcggcgttgaggacttcctgctgatcggtgatctgcttgcgttcggcggcgctcagcgcctctggttccgcgttgaacaggtagtgcttcagatcgaaatctttcagcaacatcttggtatggaagatattttcctggtaaacgttcacgtccatcatgtgatacagcgccttgatgtcttccgacataaagttctggatcgaattgatctcatgatcgatgtaatgtttcacgccgttcacgtcgcgggtaaaaccgcgcacgcgatagtccatggtgacgatgtcggattccagctgcccgccttccggatggctttccgggtaggtgtgtacgcagatatggctcttgtccaggtgcgcaacgaccgtgttcggcagcgggccgggatgctccgacgtatcgacgtctttcggatcgatcggctcttcgctgaccaggatggtgacgctggcgccctgcggctcgtagtcctgacgcgcgatgttcagaatattggcgccgatgatcgagcaggtttcgctcaggatctcggtcagccggttggcgttatactgttcgtcaatgtaggcgatatagccgtcgcggtcgtccgcggtcttggcgtaacaaatatcgtaaatacaaaaactcaggctcttggtcagggcattgagcaaatattgcggcagggcaaaactgccgacgtgaattgccggagtaggcagatcgcgctggcgcagcgccgggttttggctcgcccaggcaaaggtcatgatgccgccgtaataggttgggatcgccgcctgatagaagctgacgtcggtaaagtagcggctcagtttggcgtggctgttgaccgcctcgtcctgttgcaggaagcagacgccgttctgcgcgacgaaaatgccgccctcattcaggcagcgggcgcagccttcataaaacgccgaagtgaacaggctttcgccggggccgatcggatcggtgcagtcggagatgatcacatcgaaggtttcgtcggtttggttcacgaagttgacgccgtcgtcgatcaccagcttgaagcgcggatcgtcataggcgccggcgctgtggttgggcaggtactggcggcagaactcgacgacaccggcgtcgatctcgaccatggtgatctgctccacgccagggtgccggctgacttcgcgcagcatgccgccgtcgccgccgccgatgatcagcactttcttcgccgcgccgtgcgccagcagcggcacgtgggtcagcatttcgtgatagatgaactcgtcacgctcggtggtttgcaccacgccgtcgagcgccatcacgcgccccagcaccgggttctcgaagatcaccagatcctggtgatcggtcttctcgcggtacagcaccttctctaccgagaaatactggccgaagcccgtatgcagcgtttcgtaccaaatttctttctgggtcatgggaaggaattagttggcgtaggccagcaggctcaaagagtcgcgcgccagcgatttgcacttcttgggcgttggaatggcgatgccgctcagatcgcgatagctgtcttcgcccagcgccttcatattgaagctgttgtagttgctcaaatcccagcggttttgttgcgcgaaatagacgatggcgcgtttgatttgcgcgcctgtttgtcgtttgctgacgttaccacacttgcctgtaaaggcaccaaattttattgctgccgggccggcgttgcgtttgccagccatattctcttgattgtgaggcatagcttaaaataccgccaggaaaggcttgaccttccgccagggggaaggtttaggctggcggcattgagttatgtcactgagaaaagggagtcagcgatgttacgccgtgattttattaaattaaccgccgcactgggcgctgcgagcacattgccgttatggagccgggccgcctgggccgcctgggcggccgatcggccggctctgccggtgccgccgcgggggaaacccgctgggttgcccggcgccgccaccaaaacctggggattcaacggcgcgctgctcggggccggcggtgcagctgcagcgtggccagccggtgacggtcgatatcaaaaacggccttggcggaggccagcacccgtccactggcacggcctggaaattccccggcgacgtcgaatggcggccccgcaggccattgatccatcccggcgcggacgcgcccg

SEQ ID NO: 1879 - DNA, 366 bp, Glycine max
  Peptide Sequence Number=SeqID_93564
atgggaaactgcttgaagaaccaatcacccacaaagtacgatggtggtagcgacgatgacaacgacgattgggattttctgacaggtgaggaggggtcttttgtcaccaccaaggccgccaccgctgccaaaacggtgacggaggtgaagatcaagatcacgaagaagcagctagaggagttgttgagcaaagtggacgtgagggagttgagggtggagcaggttttgtcccagttgatgaaccatagtagtggagggttccaatcatttcaaagaccatggaggcctgcacttcagagcatccctgagtgcatgatggagttgatgatgatgaaaaagagaattggcctacttggtcaatcctga

SEQ ID NO: 1880 - DNA, 579 bp, Glycine max
  Peptide Sequence Number=SeqID_93565
atggatcaattacgtaataatgtgaatgctaggtcgttgcccggaagcaacgcgctgtatggctcgagtacagtgtcaaaagagcaagggtcgctgcatcgccgcccagatgtagtgaaaagtaagcaagggttcccacattttcgtgaacgggtgtgggtaaagaagctagttcatgacaggaggattcgctttggtacatggaatataggcacacttactggaaaatctatggaaatagtggatgttatggtgaggaggaagatcaattttatgtgcctacaagaaactaagtggacaggtgaaaaagcgaaagaattagacaactcgggatttaagctgtggtatacgggaaaaatcagatcaagaaatggggtagggattattgtggacaaggagtggaagaaggatgtcgtggatgtaagaagagtaggagatcgtatcatagccttaaaattggtagtgggacaggacacctttaatgttattagtgggtacgcacctcaggttgggttagcagaacactttaaggtagcgtggctagaggttttgagggggtgcatgggggttttggcctag

SEQ ID NO: 1881 - DNA, 225 bp, Glycine max
  Peptide Sequence Number=SeqID_93566
atgtcttccaaggttattttgatgatgccaaagaatcaagagttaagcaaattccaaagattcaagaatgaagtttcaagaatcaagattcaagattcaagaatcaagtttcaagaatcaagattcaagaataatcaagatcaagattcaagacttaagattcaagaatcaagagaagactcaatcaagataagtattaaattttttttcaaaaacattgagtag

SEQ ID NO: 1882 - DNA, 108 bp, Glycine max
  Peptide Sequence Number=SeqID_93567
atggcagaaatcaaccaagggacggatacgagtggggctagggtcacgaccgaccgatcgttgccccttcccggtgctaaacaagcagagaacgtcgctgcagggtag

SEQ ID NO: 1883 - DNA, 546 bp, Glycine max
  Peptide Sequence Number=SeqID_93568
atggtttgcaccaaccaagcggatatgaccggaaggctgcttgccggttcattggctcttgaaagccgcatccttcattatctaattgttcgtatcctactccctagatcttcaaaccttgcacaggcattgcgattaaatgctcctttaccctatccacacttagttactttgttccttcaacattttaacatccctcttgattctgaaccatatgttccaatcaagagatctttcttgatcggtgctgttgtggttgcgtcctttggttaccgcaaagagcgtgatgactcttgggtaaaaaagggtgttcaaccaaatgatgatgaaggacacttaccggttgaaagggactcttctctccttcagagtattttggacaagtttaatggacttcaaacctatgttggtgagaggtttgactccttggaacatcaagtggacacacgattcgaggagatgaactcaaggattgcaaaggttgaagaagatgtcaccatcattcgcgactgccttgatttacctccaccaccaccattagtttag

SEQ ID NO: 1884 - DNA, 363 bp, Glycine max
  Peptide Sequence Number=SeqID_93569
atggagcagaagacagctagctttggcctacttttactaaggggacacaagacaaagatggtattcatgtcgggaggacgccggaggaaggacagtgtgtatcccgaggctcaatggctttgctctgctccccctcagcttgttctaaccattagcttgaggtgtatcatggagctcacatctatttatatgaagtgtttccagacaatgctttacatgtgtcctcaaacattaattggccctcgagtggcacacgtcattagacgcggtgtaccacctggtttgtcgccggacttggtcatgacttgtcgaccattagagacgagccagtacttgatgagaaggacgttggagatgaattag

SEQ ID NO: 1885 - DNA, 78 bp, Glycine max
  Peptide Sequence Number=SeqID_93570
atgaagttggggagccttgacgatggggtgctaggtgtggaacctatggttaggaaaagagaggttggagagaaataa

SEQ ID NO: 1886 - DNA, 546 bp, Glycine max
  Peptide Sequence Number=SeqID_93571
atgggagagttgatttgcgccatcgcccgatcgccacctagtaccacatatgacggagtggtacctggagatatgtcgcgggggtcaggagaccttggggacgtcaggtggggtgctattgcccaaaaccaagcttggctaatcccgacccaacctgggcatagtcagtcatatgatagggcactggtaatcgattaccagttgtgtgtaatcgattacatagtgttacctgctactgtacatccggaggaacccgcacacacacttcagcagcctgtggagtggatactacctacacctactccatatcgactagttgagccggttcaagtaatagaggtgtcatcctctgaagaagatcgtgaagaggatccagaggaattacctcctgaacctgctatggacgcccttgacttacctgaggatgatgaagacccactccctgatgttgattctccagaggatattatgtcagcatttgaggcagactctacagaggagaatggccctagagggacagcgaatagtgacaactcttcatcatag

SEQ ID NO: 1887 - DNA, 165 bp, Glycine max
  Peptide Sequence Number=SeqID_93572
atggcacgcaaaccgaggcaggattttagcgtttcaaagctttctctctccctcacgttgcctttcttcctccctcattctccattgaagctccacacaaagcttcaacctttggccatcatttttgccccaaatcgtgaaaggagagcattttcggggtcgtga

SEQ ID NO: 1888 - DNA, 474 bp, Glycine max
  Peptide Sequence Number=SeqID_93573
atggagattattatttctattccacaaataaattgtgatttttttcgaagagagcattacaaggacaatttttatctctattccacgaataattctaggtggagacatgagtttaatccttacaatcattatgaagaagaaagagctcctgatctcgaaagtgtgtctgaagaattcatggcatatcatgctagctcaaaagctaatcaaaattcaatacaaaatcatgagattcattttggcaagagctattctttagaagattatcaaagggaactggagttacaaacctactttcaaaaggaggcagaaagaggtttcaatttggacaatttgttgatgcaattcaaggatacaattgaatcaattcaacgagcatttaaaagtatagaaattcaggttggtaagctagtagaagaagtgactcaagctgtgggcagaagagaagaagaatttgtaaaggttgaagcttaa

SEQ ID NO: 1889 - DNA, 156 bp, Glycine max
  Peptide Sequence Number=SeqID_93574
atgtatatagatggcatgaaatttccttttcaaatgcaagaaatggctctgaggaagctttcctcgaagagatctaggaaggacgccgcggctgaagggactagtgccgctcccgagttcgatagccatcgtttcaggagcgctgaacaccagtag

SEQ ID NO: 1890 - DNA, 246 bp, Glycine max
  Peptide Sequence Number=SeqID_93575
atgagggacactatgcatgagcctcaaccgaacctagggggggggacaaaccctggtgtcgcaacctacccttcggcgggagggcgacgcgggactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 1891 - DNA, 270 bp, Glycine max
  Peptide Sequence Number=SeqID_93576
atgaaagttatgccaagcaagcccacaagaaaaggaatgaagtggtacttgaacccgacttatcaaggtaatccttgtggcgtctaccctgacttatcttccttcactgaaagtggcgtctaccctgacctatcttccttcaccggaagtggcgtctaccgtgacttatcttcttttaccggaagtagcgtctaccctgacttatcttccttcatcggaagtggtgacatccaaaccttcgtagtctgtatcaaacgatccgccccgtaa

SEQ ID NO: 1892 - DNA, 1276 bp, Glycine max
  Peptide Sequence Number=SeqID_93577
cgcagttaagacggacctcaatggaaaagtcattactaatgacgatgataaagagattcctggcgctgttaacacattaatttttacaatagcccaacatttcattggagacccatccttgtggaaagataggtcagcagaattattatcaaatcttaagtgtagaaccttggcggattttaggtggtatagagatactttcccaactagggtttacacaagagaagatagtcaacaacctttatggaaagaaaaatttatagccggtcttcccagatcattaggagacaaggttagagataaaattcgtagtcaatctgccaatggagacattccatatgaaaacttaagctatggtcaattaatttcctatgtccaaaaggtagccttaaaattctgccaggacgacaaaattcagaggcaattagccaaagaaaaagctcaaacaaagagggatttaggttccttctgtgaacaatttggcttaccagcctgtccaaaacaaaagaagaaacaaacctctaggaaagaaacccaggatcataagccagccaatagaagaagattttcaaaaagaagatactcacataaaccatcaaccagtagagaaatggaaaatcctaaaaaaacaaaaaaaataacgtgctacaattgtggaaaacaaggccacatcagcaaatattgtagactaaaaaagaagttaagaaaccttaacctagaacccgcaattgaagagcaaataaataatttgcttaaagaaacctcggaggaagaaacagaaacttcatcctccgtgctttccgatgaaaacctaaacctaatccaacaagatgaccaactatcatcaacagataatgatgatgggcaaatcaatactctaacgagagaacaagatctcttgtttgaagcaatcaattccatacctgatccccaggaaaagaaagttttcctggaaaagctcaagaaaacattagaggtaaaacctagacaaaaggattttatcacaaacaacaaatttgatgtaagtaacatactcaagagattagaaaattcctcaaccaaaccaacgacaatccaagatctccaaacagagataaaaaatctaaaaagagaggtaaaagaacttcgtcaacaacaagaaattcatcacatcattctttctcagcttgaggaagatagtgattctgaaagtaccaacaacagtgaagaaaaccaaccagaaaatttagaagatgatatttttagaaacaatggccctattgaacacaggggctga

SEQ ID NO: 1893 - DNA, 270 bp, Glycine max
  Peptide Sequence Number=SeqID_93578
atgcacgagacatcggggtttttcagtccaggagacaacatagaacacaagaatgctgatatccctatgatatgtttctacaatctgaccattgggatcttggaaataataacttttggtctcccgctaagcaagaaaggcgcgctaagcgcaattccaactgagaggaattgcgctgagcggcccaaagctacgctaagcccatttccaaccgagaggaagtgcactgagcacccagaaggcccgctaagcgaaagttgcaggttataa

SEQ ID NO: 1894 - DNA, 309 bp, Glycine max
  Peptide Sequence Number=SeqID_93579
atggaaaaatctgaaaagaaaaatcatagtgagaagaaactaaagaaagcatacatcacatgggatgaaaatgatttggaatcctctgatgattctgaaaatgaagagataaatctttgccttatggcaaaaagttacgaaagtgatgaagaggtatctttgagaaagaagtggtacatagatagcggatgctcaaaacatatgactggagatgcatcaaattttacacacatatctccaaagaaaagcgggcatgccttaagcacagcctgcttagcgttagtcaactatgtgacaaaggctatctag

SEQ ID NO: 1895 - DNA, 982 bp, Glycine max
  misc_feature (974)..(974): n is a, c, g, or t
  Peptide Sequence Number=SeqID_93580
atgcagatcgtgaccagcgccacgccggacaccgtcgccatctgcttaatcgttaacgaacgcctgacccgcaaacctgctctccgtgaaatcgggctgaaacaaaaaagtggggcggactctcacccgccccctcgaaccgggctgattatactcgatcatcggctgtttttatctggctatgccgcaggcaaaaccaagaaaatcgcgggtttcagtcttttcctaaagcgaacaaacgcgacccggacacaggtcggcgtaaggcgtcagcggctgcggcggcaaatcgagatccccctgccagccggccagggaatagcgcagataaatcaacgcgtggctcggcgtatagtccttcgcctgttgaatgtcgataccggcgccgagcgtccagtgcgaactgagacggcgttcgacgatcgcccgcagcgtataaccgacgccgctcgaggagctgccgtcctcgacggcgaacttatcgggcaacgaatccgggatcagcccctgcagcggatagcggcgctggctgtcggttttcgaatgggacagcgaaaccgaaccgcccagctcccacgaccagttctcggtgcgttggcgatagttgaccggcagcgacagcgacagatattgctgcgggctgtaatagccgccctgccccagcgaatagccgctcaaatccttctggtagtgccacagcatggtattgagcccgacgctcagacggcgattgtcttcgttgatcagcttgtagtagtagccggccatcaaccgctgccgctggttatccgccacgttctggccggtaatctggtgcgcgctgagatcggcccacacgccgttcgcctcgccgcgatcgtagctggcgctcaggctgacgccggtagcgcgcacgccgccccaggtgatgccggtgttcggatcgttggcgccgccgaacgccagcagcgagctggagatcggccgccgcgagnccgccagc

SEQ ID NO: 1896 - DNA, 84 bp, Glycine max
  Peptide Sequence Number=SeqID_93581
atgtcggcaggaataaagatgaactgggtattgtcagcagccaaagttgccaaaaagatgaagctaaaatttactaaagaatga

SEQ ID NO: 1897 - DNA, 493 bp, Glycine max
  Peptide Sequence Number=SeqID_93582
ggatcgggttaaattcctgaatcgggacgtggcggctgacggcaacgttagggagtccggagacgtcggcgggggccccggaaagagttatcttttctgtttaacagcctgcccaccctggaaacggctcagccggaggaccgagtgcctcccacgcccggtcgtactcataaccgcatcaggtctccaaggtgaacagcctctggtcgatggaacaattcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 1898 - DNA, 372 bp, Glycine max
  Peptide Sequence Number=SeqID_93583
gtgcagaagactgtgtcagcccctgcatgctatcaagcgttctgtcttacagatagcaaaagaatgggtgcgaataaccataaggtatctccgcgtatcatgggtatctccgcgtatcatgggtgcagaatgaccaaacttggtctctgcttgtcatcgggcccgccgcctctggatgacaaaaggggtgcggataaccgtaaggtatctccgcgtatcatgggtatctccgcgtatcatgggtgcagaatgaccaaacttggtctctgcttgtcatcgggcccgccgcctctggatgacaaaaggggtgcgaataaccataagggtgcgaataaccataaggtatctccgcgtatcatgggtgcagaatga

SEQ ID NO: 1899 - DNA, 267 bp, Glycine max
  Peptide Sequence Number=SeqID_93584
atgttgctaagtagcaatgtcatctatatctgtgtaagagtggtcatgttggtgcgcatgatccgcactcgtctctttgcagcggcacggatatggggccccctgagagcgaggacgcgtagtcctctaaaggcgagggcgtgtagccctctgaagttcaggacgtgtcgccttttgaaggcgagggagtgtagtcctatgattgcaaggacgtgcaatcctctaaaggtgagggcatgtccccctttgaaaatggggaacatgtag

SEQ ID NO: 1900 - DNA, 165 bp, Glycine max
  Peptide Sequence Number=SeqID_93585
atggtgccaaaaacttgttcgcaaccggcaagtgtaccggatcgtacaagtagtataaaacggactttagaatcacaccagtttccactgttgaatgaccctaacaaagcatgcatctatgtgatcagggtaaaagcacactggaatgaaaagcagatagcatag

SEQ ID NO: 1901 - DNA, 1269 bp, Glycine max
  Peptide Sequence Number=SeqID_93586
atgcagcgacacccaggtggcgccgccggcggtgttcaagagcgcattgagcagcggccagtcggacaccgcatcggaaccgtcgcgcatggcctccgtctcgcggttggggctggccaccgagccggaatccaggtgatcgcggccgatcaccacgggcgccgacagttcgccgctgcgcaccatctcgttgaacgccaggccgaggcgggcgcgctggcccaggccaacccagcaaatccgcgccggcaggccctggaaacggatgcgctcgcgcgccatgtcgagccagcgatgcaggtgcgcgtcgtcgggaatcagttccttgaccttggcatcggtcttgtagatgtcctgcggatcgcccgacagcgcggcccagcggaacgggcccacgccgcggcagaacagcgggcggatgtaggccggcacgaaccccggaaaatcgaaggcattggccacgccctcgtccttggccatctggcggatgttgttgccgtagtcgaaggtcgggatgccctgcttctggaacgccagcatggccctgacgtgcacggccatggactgcttggcggccttcaccaccgcggccggttcgctgcgggcgcgctcgcgatattcggcccaggtccagccggcgggcagatagccattgagcgggtcatgggcgctggtctggtcggtgaccatgtccggacgcaccccgcggcgcaccagctcgggcagcacttcggcggcgttgccgcacagcgcgatcgataccgcgcggccttccctggtgtagcgggcgatgcgcgccagggcgtcatccaggtcggtggcctgctcgtccacatagcgggtgcgcaggcgaaagtcgatgctggcctgctggcactcgatgttcagcgagcaggcgccggccagcgtcgcggccagcggttgcgcgccgcccatgccgcccaggccggcggtgagcacccagcgggcgccgagatcgccgccgtagtgctggcggccggctttcgacgaaggtctcatcctgctgccggcggtcatctggccatacatggccaagcccttcctatccagctcgttgaagtggtcccagttggcccatcgcggtaccaggttgtaattggcaatcatcactcgctgtgcatctgcatgggtgcggaacacgcctaccggcttgcccgactgcaccaacaaggtctggtcatcgtccaggcgcttgagcgtttcgactatggcatccaagctctccctttcactcacgactcgtcctaa

SEQ ID NO: 1902 - DNA, 372 bp, Glycine max
  Peptide Sequence Number=SeqID_93587
atgaggggcatcatgcatgagcctcaagtgaacataggggatggacccttgggtactagtaccctcacctttagaggactatatgtcctcgttatcagagggctccacgccctcaccttcagaggactacacgtcctcgccttcagagggctgcacgccctcaccttcagaggactacatgtcctcgccatcagaggattacgagtccttgccatcaaaggattacgagtcctcgccatcagaggactacacgtcctcgccttcagaggactaaacgtcctcgccttcagaggactacacgtcctcgccatcagagggctgcacgccctcaccttcagaggactacacgttctcaccttcagagggtcatga

SEQ ID NO: 1903 - DNA, 420 bp, Glycine max
  Peptide Sequence Number=SeqID_93588
atgcttgttaagggtgattttaattacaaggaggctctgaccaagtcccttatcttcctagaggcacaacgttcaatgaggcacaatgtacaaggaaatacagtgctaatacaaggaagctcccttcaaataatagggtgccttggagaggagactcaacactcgatgatggcaaactcgctaatgggacaatgtgaaatatgggctccccatggctttcactgttactacgctagcatggggagccattttttacaactagttctcgacacaaaagatgatcaccattgttgggctccaccagaaaatatgaagacaaagaaaagtgttaagatgattaccagtgacactcccgggactgagatcgcggctgaaactgcagcagcaatgagatcgcagttgcaagtaaaagaggcctaa

SEQ ID NO: 1904 - DNA, 174 bp, Glycine max
  Peptide Sequence Number=SeqID_93589
atggctagtgtggaggaagctttacctcatattccaaggttggggacatgcctaagactctttaagggttttatagtgattaaacaagtagataacacaagagaattgttaacccagttcggtgcaacctcacctacatctgggggctaccaagccagggaggaaatccactaa

SEQ ID NO: 1905 - DNA, 1167 bp, Glycine max
  Peptide Sequence Number=SeqID_93590
ttcgtagaccacgtcttttccggtttttccgacgttttcctcaaataaacgttggtggcgactccgcgcgtattcctttcttggaagacgcacccgcgagtctcgcgtcgccctcccgccgaaggaaagggctcaccaagggtaaaccttgggtttttcaagccttggagtggggacgtgtttgccctaggtattttcctgactgtggagttgtaaggatcaccaagtgtggagcttgggactcaccgagggtggaccttgggttttgtgagccctttggagtatcaactaggaaatttttgacttgggttttgggcgtcgtgctcatgaatgcatgtcagtcgccgtgggtggcacttattggagacatagcgcgtgctcttgcgtgcatgtcactcgtcgtgggtggcatgtactggagacgtagtaatgtgctcatgcgcacatgccactcgctatgggtggacttaccaagggtggaccttgggtttttcgatccctttggagtatcaaccaggaaattgtctgacctaggttttaggcaccgtgttcttgtatgcatgccgctcatcgtgggtggcacgtcaattgaagtagaacttcaggctggctgtggccctgaatggaccttcccagttaaggtcaagctttctcactcggggttcttttatggcttaaccttggactcgccatacgaggtgcttgatgcctatccttgtcaagaattattcataagtctaagcttcgaactgagtgtcgttgtccacaacaatggcgtatgggaggccgtagctgcagatgagtcaatgacgactagtaggtatttggcttctcttggggcctttggtagtggtccagtatgtccattcccacatggcaaagggctaaggggagctcaaactatgaagattgttaggaggagtacgtgccatgtcagtaaactcttagcatcgtctgcacctcctgatgaagttgagggcatctgccttgagggttggctagtagtagccgactcatactactttggtggctatggagcctcatttgatggggtcatccagtttcgttcctcctctttgtcgcaacgtgcccttttgcgggcgagcgaggcgaggctcacgggtgcgctttccaaaggaggaaaagatgcgcggagtcgccaccaac

SEQ ID NO: 1906 - DNA, 318 bp, Glycine max
  Peptide Sequence Number=SeqID_93591
atgtataaaaaacacaaagaacttgaccttaaccgcgacttgccgctagaaccaaaaatcaggccttgcaatgcttacttcatcctcttagtcttggaccttgtcataggacctccaatgccatgtaaaggatcattagataggctaattgcacctctatcattccctccctctttgaaaggatttgtcctcgaatttgaactgttacctacatcaaatgaagatagatcaaccacattaaaggtagcacttatgttctcccagcggaatggagaagaggaagagttgagaggagacaccacttcaaggagaagatga

SEQ ID NO: 1907 - DNA, 201 bp, Glycine max
  Peptide Sequence Number=SeqID_93592
atgtcagtgaaaaacctcgtcgggcgcctaggagtacatgacaagacaaaccacacactatcaaggagaccagtcagggttacagtgttttccgagaatgctccaactatatgggatcaacataggcttaaaggagcactcaaacaaggtgacccccaaggcctaaactccgaagagtccgttaggacctctccctcctga

SEQ ID NO: 1908 - DNA, 551 bp, Glycine max
  Peptide Sequence Number=SeqID_93593
atgggggagacacatgaagtaccctaccataatctagccaacttcgagccttgcctcagatatgccactgagggagtcccttctgccatggcgcaaagggagaaattggatcacctagaagaaaggctcagggtcgttgaaggaggcgaagattatgcctttgctaacctagaagagttgttcctagtacccaatgttgtcatccttcccaagttcaaggtgtcatactttgacaagtacaagaggactacttgtcctaagacacattaccagtgttctgctatgaaaaagatggtgggctacacaccttcaagctttgttgatttagttttcaccggtgaaaggattgaagtgggtcagaaaagaggcaagtttgatcatcctgctttgacgaatgagaaaattggggcaaatgaagaggatgagaatgagggagaaacccatgttgtggctgtcattcctacacaaccaaatttcccaccagcccaacaatgtcattactcagccaatatcaacccttctcattacccaccacccaatcatccacaaag

SEQ ID NO: 1909 - DNA, 858 bp, Glycine max
  Peptide Sequence Number=SeqID_93594
atgcagacgctaagtgcacctgctaagcacgcctgtgcgcctaagcctcagtgtctctctgttgaggctgagctaagcgccagcatatggcttataggaaaagaaaggcaccatctacacccacccaagttagatttgacagatcaagattcacttcccaagaggcttgggaaagatacagacattattgtgcctaggaagcttctgccagagaggaacatggcggtctactatatagagttcgatgagttcaaggaggaactcgaaagaagccactgggacgaggagttgactgactttggggatggcaacattgatgttgccattgatacgcttaatactttcttgaagactcctgttattgtggaagagggggaatcactctgtgcttattctagatttgcactcctgaggcctgatcctcaggagttggctgctaagctctgtatcccagggaagggattcgagcttaatgctgatgggcagcccctgaagattttgaggaagaacttgaccaccttagctcagacatggagtgttctttccttatctaacttgattcccacctcccacacttctgatgtcactcttgacagggctagactcatttatggcattattatgaagatggatatgaatgtggggtacctaatctccctcactgctcagcatgacacatccagacttggattcccggccttgattacagctttatctaaggctaggggagttcagtctgattcaaggtccctagagagcctgagtcctgccattaatttggcttatattaagaaggactattggaatcttgatgatccaacaataacattcagaggacctaggaaggccaggggctag

SEQ ID NO: 1910 - DNA, 609 bp, Glycine max
  Peptide Sequence Number=SeqID_93595
atggcttctaggaaaaggaaagttgcaacttccaggccccaacctcactacgatactcacaaattaacctctaaggacgcctggaactgctacactgacaacgttcttggctggaacatccttccggaaaggaacgtgaagctttttgtcacaaagtttgatgagttcaggacaaagctagtcagaagaaactggcatagaacgctgaccaacctcatagaggggagcatagatgtggctctcgtgaaggaattttatgctaatctttatgtcctgaggggtaagcctctaaagcaagttagggtcagagggcatttaattaagtttgatgtggattccctcaacacttttctagagactccggttgttctagagctaggggtgactcttcctgcttactcccagttctgctcactgagaccaaaccctcaagagctggctgcccgactttgtatccctggtaggggatttgttctgaatgttgaggtcctaccatggaagctgttgaggaaggacctcactactctggcgcagacttggagcattctgtcttatttcaaccttgcccctacatcacacacttctgatctgaacttggatagggcatga

SEQ ID NO: 1911 - DNA, 195 bp, Glycine max
  Peptide Sequence Number=SeqID_93596
atggataggaaagctagtggtgaagttagcaaaggtgaagtcccgaaacccaaagagaatgttggaagtggttctgaagataaggttatgaaggctccaggtggagatggatcttacatttccaggaaggaatttgagaaaaatcctcagggttactttgatggtggcgttaactgtggagagggtgagcactga

SEQ ID NO: 1912 - DNA, 98 bp, Glycine max
  Peptide Sequence Number=SeqID_93597
atggaaagcagaaaagggaagaagcaaaaagggacaggacagacgaacacaaacaaagaggacgaacataaacaaagagacagcacacgtgcactgaa

SEQ ID NO: 1913 - DNA, 234 bp, Glycine max
  Peptide Sequence Number=SeqID_93598
atggaatataaatactggaaagatattgagctggtagacgaggaagaagcacagattggtgttgatcgttctagtgcaacctctaataaatctaagatttataaggaggaagcacgaaatgcaacacagaagcataaaccaaagagggtagagagtgtcaatgctgatgcagaagccttgggtgatgactggaaaattcagattgctctatgcattctgaagctgaaccactag

SEQ ID NO: 1914 - DNA, 99 bp, Glycine max
  Peptide Sequence Number=SeqID_93599
atggagaaggaggaaaggtacttggagacgtcacttcaaggagaagatgagtcaaaaacaagctcaacactattggaagccatggataagagcttgaag

SEQ ID NO: 1915 - DNA, 316 bp, Glycine max
  Peptide Sequence Number=SeqID_93600
gatacggtacacaaatcttttctcctctcgttccgttattgatccaaaattcaatggcatggtgatgcaatcctaccccgcatgggcattgggtagaagactccaagtagattgggctagagatccaagggaaggccctagggttctcatgagccttagggtagatttcgagcccatgggctatgatgcaagctccattggagcttgtaggcctaggatattcttcatcaatggattcctttgcttcttggaagatgaatggcagcggaatggagaaggaagagagggaggagacgccacttcaaggagaagatga

SEQ ID NO: 1916 - DNA, 258 bp, Glycine max
  Peptide Sequence Number=SeqID_93601
atgctacaattcgaaggggtttcctctaatctcagatatgatttttcaattcccaacggtgagaatgtttggaattgggttgcaaacgtggtactcaaatttcacaatgatacaacggtgaacgggtcggagatcgtcatttttctgagacaggtttggtgggctgcgggaaaaagaaaggattttgagaggagaaggggaaaaacgaaaatgaggccaaaaggaggcagctggcttaacataactatttatacctag

SEQ ID NO: 1917 - DNA, 165 bp, Glycine max
  Peptide Sequence Number=SeqID_93602
atgcataaagaagctcaaaggcttgatgttttaaacaaaaagatgagaagcgatctaaaaatgcatatcactaaattggcttcaacacaaagtgtgcctaaaagcaagggactgactatggtgtacttggatagtggctgctctaggcacatgacgggtggctag

SEQ ID NO: 1918 - DNA, 201 bp, Glycine max
  Peptide Sequence Number=SeqID_93603
atggaggttgaggaaccttggctggggttatggctaccattgaattatcaagtagatatgagagcaagtcagcgtaggacaccggaatgggggtttgttctaaaggtggtgttcctcattggaagtgcagtagacaggctttgtgttgatttagggatggcctttgtggataactgggtggtgggtaatgagaagagctga

SEQ ID NO: 1919 - DNA, 141 bp, Glycine max
  Peptide Sequence Number=SeqID_93604
atggcggaaaatcttcacggatttgctcacgaaaacgtctcagaagcgttatggaagcacctcgacttggattttcttcatggaaacacccaaaatggggaggttcttgccgccgagaggcttcttgaggaagatttctga

SEQ ID NO: 1920 - DNA, 442 bp, Glycine max
  Peptide Sequence Number=SeqID_93605
atgcgtcgacccggttatgctgcaaaacttcagcacgtccagaccgtcatcaaaggtgcccacaatctccatctggctgtgggtgttgataagccagcgctcgttcgggacgtaaaaagcaatttcggtgcccggttcaagacgctgaatgtgcagcccatcgccgtaaagcagcttgacccggtgatgcacgttcagcaggccgattttatttccgggcatctcgttagactctacgcgctcaatgacttttggatcaatgccgtggccggtatcgcgcaccgcaatacgcacgcggttgccgctttcggtgacgctgatggtgacgacccctttgcctttacagggctgaatgccgtgaacaatcgcgttttcgaccaggggctggataagcaggctcgggatcacgcagttgacctcttcatcaatatcgtaaatgacc

SEQ ID NO: 1921 - DNA, 429 bp, Glycine max
  Peptide Sequence Number=SeqID_93606
atgtcgaatcataaaagtactgagttagcactaaagaaccttgaagtacaaatgggacaactgaccaaccagatagctgacaagtcatcaaacaactttggagcaaatacggaaaataattctaaggaggaatgcaaggctgtgatgaccaggagtaaaaggtttgtggaagctgaggatgaagaaaatgtggtagacaaggaacaactgagtgaaaagacaggtgccgaggttaagaaaaatgatgtgaagggtaaagagaatcaggaaaaagggaagaaaataatggtccagaataaagagatggaggaccaagaaagagaaaaagaaatagaaaatgagaaaaatgaaaatgaaaaaaataaggttgcagagaagagtagaagtggaaaggttgtggaagaaagtgtggaagtaccatatcctgtg

SEQ ID NO: 1922 - DNA, 201 bp, Glycine max
  Peptide Sequence Number=SeqID_93607
atgggggtgaacttatcaaaaatggggggtgcaaatagcaattttgaaattttgcaattgggccttccagagtattttcgatgctggattgcttctggaggaagcaatccagctcgccgtaaccacgttggaaaccaaaaagagacaaacgtgagaggtgctaataccttcctcaaacgtaaatacaactcccgaacttag

SEQ ID NO: 1923 - DNA, 75 bp, Glycine max
  Peptide Sequence Number=SeqID_93608
atgggtggtggtgcatggccgttcttagttggtggagcgatttgtctgcttcttagagggactatggccgcttag

SEQ ID NO: 1924 - DNA, 2704 bp, Glycine max
  Peptide Sequence Number=SeqID_93609
atgagtggaatcgaaccaatgcaatctactaaaaaggcaattgaaattactgaatccagccttgcagccgcaacaactggctacgatgctgtagacgacctgctgcattatcatgagcggggcaacgggattcagattaatggcaaggattcattttctaacgagcaagctgggctgtttattacccgtgagaaccaaacctggaacggttacaaggtatttggccagccggtcaaattaaccttctccttcccggactataagttctcttccaccaacgtcgccggcgacaccgggctgagcaagttcagcgcggaacagcagcagcaggctaagctgtcgctgcagtcctgggccgacgtcgccaatatcaccttcaccgaagtggcggccggacaaaaggccaacatcaccttcggcaactacagccaggatcgtcccggccactatgattacggcacccaggcctacgccttcctgccgaacaccatttggcagggccaggatctgggtggccagacctggtacaacgtcaaccaatccaacgtgaagcatccggcgaccgaagactacggccgtcagacgttcacccatgagattggccatgcgctgggcctgagccacccgggcgactacaacgccggtgagggtaacccgacctatcgcgacgtcacctatgcggaggatacccgccagttcagcctgatgagctactggagtgaaaccaacaccggtggcgacaacggcggccactatgccgcggctccgctgctggatgacattgccgccattcagcatctgtatggcgccaacctgtcgacccgcaccggcgacaccgtgtacggctttaactccaacaccggtcgcgacttcctcagcaccaccagcaactcgcagaaagtgatctttgcggcctgggatgcgggcggtaacgataccttcgatttctccggttacaccgctaaccagcgcatcaacctgaacgagaaatcgttctccgatgtgggtggcctgaagggcaacgtctcgatcgctgccggtgtgaccatcgagaacgccattggcggttccggcaacgacgtgattgtcggcaacgcggccaacaacgtgctgaaaggcggcgcgggtaacgacgtgctgttcggcggcggcggggcggatgagctgtggggcggtgccggcaaagacatcttcgtgttctctgccgccggcgattccgcaccgggcgcttcagactggatccgcgacttccagaaagggatcgacaaaattgacctgtcgttcttcaacaaagaggcgcagagcagcgatttcattcacttcgtcgatcacttcagcggcacggccggcgaagcgctgctgagctacaacgcttccaacaacgtgaccgatttgtcggtgaatatcggtggccatcaggcgccggacttcctggtgaaaatcgtcggccagcccggtatgaaaggtactttaacgcgcaccgctttggcggcgggcggcatgatggtgacaagtgcggtcatggccggcagcctggcgctgccgaccgcgcagtcgctggcggggcaatggcaggtggccgacagcgagcggcaatgccaaatcgagtttttggcgaatgagcaaagtgaaaccaacggctatcagctggtggatcggcaacggtgtttgcaaagcgtgtttgcggcggaagtcgtgggctggcgcccggcgccggacggcatcgctctgctgcgggcggatggcagcacgctggcgttcttctcgcgcgacggcgatctgtatcgcaatcagctgggcgccgatgatgccctgacagagttacaggtagagcgaacgcacgatcaggaagtggccggagaagtaacagaaagccacgatggcgtccgccgcgcggaaggtgaaacggtagcggttgagcagccaaaccacgttggccagcagcagcagcgaggtgccggtcagcagcgagaagccgaaatcggtgctgcgcaggaaatattgctcgcccgccagccagaccatcagcaacgtcatcgccacgtaggtgacgatcggccagcgcatctcttccagccgggtccaaagggtggccagcagcaacgcgccgatcgccagcagcgccagcggcagcggccagaacaggctgaacgtcatctggctggcgaagctcagggtatacagcagatgggacaggaaaaaggcgccgatggcgtacagcacccgctcgcgcggcaacaggagcagcgcgtcgccgatcagcgtcgccagcaggccgagcacgatcagataacctgctgcgccgagcaccggcgcctgccaggccaacagcaacagcagcagcagcgtgacgggtttgaacacccagcgctgccagcgcgggccacgggagccgcaacaaccggctccaaactgtcaccaatgaaatgggaaaccgatgagcaagccaccgttattttttgtcgccgtgattgcgctgatcgccgtgctggccacgcaacgctacttcaaacagcgccagcgggaggcggaaaacgatcgcgcgccgatgcgcagcctgcaggtgacggtgagcgacaagcgcagcttcccggtcgccaggacccgcgcgccgcagcgcgaaccgctggccagcagctcgaacacgccaaagataaagatcttggcttcttgccagtagctgattggctgattcttcggctgg

SEQ ID NO: 1925 - DNA, 450 bp, Glycine max
  Peptide Sequence Number=SeqID_93610
atggcaaaagataagaaacgtgggtttttctcctggctgggctttggccagaaggaaaaggaagaagagcaacagcaacctgagcagccggtagagcaggcggagcctcaggccgcggagacgccggctgaaccggccaccgccaagctggatgacaagctccccgcccaggaatctgaacctgccgcctccgtcgacaccccgggagagtgggatagcggccaggccggtgaacccatcgcggaaaacctgccggcggcggccgaacacccgacggcgcaagcgttggccgaagagattgtcagcgtgaccgagcaggtagtggcgcagcagcagccggttgtcgagccagagccggtggttgagcccgagccggtcgtcgagtccgagccggtggttgagcccgagccggtcgttgagcctgagccggtcgttgagcctgagccggtc

SEQ ID NO: 1926 - DNA, 345 bp, Glycine max
  Peptide Sequence Number=SeqID_93611
atggtttcaaaactgatttacaaagctgtaatcgattaccatgagcatgtaatcgagtaccaatgttttaaaacggtagatttcaaagttcaaaagtcacaattagtgataaaacatgggtacatccttggtggcacaagtagagggtacatctacttgggttgttatactgagaacaagagagagtacatctgttgtagatcaattcaagtgaagggtacatccacttggttgttcaaagagaacaagggagggtacatcccttgtggatctttggcttgtaaaggattttacaaggttgaaagaaatatcaagaaccgttggttgcttggggactggatgtag

SEQ ID NO: 1927 - DNA, 297 bp, Glycine max
  Peptide Sequence Number=SeqID_93612
atgtataatactataataacctatattggtatccactgcagtgcacattggcaaatggtcatcattttgcctaaggaaaatcttttcgtctggttttgtttattgcataataggccagacaactacctgaaaggaataattaacagtgctttgaaaggacttgacgatactccacaacctaaatccaaggctggtactaggtggattgttgttaaagtaacaatgcttctactaatattttattgtaatagacaaaaaggaagcactgagtgtggatattctggatgtcaattataa

SEQ ID NO: 1928 - DNA, 792 bp, Glycine max
  Peptide Sequence Number=SeqID_93613
atgatgaaaaaacttttagcgctagcccttgttgcgccgttgcttgtctcgtgttcgtcaaaaaaaggtgatgagtacaacgaagcctggatcaaggacaccaacggttttgatattttgatggggcagtttgcccataacatcgagaatatatggggatttaacgaagttcttattgccggacctaaggactacgttaagtacaccgacgcctatctgacccgtagccacatcaactttgatgagggtacgatcacgattgaaaccattgccggcacagaccctgccgctcggctccgtcaggcaatcatcaaaaccctgctgatgggtgacgatccgggctcaatcgatctctactccgatgccgacgacatcacgatatccaaagagccgttcctgtacggtcaggtcgtcgatcagaccggccagcccattcgctgggaaggccgcgccacgaaatttgccgactacctgctgcagacgcgcctgaaaagccgctcgaacggcctgaagattatctatagcgtcaccatcaaccttgttccgaaccacctcgacaagcgtgcgcataagtacttaggcatggtgcgtcaggcctcacgcaagtacggcgtggatgagtcgctgatcctggcgattatgcagaccgaatcatcgtttaacccgttgtacagcacagcgccggtaaagacgtcttccgcgcgcaggggaaatccgggacgccgagccgcagctatctgttcgatccgcagagcaacattgataccggcaccgcctatctggcgatgctga

SEQ ID NO: 1929 - DNA, 186 bp, Glycine max
  Peptide Sequence Number=SeqID_93614
atgtgtctatcggggaaggagaggcaaggattgacattctcaccctgggtcaaggtttatgataagttgggattttggctcaaggcttgtagaatggctggtcataatatatgtcagggtttggctagcggttcggggataaaggggatgccctacattatttccatgatacacatgcaacaatga

SEQ ID NO: 1930 - DNA, 273 bp, Glycine max
  Peptide Sequence Number=SeqID_93615
atggaggcagcaccagagggtgagaagatcaaaaaagggatatcgtggaaggtggagagaggggacaagttcaaagtctgggaagatgagtggatacaaggtgaggtctcattaatcacaaagtatcccaggctgtttgtaatctctcaacagcagagcaactcaatccagcagatgggaggcttcaaggataatgaatgggagtggaacttgtcatggaggaggccattgtttgataatgaacaacagcagaacaactctattttagtctga

SEQ ID NO: 1931 - DNA, 330 bp, Glycine max
  Peptide Sequence Number=SeqID_93616
atggagataaccatgaggtcatctagtttgatagggttgatgcctttgaagcctttgttgatgaatgttatggaagggagacttcttggtgactcccatgttcgttgttcttccattcaacccgacgacttggatgactcttcccggcttgcagttaatttgaatcaaggagtggcacttcgtgaagatgagggctttgtccatgggaagacgctggtaatcgataagttcattgtgaccaaccggtgctacattgttgacttggctgcaaaagggtttggaggaagtagtttcatgttattagagttaacaatgttgaagattttgtag

SEQ ID NO: 1932 - DNA, 267 bp, Glycine max
  Peptide Sequence Number=SeqID_93617
atgctggaaggcgtcttggtgtgcagcggtatatatggagtatttggcttctcagaaacaattgatgtggagaagactatagagcttattaagatgacatcttggatgtggttaactgcaaaggataagactttttcatcatcatggattgcttgggcaacagatcctgttttggagaatgaagctttaggaagggctaattatgtagggaatggagatcatggtgtcctttccttctgtaacttggaatctttaaagtctggttga

SEQ ID NO: 1933 - DNA, 756 bp, Glycine max
  Peptide Sequence Number=SeqID_93618
atgggctcaaaaatctaccctaaggttcatgagaaccctagggccttctttagtagctctagcccaagcttcttggagtcttctatccaatacccttgggggatggacgaagatcagtggatgcataatagcataatgtttgaagaagttgatataaacgaagaaaatgaagaggaatctggtatgaatgaagaaaatggagagaaagctggtgtgcatcaacacgttgactgttttgatgccttcaatacttctcaggtatttgctacccatgatgatgttttgcattgggctcggtctgttgcttatgatattagttttgtggcggtgattatgagatcagacacagatactgaccaagggttatctgagcctgaagtcagcataaccgaagagatggaaaccatatccaagcggtttgaagagcttgatgtttatggcaaagttactctaaagagtaaactttgggaaattgcctaccctgatctaaactttatgtgtgctcctctagaaaaggtcaaaacaaaagggtacatcctttgtggcacaagtagagggtacatctacttgggttgttatactgagaacaagagagggtacatctcttgtggatcagttcaagtggagggtacatccacttggttgttcaaagagaacaagggagggtacatcccttgtggatctttggcttgtaaaggattttacaaggttgaaagaaatctcaagaaccgttggttgcttagggactggatgtag

SEQ ID NO: 1934 - DNA, 333 bp, Glycine max
  Peptide Sequence Number=SeqID_93619
atgggggtgcaaatagtacttttcaaatctgggcccttctggagactgtttttcggagctgggttgcttccgtctgggcgagctgggtggcaacctcctccccctttttcctataaaaaggcaaaatggggctgttctaagggtcccagattcaccgtggacctcctccccctttttcctaaacaagaaatttgtttccgtgaagaaaattcaagtcaaggtgcttccgtaacgcttccgagaggtttccgtaagcaaatttgtgaaggttttcctccgttcttcaccgttcttcgtccgttcttcatcagttcttcgttcttcagcgggtaa

SEQ ID NO: 1935 - DNA, 639 bp, Glycine max
  Peptide Sequence Number=SeqID_93620
atggataggaccaaggaggcaattcaaagaactttcaatgacaataaagaaaagtataaggatacccttaaaagatggggttgccaacttcaccaccctttgcatgcagaaatttattatctaaatcctaggttctattacaccaatccaaacaatgacaaagatgatgaagtggaagatgaactctccaaatgcattgacaagattagtaaagatgatgaatttgtagttgaagtccacaaagagttgttaatgtataagaggagtggagagagatgtgaaagtaatcggagtgcctttgagcatattcagtcaaagaagagaagaaggcttgagcaccaaaagcttcaagacttggtttatgttaagtataaccaagattttgtaaatcattttaattctcgtgatgtgattgatctcgttgttttaaatgacattgatgaaagcaatgactggttattgggagagttggaagaagaaaagaatgctaaagatgaggccagtgaacctttgaaatacaccaagagacagacacaaatgaagaaggtaaatgatgcaaatgaaagaggaaaaaaggggagggaaagttcatttctaatgctagtgggaatgaaaaagaattacaagaagatgagttag

SEQ ID NO: 1936 - DNA, 114 bp, Glycine max
  Peptide Sequence Number=SeqID_93621
atggaaaaggaaggagatgcttgccacccagctcgcccaggcgagctcaagaggaagcaaccgccttctggagcaagtgggcctggttgctatttgaacccccatttttactaa

SEQ ID NO: 1937 - DNA, 270 bp, Glycine max
  Peptide Sequence Number=SeqID_93622
atgatggcactggcaattgcttgtgaagaagcaacgtcttttaagaaacctattatccaatattcctataaccttccacaacctaagccactactcctcctccctccgccaaacaccaccgcttccactgcaacttacgccatctccctccaccgcaacttgccaggcaggactccatcaccactctcatcgacatcactaccacaccaaaaccctatcctccaacctcacctccgttctcaaacaactccaaaggcgactctgcgctag

SEQ ID NO: 1938 - DNA, 270 bp, Glycine max
  Peptide Sequence Number=SeqID_93623
atgacaaaggtgatgacaaaaagctcaaaggtcaatcaaaggatgagttcaagatgttcaagaaggaatcaagaacaattcaagactcaagaggaaaagttgaagaacacttcaagattcaagaagaaggatgaattcaagaatcaagattcaaggatcaagcttcaagattcaaggattaagcttcaagaatcaagatcaagattcaagattcaagactcaagaatcaagagaagacttaatcaagataagtatgaaaaatatttttaa

SEQ ID NO: 1939 - DNA, 531 bp, Glycine max
  Peptide Sequence Number=SeqID_93624
atgaaggaggacttgaggaaattaagagataagaacaaagatggtgccaaatcccaagctaatgtagtaaaaagtgttgaagatgatgtgtttttggcaacgaatgatgagttaaggaatggtggaaaaatgaaggttgaaggcatagggagtgtgagtcaaacccaagtagatgtaccctctacttgtaccacaaaggatgtaccctccaatgtgttgagacaaagatctcaagctgttaaacctttgatactttgtgaatggggatacaaaagaattctcagacgggagaagggagacacaaaagaattcaggcggttagtcctttgttcttttggaaaagggagaagagagacacaaaaagaattcaggcggttagtccttggcgaattctttttgacaaagggagaagagaatgaaaagatgaatagtataagttttcaaagtttagaaaaccagaaaactttggaaagcttttggtacaaagaagaagaagaagttcaaggagatttagggcttgtaaaagattga

SEQ ID NO: 1940 - DNA, 498 bp, Glycine max
  Peptide Sequence Number=SeqID_93625
atggatgagtacaaaatggaggagctcgacaacaaaaaggactttgacattgagtacaacccattcatgaccgtcgtcctcgacgatgaaaacatcaccatcatcaagagcaagagcttcgtgtccacgctgggctgggactccaaccccaacaatgatgtctatgattttagagagatgtatgttactccttcagatatagatgcttattcaattcccaaggttcttgctccaatgccacagaaggttgtgagacttacagatggcaaattggcaattaagatgtcagattattatttcttgtgttttgaagttcccctcccccgtacccttttcactacctctcattctcacataaacattgagattggtaatattcttccaatgatatatcagtttctcagcgagcttaaacaccctactgtgtattctctatctcccagaaccaatgtgacaccagccatgaccaaggatgtcaatggactattcaacgtgtag

SEQ ID NO: 1941 - DNA, 661 bp, Glycine max
  Peptide Sequence Number=SeqID_93626
agagatgtgcagtgccactgattacaaagttaaatcaatcggaggtatgtgcatcttaatccaaatgtgggcatgggaacgatgcacgactttggctccaaagaggacgcctcccgtcatagaaaataaaccactcagacacaggtggctgcaacgtggaaatcagcatattggcaatgatgaacttagagttttccgtcgcaaattggatctgatgaaacgacatgagtttttctgggagccatacacagcaactgtgatggtagcgttgcctccaatttgtgtggttggaagtgtagcctggttcgcggtgaatctccatggcataacgcttaaaggcaaacaagatgagaattggttccacctgttggccccaatgattagtcagtggaacaatcgagctgagtttagggtcgacgtttatcctcgacaggagggcctactgggttttaactcggactacttggtgtggtataggcgtaaaacaaagatgtttgttgacccaaataatgcaaacacagctgcattgggtgaagttgtggagactttacaatatatggtgtcaccacaagggaggaacacatggacaattgatgatctcgtgccttacgtggataagttagcgattatatcagaagagcaagagagaatcactgagcca

SEQ ID NO: 1942 - DNA, 429 bp, Glycine max
  Peptide Sequence Number=SeqID_93627
atggttttctgctgcatcgtgtttgtttgttctcgcacttcagcgtccttgtgggtctcgagcttcagcaagggtaccttcttcgcaggggttaaggtgttgctgtcctccgtaaacggtgccatggaaaagagttcctcatcatacaccatcgaggcccgaagtcgcgtgttttgtctctgtaacgtagaggctccactggtgacatcgtggactgaggataatccagggaggcgtttttatggttgtggtaggaaagggtgtaattattttaagtggcacaatctagttgccaacattcatcagaagaagatcattgtagcattgatgaagaaggttgatgaattgaagttgagggaaaaggatttgcaaagcaggattagtgaagatgaaggaaaaattataaggattgtattggttgtttcttag

SEQ ID NO: 1943 - DNA, 603 bp, Glycine max
  Peptide Sequence Number=SeqID_93628
atgttaaaggatgaccttcgcaatatggaaagatcaaagaaaagggaaggtgttgatatgacatatttcaaaaatgttatcttcaacctgcttgagactggtattaatttcaatcgtgctgttggtaaagagactagactagtgagactagagaatgttgatgacttgatgagctaccaaatgatttttaagaagcacaacataagacatatgaaaaacgggatacattgtacatctgcacatgcttcaatgagaagtctccctatccagttgttgtgcttcaaacagcttttcccaagtaatgttgatgagattggtgtttggtccctgcaaggaataagaaaccatccagagaaaaatgttgtcaatctcaatgtaaaaatgaatcccaatccactgtcattgaagcatcagattctccagtcaattcatctagagtccttagggatgatgtgtctcaaagtttcaacattggatccatcggacagtgttctcttccagctccatataaatcatgaggcaaaactttaccagattctaactctaatagacaaggtgttgtaccactgggggaaatacgttctattattctgcatattttaa

SEQ ID NO: 1944 - DNA, 327 bp, Glycine max
  Peptide Sequence Number=SeqID_93629
atgcctgaatcgatgaaaaagagaaagggctccaccgctgctggccatcgacgccatggaacatctggagcggtaacttcttttgggtaccgtaaggatattgatggacagtggattaggaaacaagatttaccatcgctgattccttacgagctcctttttgagctacgtggtcttcaagtgtttgtcggtgatcgttttgatgccatggatagtcgtctggatgccatggatgctcgttttgaaggcatggattcacagattactcaacttgaagacgtcataggtttcattcaccgttgctttgatccaccgactaccctatag

SEQ ID NO: 1945 - DNA, 768 bp, Glycine max
  Peptide Sequence Number=SeqID_93630
atggccttcatcatttccaaatcttgcattcattcagtattcagagattcatacaaaaatcggtatttgatgctagtcgttccctcacaatttaagattcacacatttcaccgggttacaacaattggttaccttcactatttacttgtcaagcaagctaacattttcactcatgcccctaattttcatgttctttctcttatagatatagcatacttattcgaggtatatgatctagcatcgcaagtcactcaattcgtgcaatcaattcagttcaaaccaatatcaaacaaacaccactaccataaaggccaccatgctcataatcggcctttgctgagccagatcgtgaatgctctacatcaccaggcaaaggccgtggtgaaggctctacaacatcggcactacaacattactactctgcatggatggccggatggtgctgaaggtgctggagctggtactagtgctagtgtgggagcaggagctgaggtggaagcatatgagggagccctagccctggccttgcgggacccaagaaatgccaaattactagccgggctgaaggactcaaaggtgagtgagtcagatactactcctccggctatgcgcaatgctgtgataagtgtaggaaatccaagcctagaggagttggactgggccatctgggagatctggcttgagatgatcgggcccgcgtctatatccatcttcatcacgagcccgtataccaacctcaccctatccatgctcagatcagaagtgtga

SEQ ID NO: 1946 - DNA, 4560 bp, Glycine max
  Peptide Sequence Number=SeqID_93631
atgtatctttatgacattgacatcaatgatcgtttgactttgacagagttcaaaagtctgttttggacttcatggcagcccttagaatcaacatgcttgttggagcatattattttacctgtggaacttggtttcttagtgatcttgttattccaactcctaagaaaatatgtgagccagttcagcaagcaaaccaaggtcccagatggtgccacaaaaatgatgcatccaactgcaatcaaatttggttttgcatacaaactcacctttgtttgcaccacattgttgttggttgttcattcatcacagctattgctgatgctcaataatgagactcaatgcacctcaaaacttcaggccttcacatcagagatagttcaagtgctatcatggtcaattagtcttatagcaatatggaagatatcaaaatcacacacatatttcccttggattctgagggcttggtggctttgcagtttcattttgtgtatcataaccacagcccttcatgcccatttcagtgtcatcaacaatggtcagattggtttaagagaatgtgcagatttccttggtttgcttgcttcgacatgccttttggttatttccacaagagggaagacaggcactgtccttcttgccacaaatggtgcatctgaaccacttcttggagagaaagctgagaggcattcagagtgtctaaaggaatctccatatggaaaagccacacttctccaactcataaatttctcttggctcaaccccttgtttgcagtagggtataagaaaccccttgagcagaatgacattcctgatgttgacatcaatgactctgctgagtttctaacatgctcctttgatgagagccttaggcaagtcaaagagaaagatggcactgctaatccatctatctacaagtcaatctacttgtttgctaggaagaaagcggcaatcaatgcattgtttgcagtggtaaatgcttcagcatcatatgttggtccatacttgataactgactttgtggatttcctaggagaaaagggatcgcgcggcttgaagagcggataccttctgtcactggcttttctgtgtgccaaaatggttgagaccatagctcagaggcaatggattttcggtgccagacaattaggccttcgccttagagcggcattgatatcgcatatatatcagaagggcttacatctttcaagtagatcgcggcaaagtcacacgggcggtgagataatgaattacatgagtgtagatgtgcagagaatcacagattttgtttggtatgtgaatgtgatatggatgctgcctattcaaatttctttggcagtgttcattttgcatacaaatctaggactaggttcattggctgcattagctgctacattggcagtgatgactttgaacattcctcttacaaagatacagaaaagataccaagccaagatcatggacgccaaggacaacaggatgaaagccacttcagaaatcctcagaaacatgaggactttgaaacttcaagcatgggacagacaattttctcaaaggatagaagcacttaggcagatagagtacaattggttaatgaagtcattgaggcaagcagcattttctgctttcatcttttgggggtcacctacattcatttctgtgataactttttgggcatgcatgttcatggggattgaactgacagcaggaagggtcttgtctgcatttgccacgttccgaatgttgcaggatcctatatttagcctgcctgacttgctcaatgccattgctcaaggaaaagtttcagtcgataggatcgcttccttcctccgcgaggaagaaatccagcatgatgtcattgaaaatgttgcaaaggacaaaacagaatttgacatagttattgagaaagggagattcagctgggatcctgaatcaaaaactccaaccattgatgaaatagagttgaaagttaagaggggaatgaaggtagcagtttgtggatctgtaggttcaggaaagtctagtttgctatcaggccttttgggagaaatatataaacaatctgggactgtgaagatcagtggaacaaaggcttacgtgccacaatcagcatggatactgactggaaacataaaggacaacattacctttggaaaagagtacaatggtgataagtatgagaagactattgaggcatgtgcattgaaaaaggactttgagctattctcatgtggtgacatgacagagattggagagagagggattaacatgagtgggggacagaagcaaaggatacagattgctagagcagtttaccaggatgctgacatttacctttttgatgaccctttcagtgctgttgatgctcacactggcacccacctctttaaggagtgccttatggggattctcaaagagaaaactataatttttgttacacaccaagttgagtttcttccagcagcagacctcattctggtgatgcaaaatggaaggatagcacaagctggaaaatttgaagatcttctaaagcaaaatataggatttgaagttttagttggtgctcacagcaaagctctagagtcaattattgtggctgaaaattcaagtagaacaaatttaaattcaatagctgaagaaggggaatctaacttcagctccaagccaagtcatcaacatgtgcaaacacagcatgactcagtgcaagacaatcctccagagggcaaaggaaatgatggaaagttggtgcaagaagaggaaagagaaacaggaagcatagcaaaagaagtttactgggaatatttgaccactgtcaaagggggaattctggttcctctcattctcttggcacagtcttcattccaaatacttcagattgctagtaactattggatggcttgggtttgtcccacaagtagtgatgctaagcctatatttgacatgaatttcatactacttatttatatggcactctcagttgctggttcattttgtgttttgctgcgagccatgatggtgttaaatgctggactttggacagcacagacacttttcacaaagatgttgcatagtgtgctccgtgcccccatggcattttttgattctacaccaactggaagaatattgaacagggcttccacagatcaaagtgtgctagacttggaaatggcaaacagaataggatggtgtgctttctcaataatacagattctaggcactattgcagtgatgtgtcaggtggcatggcaagtatttgtcatcttcattccagtaactgcagtctgcatatggtaccaacgatattatacgccaacagcaagagaactggctcgcttagcacagatacaaatcactccaattctccaccatttttcagaatcattagcaggagcagcatcaatacgagctttcgatcaggaaggccgtttcatatacacaaatcttctccttgtggatggcttctcaaggccatggtttcataatgtgtctgcaatggaatggctttctttcagattgaatttactttcaaattttgtttttgccttctcactagtcatgctagtgagcctccctgaaggaataatcaatccaagtattgctgggttggcagtaacatatgggatcaatctgaatgtgttgcaagcttcagttatatggaacatatgcaatgcagaaaacaagatgatatcagttgaaaggatccttcaatatacaaatataacaagtgaagcacctcttgtgattgaagacagcagaccacctagcaactggccagaaactggaacaatatgtttcaaaaatttgcagatacgttatgctgaacatctgccatctgtgttgaaaaacatcacttgcacatttcctggaaggaagaaagttggtgttgtagggcgtaccgggagtggaaaatcaactctcatacaggccattttcaggattgttgaaccaagagaaggaagcattataattgacaatgtggacatatgcaagataggtctccatgacttaaggtcaaggcttagcattattccacaagaccctgccttgtttgaaggcactgttagaggaaacctggacccattgcagcaatactctgacattgaagtgtgggaggctctagataaatgtcagctaggtcacctagtaagggccaaggaagagaagttggaattcccagtggttgaaaatggtgataactggagtgtgggccaaaggcaattattttgccttggaagagccctgctgaagagaagcagcatattagtactagatgaagcaacagcctcagtggattctgcaactgatggggtgatacagaacatcataagccaagagttcaaagataggactgttgtcacaatagctcatagaatccacacagttattgatagcgatttggttttggtgctcagtgatggaagagttgctgagtatgatgaaccatcaaagttactagagaaagaagattccttcttctttaaacttataaaggagtattctggaagatcacataacttcagcaacttggcaactcaacatgtccaaagcagggagcaattatag

SEQ ID NO: 1947 - DNA, 465 bp, Glycine max
  Peptide Sequence Number=SeqID_93632
atgagcaacagaaaagataatactgatgatgagtctagtgaaagaggtatattttcacatctaggctatccaagtgcaccaccctaccctcctccacatggatacccaccatcaggctatccacctccaggagggtatcccccaacagcctatccaccaccagcatatccgcctcccggagtatatccgcattccggttactatccttccgaatatccacctgcatatccgcctccgggagggtatccacccactacttatcctcattcaggatatcatccaccagcttatcctgccccacatggctatccacctgctgcacctccatatcctgcaggggccacacaaacgcaggtcccctctagctcaaattatgatgtaggctctgtcacttgggcagaccttagagcagcaccccttcaaagtgcaatggaggtcactgccctaggccataagccttcatga

SEQ ID NO: 1948 - DNA, 228 bp, Glycine max
  Peptide Sequence Number=SeqID_93633
atggggtcaattggtgatcaagaaggccaatggcctaggacagtgacctccattgcactttggaggggtgctgctctaagtccatcagaccggcgcctccgtgcaaaggcgacacgtggtgtcggcgcggtgcacgagggggcagcaggtagcgcccgtgacgtgggcacgtctgctagtgccttgggactgagcacgactggtgacgcccctgctgcaggtgcctag

SEQ ID NO: 1949 - DNA, 210 bp, Glycine max
  Peptide Sequence Number=SeqID_93634
atgggcattgggagaatgagaggtggtgtgggagagggagtgacagagaaggaaaaattgaatagaaacgaagggtgtggaagtggaagtgttggtttatgtgcagtggagaagactttgagtagtgaaaatggacgacgaaaggaatcacgaaactttggagtgttgaaaaagaaggaacgaattaggaaggagttcggagcgaactga

SEQ ID NO: 1950 - DNA, 225 bp, Glycine max
  Peptide Sequence Number=SeqID_93635
atgggcatctggaaaaggagggttcgctttgaagttgcgacgctacacacatgtccatcacggatgggtgccactccgctccgctccgccgctatagcggccactattgacaactatgctttctgtactctgcttaggtcaattggttgcggacaattgtggataggtggtaaagcctctgtagctagttatgtttgcagccttaactctccccaagaaacatga

SEQ ID NO: 1951 - DNA, 231 bp, Glycine max
  Peptide Sequence Number=SeqID_93636
atgggagtggcggcgcgggtagtggtggtggtgtcgatgacaatgatgacggtgatggggtcaaataatggtggcgatgatggtggcgatggtggtggtggtggaatgatgatagtgacgctagtagtggtggaatggccaatcatcgatttaatttttaaaactatgggtggtggtatggtggaggaggtggcaataacaggtgtggtggtggtggttgtgaaggaataa

SEQ ID NO: 1952 - DNA, 428 bp, Glycine max
  Peptide Sequence Number=SeqID_93637
atgttgaattcagaggggtcttcgttgttcaagcctatcggtgatagggtagatgccttttggaaatggaacagtttaaaggataaaaataacaggaagagtgtaacctgtgatttttgtcacaaaacgactacgagaggaatttctagagcaaaaagacatcaacttcaaataaaaggagatgtgggttcttgtaaaaaagtaccggaggatgttaaattagaaatgattgctgcttatgagaagaaaatagctgaaactgcagcatacatggaggcaatgcaagaagaagacgaggaagaggaagatgggatcctagagattgcacgacttaaaagtggaaaaaagcgtccaacaacatcaaatgaagcctccttaactgcttccaataagaggatcacaactaaaaaaggccccattgatttttt

SEQ ID NO: 1953 - DNA, 525 bp, Glycine max
  Peptide Sequence Number=SeqID_93638
atgactgacaaagccagaaatcctttcagtttagatttggagaccagcaaaaagctatttagggtggatctcttgaagaataaatttggatttgatgaagccttcaactacaaagaagaactagacgtcaatgctactttgaaagggtactttccagaaggcattgacatttactttgagaatgtggggggcaagacactagatgccgtgctcttaaacatgagagtccatgggcgcatacctgtctgtggcatgatatcacagtacaatcttactcaattagatggtgtaacaaatttggcaaatctcatatttaagcgggttaaaatggaaggtctccttgtaaatgatttctatcatttgtatcctaagttcttggattttgtcctgcctcatattagagaagggaaagttctatatgtggaagacatagctgagggccttgagaatggccctgcagccttggttggtctctttagcggccgcaatgttggtaaacaagtgcttgttgttgctcgggaatga

SEQ ID NO: 1954 - DNA, 807 bp, Glycine max
  Peptide Sequence Number=SeqID_93639
atggggcataccaactattgtggctgtgaggcgtatatcggaacaaatgtgacgcaggatagtggacttgaaagctacaaatggggagctgctgcactagcgcatatgtatgagaatttgaatgatgcgtcaaagagcacgaccaggcaacttgtaggatatatcacacttttacagtgttggatctacgagcacttttcttttgttagttctgctagtgctactaaggattatgatgagaggaaaccatgtgtctgccgttggaagtctgggaaggcattacgagtatccatgtatcataagcatttggatagattgacgtctgatgctctgtgctggatttcgtatggtgactaccatgcattcagagagtttgagtttgggtatctacaaaccattcccccacaccctgttgttgcttctctatgtataaaagacatcgatgatagatggattcatttttctaaatacattgcacttgtgggtcagatatgtgtagcgcttggacagtgttcaccatactacatggagtggttctatatgatatctcatccattcatgagtcaagcacagcctggggatcctcctagacatccgcccgcaacggctatggatgaagcacccgaagatgcacatgctgatgaggcttgccaagcaatagttgaaaggttggaaaggctgctcaaccaaagcatagtgaccaaaggaacagaagcatacattgtcatcgaaaaatgcgtgaggatcgcaaaggtgtcagtaagcaacgaaatgtctacgtttgatcaagacgaaggtgacgtatga

SEQ ID NO: 1955 - DNA, 297 bp, Glycine max
  Peptide Sequence Number=SeqID_93640
atggctcaactctcccaaggaccctacatttcatctacaaggcccctcgggttgcagtccctcactgttggagatatcatagatcatcaaagaaaggaatcgcgagtttctttggcacaaaattttttatttgaatggctatctgtgcgcaagaagaaccacacgaacactttgcctcctcaagttgcagctacttatgtatggaaccccccacatacaggttcacttaaatgcaatcttgatgctgatcatttcattaaccaaacacaagtttggtatcgggttttgcattcgtga

SEQ ID NO: 1956 - DNA, 399 bp, Glycine max
  Peptide Sequence Number=SeqID_93641
atgaatgaagaattgagaagggaaataaggaaataccctctaacttgtcaaagacttgtcccatcgtatggacatcaaccaactgaaacaagtattatgacacgttctccagacaagataaagagcatcgatggctcaaaagaaactcttaaacttagtgtgaggatcagtgatctatggtttattggcacgcctaacaaatctgagcaagctgaaatggtgtttgtggactccgatgggacatcccttttagaaaatacaggtttgctggatgttgtggctggccaatttgaacctggactattggttgatgttattggtgttgtggaggaggttgtctttcgccaagtttcaggaaaaggtagaagggtagtcttcaaactaaaggactttacgtaa

SEQ ID NO: 1957 - DNA, 309 bp, Glycine max
  Peptide Sequence Number=SeqID_93642
atggagaatgaagttcactgcgaacaacaagcttttattcaaaaactgtcggtgttggtgaagttgcacttcaagcaacttgtcgccccccaccgtgcccatagaacttactcattaccggtgatagcaagttcaagatctccaactttagcctctttacggcaggcgcaaggcgaaacaccacaacagcctggggatggccaacaacaggcaacaaatgcaccgccgccacctccagagccccttagctcatccacaaaatggcgtccagctcaagacgttaaagaagcgctactaggaggcaaccta

SEQ ID NO: 1958 - DNA, 432 bp, Glycine max
  Peptide Sequence Number=SeqID_93643
atggcttcaagtgctatcacgcaagattttaactctgttagccaaaaccattatactagccactacaattacaatgtatcaacttcagatgaatccatagaactagaatttgactctttagaagattgtgatttggatatcagtgaccaaaacattgattttactaacaatcatgtttcaattcaagtactctcaaaaggctatttagatattgggaatccaataatgcagtgtaaacaatgccaagcaatgatgtgggataaattaaaagatgaagttgttcttgatgttaaattgaagctcatttctaataaagagaatgatggtagaatttacaatataccaatagtctctgaagttgctgcacttattactggagattctgacataggtttgacacgagatatcattcttgaaacacaaactgaatag

SEQ ID NO: 1959 - DNA, 177 bp, Glycine max
  Peptide Sequence Number=SeqID_93644
atgggtaattctccagcagataacaagttgaagggaagggagaatgagatcagtggagcgctgggcatgttggcaggggggtgttgggatcccacatcaactagagatatgatcaatgtagtcctgataaggcttaagcattcctcaccttataagctagttttatggatgagttag

SEQ ID NO: 1960 - DNA, 516 bp, Glycine max
  Peptide Sequence Number=SeqID_93645
atgtggttgaacatgtttttaaaaaatccttatacaagaggcttcttggaaaggtttcaagaccaagggttatgtgaggcccaagtgaccataaaggaagagatcgaaaccatatctaaaagatttgaggaacttgatgtttgtggcaaagttactctcaagagtaaacttcgagaaattgcataccctgatcaaaactctatgtgtccttctccgtcaaagggtttcattgacaacattgtggatgtgaaagcggatgataactgtggatatcaatcgatttccgctttattaggtatgggcgaagattcttggtcgttggtgcgcaaccaattgattaaagaacttgacaaatggtccgatgactatatcaacctcttcggtggcacaaaaagatttgaggaattaaggtggtccctacttgttgatgggttatccaaggttactatggataagtggatggaatataacgaagatgggatatgtcattgcatcaaggtacatgaagataggtag

SEQ ID NO: 1961 - DNA, 1764 bp, Glycine max
  Peptide Sequence Number=SeqID_93646
atgggtgctgtttggtttgtcaaggaaagagcgcatgaaactcctgatggggaagcggttgccagaaacatgcagattggcaaccggccggacgagggtggtggccgaaaaagaagaaaaaagcgttggataagatacaacgagaataaatgtccacctgaagaagggagaaaggatcatcaaaaagcagaagggggacggttttcgttattccctcaacttggctctagataccatgggattatggtccttataggcagtctgataggaattctttatacaagcaatttgcggataacctacaccaatccggtcatgtttatcgctgcttctgttctaatgaggtacttttggaacttgcttcaagtgaatgtgttgctctggactggaccttgtctacatgtgtttgggaaggaactagagaaaatgaaggaggatgctaaactaaagcaactgcctccagtgtacacaggtaaatgggccagtgcaacaaatgaggaagtagaagaagagctagcaaaaggaactccttacacttaccggttccgagtccctaaaggaagtttaaaaattaatgatcaaatacgaggcgaaccttacccttgcatatgcaaagaggctgtttccggattcgaacccatgaccaataagtcaccaaggcacaactttaccgctgcaccagggcttaggtggaaaatagacttaggtggtttgggcattgtcttgaaggttagttggaacttggatacgcttggagattttgtgataatgaggagtaatggtcagcctgtttataacttctgtgtaacggtggatgatgctaccatggcaatttcccatgttatcagggcagaagagcatttaccaaacactctaaggcaggcattgatatataaggcactaggatttcccatgccttattttgcacatgtttctttgattttagctcctgataggagtaaattatcaaaacgacatggggcaacatcagttggtcagttccgggagatgggatacctaccggaagcaatggtgaattacctagcattattaggttggggcgatgggactgaaaatgagttttttacacttgatcaacttgttgaaaaattcactatcgaacgtgttaacaaaagtggtgctatttttgactcaacgaaattaaggtggatgaatggtcagcatttaagagcacgtccgtcagaggagttgaccaaacttattggagagtactggaagacatctggcttactcacagtatcagatgggtcctttattgatgaagcagttcaactacttaaggatgggattgacttgataaatgatgcagacaaggccctagctaacttactttcttatcctgtgtattctactttacagagtgatgaagcagaatctgtcttgcaagataatctttctgaatttgctgctagcctcttggctgcctatgatagtggtgatctggtagcagcacttgaagaaggccatgccggctggcaaaagtgggtgaaaggctttggaaaattgctaaagcgcaagggaaaatcgcttttcatgcccctccgacttctgttgaccggaaaaatccatggacctgacatgggggcaagtgttgtattgctctataaagctgggactagcaatgcagtagctcctgatgctggttttgtgacactggatgaaaggtttaaaatactcgggcaaattaactgggaaacattgtccaaggaccaaactgtcaaagagactgctgatcctgtctaa

SEQ ID NO: 1962 - DNA, 264 bp, Glycine max
  Peptide Sequence Number=SeqID_93647
atggtggccaccactttcagaacctcgttctcttcctctgttggtaccaacacaatttataatgtgataaactatggtgctaagggagatggcagatcagatgattcacaagcctttttaagagcatggcaaagcacgtgtggagcacaaggagcagcaactctacttataccaccaaacagagtattcttggtgtcaagcttaatactaaagggtccttgctccgccgcaattcaaattcagactgggatgccgatcgaataa

SEQ ID NO: 1963 - DNA, 663 bp, Glycine max
  Peptide Sequence Number=SeqID_93648
atggtgagggatcctctggatctgaggcggtatgcgaaaactgaggacggtgatgacctaactcaagcattggtggaggaaatcatagagaaatgtcttggtttcgaagttgagcagaggagtttggtgctcattttcaagccacctgcatttttttttggcatactggcacacccatgttactctaatacatttcactatgaacttgagaaaaattggggacaaaatcttactttgatgtatgaccgagtcctaagataccctgatcatgtcagaaatttgtatttcacttttctctttgttctgcgagcagtaaccaaactactttacaaccccaagcttcaagctgcatgtccaattccatttgatgaagccaatttgtggaaaggccaaagtggacctgagctaaaacagaaaattcaacaacaatttagaaacatcagggctttgttgtggcttagtctcttagaatgtgaaagagtgaggtcagagttgccagtagacgaagacaatcgtcatcagctgcaaaggaatgaggtaattgcattgacgaaccttctcaatcgactctcggaatccttcaaattcgtccacgaagtgggacctacagttgaaagaatcatggaaggaggacatttttctgctcatacaagaactgattag

SEQ ID NO: 1964 - DNA, 729 bp, Glycine max
  Peptide Sequence Number=SeqID_93649
atggattgtagaagctcaagcttatctcctccacctagtcagttgcactcttttactaacaagagtgcaacacatgttcatgtgttagatgaagcttctaggaccacgacacggcagattggggggtacctcactttattacagtgctggatctacgagcactttccgagcgtgcatcagtgcgtcactgataatgcgtacgaggagacatccccacatgtctgccaggggctgatgatgaaagctcatatgaagggaattacaggagcgtcgtaccgggcacgttgcgacactttgacggtcacagatgtgtgctggttgccttacactgaccatcgagaggttagggggtttgagttgatttcatcgttccaggagagggtggtacgccagtttgggtacattcaaaccatccctctgtcgcctattagcgcttcattgtcatatgatgatatagatgacaggtggatgcatttctcggaccacgtagcagctacgggtgagatttgtgtagtgcctgggcaggtgatgagcctaaacatccacctgccccagagcatgacgaatgattacgaaggctataaagcgatcacagaaagcttggagcgtgtgctcaaccttaggatgatcacggaaggcacagagttatatgatatcatggaagattgcatcaagatcgccaggggaggtgccagcgcagatggaactgttagggctcgacaaagatga

SEQ ID NO: 1965 - DNA, 301 bp, Glycine max
  Peptide Sequence Number=SeqID_93650
atggctagaacacgagatttaggtcgtgccataggtagacttgtaggcagagatagacctgatgaccaggatgctgctgatgttcccgagaggcgtaggcttactgcctcagcccgtaggctacaggtacatcagatgactgcggagggacgtgatatggctgaggacgttgctgacatgactaaccatgtccctgagctggctgcggaggcacctgagatgcgtgcggacgtacagggtgctgatggtggtgaggggtcagatggtgatgatgctgctgagggattccctggtggtccag

SEQ ID NO: 1966 - DNA, 2142 bp, Glycine max
  Peptide Sequence Number=SeqID_93651
atggggaaagtggcggtcggaaccgcggtggtttgcgcggcggcggcgtgtgtcgcggcggctctggtggtgcgccaccgcacgaggagctccggaaagtggggtcgcgcgacggctattgcgaaagagcttgaggagcagtgttggaccccaatttcgaagctgagacaggttgctgatgccctggacgttgagatgcacgctggtcttgcttctgaaggtggatgtaagctcaagatgttgatcacttatgttgataatctcccttctggggatgagaaaggactcttttatgcattagaccttggtggcacaaacttccgaacccttcgagtgcatttaggtgggaaggagaaaggtgttgtcaaaatagagtctgaagaagtttccattcctcctcatttgatgactggttcttcacaagaattatttgattttatagcatctaaacttgcaaagtttgttagttctgagcctgaagagttacaccctccccctggcagacaaagggaactgggttttacattctcatttccagtgaagcaaacatccatagcatctgggactctaataaagtggactaaaggtttcaatattgaggatgcggttggagaagatgtggtgggtggactaaccaagtccttagaaaaaattggtctggatatgcgtgttgcagctctagttaatgacacagttggaactgtggctagagctagattcagcaatcaggatgtcattgctggagtgattcttggtacagggacaaatgcagcttatgtagagtgtgcacatgcaattccaaaatggcaaggtcttctaccaaaatcaggagagatggttattaacatggagtggggtaatttctgttcctcacatcttcctctaacagaatatgatcaagctctagatgcggagagcttaaaccctggagaacagatttttgagaagatagtttctggtatgtatttaggtgacattgtaaggagagttttgttgaagatggcggaagaagttgacttctttggagatactgttcctccaaaattgagaattcctttcgttcttaggacacctgacatgtctgcaatgcatcatgatacatcttcagatctgaaggtggttggaaacaaattgaaggatatattagagatcaataacacatccctgaaaacaaggaagattgttgtggaactctgtgatattgttgctactcggggagcccgcctttcagctgctggtatttttagcatcctcaagaaaataggaagagacacagtaaaggacgggaagaaacagaaatcagtcgtagcactggatggaggattgtttgaacactacgctaaattcagaagttccttggagagtacactaaaggagttgttgggtgatgaggcagatgagacagttggcattgaacattctaatgatggctctggaattggagcagccctcctggcagcttctaactcccagtggaccaagtccactgtgaagttatttttagggctgtgttcttcttgctgcaaatgcaacattgctgcttctccgccaattactgtggcgctggtggcgcgccaccacatgagaagctccggaaagtggggtcgcgtggtggctattatgaaagagtttgaggagcagtgtgggacctcaattgcgaagctgagacatgttgctgatgccatgaacgttgagatgcatgtaggccttgcttctgaaggtgacaacaagctcgagatgttgatcacttatgttgataatctcccttctggtgagtttctgcttggtttttcatattatctctgtgaatctgaaaaagtttccattcctcctcatttgatgactggttcttcacatgaattagttgattttaaagcagctaagctcgcaaagttcgttagttctgagcctgaagagttacaccctccccctggcagacaaagggaactgggttttaccttctcgtttccagtgaggcaaacatcaattgcatctggaaatctaataaagtggactaagagtttcaatattgaggatatggttggagaagatgtggtgggtgagctaaccaagtccttcgaaaaaattggtctggataagcctgttgccgctctaggcagtgtcacttctctttctttttaa

SEQ ID NO: 1967 - DNA, 210 bp, Glycine max
  Peptide Sequence Number=SeqID_93652
atgaggccttgtagcgcccccaggaaggcgcttccatggagcacgcgatacgtggcacagcgcggcgcgagacagcagcagggtagcgcccctgatgcgggcacgtctggtagcgccctgccgctgagcgcgactggtagtgcccagcgcgtggcgcgactggtagtgcccttgacgcggacacgactcaggcgtctatgtattttttaa

SEQ ID NO: 1968 - DNA, 843 bp, Glycine max
  Peptide Sequence Number=SeqID_93653
atgaagactagcgtgggtcttatgttcaaggattccattaaattgttgggagttgatagcttctacagagaacaaaaacacgacaatcaactctcctatgttggtgatgacaccaagatcctcgctgtcgaccactccgttaagttccctgccttcctcttcaaggtcgtcaccctctacgactccctgccacaggacctcaccttaaagtaccagccctccgacaaagacctcaacgccctcatctatgtcaccaacgacaatgaccttaaacacatgatgcacgaatatgttagactttatcaccctaacctaaaacctaagaccagggcttttgttgcagctttgaatgcagaggttcgtcgcaccaaaggtagactcatggatgagcttcctaaactacaaaaacggatgcacaagaaggttcttgttctgacattgccagagagaatccaagtaataccaaatggtatttatggtgctattgttcaaactgcaggatggaccgctacctcatctcaatcgcatatcaagtttgattcatcagttcacctcagtctacctaactttgattttgggttgggtggttattcatatatgcatctaacaggactaacaagagatgggttgagcaagaacttcttccatagaccttcaaaggcttacacaactgggataagaaagaggagaaagattcaaaatgaatacgacttgcaaggtgcagaaacccggtggcacaagactggtaagactaggctagtgatggtgaatggaaaacaaaagggttgcaagctgtcagctaattgcaaattacaagttgcaatttgtcagctttgcacctga

SEQ ID NO: 1969 - DNA, 1398 bp, Glycine max
  Peptide Sequence Number=SeqID_93654
atgtgcgaatcaaaatcagagcagaggcatgatgataaggaaaagcagaccgaagaattaggtggtgtgttaacaagacgttcgacaataatgtgggatgtgataggagaagcgaaatccctgtgggagttggcattcccgacagcactcactggtctcattttctacgcgcgttccatggtctccatgctgttcctcggccacctaggagacaccgaactggccgcaggttccttagccatcgccttcgccaacatcaccggttactccgttctctctggtctctccttaggaatggaacctctttgttcccaagccttcggagctaagcgtcctaaactcctctctctcaccctccaacgctgcgtcatcttcttattattctcttcaatccccatttcgctcttgtggcttaacatgtctaaagtctttatcctactccaccaacacacacacatcacccaaatggcacaaacctatttagttttccttctccccgacctcgtcaccaactccttcctccacccaatcagagtctaccttcgcgcccagaacatcacccacccggtaacgttagcgtccctcgccggcactctcctccacgttccattcaacttgctcctcgtccagcgcggcctgcccggcgtcgccgccgcctccgccgcctccagtttttccattctaagtctgctggtcctctacgtgtggatcacgtggggtccacctggccacgtggaccgcgccgagccgggatgtggcgttatggtggaccccactgccagcgtggcggctatggggattttactccagacgacgtcgttgatctatgtcttcccctcgtctctgggatttgcggtttccacgcgcgtggggaaccagcttggcgcgaacaggggtccacgcgccaggatgtcggcggtggtagcggtgttcttcgccgcagtgatgggcttctccgcggtggtttttgcgacggcgatgcggaggaggtgggggaggatgttcaccggggacgaggggattctgcggctgacggcagcggcgctgccgattctggggttgtgcgagctcggaaactgcccgcagacggtgggatgcggggtggtgagggggacggcgcggccgaacgtggcggcgaacgtgaacctgggagcgttttatctggtggggatgccggtggcggttgggcttgcgttctggctcgaggttgggttctgtgggctctggctgggcctgttgtcggcccaggtttgttgcgcgggcctaatgttgtatatgattgggaccaccgattgggagtaccaggcctgccgggcccagttactcacggcccttgatcaaggatccgacggccacaaacaaccgttgcttgccgctgtggacaacaacaactcttga

SEQ ID NO: 1970 - DNA, 252 bp, Glycine max
  Peptide Sequence Number=SeqID_93655
atgacgatctcggactcgttcaccgttgtgaaatttgagcactacgtttgcagtccaattacgagcattctcaccgttgggaatttggatatcatgtttgagctgagagaaatacctttcgcattgaagaaaaaggaatcgaatgaagacagtacaagtggagacttcaatctcttctccgtctctctgacgtttgggaattctatcggagcagtcgggggaataactggagggatgtcagggaaccgctag

SEQ ID NO: 1971 - DNA, 177 bp, Glycine max
  Peptide Sequence Number=SeqID_93656
atgaattggagaaatgataagttagagaggaagggagaaggattaggtgttgtgaaagaggaaggagaaagtgagaaaggaagggaaaaggttgggggtgtaggaaaaagggaggagcaaattgcaacgggcattccaagcccaaataatgcaagcaagtccacatgtcattcttaa

SEQ ID NO: 1972 - DNA, 330 bp, Glycine max
  Peptide Sequence Number=SeqID_93657
atggagaagtctgataagaaaaatttcaaagacaagaaagcaaagaaagcttacatcacttgggaagataacaatatagattcatcaggagattcagaaaatgaagttgtgaatctaagtctcatggccaaaaactatgatagcgaagaagaggatttcttgaagaaaagttggtatattgatagcggatgctctaaacacatgacgaaagatgcatcaaaatttactcatatatctcccaagaaaagtggacatgtgacttatggagacaacaacaaagatttgaaaaagatagattatgtgatgcatgtcaaaaaggaaaacaagtaa

SEQ ID NO: 1973 - DNA, 108 bp, Glycine max
  Peptide Sequence Number=SeqID_93658
atgaacagaaacacaaggtgtagtggcatgacggtggccatcaagatgaagagtagggtcgagatcgagagaatgaagaagatgagcatgaagaccgaagagaagtga

SEQ ID NO: 1974 - DNA, 165 bp, Glycine max
  Peptide Sequence Number=SeqID_93659
atgtccattgcccaagctccattggagcttgtaggcttaggatcttcttcatcaatggattcctttgcttcttggaagatgaatggcatcggaatggagaaggaagagagagaggagatgccacttcaaggagaatatgagtctagaagaagctcaccaccatag

SEQ ID NO: 1975 - DNA, 1924 bp, Glycine max
  Peptide Sequence Number=SeqID_93660
atggatgaatgtttttcggtgtcaagtgtgataacctcgataagtgtaacaattgaaggcgcgtgcaacacacgagcaatacccttgcatacgtgtcactcgtggagtgagcacgtactagagtcgtggtgcatggaggtcatttccattggtggttcctcttcagaggatactcatcatggtgcctcctacaatgagtcctcctctttgtacagggtaaaggcttcccgccatactggtgagggcacttcttgccctcgtaggagggcgcgacctttcgctgcttctggggagcttgtcccaattactatgatcctccccctttctgcttctgggggagtgaggagaggtagtggtggtggacatgtcagggtgtctccctatgtgcgatgtagccataaccctgggtcgccattgtgcatacctgttgtcgctggctatgagtgggtgagggatgccattttgaaatataagtcctctctcacctttgcagcgagtgtcgctactcttcaatgccaggtgaagctggcaagccctgaggactcctacaagtatctgtttgaggtcttgggtctcattatccctttaaactcgttcttgtgtgctcttcttaagcacttgaacatggccccttctcaactccacccaaacagtttggccatggtgagggcatttgaaattttgtgccctttcttcaacatccaacctagtgtgtcggtcttctttttttcctttcaaatgaaactgactgacaagattggttgggtctccttgaacaacgtgtccaagaagctgtttgagtttgactcgaacgtctttttccgctttaaggaccatttctttaaggtcttggctactgatgtcgtggctgatggtttcccactgatgttcaacaggcatggggagcctcgcttcccattctaccggcaatctgaccctaccaggtttaagtcgtttgataaggatttatggacccttgtggaaagggtcgacaaagctattttggagcagctatcgacatcgttggacctacgggctattttgtctcttcccttgacgagctatcccctcgctgccttggacgataaagtcagacctgtaggtaggactgtgccaccgtttgttgttgctcccgctgaagggggtcaacctactggtccctataagccttcgtgccctaaggtagggtgcaaggttgacgcctggtgcgggtcgccctatgattatgcagatgtgccttcggctccaccggtcgtcgaggctcctattgctgatataactactcctgatccttcacctcatccttctgtacctattctggaggtctcttctattgttgttgttgttaatgtgccaaccacttcggctggtcctgtcgtggtttcatcgtcccccgtcaattcatacttgttgagtgttggtttggcaactgctagtgctcctttaatgtcacctcctccttcttcagctccattgattccaacttttggtgtattagtgatgctgatttattgtggggcacaagttacaggagaatggacaacgacaccaagaggctttgcacaaggtggcatccttggaagcggaggtcaaaccaccaaatgtcttccaagattagtggtgtctttgtcaagttgctacgcacaaggttggacggtgatgaactgtttgcgcgacaaggtggaaagcattatggtggagagggatgagcttgcgaaggctgctagggagagggagaccaacaaggagcatgaggaggagtttctcgtttacaagaaagaggttgtggagcagcatggaaagggcttcaacaaggccgaacttgacttgggtctttttgacccattcaaggacataaaggatggtgttttgcttgatgaggtagaaactattgcggaggaggaggttgttgttgaagaacaag

SEQ ID NO: 1976 - DNA, 873 bp, Glycine max
  Peptide Sequence Number=SeqID_93661
atgaaagttcaaatccagatcactggagctaaacaagtatctgaggcccattctgctaccttgcatcaccagatcatatatagattgcagaaccatgctattaatatgtctatgcctaccagtcatgaaaatgctctctttgtcttggctaacaaccaagaagaaaccccatctattgccactttcagaagatctgtagatgggcttgtgacctcaaccttcaagggtttagatggagccagtagcaataactctcctgaggtttttcattccttgatgataaagcctaaagtcaaagaagacagcaggatgtcgatatttgcagtcaaagcagatggaagggtgatacatacggataaagtggatggacactttatttgggatattgctcctgaaatgtgtgattcaaattgttcctctgatgaacaagatagaggcacatacgacgagacaaatgatgaggatgaagggttctggaagccagaacccaggccttattctagagcagaatccgatgactttaaagagcaaactgaggaatcttcgatagaagcagaaaagtcttattctgatgaagatgaagaagctgggtatatggacatctcaaacattttgatggcttattccacagaagagccattctatgactcccccaaagaagaagaaccattgataaaagacttggatagacacttccaaagaatgaatcagagattttatcttctcaatggtctcaatgatcctagtctaaagaatacttatgtggcttcattaccagaagaaataaaactagagttaaacaaaatggtagcagctgctcagatggatttttctacaatgtccatgggacaaattcatcaattcactctagag

SEQ ID NO: 1977 - DNA, 432 bp, Glycine max
  Peptide Sequence Number=SeqID_93662
atggcagtgcagttgatccatgatcgcgttgtgatggagtgcctagagggtgattgggaaaccctcgaaggcaatgagaggtgccgattctgtggcacaattcgactcactgctacttcattagtacatccggaggaacccgcacacacacttcagcagcctgtggagtggatactacctacacctactccatatcaactagttgagccagttcaagtgatagaggtgtcatcctctgaagaagatcttgaagaggacccagaggaattacctcctgaacctgctgtggatgcccttgatttcccagaggatgatgaggacccactccctgatgttgattctccagaggatgttatgtcagcatctgacgcagactctacagaggagagcggccttggagggacaacgaataatgacgactcttcatcgtag

SEQ ID NO: 1978 - DNA, 251 bp, Glycine max
  Peptide Sequence Number=SeqID_93663
aggaaatcaagaaaacggtgtgggattgtgatggagataaatgtccgggactggatggatacgatttcaacttcaagaaattttggcatgttgtaaagggtaattttgtaaggatgggacaagagttccatgcgaatggagtgttccctagaggaggaaaattggtggcaaagcttctatccaagaggatgaatgatgtgaaccttactagaagcggatcgcttgatacaggtcacagagttttgggttga

SEQ ID NO: 1979 - DNA, 204 bp, Glycine max
  Peptide Sequence Number=SeqID_93664
atgacgtcttttccagttttgccgacgttttcctcaaataaacgttggtggcgactccgcgcatattcctttcttggaacacgcacccgcgagtcacgcatcgccctcccgccgaaggacaagcgtgctccagaacacaatgtttgcttaaaggtaatggaaggaggtcaagaggttctgaaagagtataccagccaatcttga

SEQ ID NO: 1980 - DNA, 93 bp, Glycine max
  Peptide Sequence Number=SeqID_93665
atggcgaacacttcttgtcccattcagttggagcctaagacactaaatcaagtgcagttcactcaagcaagggttatcatttactactgctaa

SEQ ID NO: 1981 - DNA, 927 bp, Glycine max
  Peptide Sequence Number=SeqID_93666
atggatgagccatggctgaaatgggtttctattttggacactaatgactatcatttatccactgaatgtgacatgaactctgttgaagaaccattggagggagagaattcagtggatcctggagaactctcatgggaaaatcactcccctaattcatatctcacaaaagaaagaaccacccttttgagcaattcttcatctttggaagagatcaacactagctttgatatgacaagtctcaaacaacatgcttctccacagaaaccaaagtcttgcattctgtcttttgaggattccacttcagtgccaattacttccaagaaaacttgccaattatatcatggtgaacattcaaaggagacacaagaagagctacccaatagaaaacccctcaagagggatacaagctttgatcacataatggctgagagaaaaaggagagagaatatcagcagactgttcatagctctttcagcccttattccgggcttgaaaaagaagtgtttgttctttagaaataatcctattcgaaacactatgatggacaaggcttctgttctttacaacgctatagagcatgtgaaatatcttcagcagcgtgtaaaggatttggaaaaagataacaagaagagaaagacagaatccgtaggatgtttcaaaataaataaaaccaatgttgctgacaacgtttgggcatgtgatgataaacctatcaagatatgtcccaaagttgaagcaagagtctcaggaaaagatgttgtcatcagagtaacgtgtgagaagcaaaagaacattttacctaagctactggccaagcttgaagctcataatctctccatagtgtgtagcaatgttttgccatttgggaattccgctctcagcattaccagcattgctaaggaaaaggataacacttctctaaagtaa

SEQ ID NO: 1982 - DNA, 189 bp, Glycine max
  Peptide Sequence Number=SeqID_93667
atgataacattctcggttttgcaggcgacttggacgcaaggacgatctcacgcaatcggagaatgccgtagaatgatagggtccgagacagcgcgttctgcaaatacagaagtccatgtctctgtgagacacattttaagggaggcaaaggctcctgcagatgctctttcgaaaatgggaatgcgttga

SEQ ID NO: 1983 - DNA, 537 bp, Glycine max
  Peptide Sequence Number=SeqID_93668
atgaaggctttcaaagattgtgttgctaaagtgggtgatattaataccaagatggatagaggatatgtgaattgtcctactaatgaagaatgggataaagcaaagttgaaaattgtgaagcacaagttgtatactttatacaatgagtatgttaagttgtattcgcaaaaagaaacaacctgcaatgttgcttcaagtcaaagttcatcacaagggacttcatctgttaatacttttgctagtggaaagtcatcaacatcacaatggcttattatgaatgagtttatacaatatgagaatgaaactttgtcagatgtggataaatctcatctagacacatatttggaagaccaaaaactttcttctcaatatcatccaaatttggatcttttgcaatattggaaggagaataaagctaggtttctagaacttgctttgatggcttttgtaggaaaagaagatgaaagtgtgcagattgagaaggatagtgaagctacatcaaacatggagtcaaatgttgtgattggaaatgcttga

SEQ ID NO: 1984 - DNA, 363 bp, Glycine max
  Peptide Sequence Number=SeqID_93669
atgccgtgtgcgaagctcagaacctcgaagctgacatccgctatgtcgttacctgcctcgttggatcgtcgtgccgtagcctgccttgtcgtggttgcctgtgtcgcggttggttgttttgcattgtgccgtgctcgccccgccatgccctgctatccaagcaagatctacattggttactctttgtgtgaaaaatcatattttgatgcctttgttgctttccaagccaaattgccttgtggggtgtatagccagccttccaccgataacaaatctaccactaacaacaaggtcaactttactgctattgaaaatggtacccgggttgttgaagcaccctcaagtttatttatgcataaataa

SEQ ID NO: 1985 - DNA, 264 bp, Glycine max
  Peptide Sequence Number=SeqID_93670
atgactatcatcacctccactgccatgaccatcattgtcattgtcgttgccgccaccatcactgtcaacgccaatgatggtggttgcgaaaatgacaatgacgattatggtgcaacagcgacaaaggtcatggtggtggaggtggtggcggttgatgacaacaacagtgatgatgacgacgatcatggtggtagttgtaacagtgatcatggtagtgacaatgatagtcatagtgatggtgatatgttaattgagatattttag

SEQ ID NO: 1986 - DNA, 171 bp, Glycine max
  Peptide Sequence Number=SeqID_93671
atggagatgcagtggaagacaaatgagaagagctcaaaagatcaaagaacaactcaagtgaatcaagaacaagtcaagagttcaagaatgaagaagaattcaagactcaagaagaaagtctacaatcaagaatcaagattcaagaatgaagaaaagactcaatcaagataa

SEQ ID NO: 1987 - DNA, 286 bp, Glycine max
  Peptide Sequence Number=SeqID_93672
atgccaattttagaattatacataaaaaaggatgttgttggtggttctgcgtttcattatacaaattctgttagatcatgtggacataatttatctaataatgagacagaatcgccaaggaatgtaaacaatttacatgaggatgaagatgatgatgattatcttgtgtctaattcatatgttgaagactctttagatgaagatgatagtgttgatggtatatctaatatagatgatgaagtcgctcacatggttcaaccagttacaattgttcaaccaagagaag

SEQ ID NO: 1988 - DNA, 363 bp, Glycine max
  Peptide Sequence Number=SeqID_93673
atggtgatccgtaagaagaaaaacaagcaggggcaattttggcatttaatagctttgctgggtgcaccagcaataatgctgggtgcacctagcaacactcaatccttaaaccatcacgggggattcggccttcttccattccttgacaaacccatcagtagaaaccatcttgagctttggtgtggtcgtggtggtgctagcggcatgccggtgacagtgctgcttgggactcgactgaagggcgaggcagggtggcatgacttggatttggatgggggaggggggagtctcaaggaaaggggagagagtgtagggatttggttagtgagcaaaaggaaaaaggggaattgcataacttggtag

SEQ ID NO: 1989 - DNA, 189 bp, Glycine max
  Peptide Sequence Number=SeqID_93674
atggagatggaagatcatgcgctcaaggaagtccttgtagacaccaaggagcacgaggatgttatggtgtactgggaacttgacctcaccgacgatgtggcggtagtggcgaaggaggagttggagatgaaaatgacagaagataagggagaagaagatgaagaaaaaaaaatttatgacaatttttag

SEQ ID NO: 1990 - DNA, 444 bp, Glycine max
  Peptide Sequence Number=SeqID_93675
atggctggagacattgattctaggaagtccactttgggctatttgattaaatttgtagagggttgtgacttggcagtccaagctgcaaaggtgacccttatgggatcatcattgttcctttcggaatcgcatgatgagaaggatctaacgaaatacatcaatagagaagtcgattgggtgggagaatggattaagatccttggatcatgctatggtgtatatatgtacatggatgaagagacaaaggataagaccagattggatatggcaaggatactaataccagaggatgcttcctttccggagaactttgttgataatgaggtgtcaaaggaggatggtgatgtagctctatttggagcttgtaggccttgtatcttcttcatcaatggatttttttgcttcataaagatcaatgtcagcggaatggagaaggaagaatga

SEQ ID NO: 1991 - DNA, 288 bp, Glycine max
  Peptide Sequence Number=SeqID_93676
atggcacgcagcgtgtctgcttcgtgcccttattcaagggacctatatgggagagagctaaaatggcttttagtgataatccccaaggtggtcatatctctcttgatggtctctagagtccccagtggagtcgccaactgtcgcaacctacccttcagcgggagggcaacgcgtgactcgcaggtgcgtgttccaagaaaggaatacgcgcggagtcgccaccaacatttatttgaggaaaacgtcggaaaaactggaaaagacgtgatctacgaactttttaagtga

SEQ ID NO: 1992 - DNA, 243 bp, Glycine max
  Peptide Sequence Number=SeqID_93677
atgcaatgtggtaccgtttcattgaaaaacctcgtcgggcgcctaggagtacataacaagtcaaaccatacactaagaccagttggggtcacgctgttttgcaagaatgctccaaccatgtgggattggcacaagcttagaggatcactcaaactgggtgtatttgcctccaaggcctacactccgaagagtccattagggcctctccctcctgattcaggtccaacccagaaaacattttaa

SEQ ID NO: 1993 - DNA, 135 bp, Glycine max
  Peptide Sequence Number=SeqID_93678
atggtagcaggaaatgcaactatagaaaaacctagggaacaatgggatgaagaggaaaagaaaatggcatggatgaatattttggagtatcaaactgcaagaatgcaaaggagatatgggataccttacaagtaa

SEQ ID NO: 1994 - DNA, 294 bp, Glycine max
  Peptide Sequence Number=SeqID_93679
atgacagttgatcttgaatttcccaatactactgaaagctacaaactcttttcccagagggtgattgctagtgatatcaaggaatgtgtgtgccgtgctccagatactccatatgatgagagtgcgtattcaaacattccaatgacctcatatgagcttcctgatggccagacagttgaaattggagctgacagatttaagataccagatgttcttttcaatccatccctggttcagaaatacaccaaggcttcttgcaagagtaaaaggaaaaaggtgcccttaatgtactag

SEQ ID NO: 1995 - DNA, 549 bp, Glycine max
  Peptide Sequence Number=SeqID_93680
aatgatgaagggttttgcgtctttgtgggtattgtcatatcttacattatgatggtggaggaaactaaatcgatggaaagactggaagcaggtagggttccaatacatacctcaacaatgacactggatggtaggattttcggcattagcattttggaagaaatccctaaggagatcgcgaatttttgttgcagtagtatccatgatgaggaagatgaacactcatctgaggacatcgttgagggagatttcttggtggtgtccaaggtggctaatgtacgatatgatatgggaaaaggaagtgtgggtgctttaagtgggccaaaatgtggtcctcctaaaagggatgatgtctatggcatgagttctaaaataaaagttgaaggtggtctatatcaacaaaatgagggtgtttgtgggccttcaatagtcaaggataagcctattttggtgactaatatcccacaaagtcaagaagaggtggatgacgtgtggtgtgacaaaccattgaggattaagagtgtggctgtgaagtatttccgggactaa

SEQ ID NO: 1996 - DNA, 234 bp, Glycine max
  Peptide Sequence Number=SeqID_93681
atgtccaattacacggaagctaacttggaaggcactcaacatatggatttagggttaaaatttattgttgagacattagatgatatcctccaccttcatccaaagatgcgagactctggtgttctgctccatactgtaaaggtcataaccacacagtcgaagacggtagagttagagatgggaaaatgcatctacaccaagatgagaaacaatttcctacatgacatgttgtaa

SEQ ID NO: 1997 - DNA, 2643 bp, Glycine max
  Peptide Sequence Number=SeqID_93682
atgccaccgaaaacggcgaagcgagggtctgcgtcgagcttctcgaagaggggcggcagaggcggcaggggaaccctgaaggcttcacagaaccaacagcaacacgaacctgcggaagagaccgtgaaggtcgaagagaaacaacaacccgttgttgttgttgttgctgaggaggaacagcacacagtggtggtggaagaagagaaccctgctgttgaagagaaacggcttgtggttgaagagaaagaatctgtagtggttgttgaggacaaggctattgacatgaaccaaatggctcctgaggctgtggaagaagcgtcccatgcggctaatgggttgagcgtggcgaaaaggttttggttgtgtttacatttggttgtaatcaaggttttaaatggcaattgtggttttggtttcattgtgatcctatacattgcgggaaattggaacaaatgcggccagggtggtcacttgcggttgcagtttcgccacggaaatgtagtagctaatagcaggaaagctattgcacaatacgatgaagaggaggttaaggagtccatagatgaatatgagaaagatgaacgcttagatttggaggataatgatcctgagtatgaacctgaggagtatggtggagttgattatgatgagaaggaacttgaacaagatgagggtcatgaggtgggaaatgaagtagaagaagaagtggctgaagataatgtaggtgaagagggtgatacaggtgaggaagaagtcgaagatgttcacgatgaacttgagggtgaagaggagcatgagcatgagcatgagcatccagactttgctgatgttgaggaagaggaacaccgagaagttgtgaaggagaggcgaaagcggaaagaatttgaagtttttgttgggggcttggacaaggatgctactgagagtgatctgaggaaggtttttggtgaagttggggtggttacagaggtcaggttgatgatgaaccctcaaactaaaaagaacaagggatttgcattcttgcgttttgaaactgtggaacaagcaaaacgagctgtagcagagctcaaaaatcccgtgattaatggcaaacaatgtggtgtcactcctagtcaggacagtgataccctctatttgggaaacatatgcaagacatggacaaaggaggctttaaaagagaagttgaaacattatggagtcaccaatgttgaggatttaactttggtagaagatactaatgatgaaggaaagaaccgtggatttgcgtttttggaatttccctctcgttctgaagctatggatgcctttaagcgactgcagaggagggatgttgtatttggagttgataagcttgcaaaagtttcttttgcagattcctttattgatccgggtgatgaaattatggcacaggttaaaactgtgtttattgatgcattgcctccttcatgggatgaagattatgtccgggatcttctcaggaaatatggtgagattgaaaagattgagcttgccagaaacatgccagctgctcgtaggaaggactatgggtttgttacatttggcacacatgatgctgccgttaaatgtgctgatagtattacaggaacagagttgggtgagggacacaagaaggcaaaagttagagcaaggttgtctagaccactccaaagaggccgcggaaaacacagtagtcgtggggactatcgttctagtcggggatctggaatgatgacgaggccttcatggggccgacctgcacctcattcttttccttctcgtagtgtaagaggagttggaagccgtactcctcctgtcagatcagttagtgtgagagatagacgtcctatgatgtccataccagcaagaagtaggccagtgcctcctccatctagatcttatgataggagaccagttgctcctgcatatccaaaaagtagcatgaagagagattatggtcggcgtgaggatataccacctcccagaagtagagttgctgtagattatggctcaagggtggcttctgtaaggcgaccatcttacagggattatcctgcccgtggtcctggctacaccgagctccctagaagcacatctcgtgctgcaccaaggagaggctatgtggatgatgggtatggccaaagatttgaaagggctcctcctccacctcctccaccccatctaagttaccgtgaaggacgtcctcgagattatgatgctctgtctggctcaaaacgtccttatgctgctatagatgatcttcctccacgatatgctgatactggtgctcgccaatcaagagctcgtctagactatgactatggtgatagtgcttcgcagtatggagatgcttatggtgatagacttggaagatctagtgtgggatatggtggtggcagcagaagttctatttctagtcaagattcacatgggatgtatagcagtcggcagggcatgagttatggaggaggtggttcttttggtagtggtgatgttggtggcatgtattcatcaagttatggtggtgattacatttctcgtggaagtgatgttggtggcagctcatattcatcagtgtattctggaaggggtgtgggtggtggtagcagttatatgggtggtggtggttcaggatcttattattga

SEQ ID NO: 1998 - DNA, 384 bp, Glycine max
  Peptide Sequence Number=SeqID_93683
atgaatcacagaccaaaaagtgtagcaaacaaacctcagtatctgcaagattacgtcaaggaagtcctgcaaacaaacctaagtatctgcaagaatatgcaaggacttggccagaagtttaaacagccagcaggaactagtattgatttttcaacatttgaggagtctgagttattgaaagtaggggacatggatgtctatcctattgcaattaaagcagatggatcctccagcgaccatggtgattcaaaatcaaatgaaactccatcatctggtagctcaaactctcagataactcaagtagtgtttgagaaggagaaaggagaattacaggtgaaggttgtgaagcagatcttggtagcttatgtaatcatgttggaatag

SEQ ID NO: 1999 - DNA, 144 bp, Glycine max
  Peptide Sequence Number=SeqID_93684
atggtgtttttaggggtgtttaggtcaaagttggtggtgttgggctttatgaagcgtttgaatagctacgatgatcgttgggtgcgtgctgatgttttgggaggagatggtggggcactaaatgatggtggtggtgctgtctga

SEQ ID NO: 2000 - DNA, 447 bp, Glycine max
  Peptide Sequence Number=SeqID_93685
atggcacaaaatgattggcaagcaattgacattgacctaaaacgtgcttttgaggtgtttgatgaaatgcaagaggaagaaaatcagtttaaaaatattgaatgcatgttctatcacagcatggacaacaagcattggcataaagtaatcactactgagtgtagggaaagcatgcacaacaatatttttcctgaactttatttatacaccaatgcttaccttgtcattatacctgcgtactcgatgcaggcactttctttactcaattacattttagcgttaatagtcgctaagtttggatatagtgtttcatgggctggttcagctcaaatggcaggccttttgtttgtgtttggaggagccaccggcttaatgctagttattggcttgataaccatggtagtgttttatgctacatggcacccctctgtgtcctctccaaattaa

SEQ ID NO: 2001 - DNA, 367 bp, Glycine max
  Peptide Sequence Number=SeqID_93686
ttgtatcaactcaaaatggagatggggaggagatctccatgaccacatcaacaagttcaatcggctatcttccaaagctttggttcaaacgttgcttgtgggaagatcaactttgaatttggatgagcgagggaggaatcattcaaggagacatgatggtctaagaggaagatcaaaatcgcaatcgcatccacaacgagatatgagtaacattcaatgttactattgtggtgagaatgatcatgtgcaagtgaggtgtaaacaaatgaaggaggacttgaaaaaattaagagatatgaacaaagatggcgtcaactcccaagctaatgtagtaaaaagtgtgaaagatgaggttcatgcatattga

SEQ ID NO: 2002 - DNA, 387 bp, Glycine max
  Peptide Sequence Number=SeqID_93687
atggttaggaccagaggattaggtcgtgccttaggtcaggtcactcgcagaggtgtgggcagaggagatcatgatgattccgatgatgctccacagcgtcgacgacctactgcatccacacgaaggcagcgagtcgctgtgactgcggatcatgttgatgagccagtcatccctgacccagacgttcaggatgacccgatggaggcaccagctgctatggaggacattcctgtggacattcctgcggacgcaggcgcagaggtagctgaggatcagcctcagggatttccgggtggtccgagcgacccatctgtgcttacagcgtatgcggatcacgttgcttgcagcgagcgtcctgaattgaagttatcctcgcatgggaggaag

SEQ ID NO: 2003 - DNA, 297 bp, Glycine max
  Peptide Sequence Number=SeqID_93688
atggatcacctgatccgtaaacagcccagcaacttcccaatggcggtttccgccatcgacggcaacaatggaggaagaagaagcaacgcgaaggagaaacgtacctcgaggaagaagctaagtgtccaagatgaagcagaaacgcgaagaagaaccacaccaccgtcctacgcagaaacgcgaagaagaaacgcgaagaagatgccaagaagcagaaacgccaagagcagtgaagaagatggaatcgcggcggcgcacaagaagaagattgaagaagcagagaatgaagaagattga

SEQ ID NO: 2004 - DNA, 594 bp, Glycine max
  Peptide Sequence Number=SeqID_93689
atggaggttcctttgtcttatcatagacaatggtccccaaattatccaaattatgtgttattcgactacgaaggagacaaacattttataaagcttcataaatatggtaaccgtttctattttggtgatggactcaaggaacttaggagaatccatggcattcacgaaagtgttctcatgcggtttgttggaagggacaaaaatactactttcagtgtggacattgtgggacctctacaccaaagggcagccccaaccataaggcaccatgtttttaccattgatgtctctgaagatatgatacaacaaaattatcaattggttctgccaccagaggcttcaatttatttaactgcatcaaaaaaatatatggttgtggatcgtggtagtggtaggcataaaaaatggatgatcaccatgaacaatggcctatcatgtgttactgacgcatggattcattatttaggtgactgtcatttgaaggctgaagatgaggtcatctttttctacaacattgaccaacatctatgggaggtcctctataggaagcaggttacatgggatgacacagaggatgaagctgactccccttga

SEQ ID NO: 2005 - DNA, 1989 bp, Glycine max
  Peptide Sequence Number=SeqID_93690
atggagaaaacagtacacatagcagtagttcctggtcctggctttagccacttggtcccaattcttcagttctccaagagacttgttcagctccatccaaactttcatgtcacatgcctaattcccacactcgtgtctcccccaagtgcctcaatatccatccttcaaactcttccaccaaacatcaacactatttttcttcaaccggtgaaacctgaggacctaccacaaggggctaccatagaaactcaaattcagctcatagtggctctctctatgccctccatacatcaggccctgaagaccttaacttcaaggactcgctttgtggccttggtggctgattcttctgcctttgacgcattagattttgctaaggagttcaacatgttgtcctatatttacctccccatatcagcaacaacactttcttggtacttctatgtgcccatgttggataaggagacatcatgtgagtacagagattttcctgagcctattaaaataccaggttgtgtaccaattcatggccgggatctcaataacatagttcgagatcgatcaagtgaagtttataaaacctttctccaacgtgcttggcgattccgttttgttgatggtgtcttaatgaataccttcttagaaatggaaacaagtcctattagagcattgaaagaggagggaagagggtaccctcctgtgtatcctgttggaccaattgtccaaagtggtggtgatgatacaaaagggttggagtgtgaaacatggttggacaaacagcaagttggttctgtcttgtatgtttcttttgggagtggtggaacactctcacaagagcaaatcaatgagcttgcttgtggtttggaattgagtaattataagttcttatgggttgtgagagcaccaagcagtttagccagtgatgcatatcttagtgcacaaaaagatgttgatcctctgcatttcttgccatgtgggtttttggagagaaccaaagagaaaggtatggttgttccttcatgggcaccccaaattcaagtccttagtcacagctcagttggagggttcttgactcactgtggctggaattcaatccttgagagagtgctaaagggtgtgccattcatcacatggccactgtttgcggagcagagaatgaatgcggttctgctatgtgagggtctcaaagtgggagtgaggccaagagttagtgaaaatggcttggtgcaaagggaagaaattgtgaaggtgataaagtgtctgatggaaggggaagaaggtgggaaaatgagtggaagaatgaatgagttaaaagaagctgctactaatgcactcaaagaagatgggtcttctacaaagaccctttctctgttagcactaaagtggaaaagtttgttcttacaagagcaaataaccgagctggcttatggtttggaattgagtaatcataagttcttatgggttgtgagagcaccaagcagtttagctcgtgatgcatattttagtacacaaaaagatgttgatcctatgcagatcttgccatctgggttcttggagaaaaccaaagagcaaggtacggttattccttcatgggcaccccaaattcaagtccttagtcacagttcagttggtggattcttgactcactgtggctggaattcaacccttgagggtgtgctaaagggtgtgccactcatcacatggccactgtttgcggagcagagaatgaatgcggttctgctatgtgagggtctcaaagtgggagtgaggccaagagttagtgaaaatggcttggtggaaagggaagaaattgtgaaggtgataaagtgtctgatggaaggggaagaaggtgggaaaatgagtggaagaatgaatgagttaaaagaagctgctactaatgcactcaaagaagatggatcttctacaaagaccctttctcaaagaagatggtctacaatgattcttggcaccaatggatgttacatgtaa

SEQ ID NO: 2006 - DNA, 750 bp, Glycine max
  Peptide Sequence Number=SeqID_93691
atgaaacaagatgtaaacaagaatgcaaataacagaacaaggacaaaaacacaaacctggacagaatacaaagaaaaagatttggataggataaaaactgtatcaagagccgaagctctgataccagatgatgtgatcctgactaggagcggatcgcttgatacaggctacgaagatttggataatgccacttccaacgatgagccagtggtccctgcgacagaggctgacggagcttcggttgaggctgacgtatatgcaaatgagccaagggcaagaggtgatgtacatgacactggggtagacactcctacagacacaggcgcacaggctgttgaggatgagcctgagggatttctgagtggtccgagggacccatccgtgctgaccgagtatgcggatcacgttgcaagaagcgtatggacgggagagatgatgttaacgaattgtgtgttcctttatacttcaattaaggagcgtcctgagttaaagttatcctctcatgggaggaaggtccatagtttaggcaggtctgtccctgccattgaggggctagttgttgggacaggactaagtcctctgaccgcgtgttcgatagtgatcgaggccgtacccgaatcaaataaacatgaaaatgcagtaactaggaaggtgatcctaggtcgtttcccaacgagcaatgataaaccaaatattcataatacacttgcagtaacagtaacaattagggggggtttgtttgttttgtga

SEQ ID NO: 2007 - DNA, 267 bp, Glycine max
  Peptide Sequence Number=SeqID_93692
atggtggtcacaattcgatacttcaaaggctgctccagatcaagtcaagaactgaagtcgcaactggcagcattcttagcaagctcaaaatctaaagagagtcttgctcagaatctcaaagaagttctccaactacttcaacaggaagtggaagaagaaccttccaagaaggaagctgaatcatccgagactaatgatgaccaagaagatgatccattctaccagaatgaagatgattgttttggtatatcattggacgacgattaa

SEQ ID NO: 2008 - DNA, 378 bp, Glycine max
  Peptide Sequence Number=SeqID_93693
atggctgcccgcaaggctaaagagaggaaattgcctgactctacatgtggaaggtgtggccaaaccaatcataacatcagaagctgcaaaaatattggagttcctattaggccaaagaaatatgttgcaccaccaacttcaaatgaggatgaccacctactatctcaagatgagcaagctttgaatgaggctgaagaagctgctgctcatgttcaacaagatccggtggagattaatttatcccagcctaatttgtcacaagatagtgacatggagttggtggtccttgcaactattgttccaccagtagcaaggaataaactaaacataacaagagccaaacaaatgaaggttgctgataaagataatgcaatataa

SEQ ID NO: 2009 - DNA, 1275 bp, Glycine max
  Peptide Sequence Number=SeqID_93694
atggcgaaggttgaaagcagcagcagcattagcatgagcatgagccgcgtggtgctggagccccacgcgcagttcgacctcacggcccactcacgcgccagctccattcgatccctcgcaatcgcccactcgaaacgacaccatacgactcttttctacgttggaactcactccggaactctcttttccctctccgccgaagattccaactacaccgacgacgacgccgttttgcgcaagctctccttcctaagaagcgtttcggtcagcgacaccgccgtcgagtccatttcggtcatcgaagagttcgggaagcttctgctgctctccgatggggctctgttcttggtcgattccgagctctcaaatggcgccacgaaattgagtttccccaagggggtttcgttggtcacgaggagaaggttcaggaacaacggcggtggagaatctgagggtttcggttcaggtttaggttcaggttcgggtttagggttgtttcagaaattgagaatgaactcaatgaaggaggttgatgtgcagagtgagacaggtggtggatttgtttttgcagttgttgttggtaagaggctgattctagcggagcttgttttggggaataggaatgggaaaactgagagggatgatggtggtggtggtactcttgtgattttgaaggagattcagtgtgttgatggggttgttagtgccatggtgtggctcaatgattctatagttgttggtactgtgaatgggtacagcttgatttcctgtgtgactgggcagaatagcgtgatcttctcgttgccagacgtgtcacggccgcccaggttgaagctcttgcacaaggagtggagggtgctgttgttggtggacaatgtgggggttattgttgacccccacgggcagcccgtgggggggagtctggtgttccggcacggcttggacttggtgggggagattgattcctatgtggtggttgtgagtgatgggaagattgagttatatcataagaggcattgtggttgtgttcaggtgttgccctttggcggggaaggggttgggcgatgtgttgttgccagcgaggaagataggggtgggaggcttgttgctgttgcaactgctaccaagggttcaactcaatggataaatgttttattagggttgtggattaatggattgttgagtcgtggttgcagttgtggttttgttgtggtcctgacattgcgggcaaatgcagctgatgtggttgcaaatggggtcgtggattttttttga

SEQ ID NO: 2010 - DNA, 1629 bp, Glycine max
  Peptide Sequence Number=SeqID_93695
atggtagtgtgctatcagaaattaccttcagtggaacaaataaaagaccttctgaggaagaagaactataagggagccatatccttggtggaggagcttgagtcagaaggtgaaatgtcaaaagatttgctctcgtttgttcatgctcaagtgggatttctcttgctttttgacttacattttaaagaagcagtggaccacttcttgctttctgagacgatgcaaccttctgaagtattcccatttataatgcgagatccaaatcgctggtccttactggttcctaggaataggtattggggtttgcatcctccaccagcccctcttgaagatgtaatagatgatggcttgatgacaatccaaagagcttctttcctgaggaaagcaggcgtagaaacaatagtagatagtgacctttttctcaatccagcgaatagagctgatttgttggagtcagcaatcaagaatattagcaggtatttggaggcctgtcgagaaaaagacctaacggaatcagtcagggagggagttgatactctactaatgtatctgtatagagctttaaattctgtcgaggacatggagaggctggcttcttctataaactggtgtgttgtggaggaattggaacaaatgctagaagagtctgggcacctacggacacttgccttcctatgtgcaagtaaaggaatgagctcaaaagctgtgcatatttggcgcatcctggcacgaaattattcatccggcctctggaaagacccttctttggagaatattacacagaatagtggggaaaaccttatttctggcagggcaattgctgcagctgaagcttcaaagattcttgaggaatcatctgaccaagaattgattctacaacatctaggatggattgcagatatcagccaggttcttgcagtcaatgttttgacttcagacaaacgagagatccagctttctcctgatgaagttgttacaactattgatccgcagaaggttgaaattttacagaggtatcttcagtggttgattgaagaccaggactgtaatgatacacagctgcatacattgtatgccctctcacttgccaaatcagcaatcaaagcctttgaatccgaaaatatttctgagaatcttgatagtggaaatatagggacaagaagtttggccatgttgaagaactcaatctttaagattcctgtcagggaaagattacagatatttttgcagtcctcagacttgtatgatccagaagaagttcatgacttgattgaaggatcagaattgtggttagaaaaggctattctgtatagaagactggggcaggagactttggtcctccaaattttggctttgaacaatgagacagatgaagaactgaccaaaagtagaaacatgataatttgttgcaagagaatcgaattacgttgttcgacaccagttactgcacaagacggaagatcgttcaatgatttgatcaagaatgtgaaagataccaaaaggaggggcaaaagggtcttcttactgagtttccgggaccttggctcgcccaggctagcctctggcttgcctggggccccaagttacttcagcttgaaggaaccagctcgcctgttacttcaggagtaa

SEQ ID NO: 2011 - DNA, 120 bp, Glycine max
  Peptide Sequence Number=SeqID_93696
atggctgcggagttagggcaacagacggtggagctatccaccctcatcacacgtggtgctaacggttcttctggatctgttgtcttgtcttatatctcaaaagagaaactagctaactaa

SEQ ID NO: 2012 - DNA, 450 bp, Glycine max
  Peptide Sequence Number=SeqID_93697
atggaactccaacgactaaatgaaaatgaagaaaccgacaagaggaaacgaatcatagcactaaaagtctcctcatcaatgcaagaggaaaatgaagatgaagaatcagaagatgaagaagacttctcactctctgtgaagaagtttcacaaatttgtcaaaaagagaagaatcgagaggcatcaaaatttcaaccatggaaaaagattccaagaagattctccaattcttagatgctacaagtgcaaccaacttggtcacatcaaagaaaattgcccctcaaacgagcaatggcctgaaaagaatgagaagaaaagtcatgaagaaagaagatccaagaaggcatatattgcatgggatgacaatgactcatccgatggttcggagaaggagatcaaccttctatccaagaactacaagagcgatgagaacatctctcaagaagattaa

SEQ ID NO: 2013 - DNA, 312 bp, Glycine max
  Peptide Sequence Number=SeqID_93698
atgaaaaactggatgcggaattcaaaatgcgatgtctacctagaagcctacctgaatggtgcacactggcaaatggtggtcattttgcctaaggaaaatcttattgtctggttttgttccttgcataacaggccaaacaactaccttaaaggaataattaacagacaaaaaggaagcactgagtgtggctattacgtgatgtactggatgtccactataatcttaggaagtttcaggagtaattgggaaacatattttaatgatgttagaccattggaagcagagagattcaaggcgtttcgcatccagtag

SEQ ID NO: 2014 - DNA, 570 bp, Glycine max
  Peptide Sequence Number=SeqID_93699
atgatgaaattgcttctcaatataatgctggtggatatatacctcagcaagatggagctggagatgctgcttctcaatggcacctgtaattcaccaaagcagacctcagtgccacattggacagcctacgtgtgccacctatacacctcactaacgtcgtcacctgagaatttaatgacatggactattttgcaaaacttatgtaaagttagggactattatgaattaaaatttaagtcagggactaatatgcaaactgattgcagctttcaagaatgggtcactactagaaaagctatgttctacgctatcacacggtgctccacactcttgctcttgagagaattcattgtttctgaatttttgtttctttgcacttttgcggcaaaaagagatcctaatgatacagagaatgctatgcttggggcagtggctggttattcaacatttaacatcggttgtgacgtaaacaccgatattaaaacatacattttttacatcgtttacgactacaacaccgatgtagaaggtctaatttctacatcggtggtcaggacagtactgatgtag

SEQ ID NO: 2015 - DNA, 264 bp, Glycine max
  Peptide Sequence Number=SeqID_93700
atgcatacttacctatgtcacaatggcatgaccttaccggggggaacagacacccgggggagatcggcattgtggtcgccgggcggaatgttgctaagtagctacgtcatccatatctatgtaagagtggtcatgttggtgcgcatgatccgcactcgtctctttgcagtggcacgggtgaaatcttgccctggtatgcatagtagctgcacgataacctcctcctctagttgtgcccgcacagttggcactcctccaggataa

SEQ ID NO: 2016 - DNA, 210 bp, Glycine max
  Peptide Sequence Number=SeqID_93701
atgtggtaccatgtcagtgaaaaacctcatcgggcgctttgggctaagctcaccattttttggctaagcgcgtatcccacgctaagtgcagcttcagcgcgcttagcacgacagagaatctggcacaacaccaatatcaaggttgtgcgagatcagtgtgctaagcgcagcgattgtcttcagccaggctcagcacatgactggcgctaa

SEQ ID NO: 2017 - DNA, 303 bp, Glycine max
  Peptide Sequence Number=SeqID_93702
atggcatcaacgtttctcaccctaccaactcccttcctacacaaaactaatgccatcactttctctgacaagagaccctcatttttgcagaggagctctctgaagatcaatgcaattaccaaaaaatgggaacccactaaggttgtacctcaggctgatagagttcttgttcgtttggaggagctatcagataatattggtgccacttgtgcacatgtgaagtgctttaaaagatattctgaggtttcttcatacaatgtcctcagcttggttttctgttgtgtcagtgtcagtaaaaactaa

SEQ ID NO: 2018 - DNA, 1346 bp, Glycine max
  Peptide Sequence Number=SeqID_93703
atggcgaagctgaagacgagcattgattcatcgttctgggacttcaacgtggcgtcccctcagctgcacgaaggatgggtcaagtccgttccgggcgacccgtttccgttggacggctccgtcgccagcagagtgctccggccacgacagctctccgtcatcggaaacgggttgcctcttcccgtcatcgttccctcgctctctcccacttcgcccaaggacttgggttccttctgtctccagtccctcctcctcaaactagctaatcctcgctggtggcttaccatgactggacagtttcgtcccaggaagctgattgctgatgttaaaaatgagatctctaatgctgaagaatttgatctctccacagtcaaggatgttgcgaagcatttcattaacaagtcactttattctttcgggttaacctcacaattcgcttttcctccttcaacatccttgctgcttgctatagaaggccatggtgaaaaagaaagattgcgcagcaaagtgatgcttcctgatcatgaccttacgttggaagcagcatggcctcaattatttgttgaccacaaaggaaaatattgggatgtccctgagtctttatctgttgatttgtcatcccttgtgtccgaatctggattgcgataccacattgggatgcataaaaacagtgttaatccccaggcaatgaatgcaaccaatggtaacccaccactgtctctactgccagggttatgtgcgaaggttgccgttagttatgagaagatcaaatacttctggagagataagggtgctgcagaacaagagaatgaagaggcgcttccatatgatgtagcacctttgcttcctggatttggaatggaaggagcttgtctagcattgattccagagaagatccagagggtagatgctcgtttagatatatcttcagcttcagcatttgcaaagaagattctgaatggttccagtagttcaactgcttatgttagtgaacaaccatcagcctcaccccggctgaatttaatctttcaacagcaggggattgagagaggctcatacagaacacttgatgagattgaggaagtggaggagcacttttgtaatgcctactttgcgaacggctatacgtgccaccatgacctctgcccccggaacggagatgttgcagggccagttgtttttcgagctgattcccggattgccctcgagtctttcgccaggaaaaacggtgtgtcagttgaggatttcatttgcagcctgagttactccttgaaggatcttgaatctggaaagatcgttgcttggtactctccaaaaagaaaagagggaatggttgagtttcgcat

SEQ ID NO: 2019 - DNA, 573 bp, Glycine max
  Peptide Sequence Number=SeqID_93704
atgggtgaagtagacgaggtgcaagagcggataaaggccaacatagaggcactaaaggagcaaatggccacaatgatgagcatgaaaaagataatggaagtcaatgtggctacagttgccgctaccagcgctgttgctgaggtggacccgacttccccatttggcctcaaccaaataaatcatccaatctcggatatggtagggcagagaggcaaagaattgggaagtacgggcgccccccattttgtgcaagttcaaaacaagcatcccttcccgccatgtggcttgcctcccaattatacaccaccccatgtggcacacactcccgatgagaatgtcaataactccactcccatactcattgagaaccaacaacctcaatctaatcatgcacgtgtctctcaacccatgagggaggaccatgaaataccccaccacaatttagccgacttcgagccttgcctcagatacgcccctgaggggcaagcaattggtggtgtatccctgccaaatactttggaaggccctcagttttgcccagaaccacaaccccttgcattatgcccttgctga

SEQ ID NO: 2020 - DNA, 294 bp, Glycine max
  Peptide Sequence Number=SeqID_93705
atgcattgtgtaattgattacatggttatgaagtttcaaaaatttgtcaagaagagaagaatcgaaaggcgtcaaaacttcaacgatggaaaaagatctcaagaagactctcaaattcttagatgctacaaatgcaaccaacttggtcacatcaaagcaaattgtccctcaaatgaggaatggcttgagaagagtgtaagaaaaggtatgaggaaagaaggaccaagaaggcttacattgcatgggatgacaatgacttatccgatggttcagaaaagaagatcaaccttctaa

SEQ ID NO: 2021 - DNA, 1111 bp, Glycine max
  Peptide Sequence Number=SeqID_93706
atgggtcagctccagcggcaagcttttcgcaaagcttacggcgaatgggcctcattcatagacattctcgcattgttgatcttcggaggagtcttctttccaaatgtggatgggttggtggatctagcagcgatcgacgcttttctcacctattatgaccacaaggaaagcccggttatcgctatgctagccgacatatatgacaccttcgaccgaagatgtgagaagaccagatttgcaaatgttcccttgatagggacaaggggttgcatcagttacaatcccgttcttgctataaggcaacttggctaccctatgagggtcaccactagaggaagagctcgcgcctgtcatttcatgaggacagaactcagaggcagtaacaatgggcccatcggtggctaccgtaagtggttgaaagcccacgtgcaaggtttggattggctcccgagtttgagaaccactaaaagggaggaagttgaggcaccggaggaagacgaagaggtgcaggcccttagggcagaactcgagcaagcccaaatagtcaaagaaaggttcaaatcagcagcttttaagatccgaaaggagaatgccaaactaagaggtataaatatagctaccaccaaggccttggaacaagagaccaagagggctcgcaaggaagagcatggccgtaacaaatttcatggagccttgtggggcaggaacagtgagctcaagcttcgaagggaagagagagaccaatcacgagcacatagcatggtcttgaaagaagagttagccgcttgctcaaggtacaaaaggaacttgtctcagcgtttatgcaagacagagaccaacatgttagctattgtcagcaaataccaagaagagctaaatctagccatggcccacgagcataaagtggcagacgagtatgcccaagtgtacgcggaaaaggaggctagaggaagggtgattgactcgttacatcaagaggcaacaatatggatggaccggtttgctcttaccttgaacgagagtcaagaacttccccgattgctagccaaggccaaagcaatggcggacacctactccacccccgaggagatccacggacttctcagctatt

SEQ ID NO: 2022 - DNA, 312 bp, Glycine max
  Peptide Sequence Number=SeqID_93707
actcatcttctccttgaagtggcgtctcctctctctcttcctttctccattccgcttccattcatcttccaagaagcaaaggaatccattgatgaagaagatcctaggcctacaagctccaatggagcttacatcaccgggcttaactctctcacagtccccagtggagtctccaactgtcgcaaccttccctccagcgggggcacgatgcgggactcaatggatgcgtcttccgaggaaggaaaacgtgaggagtcaccaccaatgtttattcgaggaaaacgtcagaaaaaccaaaatggaaagggttga

SEQ ID NO: 2023 - DNA, 378 bp, Glycine max
  Peptide Sequence Number=SeqID_93708
atggtacttggaagttggtacctcttccacctaacaagtccattgttgggtatcgatggcttttacactctcaaagttggtctagatgggaaaattgatggctttaaggctcacatggttgctaaaggttatacacagaatgatgctcagaaaaggttcataacaactgtcaaagttgagaatttagaaaaattcatggagctcatcagaatgatgaacccaccaaaccagtctcagaaaaacgacgatctggaacccgttcaccgttggatcgtcatgaaatttgagtatcatgttcgcaacccaattccgaacattctcaccgttgggaatttcaaaatcatatctgagcttagaggaaagcccttcgcattatag

SEQ ID NO: 2024 - DNA, 219 bp, Glycine max
  Peptide Sequence Number=SeqID_93709
atggagatgcaactgaaggcaaaggagaagaggagaggggagacaccatccactagggaatatgtagaagcaaagcttcatgatgatgacaaaggtgatgacaaaaagctcaaagatcaatcaaagaacaactcaagtgaatcaaagatcaatcaaagaacaactcaagagttcaagataagaatcaagaagaattcaagactcaagaagaaaatctaa

SEQ ID NO: 2025 - DNA, 249 bp, Glycine max
  Peptide Sequence Number=SeqID_93710
atgaatcggcttagcgcaaaaggcacgcttagcgcgctcatcgtgatttccagcaattactcaggggttttcaccccttttccagttttgtatggcacgcttagcgcaaggctacgcttagcgtgtccatatgatgtttgggttttaaagcccatgcgcttagcgccagttctcgcgcttagcatttcctgcagctcaaattggttttgcaatctgcgcttagccgccaatggtgggcttagtgcataa

SEQ ID NO: 2026 - DNA, 333 bp, Glycine max
  Peptide Sequence Number=SeqID_93711
atggcaaataaagtctcggagctgaatgtggagggtctggaagaaactggggctaaagctggagctggtacagatgaagctggagcatatggagctacagtagaagtagaaagagctgaggtagggaaagcagaagatggtggagcctcagacctcttgcccttagccttgctctcaaaagataacgaatcagaagtgactcctctggccttgcatagggcagtgatgagggcagcaaaaccaagccatgaggacctggccctatccaatgtaatatcagaagtgtgggaagtaggggccaagttagagaatgacaaaacactccaggtctga

SEQ ID NO: 2027 - DNA, 912 bp, Glycine max
  Peptide Sequence Number=SeqID_93712
atgaaggaaggcataggtcacatcttagacctcactcctataggagagaaaaggaaagaaagcctcaagaggctaacattaacctcccatacttccatggaaaggacaatgaagtctactccaaaatcttatggctctcattcttatccaaagaaagaccaaggtcaaggcatcttaggggtgacaccttctaagctcaaagatgatacgggaaagacaatagaaaagcaaccccctaaggctagtatgcaagagaagactagctttataaaccaagatgaggctactacttcaccttccgctagtgaaagtgaagaagaaaaaggggaagaatctagtgaagaaatctacccccaagaagaaggacaacctttaatggttaaggaggagtgtaaggaggtaagtgtctcctccaagagtttagctaagaaggaaagtcatttggcaataaagacaaaccttaaagaaacttcccctcttagacaacctccacatcttctcctttgtaaaaagacacttgttagcattgccacacctcttggtaaaaagacatttataggtgatatgatgaatgtgttgagtggtgcagcccttttttgcaaaatcactcatgcccctaacatcttcatgattcatgtacatagggattcattaggtaggaataatcaacatgaaaatacagaaagagatcaaggggttcccacataccctaagagaataaaggttattactgcatgtaagcacatcaacatagattacttgcaatacgttagtccagtgtatatattggattacatgtcaagtgtctacaaagtcccattagtaggtatgtgtcatcatgattactggccaccatatgaaggaccacaattttgtgccaatctagccatgaggagaaacaaaaaaggttga

SEQ ID NO: 2028 - DNA, 462 bp, Glycine max
  Peptide Sequence Number=SeqID_93713
atggcaagcagaaatgaaaatgcccctgccatagtctactacaatgcctatgtagccgattgtgacgagggcgttgagtttaagggcataaacaatgtatttgtttcaattaggagaggcatgaccttcaatgtcttgaaaacaaaaatccaacataagatgagcctaaatcgagttggtgacttcagtgacgacgaagatgaaattttggcagacaacaacaacaacgacgacaacgacgataatggcatacaattcatttttcagcaaacatcaactgaaaatgtctatcgtccatatccaaatagcgctgatgttggtgacaaccaagtgcctgacaaccccgactataggcatttttttggaccaaccctgaatatgtctatcgtccataccaaactaagatgcctttggcatattcatggaatattcctttccaatgtgctagagtcacacctttga

SEQ ID NO: 2029 - DNA, 618 bp, Glycine max
  Peptide Sequence Number=SeqID_93714
atggaagaagaattctctcttcaagagaagaatattacaatgaagatcatcttgcatgatttacattctccccctttctcaagcaaattcttaattcttcttgacatcatcaaaatcttcatgatttacacttaccgaatgcatgctagagctagagtaatgagtgaaatagaggaggtgcaagagcagatgaaggccgacatggaggccatgaaagagaaaatggcgacaatgatggaagccatgatgagtatgaaaaaaataatggagatcaatgcaactacagctgttgatgcaagtatcgccacagaagtggacccgactcacccatctggcctcaatcaagtaaatcctctcgtctctgatatagtaggacagggaggcgaagcgttaggaagtacggatgacccctattttgtgcaggttcagaacaagcattccttcccacaatatggcttgcctcctaactatacactgcccaatgttgcaccactcccaatgagaatgtcgacaactccactcccatactcattgagagccaacaaccccaatctgatcatgcacatgtctctcaacccatgggggaggcacatgaggcaccccgagaccataatctag

SEQ ID NO: 2030 - DNA, 270 bp, Glycine max
  Peptide Sequence Number=SeqID_93715
gggcaggatcatcttgggctaccttctggggtggggaccaaacatggacagcagaaaccaatcaaggaacggatgcaagtggggatggggtcacgatcgactgatcgttgccctttctctgtgctagacaagcagagaacgtcgctgcaaggcagccccgcccaagcaggagaggcgcccccagaagttcccggtgatggagaggaggctcacgaggacgaggagatggccgatttgcttgacttcttgggagggagtggagcttcatga

SEQ ID NO: 2031 - DNA, 702 bp, Glycine max
  Peptide Sequence Number=SeqID_93716
atggtcattgatacacgtggtgcacaagataagaaagcctgcactcaatgtagatgtgacaatatgaatctcccgaaggacttttataatgtcacaagggatatacataaccaaagattgactacaaattataaaggaggtctcttttgttgtcaggacaacttacaatgcaagcaaatagagggttttcaaggttcaaggagaatggtttccttaagatacaaaattagttgggttgattggaacatataccaaataccagttaaggtttacatacttgattccaccgacaaagtgaggtcaaatggttccaaaatacttcatgattgtctggcagagtataccattccagctggtggtggtggtgattctcctcatgtccaaaaagcaaacatcccaatggaaaatggaggttatctaatttatggcactgctcatatgcattcaggtgttgtaaatgcaactttatatggacaggatggaaggactttatgtacatcaacaccaaaatatggaacgggaaaagaggctggaaatgagaaaggttatctcattggaatgtctgtttgttatccacaaccgggttcaatcaagattcatgatggtgaaattttgactctagaatctagatataaaaatgagtttcgtactggagctatgggacatttctacatctatttggcagaggaactaccacaatga

SEQ ID NO: 2032 - DNA, 466 bp, Glycine max
  Peptide Sequence Number=SeqID_93717
atggcttctaggaaaaggaaagccacagcttccaggccccagcctcactacgatactcacagattcacctctgagtggaaccgctatgctgacaacattcttagtcggaacatccttccggaaaggagcatgaagctttttgtcacagagatgctgaccaacctcatggaggggagcataggtgtggctctcatgaaggaattttatgctaatctttatgtccttgagaataagtctccaaagcaagttagagtcagagggcatttaattaagtttgatgcggattccctcaacacttttctggagactctagttgttctagagccaggggagactcttcctgcttactccatgctctacagacttagaccagaccctcaggagctggctgcccaactttgtatccctgggcctgccatagaagctattgaggaaggacctcactactctggcacagacttggagc

SEQ ID NO: 2033 - DNA, 537 bp, Glycine max
  Peptide Sequence Number=SeqID_93718
atggctccgaggaagctttcctcgaagagatctaggaaggacgccacggccgaagggactagtgccgctcccgagttcgatagccatcgtttcaggagcgctgagcaccaacagtgtttcgaagccatcaaggggtggtccttccatcgagaaagacgcgtccagctcagggacgacgagtacacaaatttccaggaggagatagctctccggcgttggacgtcgctggtcactcccatggccaagtttgatccagatatagttctcgagttttatgccaatgcttggcctatagaggagggcgtacgggacatgtggtcatgggtaaggggccagtggattcctttcgatgcagacgccctcagtcagttcctgggatacccgctagtattggaggagggccaggagtgcgaatacggtcagagaaggaaccgggccgacggatttgacgaggagtccattgctcaactgctatgcataccaggtatgccgcataccaggcaccctctagacccagataagtctaacagggcactg

SEQ ID NO: 2034 - DNA, 363 bp, Glycine max
  Peptide Sequence Number=SeqID_93719
atggcttatgatagagaaggacgtcggtatggccacatgacaaccaacctctcagaatgtatcaataagggttttgaaggattgtcgcaacattcccataacagcgttggtcaaatcaacgtacagtattctgcacttcactatccatgttcacacattattgcagcttgtggttacgtgagcatgaactactaccaatatatagatgttgtttacacaaatgaacacatcttaaaagcttactccgcacaatggtggcctcttgggaatgaagcagctattccttcttctaatgacgcatggacacttatcctgacccaactacaattcgtgcgaaaggtcggccaaaatcaacaaggataa

SEQ ID NO: 2035 - DNA, 466 bp, Glycine max
  Peptide Sequence Number=SeqID_93720
ctcaggtgtggagtgtcctctcatactccaacttggcccttcatcgcatacctctgatttgacagttgacagagctaggctaatctttggcctagtatctcacttggatatgaacataggagcactgatctctggccatatgacctctatagcccaatctaacacctctagacttgggttccctgctttaatcaccgcattatgcagagccagaggggttgtctctgacagccttaccttcgagcgcctgagcccggtcattaacctagcctacatcaggaagaactgttggaaccccgaggatctaacagtctctatccgaggggctaggagggcgagggcaaggccagctgagcttccttctacatctgcagcttctactccagcatccacttcagcagccccttctgtcctagctcagacaaattctcagcactttgaagccatgctccaaagcattcattag

SEQ ID NO: 2036 - DNA, 450 bp, Glycine max
  Peptide Sequence Number=SeqID_93721
atgcccttcggagaagctttacagcagatgccactctactccaagttcttgaaaaggttgggagagttggagatcatgcccactaagatgactttacaacttgctgaccactccattaccagaccatatggagtaattgaagatgtgttggtcagagtgaaacattttatcttcccggcagactttgtgacaagcctgctcctaggaggttctggaggtaatggaagtgggtcaagaggttctggaggtaagaaccaaaacatgatatcacccattgagtgcaagcctcgcgctaagcgcatctttggtcatacgctaagccgcgagtctcaagcgcttagcactcaacccttgcatcttaggttgatttggtccgctaaactggccaaggctgagttaagccaatttcaatttgatctgaatttggctaagcgacagcctgaccgctaa

SEQ ID NO: 2037 - DNA, 323 bp, Glycine max
  Peptide Sequence Number=SeqID_93722
ggctttttccggaggagccctggtgcttaccaacatggatggcgaagagctaccttcacccggatttcctgtctgttgtatctctcgttacaatctttcaaagaaatgaacgtggattcgaggcttttagtcctcacgggcaggatcaccttgggctaccttctggagtagagacaaaacatgaacggcagaaaccaatcaaggtacttaaggacgaacgcaagtggggatggggtcacgaccgaccgatcgttgccccttctctgtgcgaaacaagcagagaatgtcgctgcaaggcagccccgcaagatgctaatccatga

SEQ ID NO: 2038 - DNA, 75 bp, Glycine max
  Peptide Sequence Number=SeqID_93723
atgggtgtaaaatgtggtatttatggtgccaattctgcagaatggattatgagcatgcagttttttccatcttaa

SEQ ID NO: 2039 - DNA, 399 bp, Glycine max
  Peptide Sequence Number=SeqID_93724
atgagggttcactgttatcaagcaagtcggagacccagcatgaccacagattcacctcaactccttttgttcccatggacctggtccccagtggagtcgccaactgttgcaacctaccctttggtgggagggcgacgcgggactcacgggtgcgtcttccatgggaggaaaatgcacggagtcgccaccaacgtttattcgaggaaaacgtcggaaaaactagaaaggtgtggtctacgaactttaagtgtgaaaggttcgggagttgtttttacgcacgcggaagggtgtttccctcgctcctacgtatccttaattgcgatgaggaaatcagaccaacgtagttccttgagaactaaacgttggttaagttgttttgatctttttccgcaagattga

SEQ ID NO: 2040 - DNA, 234 bp, Glycine max
  Peptide Sequence Number=SeqID_93725
atgacgtttcactcagcgccaatgcacagctcatccttcttccagattcttcctcgtgctcagccgaggagtgttgcgcccagcggttggctcgctaagccagtagattggcttagcgagaggatgaaaatcagcgcttcacaaactttcctaattaacctgaaattttttgcttgtcctcaagcaaataaagaacaactcactggtcccccaagtgacaaaaacatgcagtga

SEQ ID NO: 2041 - DNA, 264 bp, Glycine max
  Peptide Sequence Number=SeqID_93726
atggcgcctactaggcaccctttgtacccagataagtccaacagggccctggggtttccagcgctgatcacgggcctctgccagtcctacggagttcccgtcacccccagtaaggtaatccaaccgctaatcacccgagccttcatcgagaagtattggacgcctaggcaggcgcagggtgatgcacatcatgtcgcaggcacaccgccaccaacttggcaggccgatccagctgggccactgggcatggagcgttatctatag

SEQ ID NO: 2042 - DNA, 288 bp, Glycine max
  Peptide Sequence Number=SeqID_93727
atggctcctaaaaaactctccactaagaggtctaaaaaaaacgccccaggaaaaggatccagtgccgccccaaaatttgatagtcattgtttctggagtgccgagcacaaacagcgcttcgaggccatcaggggatggtcgttccacagggagaggcgtgtccagctcagggaggatgagtatacggactttcaggaggaaatagctcgtaaacgttggacaccactagtgactcccatggccaagtttgaccccgagatagtcctagaattctatgctaatgcctga

SEQ ID NO: 2043 - DNA, 390 bp, Glycine max
  Peptide Sequence Number=SeqID_93728
atggtgaaagttggaacctcttacgtgccgatccacgtctcattttcgccaaaagttggcccagggctccccggtgctccagtggcttctgtttctatccagctgtcccctccctgttcagctactgacggggtggtgcgtaacggcaaaagcaccccccggacatcagcgctggcaagtgtagcggtcacgctgcgcgtaaccaccacacccgccgcgcttaatgcgcccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 2044 - DNA, 381 bp, Glycine max
  Peptide Sequence Number=SeqID_93729
atgtcagtattattgaaccagcagacaaatgctgcaaccaattgggcattgtgttactggccgctccagtgtccaggcttggcaaacttccaacaaccattgcaatatggtttgcaacaagtgctacagcaaaccaccattgctgatgcagcctgcgtgtatcaaggtatcaggctggtgaacccggctggtatggggcagcgccaagaacatgatgtatcagaagcgccgcagattgatttgttagaagcgatgcgtctggccagcgcgcaagatatggttgcacgccaatatgtcgatggctatgccaccatcttttctgcagtgttgccactttaccgcgaactgataaggcgctgggaggtccagcctgggcactga

SEQ ID NO: 2045 - DNA, 420 bp, Glycine max
  Peptide Sequence Number=SeqID_93730
atgaacaagagatttacctttctttacacaacatgtagtgtaccttggacactctttcttcatgtgtccagacttcttgcagaagtagcagaaataaaaagagtagggaagaagaagacaaacccacaagagttttatactggtttggcaacaacccgtgcctacatccagttcccaagcgacctacggtccttgagatttcttttcaaccttgtaaaatcctttacaagcaaagatccacaagggatgtaccctcccttgttctctttgaactacctagtggatgcaccctccactagaactaatccacaagagatgtaccctctcttgttctcagtcacaacaacccaagtagatgtaccctctacttgtaccacaaaggatgtaccctccaatgtgttaagacaaagttctcaggcg

SEQ ID NO: 2046 - DNA, 317 bp, Glycine max
  Peptide Sequence Number=SeqID_93731
ggaatgatgagaatcatgaaactggccaaatacagactaaaggcccttgtggagaaggacgaaggcccaagtggagaaggacaaagcccccgagtggagaaggatgaaggcccagaggcaaagacactatcaagactattaattacttatcaaggtaatccttgtggcgtctaccctgacttatcttccttcaccggaagtggcgtctaccctgacttatcttccttcattggaagtggcgtctaccctgacttatcttccttcaccggaagtggcgtcatccaaaccttcgtagcctgtatcaagcgatccgcctc

SEQ ID NO: 2047 - DNA, 478 bp, Glycine max
  Peptide Sequence Number=SeqID_93732
tatggaaagaagaggaggacaaggaaatagacaaccaaggaggactcttggtgactatgcttatcaacaaggactaaagaattacaacaatatggttgtggagttgaagccagcactgcttagtttgattgactcacacccttttgctggaatagatcatgaggacccatacacacatttgtctaccttcatggagctttgcagtaccatgggagcttctgacaaagatgctaaagttgtcgaccttagagccttcccattctccttggtaggtactatgatgtctaagagcttggaggaagcaattgtaataattgactccattgcagccagtgattatcatagtcaccatgatagggctccaattcaaagaaaatgtataatggagctagatactcagaatgcaattttggctaaaaataaactcttgaatcagcaaatagaggccttaaccaaacagatatgccaacttccttaa

SEQ ID NO: 2048 - DNA, 174 bp, Glycine max
  Peptide Sequence Number=SeqID_93733
atggctccagatagaatgcaagtacaacacatgtgtaagagagacaatgaatctttcaaagaatatgctcaaagcaacaagcccaacagagattcctcaaccttcattgccccgaggatacaacccaaatgtgacatgtgcttatcacaatggagtcccggggcattccattga

SEQ ID NO: 2049 - DNA, 363 bp, Glycine max
  Peptide Sequence Number=SeqID_93734
atgactaaccgaggttacagcatgaacgatcggttggaattcattttaacagttattagacaagattacacattaaacaatctgttggaattcattttaacaatgatccccgatggtataagaatgaagatgaagacatatgttgaacccttccttcagcccccctcatgcctatttataggaaataagaggtggacatcgcacagcaactcgcccaggcgagctgttgcttcatccctaagctttctagtgggcccaggggctgaaaaatgtcccaaaagtgaccattttgcccttctattgaatattttgcgcatttccttctgtaacgtcacaaaaccctatggattgcacgacaattag

SEQ ID NO: 2050 - DNA, 366 bp, Glycine max
  Peptide Sequence Number=SeqID_93735
atgacaagaaacaagaagcgtttggtagttgaggatgaggatagggtggctttggagaaacaaattgttgtaaaggatggcactgagaaaaagaaagaagaggtaacagatgtgacaagtcaggagagtgaaaaacaaatagtggtcgaggagaaagaaataaacgaccaagaaaaagaaatagggaaagaaaagagtagaagtgagaaagcaagatgtggaagcaatgccttccaagattattttgatgatgccaaagaatcaagagtcaagcaagtttcaagaatcaagatcaagattcaagattcaagaatcaataatcaagaatcaagattcaagaatcaagagaagactcaatcaagataa

SEQ ID NO: 2051 - DNA, 648 bp, Glycine max
  Peptide Sequence Number=SeqID_93736
atggccccgaggaagcttgcctcaaagaggtccaggaaggacaaggcggtcgaaggaactagttccgctcctgagtatgacagtcaccgctttaggagcgctgtacaccagcagcgcttcgaggccatcaagggatgggaggagataggtcaccggcggtgggcatcactggttacccccatggccaagttcgatctagaagtagtccttgagttttatgccaatgcttggccaacagaggagggcgtgcgtgacatgaggtcctggatgaggggtcagtggatctcgtttgatgcagatgctatcggccagctcctgggatatccgttggtgctggaagagggccaggagtgcgagtatggccagaggaggaaccggtctgatgggttcgatgatgaggccatcgcccagttgctatgtataccgaggcaggattttgcccggactgctgcagggaggcgagtgcgaattatgcgcaccaacatgaccaccctgactcagatatggatgactttgctgctcagcaacatcctgcccaccgaccataattccgacctccccttgccgaagtgtcagctggtgtacgccatcctgacgcggatgagcatccatgtggctcagttaatcgcttatgccatctatatttaa

SEQ ID NO: 2052 - DNA, 390 bp, Glycine max
  Peptide Sequence Number=SeqID_93737
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgaggagttagtcttgaagtcatgcgccgggttaaggctaaactgaaagggacaagttttggtgactgcgctcctccaagccagttacctcggttcaaagagttggtagctcagagaaccttcgaaaaaccgccctgcaaggcg

SEQ ID NO: 2053 - DNA, 333 bp, Glycine max
  Peptide Sequence Number=SeqID_93738
atgtcagcagaacaactcttggagtttgcttggggtttggccaacagcaagaaaccctttttgtggatcattaggcctgaccttgtcattggagatcagccaacaaactgcagatatatctacaacgaatgggaaattgggattgaaattgataccaatgtgaagagagaagaggtggagaagctggtgaatgacatgatggcgggagagaaaggaaagaaaatgagacaaaagatcgtggagttgaagaagaaggcagaggaagccactacacccagtggttgttcattcatgaacttggacaaattcattaaggaggtgttgcttaattag

SEQ ID NO: 2054 - DNA, 297 bp, Glycine max
  Peptide Sequence Number=SeqID_93739
atgaagcttgcttctacaaaatctacacctgttgcaagagtctgtggtctatgttcttctgcagatcaccatacagatctctgtccttctttgcagcaatttggagtcaatgagcaacctgaagcctatgctacaaacattgataatagacctcctcaacagcaaaaccaacaacagcagaataattatgacctttcaagcaatagatacaatccagaatgctgctggtccaagcaagccatatgttcctcctccaatacaacaacagcagtcacaacaaagacaacaagcaactga

SEQ ID NO: 2055 - DNA, 391 bp, Glycine max
  Peptide Sequence Number=SeqID_93740
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggccgaaaccccgacaggactataaagataccaggcgtttccccctggggggctcccctcggtgcgctctcctg

SEQ ID NO: 2056 - DNA, 529 bp, Glycine max
  Peptide Sequence Number=SeqID_93741
aaggctgcacgccctcgccttcagaggacttcacgtcctcacctttagaggactacacgtcctcaacttcagaggactacacgtcctcgccgtcaaagggtcatgtaccttcacctttgtagggcgacatgtcctcaccttcagaggactgcatgtcctcaccttcgtagggctacacgccctcgccatcagaggactgcatgtcctcaccttcgtagggctacacgccctcacctttagaggactacacgtcctcgccaacagagggctgcacgccctcaccttgagaggactacacgtcttcgccaacagagggttgtacgccctcacctttagaggactacacgtcctcgtcaacagagagctgtacgccctcaccttgagaggactacacgtcctcgccaacagagagatgcacgccctcaccttgagaggactacacgtcctcgccaacagagggctgcacgccctcacctctagaggactacacatcctcgccttgagaggggctgcacgccctcacctttag

SEQ ID NO: 2057 - DNA, 147 bp, Glycine max
  Peptide Sequence Number=SeqID_93742
atggcctttgtggataactgggtggtgggtaaggagaagagtatcgataatgtgtctaccatcacgattatcgtctccctctccattattgggggtaccacctgggctgccagatccctccaccttttgggcgtgttctttgaatga

SEQ ID NO: 2058 - DNA, 204 bp, Glycine max
  Peptide Sequence Number=SeqID_93743
atgtcatgttggcacgctaagctcagaggccctttgggtgttacctttgcacccaaacctctacaccttcctaaccttaagcacttgtgtactttctactgcgtgtgtattgcttgcctgcatcttcattgcttcatttcaagaacaatccaaatgaacgcgctaagcggaccatgttgcgctaagcgtgttcatccctactaa

SEQ ID NO: 2059 - DNA, 406 bp, Glycine max
  Peptide Sequence Number=SeqID_93744
gctggccgatcgccgcggggcggtaccggcgctgacgctgatttttatcgcgctggccatactgttagtggtattccagttcaccgccagcatgcattaccccgcgctgctcacggtgctggtgatgggcgtctttgcctttgctaacgtacctggcctgcaggtttacgtggtgcaaaaggctgaacactatgcgccaggcgcagttgatgtcgcgtcagggctgaatatcgcggcctttaatattggcatcgcactgggttcaaccgtcggcggtcacatcgtggaacattacggtctggcgcagacgccatgggtgggtgccgtcatcgtgtttgcggctctgctgctggtccgcctcagcggccagctggataagccgcgcacggcagccattactgaataa

SEQ ID NO: 2060 - DNA, 537 bp, Glycine max
  Peptide Sequence Number=SeqID_93745
atggagaggagtatgattgatgctaccagtggtggagctcttggtgatatgacccctgatgaggctaggaatttgattgagaagatggcttccaactcccaacaattcaatgcaagaaatggtgctattattcttagaggagtccatgaggtggccatggattcatcttcatctactgaaaataaaaagtttgaaggaaaacttgatgccttggtcaacctagtaactcagcttgccatgaatcaaaaatctgcacctgttgcaagaatctttgtccttctttacagcaacctggagtcaatgagcaacctgaagcttaatgctgcaaacatttataatagaccccctcagcagcaaaaccaacaacagcagaataactatgatatttcaagcaacatatacaatccaggttggaggaatcatccaaatctgaaatggacaagtcctccacaacaacaacaacatgtccctcctttccagaatgctgctggtccaagcaagccatatgttcctcctccaatacagcaacaacaatag

SEQ ID NO: 2061 - DNA, 681 bp, Glycine max
  Peptide Sequence Number=SeqID_93746
atggatatgaactttgggtacctcatatcccaccagatctctcttactgcacaacatgattcatccagacttagactccctgccttgatcacagctctatgcaaggccaggggagtccaatcaaattctagatccttggagaacttttgccctaccattaacttggcatatattaaaaagaactgttggaatcttgatgatccaacaatgacatttagagggccaaggaaggccaagggtaagagatcagaggtccctactacttcagcaccaccagagacagcagctccttcttcttccacagctccagtacctcccattcagactccgagcttacacagggggcagtccattatcatgcagagccttcagggcttgggcttgccttccatcatgagcatggatgagtttgatttgcaggtggcctggccaggagcccagccttctccttctggaggggctggggcctccgcagcccaagagcctgaaccagaggagccagaggaggagacttccacagaccagatcccagagccatccctagcacccatacctgatgatgccataccatctgcaccagcatctgagttaaagcagcctatctctcaggattcaccagctactcaggtgttggatcttaatgagcatgcacaggagcaaccacaggagcaagacatttaa

SEQ ID NO: 2062 - DNA, 84 bp, Glycine max
  Peptide Sequence Number=SeqID_93747
atggtggatgactcactcccgcgcggcctgtctgggttgaagattgctcattggcagagagagggatttaataaaaacttctaa

SEQ ID NO: 2063 - DNA, 558 bp, Glycine max
  Peptide Sequence Number=SeqID_93748
atgaagaaatgggcccttgcagtcgatcagaacggtgtcgaggacactgtctgtgacaaatacgacatcagcaagaaaaagtgggcccagttttgccagactcgtagagacccttcttgggagctcctggctgagaagacaaagaagaagctgcaggaagctgcacagtcaggaagcgttgatggcgtcatcgaccctccatccccggtcagatgccacgtgaagtggaagatggcccgcacgaacaagacaggggagatgacgactgaggtcgcaaaggaaatcgctgagaagattgattcgtttgagaagcaggccacacagggatcgttcatcccccatggacatcaggatgttctagccgctgctattggacgtccagagcaccctggacttgtccgtgctgctagagccggtgtcaccatcaagcaatactttggatcggctccacggacgtcccgcagcgcttcctccctgcctcctgatgaattacagcagctgacccagcagatcagggatcagctagaggagtccatcacagagaaagtgacgaggtag

SEQ ID NO: 2064 - DNA, 639 bp, Glycine max
  Peptide Sequence Number=SeqID_93749
atggtagaagtctccatagaggccattgcttccctcgcccagtattatgatcagccgttgaggtgcttcacctttggggacttcaagctatcacctatggtagaagaatttgaagaaatcctaggatgtcctctagggggaaggagaccatacctcttctcagggttctatccctcattagctagaatttccaagatagtccaaatctcggcgcaggaattagaccacagaacgcaagtcgataatggggtggttggaatatcgagaaaatatttggaggcaaaagcaagaatcttggcaggtaaagacgagtgggccccgttcatagatattctcgcactgttgatcttcggaggagtcctctttccgaatgtggatgggttggtggacctagcagcgatcgacgcttttctcgcctatcataaccacaaggaaagcccggttgtcactatgctagccgacctatatgacaccttcgaccgaagatgtgaaaagagcaatacaaggattgtttgttgtactccagctctttatgtatggttagtttcacacctttttcgccaagaggtgaggcatgcttgcccgctagaaagccaccgttcatgcatagagaaaggaggggacaaggggatcctctag

SEQ ID NO: 2065 - DNA, 411 bp, Glycine max
  Peptide Sequence Number=SeqID_93750
atgaaactggccaaatacaggctaaaggcccaagtggagaaggacggaggcctaagtggagaaggacaaagcccccaaacttatcaaggtaatccttgtggcgtctacccagacttatcttccttcactggaagtggcgtctaccatgacttatcttccttcactggaagtggcgtcatccaaaccttcgtagcctgtatcaagcgatccgcccctggcgtctaccctgacttatcttccttcaccggaagtggcgtctaccctgacttatcttccttaaccggaagtggcgtctaccctgacttatcttccttcaccggaagtggcgtcatccaaacctccgtagcctgtatcaagcgatccgctcctactcaggttcacatcatctggtatcagagcttcggctcttga

SEQ ID NO: 2066 - DNA, 366 bp, Glycine max
  Peptide Sequence Number=SeqID_93751
atggggagttgccgtcctagtgcatatatgattcctccacaccgtacgggttcaagactgtgcttcaaagatattgacgacagatggatgcatttctctgactaccttgcatcggtgggccagatttgtgttgtgcatggacaatgtgcaccggactacatggattggttctacatgatttcacatccattcatgaagctggcacaacctggtgatccacccagacatccagctgtcatgcaagatgagacatatatggaaccagatatgcctaagtacccggtggcaacaatagctatagaggaagcacctgcacaagcaccttctgatgtggaacagcctagacatgtagtggaggcttgctaa

SEQ ID NO: 2067 - DNA, 705 bp, Glycine max
  Peptide Sequence Number=SeqID_93752
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcaggcgggcgtaatttttttaaggcagttattggtgcctagaaatattttatctgattaa

SEQ ID NO: 2068 - DNA, 863 bp, Glycine max
  Peptide Sequence Number=SeqID_93753
ccgggcgcggtgctgtgcgccattccttttctgcggccgcgcgatctgctcaccagccgcgccggcgaatccggcgcgcaaaaacagcaggcgctgcaggaagccatcgccgaacattaccaggcactgtatcaggcggcttgcgaacgccgcgatcggctgggcctgccgctgccgatcgtcgccaccggccacctgaccaccgtcggcgtcaccacctccgactcggtgcgcgacatctatatcggcaccctcgacgccttcccggcgcaggccttcccgcccgccgactatatcgcgctgggccacattcaccgcgcgcagaacgtcgccaaatcagagcatattcgctatagcggctcaccgattccgctcagcttcgatgaactgggcaaagccaaaagcgtcttcctggtcgatttcgccgacggcgccctgcagcaggtagaagcgttaacgatcccgcagttccagcccatgcagctgatcaaaggcgatctggccgagatcgaacggcagctgcagcaatttgccgactatgccggcgagctgccggtgtggctggatatcgaagtggcgacgcaggactacctcagcgatatccagcgccgcatccagctgctggcggatgagctgccggtggaagtggtgctgctgcggcgcagtaaagagcagcgccgccaggcgatcgcacagcaggataaggaaacgctcaacgaactgagcgtcaacgaggtgttcgaacggcgcctggcgcaggaggccgacatgccagaagcgcgccaacagcggatgcatcaactgttccgccagggcgagtggaaaattgacttcaccgccgagccgttcgccagcaacggcct

SEQ ID NO: 2069 - DNA, 99 bp, Glycine max
  Peptide Sequence Number=SeqID_93754
atgaacgatagagctctcagagcgacgcacagagaagttgacggagagctcacgatagttaccatgatggatatccctggtggaggaaagagtggttag

SEQ ID NO: 2070 - DNA, 738 bp, Glycine max
  Peptide Sequence Number=SeqID_93755
cgaggtttaggtcgtgccataggtagagttgtaggcagagatagagctgctgacgaggatgctggtgatgttcccgagaggcgtaggcctactgcctcagcccgtaggctacgcgttcatcagatgactatggagggacgtgatatggctgaggacgtcgctggcatgactgatgatgtccctgagcagcctacggaagcacctgagatgcgtgcggacgcacagggtgctgatagtggtgaggggtcagatgatgatgatgctgcagagggattccctggtggtccacgtgacccgtcagtgctgacatcatttgccgagcatgttgcacatgctgtgtggagtggacaagaacgtcctgatttgaagttagtgtcacatgggagaaaggtgacactgattgggaggccagtgtctgagattgaaggcctggtggctgccacaggattaagtccactgatagattgttcagttattactgacaatcctggacttatatctgcatttgtggagaggtggcacaatgagactagcaccttccaccttcctgtaggagagttgacgatcacattggatgatgtgtcgtccatcctacatttcccatcactggcgccttgcacagtttccacgctctttctacggaggaggccagattcttgcttacggagttgttggaagtgtctgctgaggaggccagagccgagacagcactcacacgtggagcatatgtacgattag

SEQ ID NO: 2071 - DNA, 459 bp, Glycine max
  Peptide Sequence Number=SeqID_93756
atgaccaaacttggtctctgcttgtcatcgggcccgccgcctctggatgacaaaaaggtgcgaataaccataaggtatctccgcgtatcatgggtgcagactgaccaaacttggtctctgcttgtcatcgggcccgcccgcctctggatgacaaaaagaatgaccaaacttggtctctgcttgtcatcgggcccgccgcctctggatgacaaaaaggtgcggataaccataagaatgaccaaacttggtctctgcttgtcatcgggcccgccgcctctggatgacaaaagggtgcgaataaccataagaatgaccaaacttggtctctgcttgtcatcgggcccgccgcctctggatgacaaaagggtgtggataaccgtaaggtatctccgcgtatcatgggtgcagaatgaccaaacttggtctctgcttgtcatcgggcctgccgcctctggatga

SEQ ID NO: 2072 - DNA, 844 bp, Glycine max
  Peptide Sequence Number=SeqID_93757
agctttctttgtagcagttgtggtggatagcaacaacttcacactgaagaccaccttgaaaggaactgagattctaatctcaaaacaactccttactgatcttttgggagttcctactgatagctctaggatctatgatggttggtgtgaaatcatgggccttagaaagaccaagatcataaagatatttttgaaggataaggacaatgacttcaaaaagattcctcttagcctatcccatttgatcatcaatcagatgatcaaggaaacctctagtgtaccttgtaggatgctaatgaccctagttttgaggcattttggtgtattcttggaggatgagaccaaggatgatgaggaagatgctgaaaataaggaaaaggagaagaagaagaagaaaaaggcaaaggagaagaaagaaaagaaggacaatgtgtctaccaagagatcctcaccccttttcattgagcttatcagaagtgggaagaggttgaaggttagggctagaataagccctcagtccaattctgaggaggtctctgaacaaaatgaaaaatttggtgatgaagataaggtaagctttgaggaagttcaaaactctgaagaagaaaaaccttctgaaggccattttgagggagctcaggatgaggaagaaaaggaacaatcccctcaaggtgaggaacaagtgtcgaaagcggtcccttttaagaagccactggactatggctctttttatgaaacctcaaaacacttttctatgaaagagaagaaggatgaggaataccattttgagcctcaaaatgaggtactatcagtcgatgaaggtggtcaatctgctcagaattaa

SEQ ID NO: 2073 - DNA, 386 bp, Glycine max
  Peptide Sequence Number=SeqID_93758
atggctggttgtgaaaagggtagtacatatgggcttgggaggagtgatggggactcggcgttgagaggaacgaggataagggctacgtgggagtacgtgagctcagttggaggtgggcaacaggggatggtggtggtacctggagatatgttgcggggatcagaagaccttggggacgtcaggcaagctcctgacagtcaacagataaaaggaacaaagaccacaaagcaaggaggcttgtgtggtggctggccagctgtgaatcttgagcaagataaagtgtcaagtgatgaattgaagttgaaggatccacgatgtcggatacaatgtcctgacatcttgctcgataatactggaagtgctgtacaatgcaagataaaagtcaa

SEQ ID NO: 2074 - DNA, 99 bp, Glycine max
  Peptide Sequence Number=SeqID_93759
cctaaatcaaaggctcctgctaggtgtattgtcgtcaagtattttaacgatcctagaccgttggagccagagagattaaaggcgttgcggatcgagtga

SEQ ID NO: 2075 - DNA, 722 bp, Glycine max
  Peptide Sequence Number=SeqID_93760
atgacatacaagaacatacaaaagggtgtaagtgtgtgtgtatgtgtctttgtgtgtgatgagggtgtgtgtgtgtgtgtctttgtgtgtgatgagggtgtgtctctgtgtgtgtatcatgaggattatggaaatctatccactattgctttaagtgtgaaggaccttgttagtgtgaaagagagaagggaacgttttctgcagggtttaggcttagttgattcttctgccaaggtttgttcacaagaaaaaatgagcttagatgagtcatctatcagcttgggattggagaggatcagggagtgcagtggggcattctcaaatgcttgcattttgcttactgatgaagtagtatttgagaagttgattctctctggaggcaaagcaggttctaaagaaaaaatctctttggatgaattcaaagggtgtcctcaagatgaagcacaagcaaacattcaaggaaaagagcatgagttgttttatacacctcaagagcacagacccagcgaaggtgtttcacaagaagaatttcaggatttttatatcagtaaaagaaagaggaaaaactggtggaagcggtttgtcaacatcaggaaaattcgtgatggaaatcacaagctggatttcaaggataacaggtcagtagacccacagagatacactttcagcctaacagcaacaaagcctattagtttggaagacaaaaggaagcttggtgaagg

SEQ ID NO: 2076 - DNA, 222 bp, Glycine max
  Peptide Sequence Number=SeqID_93761
atggtagtggaatggagaaggaagaaagatgattggagacgccacctcaaggagaagatgagtcaagaacaagttcaccaccatagtgataagatgaatggcaacggaatggagaaggaagagagagaggagacgccacttcaaggagaagatgagtctagaagaagctcaccaccatatgaggccatggataagagcttggaggaagaaggagataaatga

SEQ ID NO: 2077 - DNA, 830 bp, Glycine max
  Peptide Sequence Number=SeqID_93762
tgtctattgaagccattgcatccctcgctcaatattacaaccagccgctaaggtgcttcatgtttggggactttcagttagaatcgaccgtggaagaatttgaagagatcttgggatgcccgctaggaggaagaaagccatatctcttttctgggttatacccctccatggcaagaatagccaaagtggtcaaaatctcagtgcaagaattggaccaagtaaaacaaaatagaaatggagtgatcggaataccaaggaagcacttggaagagaaagcgaaggctttggcggatcaaggtgaatgggtttcgttccttgatgtcttagcgctattggtgtttggagtcatcctctttcctaatgtggatgggctagtggatctagcagcgatcgacgccttccttagaggcacaaggattgtctattgcacacccgctctttatgtttggctggtctctcacctctttcgttatgaaagtagactcgtcagtcccctacaaggtcaccgtctgtgtgccgagaaagggaaagcaaattgggagcaactcttgcctgataaggagcttaggggaagcagcaatgggatcgttagcggctatcacaagtggatgaaggctaaaaggcaagagataacctggccgctgaagctaaagatcacatgtgaggaagaggctgaaacccctgaggagagcgaagaggtgcaagccttgaagcgagctcaagcttcgaagggccaagagagaccagtcgagagtcaaaggtatgatattaaaggacaagttgaaggcttgtcaaaggtcaaagaggagcttgtccgaacagttgagtag

SEQ ID NO: 2078 - DNA, 777 bp, Glycine max
  Peptide Sequence Number=SeqID_93763
atggagttctatgccaaggcctgccccatggaggagggagtcagacacaagtgctcctgggtgaggggccaatggatccccttcaatgaggatgtcattaacaagtttctggggcatccattggtcctagaggaaggccaacgttgtgagtttagccagatgaggagtcaggccttaggcttcgacaaggaggccatcaaccaactgctgtgcgttccgagcaacattttccctagcgaccataattcaaacctccccctgtcgaagtgtcacctagtctatgtcatcctgactcatacactgagtggacctagagaagtccaaaagggcactggggtttcctactttgatcatgggcctgtgccaattctatggagtgccggtcactcccaccaagctcatctagcctcccatcaacagagccttcatagagaaatactgcatgcccaaacaagcacaacagtagaaggagggttagcaacagctagccgcaggcgcaccgccgttgcctctacaggagacaccatccttagagcggctaatcacaggggtcaggtgcaactaaatgagagcttctaccggtacacccaacaccaacagatccaggaccctagtcctttcccatggcctaccctcgagacgtttggggccatggttgcatggcccggagatgagcccgattttgacacaggggcaagacccgtaggggcccctggggacgacgatggagctcaggaggatgatgacatggctgatgtgctggattttttcacttga

SEQ ID NO: 2079 - DNA, 201 bp, Glycine max
  Peptide Sequence Number=SeqID_93764
atgaggaaaatgcaaggatcatgcatgagtgaacataacatgcgaactgtgaaaatagaatggactattagcggcaatgtatcaccaaaagaggaaactctagatgaggcttcactgttatcaagcgagtcagagatgcaacatgaccacagatcgacctccactccttatggctcacatagacccgggtatagggcctaa

SEQ ID NO: 2080 - DNA, 444 bp, Glycine max
  Peptide Sequence Number=SeqID_93765
atgacacatgcacaacctagacatattgatggctcgttgttgcgcttacaagacaaccatatttcaaatcaagtgtgggaagacaaaaagagaatgattcgtttgacgtataattctgtttgggcttttacacacttggatcaaatagataatcatgtcaaaaacctaatcactttagctggtttttgtcatgttatcaatgtcagaaaaattgatattaaccaacatttggttagtgcattgattgaacgttggagaaccaaaactcacacatttcattttccacatggagagccaaccataactttacaagatatgaccctacagttgaacctgaagattgatggattatcagtaattgatatcatcaccgatgatgtacgtgttgcttgtcagacattactaggggacactccatctgataagtatataaagggtaaaaag

SEQ ID NO: 2081 - DNA, 253 bp, Glycine max
  Peptide Sequence Number=SeqID_93766
atgttttcgtttgctaggcatggaagtgatgaggacatgaccaagagcaagggcaaggatccacttgaaggacttggaggacctatgacaagggctagagcaaggaaatccaaggaagctcttcaacaagtgctgtccatactgtttgaatacaagcccaagtttcaaggagaaaagtccaagggcccaattggcaacctaggcatcagccttttgggagaccaaatggtggctgacttgttggctgttgggg

SEQ ID NO: 2082 - DNA, 454 bp, Glycine max
  Peptide Sequence Number=SeqID_93767
atgccctgtgagtggtcccttcaaccgcttcaccagaaattgaaattcgcagtgggtggacttttagtgatagtgtcgggtgaagaggatatgttagtgagctgcccctcctctgccccatatgtagaagtggcggaagaatcattggaaacggctttccaatcctttgaagtggtgagctgtgcctctgtggaaccaagaacggatttgagcccagaaatgggtctaggaaagcacggcctcggaaatgccgatgtggtcgatatcaagggaaatccatacaaatatggattagggtatgaacccgggataccggggaggaggaacgtgccatccagatttcgggcggatagggtatggcccggccgtattagccagtgtttcaccagcgctggaatggtgtccgaggaagaggtggccgcaatagaagaggagttccctcaagacccaccaa

SEQ ID NO: 2083 - DNA, 162 bp, Glycine max
  Peptide Sequence Number=SeqID_93768
atgtctagccctgcgagggcatgtagccctctaaagcctagggcgtgtagccctctgaaggcgaggatgtgtagttctctgaaggcgaggttgtgtagccctctgaaggcgaggacgtgtagtcctctgaaggcgaacgcgtgtagccttctgaaggcatga

SEQ ID NO: 2084 - DNA, 153 bp, Glycine max
  Peptide Sequence Number=SeqID_93769
atgaagccctctgaaggagagggcgtgcagccttctgaaggtgaggacgtacagtcctctgaaggaattaatgaaacattgggcttagtctggattttggttgtggacttgaagagggcaaataaagcagcgcttaccttagtcaatttctaa

SEQ ID NO: 2085 - DNA, 512 bp, Glycine max
  Peptide Sequence Number=SeqID_93770
ctggttccctccgaagtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtggacggggaagcccgtctgatagcgctctgtgcgcgtactcgaaaggaatcgggttaaaattcctgaaccgggacgtggcggctgacggcaacgttagggagtccggagacgtcggcgggggccccggaaagagttatcttttctgtttaacagcctgcccaccctggaaacggctcagccggag

SEQ ID NO: 2086 - DNA, 387 bp, Glycine max
  Peptide Sequence Number=SeqID_93771
atgttgagtcaacatcccaatattctaaactacactgactctctgatgaagagagaatctcctctatccctgcattacaaactgtttgaggggacacatgtcccagacattgtctcgacatcaggaaaagctgctgcttcaggtgctgtgtacaaggatgctttgattgctgaactcaatgacacatgcaaggtgctggaagcaaccatcaaagccaccacagagaagaagatggagcagctgaggaagaagaagaagcagctgtggaagaagaagaagcagctgaggaagaggaagatgcagcagaggatactgaatcagatgatgatgattctgaagccaccccatgaccatcagacctttatttttgctttttactcttactag

SEQ ID NO: 2087 - DNA, 854 bp, Glycine max
  Peptide Sequence Number=SeqID_93772
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccatgaattaaagtgcctgacggctccaggggagagtctattctgggcctttctcttagcttctgatgttgcagcagtcatggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 2088 - DNA, 303 bp, Glycine max
  Peptide Sequence Number=SeqID_93773
atggcgaggacgtgttgtcctctaaaggtgagggcgtgcagccttctgatggcgaggacgtgtagtcctctaaaggtaaggacgtgtagtcttctgaaggcgagggcgtgcaaccctatgatggcgaggttgtgtagtcctctgatggcgaggacgtgttgtcctttgaagacgaagacgtgcagtcctctgaaggtgaggccgtgtagccctacgaaggcgaaggcgtgtagccctctgaaggcgaggatgtgttgccctctgaaggtgagggtactagtacccaagggtccacccttatga

SEQ ID NO: 2089 - DNA, 276 bp, Glycine max
  Peptide Sequence Number=SeqID_93774
atggtgaaagttggaacctcttacgtgccgatcaacgtctcattttcgccaaaaagttggcccagggcttcccggtatcaacagggacaccaggatttagttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 2090 - DNA, 198 bp, Glycine max
  Peptide Sequence Number=SeqID_93775
atgcgtctaccggggaaggagagtctgctgatgggatcccccataaccataaatgagattttggatgttagcatttcgtttctaaatgaccatttagaggaaacactgggttcgacaatagaagaaaatcactcaaagtgtatcaatctcgcacagatattgtctggtcaaaaagacctctctgcacatttcttctag

SEQ ID NO: 2091 - DNA, 342 bp, Glycine max
  Peptide Sequence Number=SeqID_93776
atgtcaatctccccctgcaaaaggatcgcgcccgcaagacacccagtggacccagagacgtccaacagggtcctggggtttccagctttggttacaggcctctgcaaatcctacagagcgcccgtccccccatcaagtttatgccatcgtgacctagggatcgtgcccgcaaaacactctgtggacccgaagaaggccaataggttctacggagtgcccgttgcccccaacaaggtcattaggtcccgcattaaccgggcttcatcaagaagtactacgcccccaggcaggcacagggcgaaacaccacagcagcattgggatggccggtagcgggcaatag

SEQ ID NO: 2092 - DNA, 504 bp, Glycine max
  Peptide Sequence Number=SeqID_93777
atgggcccagttttgctagactcgcaaagatccttcttgggaggaattgcgcaaaaaggcacagaccatccagaaacagaacattgcccccccacggtttgtctcgtgggggttatgaatatttggagcagaagctcctggctgagaagacgaagaagaagctggaggaagttgcacagtcaggaagctgcacagtcaagaagcgttgatggcatcatcgaccctccatccccggtcagacgccacgtgaagtggaagatggcccgcacgaagaaaacaggggagatgacgactgaggccgcaaaggaaatcactgagaagatcgattcctttgaggagcaggtgacacagggatccttcgtcccccatggacgtcaggatgttctcaccgctgctattagacgtccagagcaccctagacgtgtccatgttgctggagccggggtcaccatcaaacaatactttggatcggctccacggaggttacagatgcaaatgctctag

SEQ ID NO: 2093 - DNA, 261 bp, Glycine max
  Peptide Sequence Number=SeqID_93778
gtcgacaaaagcggggctcttgctcctacgtaccctccatcgaagaggaaatcagacctacgtagttctttccaaaggggcgaatcaagttattcttttttacttggaaggtggtcatttaaggcgttggaccttgaaatgatccatttctacttggtgagaaaagctgaggaaaatgagggaggactttgccactcagctcgcccaggcgagctaggttgcttccaccagaagcaaccgccttctggaggaacatcctag

SEQ ID NO: 2094 - DNA, 810 bp, Glycine max
  Peptide Sequence Number=SeqID_93779
atggcagagccatcaaagaagagaaagggatcatcctccaccactgctgctgctgcccatcgccgccacggcccatccggagcacccacaacacctattcctccttctttgtcatctccaagatcatcaacattgttttcatccgatgatcaacgtctatggtacctttctcagttttcttctagaataatcttagaccctaagtacctagacgtagaattctttaatgatgaaacgtttgattgctatcaagtgtttcaaaattctggtcttgttgatttcatgtcattaaaattgccatattgtcctgaacttgtaaaagtcttctactacaatttaaaaattcaggatggtattattatgtctgaggtgcatggtatttctatggtcattgatcaatcactattcttttctttgactcatttacccagtcaaggtgcaccttttgagggcaccattgttgatgactggaaatttgattattcaagtcatgatgctcgccgtatggtctgcaatgatcaagctgaaatgaccgcacaagcctctgaggaggatttgattcttatgtgggcttttcttaccggtcgtcagatcgactgggcccatttggttcggtaccgaatgcataaggcattacgggccaatgcacctcttccttatccacatttaattactctgtttttgcgtcattttcaaattccgcttgatgatgaaccctttgttcaagtcaagcgttcctttgccattggtgctggtgcagtgacctccattgggtatcgtaaagatcggaatgggggggacaatggctga

SEQ ID NO: 2095 - DNA, 291 bp, Glycine max
  Peptide Sequence Number=SeqID_93780
caccactcattgagtgggtgaggaaccatgttccctcatgggaagatgtgtcgagggaaggagcccagagtatgaagaacctcaggattttaggtcaaatcctttccaaggtcgagggaatgatgcaatcctaccccgcaagggcattggatagaagactccaactagattgggccagagatccatgggaaggccctagggttctcatgagctttaagggtgagcttagctattatagggggaatcttctcaaggaagcttctcaaggaggtgagcttagttatgagaggg

SEQ ID NO: 2096 - DNA, 300 bp, Glycine max
  misc_feature (116)..(116): n is a, c, g, or t
  Peptide Sequence Number=SeqID_93781
atgatacgcggagataccttacggttattcgcacccttttgtcatccagagccggcgggcccgatgacaagcagagaccaagtttggtcattcggcacccttgtatcatccagagncggcgggcccgatgatacgcggaaatacccgagtggggctgacatagtcttctgcaccttttgttcctccgggaacaataagtcatttacatgcggaaatttcatggtcacccgcgactctcgtcaaccgagaggagcgaaattagtgtcatacactgattttcgtccgggggcctttgcttga

SEQ ID NO: 2097 - DNA, 948 bp, Glycine max
  Peptide Sequence Number=SeqID_93782
atgaatcagaaatctacacctgttgcaagagtctgtggtctatgttcttctacagatcaccatacagatctttgtccttctttgcagcaatctggagttaatgaacaacctgaagcttatgctgcaaacatttataatagaccccctcagcagcaaaaccaacaacagcagaacaattatgatctttcaagcaacatatacaatccaggttggaggaatcatccaaatctgagatggacaagtcctccacaacaacaacagcctgtccctctttttcagaatgttgttggtccaagcaagccatatgttcctcctccagtgcagcaacaacaacaacaacaacaacaacaaagacaacaagcaattgaggcccctcctcaaccttccttagaagagttagtgagacaaatgaccatccagaatatgcaatttcagcaagagacaagagccttcattcagagtctgacaaatcagatggggcagatcgttactcagatgaatcaagctcagtcccaaaattctgacaaattgccttcacaaactgtgcagaatccgaaaaatgtgagtgccatcaccttgaggtctggcaaccaaattcaagtgcctccaccagtagcagcacctacacctgaacctgtcaagcttcattctacacttgaaaaagaggatgagatagctgcacaaaagagaaagcttgctaacaaaaattttcatgcaggtggaccttcttctagtaattctgacttacagcagcttcctatccctattccattcccacctaaagcaattccaaacaaaaaaaatggaagaagcggaaaaggagatcttggagaccttcaggaaagtagaggtgaacatacctctgctagatgccatcaagcagattccaagatatgccaagtttctaaaggagctgtgcacccacaaaaggaagctcaaaggaaatga

SEQ ID NO: 2098 - DNA, 1120 bp, Glycine max
  Peptide Sequence Number=SeqID_93783
gtagtcgagcagctcatcaagccaggcagcgccccgttgataggccgcggtcgccgccgtcatcgacagcgcgttgaatacatccagcccgtgggcgttcagccgatcgacaaacgcctgccgaagccgggcattggggatcaggaaattcgaaatgcgcagcgaggaaaggccgaacgttttgctggcggacgtcgccgcaatcacccgatcgcgatattcctcgcccagatgcaacaccgacgtaaacgtctcgccgggcagcagcaggtcggcccaaatttcatcggagatcaccgtgacgtcatgggcgtggcagagcgccatgagccgctccagttcatcgcggcgccagcaacggccggttggattgtgcgggttgcacagcaacaacagcggcggtttacgctgcgccaggcaggcggccagctggtcgaaatcgatccggtatccctgcggggtttcccgcagcggttggatcagcatcgccagccccggcaccaccccttcaatcgacgtgaaccactcgcgccgcagcggcaagccgtgccgcttggcaaaccagtcgattgccgcttggtagtaggcgtcgtcgcgttcgctgtagccaaagacgccgtggtccacccgctgatgcagcgcctgctgcacctctggcgggcacggaaagtcgaaatcggacacccacatcggcaacagttcgctgccgtccagttgcagatagcggtcgatgaagtcccacttcacggagccggtgttgtggcgatcgatgatggcgttgaaatgactcgtcatgtcaggcttccttacgctgcaagtcgttctgagatcgagggtgctgacccccagcgtggtggccatgtaaatgccggcggccgtccacgggatcagcggttcgatgacggtgcccgcatcttcgacggtgcgcgacagatttttgttgtccagccccatgcgccgataggcccctttgaacagctccgccgggatcagcagcgccagcttgccgtcgctggtcgcgccggtcaccaggatagtggtggcaacggtggcggcgatcagctggccggtggtgtgcaccacgttcagcagccggctgatgatcaccgtcagcgcgccg

SEQ ID NO: 2099 - DNA, 129 bp, Glycine max
  Peptide Sequence Number=SeqID_93784
atggaggtgaggaaacctagcagggggttatggctaccattgcattatcaagtagataagggagcaaggatgacctttgtggataactgggtggtgggtatgttggacaagtggcctcagatatcttaa

SEQ ID NO: 2100 - DNA, 729 bp, Glycine max
  Peptide Sequence Number=SeqID_93785
atgtgggcatgggaacgatgtccaaccttggctccaaagaggactccttcccaagtagaaaatacaccagtggggcataggtggctgcgacgtggaaaccaacatatcggcaatgatgatgtgagagtttttcgtcgcaagttagatattatgaaacgtcatgagtttgtgtgggagtcgtacccatcaaccgtaatatcactgttgcctcccgtttgtttagtcggaagtctcgcgtggtacgcggtggtgccactaatttgtttccaagttattgagtggcaccaaccggacagagtattgagacaatttgggatgcaacagccaattccagagtctccttcacaacccttaaacattcatggcataacattgaaagggaaacatgacgaaaattgggggcaattgttcgccccaatgattgatcagtggaataatcgccatgcatttagggtcgacgcttatccccgacaagaaggcctattgagttttaactcggactacatggtctgggtgaagttgcggaggcattacaatacatggtgtctcctcaagggaggaatacatgcacatttgatgatctcgtgccttatgtggaaaaaattacaattttatccgaagagcaagagagagtcactgagccagtgtcacatggtcccgcatcagagcgtcaatttcctgcacaacagtttcacatgcttcagtcaagtattgaaactcaggggatag

SEQ ID NO: 2101 - DNA, 201 bp, Glycine max
  Peptide Sequence Number=SeqID_93786
atgaggaatctggaaggtaatctatcacgcaagcacgcgctcagcgtgtcatcagcttgcttagcgagtcatttgtcaccttccaggcttagtgtgagtttggcgccgagtgaaagttcacttactcacgctaagtgcgacgtcgaggagcttccttgctatggaaggctaaaccctcagttggggattcttgctgagtaa

SEQ ID NO: 2102 - DNA, 222 bp, Glycine max
  Peptide Sequence Number=SeqID_93787
atgcgcttagcggataggaggaatctggaagggaatctatcacgtaggcacgcgctcaacatgtcatcagctcactcagtgagtcgtttgtcaccttctaggcttagcgcaagtttggcgctgagcgaaagttcacttactcgcgctaagcgcgagaatggcactaagcgcgatgtcgaggtcagtgagcccttttttaagcctgacttgcggagaatctaa

SEQ ID NO: 2103 - DNA, 456 bp, Glycine max
  Peptide Sequence Number=SeqID_93788
atgcatcctccaccatcaagtccagagccccatgaattgatttgtgttctagtgccttgtctgccaacagagcaagggatgtcctatgagagcaagtataatcgcctcctccaacctgtttcggtgccaacacaaccatggtctgatatcgccatggacttaatcacaaatgagcccagctcaagaggtcattcaatgttgtgggtggtgcttcaactttactggcaacattcagctttcaatctgagagattccaagcttcaccattgcttatgtggaccttatcccattctcatatgcactagggtcgtggcttatgaattggagcatccggccactgctagaatccatctcatgttccatttggggctattttgccgttacaaaggaccccttccaccagctcctttgaaatttccttctttgtcattacttgaggagcaatgtaaatcctaa

SEQ ID NO: 2104 - DNA, 559 bp, Glycine max
  Peptide Sequence Number=SeqID_93789
tgctttgaaaggacttgatgatactccacaacctaaatccaaggttggtgctaggtggattgttgttaagtgtaatagacaaaaaggaagcactgagtgtggctattacgtcatttactggatgtccactataatcttaggaagtttcaggaataattgggaaacatattttaatgatgttagaccattggaagcagagagattgaaggcacttcgaatccagtgggcacaacattatctcaaagaccaagcccaaggaattttgggggctgcaccttcaaaacccaaggaagataagggtaagaccatagagaaatccacccctaagactagttcccaagaaaggactagcaacattaaatgcttcaaatgtcttgggagatgtcacattgcatctcaatgccctacaaagaaaaccatgattatgaagggtcaagacatttatagtagtcaagagaagactacttcttccccttcctctagtggaagtgaagatgaagtaaggggtgaagagtctagtgaggaagtctacccccatgaagaaggtgacctcctaatg

SEQ ID NO: 2105 - DNA, 489 bp, Glycine max
  Peptide Sequence Number=SeqID_93790
atgacacttatcaatgctacagaggaagaatatgatgatgatgactctggtgaagaagatgaagagctaagtctgatcattatgaagataaaaaagatatggaaaagaaggaactcctccaagttcaacaattcgtccaagagatccttccacaagaaggataaaagtctagtcatatgctatgagtgcaagaagccaggacactttaagtcagaatgctctaaccttgaaaagtcaaaggataagaacaagaaattattcaagtccgaaaagaaaagtgatggaagcttgcttgtggagcatctatggaggatggatcttggagcttcaatgaggtccttcaatggtgatttttcaccatggagatgcagcggaaggcaaaggagaagaggagaggggaggcaccatccactagggaataagccaaggaagaaggagcttcaccaccaagaattgccttggataagaagcttgaagaggatgctttaa

SEQ ID NO: 2106 - DNA, 159 bp, Glycine max
  Peptide Sequence Number=SeqID_93791
atggaaatcatcaacattcacacaaacaatgagccatccattcatacacttcttgatgtagctccatgtgcagcttgtaggccttggatcttcttcatcaatggagtcctttacttcttgaagttcaatggcagtggaatggagaaggaagaaagatga

SEQ ID NO: 2107 - DNA, 279 bp, Glycine max
  Peptide Sequence Number=SeqID_93792
atggatgtttatgctttgttggaaaaagggaaatggcttcgaagaaactctccacgaagaggtctagaagagacgccgcagcagaagggcccagtgccaccccccgagtttgatagtcatcgtttcaggagtgccgagcaccagcagcgcttcaaggccatcaaaggatggtcgttccacagagagaggcgtgtccagctcagggaggatgagtatacggactttcaggagggagatagctcgcagaccttgggcgccgctggtgactcccatggctaa

SEQ ID NO: 2108 - DNA, 254 bp, Glycine max
  Peptide Sequence Number=SeqID_93793
atgggcccgaaatctaccctaaggctcatgagaaccctaaggctttctcgtgcatctctggcacaatcttcttggagtcttctatccaatgcccttgcgggaaaaaaaaagaaaaacagtcctttcgctaagcgcaagcctcgccctaagcgcatctctgttcatgcgctaagtcccgagtctcaagcgcttagcacccaacccttgcatctgcggccgatttggtccactaagctggccaaggttgagctaag

SEQ ID NO: 2109 - DNA, 462 bp, Glycine max
  Peptide Sequence Number=SeqID_93794
caaaagaaagtttatacggataaccactcgggtatttccgcccgtcagcgtgactcaaatgtcagtatgacagatcttgtgagcgcggaagatgacgtaaatctccgcgtgtcaacgggcttgtcggccgcgattgacgaagggcgcagaagacgagtcagtctgcgtgctatcaggcttttcgtcttacagacagcaaaaaagaatgtttatacggataaccactcgggtatttccgcccgtcagcgtgactcaaatgtcagtatgacagatcttgtgagcgcggaagatgacacagcaaaaaagaatgtttatacggataaccactcgggtatctccgcccgtcaacgtgactcaaatgtcagtatgacagatcttgtgagcgcggaagatgacacagcaaaaaagaatgtttatacggataaccactcgggtatctccgcccgtcagcgtgactcaaat

SEQ ID NO: 2110 - DNA, 312 bp, Glycine max
  Peptide Sequence Number=SeqID_93795
atgtctcctccacctctagaacctcacaatcactcacaaactcatctcaagctcttaggacagctgcctcttcaagcttggttttctgcaggcggctttgttcgtgcttgcgagccaagcacaattctgaactgcttagcgcttattagtggattttggctttgcgcgtgcttttctcgctcagcggatggactgaagtggtgcacttcgctggatgacccttcgcttagcgcaaatgcacagctcatccttcttccagattcttcctcgcgctcaaccgaggagtgttgcactcaacggatggctcgctaa

SEQ ID NO: 2111 - DNA, 205 bp, Glycine max
  Peptide Sequence Number=SeqID_93796
atgggtgaagcaaaggaggtgcaagagaagatgaaggccgaaaatggaggccataaaagagcaaatggccacaatgatggaggccatgatgagcatgaagagataatagaagctaatgtggttatagttgccgctactagcgctgtcgctaaggtgaacccgatgctcccatctggctcagcaaatgatcatcaactcaaatatg

SEQ ID NO: 2112 - DNA, 99 bp, Glycine max
  Peptide Sequence Number=SeqID_93797
gaagcaattgggcggcaagcttctccacgtttttgaaaaatggtttccgaggcttccgtggcttccgtaatgcttccgtaaaatttccgaaaaccttgg

SEQ ID NO: 2113 - DNA, 186 bp, Glycine max
  Peptide Sequence Number=SeqID_93798
atgtcgcaacgtgcccttcgcgggcgagcgagagcgaggctcacgggtgcgctttccaaaggaggaaagaaaaaccgaaggaaaccggtcaaaatgaaaattctaagttcgggagttgtatttacgcttgaggaaggtattagcacctctcacgtttgtcccaaaggacaacaatctattttttag

SEQ ID NO: 2114 - DNA, 417 bp, Glycine max
  Peptide Sequence Number=SeqID_93799
atggctaagtttgaccctgaggtagtcctggagttttatgctaatgcttggcccacagaggagaaagtgcgagacatgcgttcatgggtgaggggtcagtggattccctttgacgtagatgccctcagccagttcctgggtgacctggtagtgttggaggaaggccaacagtgcgagttcagccagaggaggaacaaggccgatgggttcgacgaggaggccattgcccagctgttatgcacaccggggcaggattttgcccggaccgctgcagggaggcgggtgcggatcatgcgcaccagcatgaccacattgacccagacgtggatgacattgctgctcagcaatgtcttgcctagcgatcataactccgatctcccctgccgaagtgtatgccatccaccaggcaccctctag

SEQ ID NO: 2115 - DNA, 1284 bp, Glycine max
  Peptide Sequence Number=SeqID_93800
gaacgcggtggcacggcaggtgccacaccccgatgctgtccagcgaacattgccgcaaccttgcctgtcctcgctcccggccacgcatggacaggtgccagttacacagtgctccagcggtggcgtgctggtcacacccggatgcaatggaaactcgacacggatcaatgcaccaccgcccggcgcatccagaatcgtgacgtggccgccgtggcggtcgatcacctggcgcaccaggttcagccccaggcccgcgcccgtctgccgcggccgcaaccgatggaagggttcgaaaacgcgttcgcgctgttcgaccggtatgccggcgccgtcgtcctcgacctccaggcagctgccctgaacgcgcacgatgatctggcgtccgccatgttcggcagcattcagtaccaggttggaaattacccgctccactgcgccggtctcgccgagcaccgggaaatgcgattccaccgcgacggctacggtcttctccgactggatcaacagcggcgccagatcggcggccacccgtttggccacccgcgccaggttgatggtttccttcggcccgtcttcgtccatgcggtgcagatccagcagctgctctgccagcgtcgccaaccgcgccacttccacggccaggctgcgcgaggtggcgtcgtcggccgcatcgaccttcaccctcagaatcgcaatgggcgtgcgcagctcatgcgcggcggcggcgatgaagcggcgttgccgttcgtgcccctcgtccagccgctccagtgcttcattcaccgccgtcaccaacggagcgatctccaccggcacagcggtttctgtcaggcggacaccgcggcggctggcggagatgttgcgggcttcctgggcgatgcgctccaccccggccagggcccgtctcacgatgatcggtgtcaggacgatggtggccaggcccagcagcaggaagatcggcagggtgatgatgtgtgccgccagcgccatctgccaggtcagcgtatcggtttcgccatgggccatgatggtcagcttgccggccggcccgctgtgctggcggaccacgacggccaggccatcgctgcgatcccgcccgcgcaggtcgccaaaggggatgccatccagtgcgcctaccagcgaggcataggccggcggcacaggcccgaacgttacgtggtggccgtgctcatcctcggcgatgaaccatgcaccgggaacgatcttcagcagttcggccaattccggcgtgttctgcacgtacagttctccattgcggtcgcg

SEQ ID NO: 2116 - DNA, 411 bp, Glycine max
  Peptide Sequence Number=SeqID_93801
atgggctcagaaatctaccctaaggttcatgagaaccctagggtcttctttagtagctctagtccaatcctcttggattcttctatccaatacccttggggggtaggattgcatcaaaaggggattgggtttggctctatcttaggaaggatagatttcccactaagaaaaagtgtagctgattcagatgatgaggggtctacagatttgaggacaaatcctcttcaagagggaggggatgatgcaatcctcccaaggaggggacccatcaccagagccatggctaggagactccaagaagattgggccatagatgcaggagaagaccctagggttctcatgagccttaagggctcaatagtgtatggagagtgccctagtaatgtaggattttcggcccttgtattttag

SEQ ID NO: 2117 - DNA, 210 bp, Glycine max
  Peptide Sequence Number=SeqID_93802
atgttgggacatggatatgagcccggaatgggtttgggttggaacgacaatggtgtggcgagtttggtagaagtcaccaaaaaccgcagaagatccgacaatgagtcctgcgaaggtaatgataccgaggacccagacgttgattttgagaaactagtaaatcaagctgaagaaggggaagatgaggattgggggcttccccatagctaa

SEQ ID NO: 2118 - DNA, 192 bp, Glycine max
  Peptide Sequence Number=SeqID_93803
atggctatactcgtggatgataaaagacttccgctagagggggagactaccatgtggaagagactcacacttgagggggagatgtgttgggttacaagtgtgaggtctccttatgtggtgacttgtggtccacaggtgtacccctcgaatctccccaacaatatcaagtccacgaagctggaaggcatttag

SEQ ID NO: 2119 - DNA, 195 bp, Glycine max
  Peptide Sequence Number=SeqID_93804
atgaagaaacaagggcttttcttttctaagatgccatctgcaaaatctccattggagcttgtaggcctaggatcttcttcatcaatggattcctttgtttcttgcaagatgaatgatagcggaatggagaaggaagagagagaggagacaccacttcaaggagaagatgagtctagaagaagctcaccaccatag

SEQ ID NO: 2120 - DNA, 309 bp, Glycine max
  Peptide Sequence Number=SeqID_93805
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccctgatttctctgcacatgatgcccgctag

SEQ ID NO: 2121 - DNA, 495 bp, Glycine max
  Peptide Sequence Number=SeqID_93806
atggtagctgtagttcaaacctacaatgttacttgcatgagaagaggcaatccatctgacttacaaccctttgatcctgagatagataggacatttcatagattagttagacatcattttgtaccttttgagcatcctgagcattctgttattggtgattttgagcattatagttttaaacattctgattttgtacattctaagaatatggcacaacctccaccccatgagaggactttaagggaaatggttgcacctgatttcacctacgaaagcttatgcatccaataccctgatgagtatgtcccatatgttcctaaaattggactgatcaatttgcttccaaagtttcacggccttgcaggtgaagacccacacaagcatctaaaagaattccatattgtctgctccaccatgaaacccccagatgtccaggaggatcacatatttctgaaggcctttcctcattctttagagggagtggcaaaggactag

SEQ ID NO: 2122 - DNA, 633 bp, Glycine max
  Peptide Sequence Number=SeqID_93807
atgaccgaccctctcgatgagtcgatctcttgctttctcataagggtgaacccttgggtactagtacctatcaccttcagagggcttcacgccttcaccttcagaggactacacgtcctcgccatcagagggctacacgccctcgccttcatagggctacacgccctcaccttccgaggactacatgtcctcgccttcatagggctacacgccctcgccttcatagggctactcgccctcacctttcgaggactacatgtcctcaccttcaaagggctacacgccctcgccttcatagggctacacgctctcaccttccgaggactacatgtcctcacctttagaaggctacatgccctcgccttcatagggctacacgccctcaccttccgaggactacatgtcctcaccttcagaggactacacgtcctcaccatcagagggctgcacgcccttaccttcagagggctacacgccctcgccttcgtagggctacacgccctcaccttccgaggactacatgtcctcaccttcagaaggttacaccccctcaccttcagaaggttacaccccctcaccttcagaggacttcacgtcctcaccataagagggctacacgccctcaccttctga

SEQ ID NO: 2123 - DNA, 171 bp, Glycine max
  Peptide Sequence Number=SeqID_93808
atgcaggggtgctcgcccaggcgagctaaccctgtatttttatttttgggaagacacaggatacttggctacctcccagctgcgctttccgcttgtccagagctaggcatgggacgacgatctatcaatcgtgatcctagcctctacttgcgtccgtccctaagtacctaa

SEQ ID NO: 2124 - DNA, 59 bp, Glycine max
  Peptide Sequence Number=SeqID_93809
atgaaggagaactctttcccttccaaaccttataaattatcacctttcaaaatgggaag

SEQ ID NO: 2125 - DNA, 204 bp, Glycine max
  Peptide Sequence Number=SeqID_93810
atggggggggggggagaactgccaggaaaccacattacaagcgaaacctcaaagagagttgggcttcgtcctcaaaaggaaacaacaccagaaaatctagccttccatggattcaaacagaaaacgccattgaaacatagaagcagaaacgtaaatgaacagaaacgtaaacgaacagaaatgtacaatggaacagaaacgtaa

SEQ ID NO: 2126 - DNA, 519 bp, Glycine max
  Peptide Sequence Number=SeqID_93811
atgccatacgtggaagccgcggaggagtcattggaaacgactttccaatcttttgaggtagtaagcattgccgccgtagattccctctctaggcagccccgcctgtcagatgcggcaatgatggtggcccgggtgatgctggggcacggctacgagcccgaaatgggtttgggcaagaacaatggctacaggaccagcctggtaagcaccagaggaaaccgcgggaagtttgggttaggcaataaacctacacaagctaacataaggaaaaatatatcggaaaggaagaacaaaggccagggctcgcggttgggacagcgagccaaagaggccccgccgtgccacattagtaggagcttcataagtgcgggtttaagatgcgatggtcaagtcgccacgatatgcgatgatgactccccgaggagatcggatttggtacggccataccctcttggtttccaactaggaaattggcggatggaggaacgcccagacgtttacgcgacaagcataatgtaa

SEQ ID NO: 2127 - DNA, 402 bp, Glycine max
  Peptide Sequence Number=SeqID_93812
atggagaggtgcgcttcacgactccgaaaatggcttcctttcgcgatttggagcagaaatggtgtgcaaaggttggagctttgttggagcttcaatggtgaggaagaagaaaagaatggcaacatgtgccacatgtcttcttttgagtggagcaaaaatgatgcaagctccattggagcttgtaggcctaggatcttcttcatcaatggattcctttgcttcttggaagaagaatggcagcgaaatggagaaaggaagaaagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 2128 - DNA, 357 bp, Glycine max
  Peptide Sequence Number=SeqID_93813
atggtgtggcatctacaatcatctttcttccatctccattatgctgccattgatcttcaagaagcaaaagactccattgatgaagaaatccaaggcctacaagctccacatggagctacgtcaaaagtgttgggattcaaccttaagactaaccctactattttgcactatacttttgtcatcttgtcctttaatgtagaacaaatacttgttgatatcatatccctaccaagttctaacattttgtttaggcacataaggaaatcgggacattttcagaaggattgcccaaagtataagtcttggttcgaaaagaagggtgagcttagtgcttatgtatgtttgaatcaaacttaa

SEQ ID NO: 2129 - DNA, 513 bp, Glycine max
  Peptide Sequence Number=SeqID_93814
atgggatcatgtcaaatgccttcacttaaaaagaggttctatcaagtcaaggtcaagagcctagggaccaccagtctaaaagagttagggcagttaatgggtcagctccaacggcaagcttttcgcaaagcttatggtaaaatctgggacctagccatggtagaagtctccacagaggccattgcctccctcgcccagctttggaacaagagaccaagagggctcgtagggaagagcacggccggaacaagattcgagggaaagggaccaatcacgaagaccaacatgttagctatcatcagcaagtaccgagaagaactaaatctagctacaacccatgagcatagagtggcagacgagtatgcccaaatgtacgtggagaaggaggctagaggaagggtgatcaactcgttacatcaagaggcagtgatgtggatggaccggtttgctcttaccttgaacgggagtcaagaacttccccgatggctagccaaggccaaagggatcctctag

SEQ ID NO: 2130 - DNA, 390 bp, Glycine max
  Peptide Sequence Number=SeqID_93815
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtgtgggaaggacagggagttatttcctatggccgaaagctaattggagccacagatcctcagaaatcagaacctggaaccattaggggtgatcttgctgttgttgttggaagaaatatcattcatgggagtgatggtcctgagactgccaaggatgagattaagttgtggtttaagccagaggagttggttagtttcactagcaatgcagaaaagtgggtttatggtgtcaccgactga

SEQ ID NO: 2131 - DNA, 195 bp, Glycine max
  Peptide Sequence Number=SeqID_93816
atggaaaaccctaatgcgagaagaggaagggctacctgtggggtgaggaaggagcagatctgggaaaccggatggccaggcacagagaaaacgatgagatggacatacttgtcagcggagtgggaagacaagaagtcaaagcaatccatgttaacaatcatttcagtgacaaaattgtccctccgtgccacatag

SEQ ID NO: 2132 - DNA, 246 bp, Glycine max
  Peptide Sequence Number=SeqID_93817
atgcttcatgagccaatacctttgcaaagatctacaagagaaaggagaagtactattctagatgattatgtggtatttctcaaggaacatgaggaaaataatggtatgatggaagatgattcagtcaccttccatcaagtcatgcaagattccaactcagaaaagtggattgaagcaatgaatggggcgtataagtccatgcaagacaacaaggtttggggacttgtcctatgtgaaacccattag

SEQ ID NO: 2133 - DNA, 2340 bp, Glycine max
  Peptide Sequence Number=SeqID_93818
atgccccttaagaccaccttctcatggaacaccattctctccgcgcatgccaaggctggcaacttggactccgcgcgccgagtgtttgatgaaattccccaaccagattctgtgtcctggaccaccatgatagtggggtataaccacttgggtcttttcaaaagcgctgttcacgcgtttctccgaatggtttcctctggaatttcgccgacccagttcacgtttaccaatgttcttgcctcatgtgctgcagctcaggctctggatgttggaaagaaggttcattcctttgtcgtaaaactggggcaatccggggttgttcccgtggcaaactcactgcttaacatgtatgcaaagtgtggtgattctgttatggcaaaggttgtttttgaccggatgaggctgaaggatacatctacttggaatactatgatttctatgcatatgcagttttgtcaatttgaccttgcacttgcactctttgatcaaatgactgacccggatattgtctcttggaattccatcatcactgggtactgtcatcagggatatgacatcagagccttggaaacattttcttttatgcttaagagttcgtctttgaagccagataagttcaccttgggaagtgttctgtcagcttgtgccaatcgggaaagcttgaaacttgggaaacaaatccatgcacatattgtaagagccgatgttgacatcgctggggcagtggggaatgccctgatctcaatgtatgcgaaatcgggtgctgttgaagttgctcataggattgtagaaataaccggtactccaagtcttaatgttatagcattcacgtcactgttggatggctatttcaaaattggggatatagaccctgcaagagccatatttgattcattgaagcaccgtgatgtagttgcctggactgccatgattgttggttatgcacagaatggcttaattagtgatgctttggtgctgtttaggttaatgattagagaaggtccaaagccaaacaactataccctggcagcggtattaagtgtcatttcaagtttggcttctctggatcacggtaagcagcttcatgcagttgccataagattggaagaagtatcatcagtttctgtgggtaatgctttgattaccatgtactcaagatctggtagcatcaaagatgctagaaaaatattcaatcacatatgctcctacagggatacattgacttggacttccatgattttatctctagctcaacatggtcttggaaatgaggccatagaactgtttgaaaagatgctgagaattaacctaaagcctgatcacattacttatgttggtgtgttgtctgcttgcacgcatgtgggattggtagaacagggtaaaagttactttaatttgatgaaaaatgttcataacattgaacccacttctagccactatgcatgcatgattgacctgcttggacgtgctggattgcttgaagaagcatataattttattagaaatatgcctattgaaccagatgttgtagcttggggttcgcttttgtcttcgtgtagggttcataaatatgttgatttggctaaagtggctgctgaaaaattgcttcttattgatcctaataatagtggggcttacttagcgcttgctaatacactttcagcctgtggtaaatgggaggatgctgctaaggttaggaagtcaatgaaggacaaagcagtaaagaaagaacaaggattcagttgggttcaaatcaagaacaaagtccatatttttggggttgaggatgctcttcacccgcaaagagatgcaatctactgtatgatttccaaaatatggaaggagataaagaaaatgggctttattcctgacaccaattctgtattgcatgacctagagcaagaagtgaaagaacagatccttagacatcatagtgaaaaactcgccattgcatttgcattaataaatacaccaaagcatactacagtgaggatcatgaagaaccttagagtctgtaatgactgtcattctgccataagatatatctctttgcttgtggaaagagaaattataggaatgagtggaagaatgattgagtcaatcaagcttgcaggaaagttgctctacaacaatcgtaagagcatttcgaggagcattgttacaatcaaagactcaacccgaagcaacacagagcatggtgagcaagaaataggaccaaacacagaaacaactcaggaagcagaattcaagctagaaacagggtcgagcaaggaaaaagcttcaaggccaaaaagggaaattgttaaacctcaatacctcaaggattttgtggaaaaatag

SEQ ID NO: 2134 - DNA, 285 bp, Glycine max
  Peptide Sequence Number=SeqID_93819
atggcaactcaagtagcgccccccaagagggagttgataacgatgatagtagatgcattatcggtgtccaactatgaaaagatggtggattacatgccttcaagatttggcgatttagtgttcaccggtgaaaggattgaagtgggtctgaggagaggcaaatttgattgtctcgctttgacaaataaaaagcctggggcaaatggagaaaaggagaatgaggaaggaacccatgttgaagagccctacaccggggcaatgagaggcaccgtgcatgagccttaa

SEQ ID NO: 2135 - DNA, 740 bp, Glycine max
  Peptide Sequence Number=SeqID_93820
ttgctcaggtgtctggtgaggaggctagagccgagacagctttttgcgacttgggtcagagtgggggctatgcctggggagctacggccctggttcatatgtatgaccagttaaataaagcttctaggaccacaacacggaaaattgaggggtaccttactttattacagtgctggatctatgagcattttccgagtgtgcatcaatgtgtcaccgatgatgcctatgaggagatgtcccctcgtgcatcccggtggctgacgatccaggctcatatgaagggaattacaagagcaccgtaccgggcacattgtgatgctttgactgtcacagacggtcagctgagatggggtcctacgatggtcacagttcgatcggagagggttctacgccagtttgggtacattcagagcatccctccactgcctgtatctgcggattacatggagtggtttttccagatatctcacccattcatgataccgatccaggcaggtgaccagcctagacatgcacctgccccagaccatgaggactacatgcagccgaacatcccacaggttccagtggcatttgacccccctcgacatgcagtggatgattacgaaggctatgggcgatcgcagaaagggacaaagttacatgatatcatgcaagattgcctgaagatcgctaggggggtgccaatgcagatggaaatgttagggctcgacaaagatgctgcacagagcattgatgat

SEQ ID NO: 2136 - DNA, 453 bp, Glycine max
  Peptide Sequence Number=SeqID_93821
atggcttccatgatggatgccatgctaggaatgagacaacttatggagaataacgtggccaccgctgctgctgatgagaaaaaagcacactggggcacctcagcaacccccatctgggatacaaccgagtggcttacccttacggattaccacctaattacacgccaccagtcatgcgtgatgacgcggatcatgtcccttcccccatccttgaaagggagcctcctcgacagtccgacgaggttcacgaggatcgcagagagtatgcccaaggagacatcgatttctaccccccgatccctgtcgaggggccgacacccaacatgctacctcagcccaacctcacgggagaacctcaaagtctcccagcacaaccaatattcttgtccgcagaaggaccacccccggcagcggaaggaaaaaggaaactcgatctcatcgaagagagattga

SEQ ID NO: 2137 - DNA, 264 bp, Glycine max
  Peptide Sequence Number=SeqID_93822
atgagggaggggagttttgggaggagagaaactcaccctcccctcgtttttatgtttttaggtgcaggggtgctcgcccaggtacgcgctctctatgggtcggcgttcgcttactcgaacccccttagggctgcctccctgatgcaatcctaccagcttgcatcactcccagcagcacttcccgcttgtccggagctggacatgggacgacgatccatcgatcatgggcctagcctctactcgcgtccatccctgagtacctaa

SEQ ID NO: 2138 - DNA, 156 bp, Glycine max
  Peptide Sequence Number=SeqID_93823
gatgttcaaaattaccaaccacagaatgctcaagatgctcaaaaggtacaaaatgttcagggatcaaagggttgtaagtcacctggattgcctctagtcatgcactatatgcagcagttcatgtgtttctcagacaaggcaaaagaggtgggttaa

SEQ ID NO: 2139 - DNA, 906 bp, Glycine max
  Peptide Sequence Number=SeqID_93824
atgattgagttgcgaaaacttctggataggtatcctacatctgaactgaattctttctggttaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaagttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcggtcttttagtgaactatctctccagggattgtgaaagatgttctactagaaatattcttgttattgcttcgactcatattccccaaaaagtagatccggctctaatagctccgaataaattaaatacatgcattaagatacgaaggcttcttatttcacaacaacgaaaacactttttcactctttcatatactaggggatttcacttgcccaacccaatgtcccatactaatggattcgggtccacaacgatgggttcaaat

SEQ ID NO: 2140 - DNA, 230 bp, Glycine max
  Peptide Sequence Number=SeqID_93825
ggtgtttcccttgctcctacgtattcctcatttgtgatgaggacatgttcaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggttgtgagttgtatcatggcccaaatggaggaggactaa

SEQ ID NO: 2141 - DNA, 141 bp, Glycine max
  Peptide Sequence Number=SeqID_93826
atggggctccggataaaagtggagaatgcgctaggcaatgaattcatggggctccggataaaagtggagaatggagaattggcgaacagcgctaggcaacaaattcgcggggatccatactcgtcggtggaggatgcatga

SEQ ID NO: 2142 - DNA, 231 bp, Glycine max
  Peptide Sequence Number=SeqID_93827
atgaaagaaagagaacagaagatcttcagaccagataaattttcggcaaggtggaaaaaacccggtggaccattcggtcctgccaacaaatcttttattcggagacccatgaattgcgtttttcgtttcatgtgtccctctattcttcgagtttgggagcccatgcgtagtgatttgcttaatgcaaattcctcccattctcaaatctttttcggagctgtcataccctaa

SEQ ID NO: 2143 - DNA, 189 bp, Glycine max
  Peptide Sequence Number=SeqID_93828
atgtttgtgatagtgtcgtcaacacgcttcttaacattcaagatgcaaaatctaccggcaagtgcatcaggtcatcaagtttgttcgataagcagacatttgcaaacagaaatcatgtttgtgaatgaaagtaaaagtatgttctattctaattacaaagcaataaacgtgagcaagctcaagtactaa

SEQ ID NO: 2144 - DNA, 426 bp, Glycine max
  Peptide Sequence Number=SeqID_93829
atgactaggggcaatctaggtgatttacaaccctttgatcctgaaatagatagaacctttcatagattagttaggcatagtgtgcatcccgatcattttgagcattctgttgctggtgattctgaatattcagattttgagcattctactactaatttccatattgagaacatggctcaacctccacctcgtgagactcttagggagatggatacacctaatttcacttatgaaagcttgtgcattcaatatcctgatgagggtgttccatatgttctcgagattggactaatacatttactgcccaagtttcatggtcttgcaggaagatcatatctttctaaaggtttttcctcattctctggagggagtggcaaaagattggttgtactaccttgctcccagatccatctccaactgggatga

SEQ ID NO: 2145 - DNA, 201 bp, Glycine max
  Peptide Sequence Number=SeqID_93830
atgaagaaacgaatgaagaacgtcgaagaacggtggaaaccttcgcaaaattcctcacggaaacaaaattgggggagaagcttgccacccagctcgcccaggcgagcagggttacttcctccagaagcaacagccttctggaggaatcttctggagggcccaagtgggcctggttgctatttgcacccccatttttactaa

SEQ ID NO: 2146 - DNA, 292 bp, Glycine max
  Peptide Sequence Number=SeqID_93831
aatatgtgatacaggatatattccgcttcctcgctcactgactcgctacgctcggtcgttcgactgcggcgagcggaaatggcttacgaacggggcggagatttcctggaagatgccaggaagatacttaacagggaattcgctccaagctgggactgtatgcacgaacccccccgttcagtccgaccgctgcgcccttatccgtcatgcgccggttaaggctaaactgaaaggacaagttttggtgactgcgctcctccaagccagttacctcggttcaaagagttggtag

SEQ ID NO: 2147 - DNA, 141 bp, Glycine max
  Peptide Sequence Number=SeqID_93832
atggttatgaggggtcaagacatttacagtagtcaagaggagactacttttttcccttcctctagtggaagtgaagatgaagtaagggatgaagagtctagtgaggaagtctaccctcaggaagaaggtgccctcctaatg

SEQ ID NO: 2148 - DNA, 255 bp, Glycine max
  Peptide Sequence Number=SeqID_93833
atgggttctccacctgcctccactcctcctcttcctcctcctcctcgtacttcggatgcatcggctttgccatctgccgtgaagcggacacgcaaagcctcacgtctacgatcgttgtccactagaccacctggtgctaagagaccagcggtgcatttgatccttctaccgggaaggccgacggtggacatcacctacgagaactggaaggaggtccctactgctcagaaggacctgatttgggaggatattcag

SEQ ID NO: 2149 - DNA, 216 bp, Glycine max
  Peptide Sequence Number=SeqID_93834
atgtgtggatatagcaggatattttgcgcgtatgcatgttcacaaatgttcttcttcagggaaatgtgtgcacaagaaatggctccgaaaaagctttccacgaagagatctaggagagacgtcgcggaggaagggtccagtgctgcccccgagtttgatagccaccattttcatagcgctgagcaccagcagcgcttcgaggccatcaaaggatag

SEQ ID NO: 2150 - DNA, 228 bp, Glycine max
  Peptide Sequence Number=SeqID_93835
atgccttttagaggcttgaaaagtgcaagaaaacggactgcattttctgcgttttctggaaaacgcgatgaactcgctaagcaagcatgttgcgctaagcgagttcatcaatacgcattgtatcctttaacgagcttagcgaaaatccttgcgatagatgttcagcttagcgggcactgtcccgctaagccaattctacaaaatctaaatttctgcaacttccgctaa

SEQ ID NO: 2151 - DNA, 168 bp, Glycine max
  Peptide Sequence Number=SeqID_93836
atgactgttgcccctctttacttgtcttttattggagataaaagggaagtgagcggaatgaccataatttgtctctgcatgtcatcgggcccgccgcctctggatgacaaaagggcacagaatgaccataatttgtctctgcgtgccatcagacacgattgtgtctga

SEQ ID NO: 2152 - DNA, 471 bp, Glycine max
  Peptide Sequence Number=SeqID_93837
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtgctgaagatcgagcacgaagctgattaccgcgaccctcggatcaatcgttgctggccgcagcccgttaagcggatcaatataacaatcgcaccagtctag

SEQ ID NO: 2153 - DNA, 522 bp, Glycine max
  Peptide Sequence Number=SeqID_93838
atgggcattaaacatgttaattacaaggcaacccaccatgcaccttggggtggtccagaggaggtagcaagtaagtcaatggggacaaacaggggagagacagaggagaggaatatgatagaggtgagagttccaaatcttgattgtgaaggatgtgcttcaaaattaaagaaagctctcttcaagctcaaaggagtagatgaggtggaagttgaaatggaagcacaaaaaataacagtgaggggctatggtttggaggaaaagaaggttcttaaggcaatcaaacgtgcagggaaagcagcagaaccatggccatttccagggcatgctcatttttcctcattttacaagtaccctagttacattgttaaccattactatgatgcatacaaaagtgaagctaccaatggagtccacactttcttccacacccctgcagtgtattcagttgctgtggcatctgatgaagcctttgcttctctctttagtgatgataacccacatgcttgcactataatgtaa

SEQ ID NO: 2154 - DNA, 1761 bp, Glycine max
  Peptide Sequence Number=SeqID_93839
atgagaaagaacaacgaggtagtattcacgccgcagcaagaagagaatcacgaaatggtggggaattttcgtcatttcaaggacagcatctggtggccagtcgtgaaatcattgccacgatccacggcggttctcctctttcccgtcatgctcatcatcggcgcgtttgcttacacgcgcacgctcgacacacattttacgaaagatagtgtgcgtgagcaagaggaatatgttagctatttaggtgtaacttattggaaagtaagacatggtcatgtagatgtggtaggtttaacccttgctgccaaacctatgttcctaaccgcaacaggcgccagaaattgtgggttaaccaggcatagagaaattccaaaggttcgtatgttttccggtgcatcatcttccaaatcagcacaaagcaccacgccatatggcacgagtcctttcacagtctccatccggaagccaatagcaccgttgaactgcaccgcatacaacctcaccggaacatgccccacaaacctacaagaccatcagaacagtccagccaccgccacgtgtccagattacttccgttggatccacgaggatttgaggccatgggcccgcacgggcatcacgcaagacatggtggagagggcaaagcaaacggcaaattttaggttgataatattaaagggtagggcttatttggagacttactcaaggccctatcaaacaagggatgtttttagcatatgggggattctacaattgttgagaaggtaccctggcaagatacctgatttggagcttatgtttgattgtgaggattggcctgtggttttggctgatcgttacaatggccctaatgttgagcaaccaccgcccttgtttcgctattgtggaaatgatgctaccttggacattgtcttccctgattggtccttctggggatgggcagagattaatataaagccatggcatattttgttgggagagttgaaagaaggcactacgaggataccatggctgaacagagagccttatgcttactggaaaggtaatccagctgttgctgaaaccagacaagacctcattaaatgcaatgtttctgaaaatcaagattggaatgctcgtttatttgcccaggattggtttcgagaatcacaagaggggttcaacaaatcagacttgccaagtcaatgcacttatagatataaggtgtacattgaaggttctgcttggtcagtcagtcaaaaatacattctgtcatgtgactctaccactctacttgtaaaacctaaatactatgattttttcacaagaggactgattccagtgcaccactattggcccataaaggacgatgacaagtgcagatccattaagtttgctgtggattggggcaataatcacaagcaaagggcacatcaaattggcaaggtggcgagtgatttcatccaagaagaggtaaagatggactacgtgtacgactacatgtttcatctcctgaattcatatgctaaactcttcagatacaaaccctccaaaagtgccaatgctacagaactatgtgtggagtcaatggtttgtgaagctgaaggatcagtaaagaaattcatgatggaatcattggtcaaggttcctgcaaatactgacccttgcaccatgccggccccttttgatcctccaactttgtatgcaacattacagagaaaggaaagctcaattcaacaagttgaatcatgggaaaaaagttattgggatatcaaaccataa

SEQ ID NO: 2155 - DNA, 279 bp, Glycine max
  Peptide Sequence Number=SeqID_93840
atgtcgtctcaagtttcgaagcatgttacagagcaagagtctggtcaggacctgttcgaatcgaaaagagagaagagtcttttgaaagggattcccaggttcaaggaagtatttgcgaagtacaaggctaggacaggaaagagggcttcgaatcattgggcgattcgagttggtgtatggtcgagtcgaacttcgacttcgagcaatgtggataaccgttctaaggagcagatatgtgcatgtaagatgtacgtggcaggacacttggcattaggatag

SEQ ID NO: 2156 - DNA, 1064 bp, Glycine max
  Peptide Sequence Number=SeqID_93841
gaaagaaaggtcatggtgagggctgcgaaatctgtggtgactgggcccaaatgtttgagccactggactcccagcacgatatcggcgccgcaaatggggagggtgatctgaggggacacagtgtcacagtcgagggtgtggccgttgccgaccatgacgcggagaggggaggtgggggcagtggggaggttaaggaagcgtgcaatccgtgtttggatgaagttatgagaactttcgccatccacaaggataatgacgcggtggtggccgatggaaccatagaggcgaaagggggaatcaggggagaggacgtcttcgtccgcgatgaacaaatggagccgggacttgcatctgtggccaggggagcatttatcatcacaatggtagcagagcccctggtcgcggcgcacggcgagctcctcggcggagagacgcttgacagggagtttcggggggagaggggagggggagtgagggaaaggggaatgcggcggaggccgagggccgcggcgacgatcgagcatcttgtcctcctgaagccgggcaagctcgatggcctgggcgatgccgatggtgcggttggcgaggcgctcaaaagctgtaaggtaatcggtaacggtgcctgtttgttgaagcttgaacaggataccctggtaatcgaagaactgggatattttgaatatccagcccaacgggtcgtggccatcgaaacggggaacgtcgagcttgagggctatggtggcaaggcgttcgaagagggattcaatttgggctgtgagggaagagtggatattgtcaatcttggaattgagggactgatgaccctgggagagggaagtgtggctctcggagaggcggtggacagcttcttcgagcttgtcgatggtggtttggcgggtatggtggtcgggcatggcgtcgaggagcagaatagcatcagatcttcacacgaagtcttccaggtatgtgggtctgtgggtcactctcttgggcctgttagtgctgctgttattggtatctgtggccttgttctgcataatgctatcaaaatgtgtactccatga

SEQ ID NO: 2157 - DNA, 90 bp, Glycine max
  Peptide Sequence Number=SeqID_93842
atgacatggctggactttgtggagtgtccaaaggttcaagatgaacaaatggaaaaccttgagatggacttgatggcttctatagggtaa

SEQ ID NO: 2158 - DNA, 195 bp, Glycine max
  Peptide Sequence Number=SeqID_93843
atgatgacaacaaaagatgatgacaaagaacaagtcaagagttcaagaattaagaagaattcaaggctcaagaagaaagtctacaatcaagaatcaagattcaagattcaagatctcaagaatcaagatgaagattcaagactcaagattcaagattcaagaatgaagaaaagactcaatcaagataagtattaa

SEQ ID NO: 2159 - DNA, 636 bp, Glycine max
  Peptide Sequence Number=SeqID_93844
atggccccaaggaagcttgcctcaaagagatccaggaaagacaaagcagctgaaggaaccagttccgctcccgaatatgacagccatcgttttaggagcgctgagcaccaacagcgcttcgaggccatcaaaggatggtcattcctccgggagagacgcgtccagctcagggacgacgagtataccgacttccaggaagagatagttcgccggcggtgggcatcgctggttacccccatggccaagttcgacccagacatagtcctcgagttttatgccaatgcttggcctacagaggagggtgtgcgagatatgcaatcttgggtgaggggtcagtggatccctttcgatgcggatgcccttagccagttcctgggataccctttagtgctggaggagggccaggagtgcgagtatggccagaagaggaacctggccgatgggtttaatgagggggccatcacccagttgctgtgtataccggggcaagattttgcccggactgctgctgggagacgggtgcggatcatgcgcaccaacatgaccaccctgacccagatatggatgacgttgctgctcagcaacatccagcccagtgatcataatttcgacctccccttgtcgaagtgtcagctg

SEQ ID NO: 2160 - DNA, 447 bp, Glycine max
  Peptide Sequence Number=SeqID_93845
atgggaatatatgaaggtgtgatgatcacatttgctgcgccggacaagaattggaagtttgatatccacttctcactgccactgcatgcacagacatgtggcaggcctgtccattctgccagagaatatgtgtttactgtggatgtcgacaatcggatgattgttagactttatccattggtactgccactcgatgctgtgggttatgttaatgcaggagacgactatggtactgcccttggtgttcgtgggcgtcgtcacttttggaagttgagtatgcataatgggcttaaatgttttgctgagccatggttccaattcttaatagaaaatgatttgatggctggtgacgaagttgtcttttatttcaggccaaatcaacttctttgggaggtcattgccagaaagcaaactgtgtgggacgaggacgaggacgactccccatga

SEQ ID NO: 2161 - DNA, 331 bp, Glycine max
  Peptide Sequence Number=SeqID_93846
gtttcaaccaacatatgggtgttctaatatcatatcaaatatcattagggcaaaatttgatgaaccagctgcaagttggttgacggtgtcagttgaccttcgtgataggttgtttggagagtttaagttcttgtttcctattttattcagaaatagtataggtggcatccacaagaagagtgagccattagagctatttttgagacaaaagtcaaaggagtttcaaagaccaccaactttttgggaggtgatggagaaaactaagaaattgaagtcgggagaatgggtcaatgacaagtcacgcaaatttgctttaagttgctttttctaa

SEQ ID NO: 2162 - DNA, 180 bp, Glycine max
  Peptide Sequence Number=SeqID_93847
gcaagcgcagggcgaagcaccacaacagcattgggatggccggtagcaggaaatagacacaccgccaccacctctaaagttcacctcagctcatccataaaaaggcgtccagctaaagacgttaaagaagcgctactaggaggcaacctagtaccttttgaatctatgcttgttatttga

SEQ ID NO: 2163 - DNA, 381 bp, Glycine max
  Peptide Sequence Number=SeqID_93848
atggtgggctgcgcaccctcaaagctttgcagatttggtcttgccagtaaacccagttacaatgttaaaagaggcaaatttggacatcctctcacgaacacttttgcagaaaactgcacggaatgtgagtgtaagccattgagaagtgagttatcaagaattaggatgtcctatggcttgctcagtctacttaagaaaaaggggggtagccataacattccccaaggttcatcaatctctcttttcgaattacgactaatgcacacgtgttcagacctctactggacaagagacccgggtctcttgagcattgatgacccttttcgaaataagaagtgtgaagagtcaagaagaggtctgctcgaaagaggtagattgtaa

SEQ ID NO: 2164 - DNA, 573 bp, Glycine max
  Peptide Sequence Number=SeqID_93849
atgactgactacctgttactgtttgtcggaactgtactggtcaataactttgtactggtcaagtttctcggtctctgtccgtttatgggggtttccaaaaaactggaaaccgcgatgggcatggggctggcaacaacgtttgtgatgacgctggcgtctatttgcgcctggcttatcgatacgtggattttgatcccacttaatctgatttacctgcgcaccctggcatttattctggtgattgctgtggtcgtgcagttcaccgagatggtaataggcggcttttttatttcaggccgaaaaatgactgactacctgttactgtttgtcggaactgtactggtcaataactttgtactggtcaagtttctcggtctctgtccgtttatgggggtttccaaaaaactggaaaccgcgatgggcatggggctggcaacaacgtttgtgatgacgctggcgtctatttgcgcctggcttatcgatacgtggattttgatcccacttaatctgatttacctgcgcaccctggcatttattctggtgattgctgtggtcgtgcagttcaccgagatg

SEQ ID NO: 2165 - DNA, 240 bp, Glycine max
  Peptide Sequence Number=SeqID_93850
atggcactgttggagaagagcattgtgccctatggatcgaccttggttacacgtgagcgccaaccagctgcttttgcattagggacagtggctgacccaaaggaccctcaccgatacagaccttgggatcctggaggacctcgacagactcaaaacaccttgaggacaagaaaatatcaaagcaagttctcccttagtctctctctcgctctctccctcttcttctatggaggttcctag

SEQ ID NO: 2166 - DNA, 165 bp, Glycine max
  Peptide Sequence Number=SeqID_93851
atgcaccctttatcattcagaaacagcaagttgggtggtaaacgcgtagatacaaattctgcgccctttgtcattcaagaacaacaagttgagaggtgggcggagacaaattatggttccgctggcagggaggttcactggccgaatggtgtttcgctcgaatga

SEQ ID NO: 2167 - DNA, 237 bp, Glycine max
  Peptide Sequence Number=SeqID_93852
atggtgaaagttggaacctcttacgtgccgatcaacgtctcattttcgccaaaagttggcccagggcttccccgtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 2168 - DNA, 288 bp, Glycine max
  Peptide Sequence Number=SeqID_93853
atggctccgaaaaagatttccacaaagaggtctaggagagacgccgcggctgaagggaccagtgccgcccccgagtttaatagccacaatttccgaagcgctgagcaccagcagcacatcgaggccatcaaaggatggtcgttccacagagagaggcacgtccagctcagggaggatgagtacacagattttcaggaggagatagctcgccgacattggacatcgctggtgactcccatggctaagtttgaccttgaggtagtcctggagttttatgctaatgcttga

SEQ ID NO: 2169 - DNA, 324 bp, Glycine max
  Peptide Sequence Number=SeqID_93854
atggactggtggctaaaggataaagggttccaggatttggtgaaacttgaatggggtaattatcaccccctgggatgggggggtttagttttgaaacagaaaatcaagttcatcaaacagaaaataaggcagtggagtatatctcagggtcatatcagttctagaaaagtccttaacctaaagagggagcggaaggctttggaggagggtttcaccagcagaatcttatctcaagatgaagttaaacttaggaaatcactacaggaacaactctggaacgcatcctatgcagttgaatctatgttgagacaaaagctagagtga

SEQ ID NO: 2170 - DNA, 201 bp, Glycine max
  Peptide Sequence Number=SeqID_93855
atgccgaccagggatcagcggatgttgcttttaggactcccgctggcaccttatgagaaatcaaagtctttgggttccggggggattggtggagcgatttgtctggttaattccgttaacgaacgagacctcagcctgctaaatagctatgtggaggtaaccctccacggccagcttcttagagggactatggccgcttag

SEQ ID NO: 2171 - DNA, 102 bp, Glycine max
  Peptide Sequence Number=SeqID_93856
atgctcaaagatcaatcaaagaacaactcaagtgaatcaagaacaattcaagagttcaagataagaatcaagaagaattcaagactcaagaagaaagtctaa

SEQ ID NO: 2172 - DNA, 357 bp, Glycine max
  Peptide Sequence Number=SeqID_93857
atggtttttcacttaaggcttgtaatgagcttcaaaacaaagaaaggggaacataggctcaaaggggctatcaagggaattaattcaacgaagcatcaacaagaacctcaagtccaagctattgtgcaagctcaagtggtttatggctcattctcacaaagttttgcttgtcctcaagcaaagaaagaacagttcacttgtcgtcaagtgaaaagctacaatgatcacttaaaaatgcttccttcaaacgatccaggaacatacacattagaatcacatctgaaaaagctagtaaggatggagaaatcttttctctcaaaggtaaggcatcaccaactctcacagcggattggttag

SEQ ID NO: 2173 - DNA, 245 bp, Glycine max
  Peptide Sequence Number=SeqID_93858
tccaggtgggacaattggcaaaacaactggcaggccgaccgtcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggaaaaaaaggctgcaccg

SEQ ID NO: 2174 - DNA, 330 bp, Glycine max
  Peptide Sequence Number=SeqID_93859
atgcctgagtgtttgctgatacctatgagtttcctaccaaaatcatttggccttggtttagtagaattttctccaaatttcccacgtctagctattctcaaattctttaacatgctgaaattcgttgtcaaccatatgattaatgatatctgtcaattgtttaggcaactgagacatgagatcgtctatcccgatggttatatgctatttttcaaaggaggtcgtcatggcaacattttgtctattagtggttcatttgccatgacaaaagatataaggatttggttaggcatgttctgtattggttgggcaatagaaattgccaagtaa

SEQ ID NO: 2175 - DNA, 495 bp, Glycine max
  Peptide Sequence Number=SeqID_93860
atgactagaggcaatccatctgacttacaaccctttgatcctgagatagataggacatttcatagattaattaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccacctcgtgagaggactctaagggaaatggctgcacctgatttcacctatgaaagcttgtgcatccaatacactgatgaggatgtcccatatgttcttaaaactggactgattcatttgcttccaaagtttcatggccttgcaggtgaagacccgcacaaacatttgaaagaatttcacattgtctgctccaccatgaaacccccagatgtccaagaggatcacatatttctgaaggctttttcctcattcatttag

SEQ ID NO: 2176 - DNA, 247 bp, Glycine max
  Peptide Sequence Number=SeqID_93861
ttggaacctctacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 2177 - DNA, 490 bp, Glycine max
  Peptide Sequence Number=SeqID_93862
atggtgaaagttggaacctcttacgtgccgatcaacgtctcattttcgccaaaagttggcccagggcttcccggtatcaaacaggggacacccaggatttatttattctgcgaagtgatcttccgtcacagggtgctccagtggcttctgtttctatcagctgtccctcctgttcagctactgacgggggtggtgcgtaacggcaaaaagccccgccggccatcagcgctggcaagtgtagcggtccccgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaaactgtcgtgccagctgcattaatgaatcggccaacgcgcggggagaggcggtttgcgtattgggcgctagcggagtgtatactggcttactatgttggcactgatgagg

SEQ ID NO: 2178 - DNA, 492 bp, Glycine max
  Peptide Sequence Number=SeqID_93863
atgaaaacatccttggcaaatgctttcgcagttgttcgtcttcataaatccaagaatttcacctctgactatgaaatacgaatgcccccgactgtccctgttaatcattactccgatcccgaaggccaacacaataggatcagaatcctgtggtgttatcccatgctaatcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 2179 - DNA, 1041 bp, Glycine max
  Peptide Sequence Number=SeqID_93864
atggatcaagttcaatgtcaagccttccgcaaggcatataggaaaatctgggatttggccatgatagaagtgtccgttgaagccatcacatccctcgctcactattacgaccagtcgctcagatgcttcacatttagggactttcagttgtttccaaccataaaagagtttgaagggatcttgggatgcccgcaacgcttggaggaaagggccgaaactttggcagatcaaggagagtggacttcatccattgatatattagcactgttggtgtttgggattgtactctttccaaatgtagatgggctagtggatttagcagtgatcgacgtttttcttgcttatcaccacaacaaggaaagctcggtcattgctgttttggctgatgcatatgacacattcgacttgagatgcgaaaagagcagtgcgagaattgtctgttgtacccccgctctttatgtatggttggtctcccatatttttcttcatgaaggtagacccgtctctcctctacaagatcatcgcatgtgtgccaaaaagggaaaagtaaattgggaggaactcttggcaggattcccaaacgttcccttgatgggaacaaggggttgtattaattataatcccatactggccataagacaactaggctaccctatgagaagggcactgccggaagagatcatcacacctttcgtcgcacgaggtttcagtgaaggcaatgcaaaaatgcttcagagaattcgaaaagcgtggaatacaatggaaagaaaagataaggagcttataggaagcagcaacgtccctgaggagagtgaagaagtgcaagccttgaaagtagagcttgaaagaacaagagtggtcaaggaaaagctaaagacgatagtcaccagggttaggaaagagtgtgacgagctaagggatgtcaacataactatggccaaagcgttagagtggaaaacaaagagagcccgaaaagaagaatggggcagaaacaagttccgaggggctctatggggcagcaacaacgagctcaagctttaa

SEQ ID NO: 2180 - DNA, 426 bp, Glycine max
  Peptide Sequence Number=SeqID_93865
atgggttacatgaggatccgtggagagaaaggcgtttttgttccatggagagagaaggaaaggtggagtacaaaaaatataatgaaggacacatggcgagatcatgatcattcatacgatctgatggatggaaccttcttaactgcacctccagttacgggagaggatccggataagtgtagggtagcaccgcctgcgctgatcaacaatattccaacacgtgtaatgtgcagcctgcaaagtactttttcggtgagcgtgatcatttcagagcgcaatagcacgctgctcttgtcatacagggaaactttccctgcaggaggttcgattttgaacaaaagaacaggtgtagcgacacgacgtcgtaaatgcgccagctttgtggttccaaaatcaataaagctaaataacttgtcgcggcactga

SEQ ID NO: 2181 - DNA, 939 bp, Glycine max
  Peptide Sequence Number=SeqID_93866
atggagacacgcatggaagctatggagaaagcaatggaggagaatcgtgaagtagtggaatcgcagctgagcttggtcgaagggatgatccaaaggttggcagtggtgtgggagaaaaaatctccagcgacgaacgtgcatacagtttacgcgagcggaggggatgaagttagggaagaggacaagttggaagcagtgatgatcacgatggagggggaagctttgagttggttccaatggtgggaatcttggaatccaaatcatttttgggatggattcaagattgttgtcactcaaaggtttcaggctgcaagcttgggaaatccttttcaagcactattgacactgcaacaagaagagacagggttggaggagacatttctggtggaagtgtttctcaaggggttaaaggaagagattagcactgaagtaaggcgttatgagccaaagaacttgatggaagccatggttaaggctcgaagagtggaggataagagcaaaattttagggaagttacccgtgggtgatgggagggggagtaatttgcagaaaactgttcattcagggcagaaggggacgttccataattggtctcctgtgaaggagctaaggttggaggtaacccctacaggcttatattttgtagaagtaggagatggacacaagaatagaaaagtcctattgagagctgaaccagagttgataaaagcttccattaacatgaaaatgatcaaggggaccatgctggaatctgaccaagggtttatgatggaattaaaacaggtggaaggagaaaagggttgggaagtagttcctgacctggtggcacagctgctgacacagtttgaacaagtttttaggaacttcaagggctaccaccacatcgagaaagagatcatgctatcactatccaagagggaaccaagatccccaacttaa

SEQ ID NO: 2182 - DNA, 393 bp, Glycine max
  Peptide Sequence Number=SeqID_93867
atgactaaccgcctgagaattctttgtcttaatacattggagggtacatcctttgtggtacaagtaaagggtacatctacttgggttgctataactgagaacaagagaggatacatttcttgtggatcaattcaagtggagggtacatccacttggttgttcaaagagaacaagggagggtacatcccttgtggatctttgcttgtaaaggattttacaaggttgaaagaaatctcaagaaccgctccattggagcttgtaggcctaggatcttcttcatcaatggattcctttgcttcttggaagatgaatggcagcggaatggagaagaaagagagagaggagacgccacttcaaggagaagatgagtctagaagaagctcaccaccataa

SEQ ID NO: 2183 - DNA, 351 bp, Glycine max
  Peptide Sequence Number=SeqID_93868
atggctccaaagaagcttctctctaaaagggcaaggcagaacgccatgggagaagggtttagagcggctccacaagcggacctagaatttgacggacaccggtttcgaagtgaggaacaccaacgctgctttgaagcgatcaagagttggactttcctcaaggagagacgggtccagctgagagagggagaatataatgagttccaggaggaagttgccaggaggcaatggactcaactcgtagggccaaaggctaaatacaacctggaaatagtcatggaattctacactaatgcatggcccacagaggaaggagtcagggacaagcactcctgggtgcggggccaatga

SEQ ID NO: 2184 - DNA, 194 bp, Glycine max
  Peptide Sequence Number=SeqID_93869
atgcagagactaacatcgtcttctgcacctgtcgcaacctacccttcggcgggaggacgacgtgggactcacgggtgcgtcttgcatgggaggaaaatgtgtggagtcgccaccaacgtttatttgaggaaaacgtcaggaaaaattgggaaagatgtggaatacaacgggagttgtatttacacatggggaag

SEQ ID NO: 2185 - DNA, 147 bp, Glycine max
  Peptide Sequence Number=SeqID_93870
atggagataccttatggtcatccgcacctttcgtcaactgaggggaacgaattagacgatatcaagatgatgttttactctcatcgtccgaaaacattcaagcccaacgacgcgcgagattcttctctgctgggtagggatgattga

SEQ ID NO: 2186 - DNA, 447 bp, Glycine max
  Peptide Sequence Number=SeqID_93871
atgtctgaagaagttgatatgaaggttgaaaatgaggaagatgctggcatgaaattgtttgctagccataataaagttttacattggactcgatcggtgactcatgatattggatttattgtagtgataatgaggtcagacatcaatactggtgttcgaggaagggcctcatttctgttaatagcttgtgaaaggagtggtcgactgacaaaggatgagaagattgttgttgctgatatgacgaaatccatggtgaagccaagaaatattctcttgatgttgaaggagcacaatgccaacagttatacaacaatcaaacaaatttacaatgttagacatgcttatcgttcttcgataagagggagtaacaccgaaatgcagcaatgcatgatgctgtttgatcgagatcaatatattcactggcataggatgaaggatgataatgtt

SEQ ID NO: 2187 - DNA, 939 bp, Glycine max
  Peptide Sequence Number=SeqID_93872
atgtgcatcgcaacagactataatgttaaatcaataggcggtttcactctcttgattcaattatgggcatgggaacgatgcccaacgttagtcccgccgtttattcctccacaacaacaaatcgcaccacttgcctacagatggttgggaggtgaatttcatcacataggcaatgacaatttacttgagcttcgtcgtaaattagatgtcatgaaacacgacgattttgcttgggttccttattctggacatgtggaaatgaatttgagccaaggtgaaatcgccgaaacactacattttatggtatcgcctgttgggagaagggtttgtacttttgaagatttgctgccatgtatcgagaagatcactcttttgtttgacgaagaggataggatacttgaggcacatgaagatgctcccccttctcagccacaacttgaacatcaacagtttaatatactacagcgaagtgtggagactcgaggcttagcgcgacatcggcaaactgttgatgcagcaccgtatagtttgccttcgatgccagaacgacaacatggaatgtattacacaccgccaacattcacccaagaaccatcgcatatggcaccgatgtattcatacccacatgattttcaaccagggtacagtatgacaggcatatttgggtcctctcctcctttagggggaactctttcatttacccaaaataatgaactatcgaccccaaatgccccacttggtggtccgtggaaggtacctggaaatatacccgacatggatgacttattaggggtcgatttacgtcatgatttctctgccaaggctgacgaagtggatgaaagggcaaagtgtagaagaagaaatcctgatagggcagttaggaattgggaccggccatgtgggacttcgtcgcgacatcacagacatagtgatgattga

SEQ ID NO: 2188 - DNA, 182 bp, Glycine max
  Peptide Sequence Number=SeqID_93873
gtgtcaagggaagaagcccagagtatcaagaacacctggatttgaggtcaactcctttccaagggggaggggatgatgcaatcctacccccaagggtattagatagaagagtccaagaggattggactagagcagttaaagaaggccctagggttctcatgaaccttagggtagatttttga

SEQ ID NO: 2189 - DNA, 684 bp, Glycine max
  Peptide Sequence Number=SeqID_93874
atgaagatgccaactaatcctcacaactgggcagagctcggcgacattcttgcggcctggtggcgcggcgacgtgccgattggtggcgtcgtcatggctgtcgtgatggccgttcttaggatggcgtatgccggcagcagctggaaagagaccatattcgaaggcttgatgtgtggcgccttggcgctgacgacttactcagccctggattacttcgatgtaccgaaagccttaacggttggcatcggcggatttattggctttgtcggcgtgaagaagctcagctcgtttttgtccggttacgcctatcaggattcggttggcgtctggacgatcggttacgggtggacacagcctgttgacggtaaaaaagtcggccccggaatgcagattgatcaggcgactgccgatcggctgctgaaatgcggcgttgtgcagtatgagcagggtgttaatcagctggtgaaggtgaaaatcacccagggccaatttgatgcgctggtgagctttgcgtataacctcggccttcgctcgctgagcacatctacgcttctgaaaaaactgaatgatggtgataaacaaggcgccgcaaaccagttcggccggtgggtaaattctggcgttaaacggctagatggtctggtggcgcgccgtgcggtagaacgcgagatgtttttgtcatga

SEQ ID NO: 2190 - DNA, 894 bp, Glycine max
  Peptide Sequence Number=SeqID_93875
atgtcctctccggggaagaaaaccatatctttcctccgggtgtctcccctctttgagcagaattgcaactgtggtcaaggattcagcagaggtttggaccgcataaaacagactcggaacggcatagcgggcctgccacagaagtacctagaagacaaggcgaggggtatggccaatcaaggagactgggtcccgtttatggatgtgttagctttgctaatttttggggtcgtcctctttccaaacgtggatggtttgatagacctagcagcaatcgacgctttccttgcctaccaccatagcaaggaaagtccggtggtagctgtcttggcagatctatttgacacatttgaccgaaggtgcgaaaagagtagcgcacggatcatctgttgcttacccgccctctgtgtttggttggtttcacacttgttccaacaagacacaagacatccatgtccgctcctgagccatcgctcgtgtactgaaaagaggagaatagattgggaccagctcttggccgggataggaggaacgaggggttgtattaactacaatcccgcgctcgctataagacaactagggtaccccatgaggggagcaccgacggaagaaagcatgtctcctttccttgtgagggatttcggcgcacaaaattccaaaactatacaaagaatccataaggagtgggaaaccccgttaaagaaagatcaagagcttagaggcattcgtaatggcatcattggtgggtaccacgaatggctgaaagttcatatacgaggtttagattggctcgccaagttaaaagtcgtcagcaaagagagttttgaagcaccggaagaggacgaagaagtccaagctctcaaaagcgagttaggaaaggcaaaacttgcctag

SEQ ID NO: 2191 - DNA, 168 bp, Glycine max
  Peptide Sequence Number=SeqID_93876
gtggttcgtgtttcgtttccacacattgtcaccatggggattttcaaaataacatctgtggatggagaagtactgatcgcacgtagacagtggaatggaggcttcaatctcttctttttctctctaacgcttgagaaccctatcagagcagtcagaggaaaagcttga

SEQ ID NO: 2192 - DNA, 486 bp, Glycine max
  Peptide Sequence Number=SeqID_93877
atgccgcatcatgcactacttgattgtgcacatccctactccctagatcttcccaacctttcacaggtttctgaggaagatttgataattatgtgggttttcttaaccgatcatcaaatcgactgggcccatcttccctttgtcaaagtcaagagatccttctctatcggtgcaaatgtagtctcttccttcagatactgcaaagagagggatggctcttgggtgaagaaggatgctccagtacaggccgctgaagaccgctctccatcaccacattctcagagatttgactcttcatctcttatgcatagcattcttgacaggtttgatggacttcaaacctatgttggtgagaggtttgactccttggaacgtcaagtggacacacgattcgaggagatgaactcaaagatggcaaaggttgaagaagatgtcaccatcattcgcaactgccttgatttacctccaccaccaccaccagtttag

SEQ ID NO: 2193 - DNA, 279 bp, Glycine max
  Peptide Sequence Number=SeqID_93878
atgactgatgggggagcagattattgctttgaatgtgttggtatggcatcattgatgcaggaagcctatgtttcttgtagaaagggttggggaaaaacaatagttttgggagtggacaagccaggatccaagttaaaccttagctgtagtgaggtccacgtttgtgggaagagcctcaggggatacttatttggaggactcaaacccaagtctcatgtacccattctccttaaacgctacatggacaagggaacacccagatatttgggtcccttgtaa

SEQ ID NO: 2194 - DNA, 552 bp, Glycine max
  Peptide Sequence Number=SeqID_93879
atggccaagtttgacccagatatagtcctagagttttacgctaatgcttgtcccacggaggagggcgtgcgggacatgcggtcatgggtaaggggtgagtggattccttttgatgcagatgccctcaaccagttcctaggtgacccgctagtgttagaggagggccaggagtgcgagtttagtcagagaaggaaccgggccgatggatttgacgaggaggccattgcccagctattatgcatatcgggtcaggattttgcccggaccgctgccgggaggcgggtgcggatcatgcacaccagcatgaccaccttgacccatatgttgatgacgttgctactcagcaacgtcctgcccatcgatcataactccgacttccctctgccgaagtgtcagctggtgtatgccacctaccaggcacccctggggtttccagcattgatcacgggtctctgccagtcattcggggtttctatcacacctagtaaggtgattcgaccgccgatcacccgggccttcattgagaagtattgcacgcctagacaggcataa

SEQ ID NO: 2195 - DNA, 192 bp, Glycine max
  Peptide Sequence Number=SeqID_93880
atgatgcaggaaatgtgcggggatttcaagatccagcatcataactgcaccccctatcggccaaagatgaacggggctgtacttatggatggacgcaaggagaggctagggtcacaaccaataggtcgtcatcccttgcctagcccgggacaaacggaaagtgccgctgcaaagcagcctagtatcctttaa

SEQ ID NO: 2196 - DNA, 440 bp, Glycine max
  Peptide Sequence Number=SeqID_93881
atgggacccggtgctgagaggaacgaggagaagggttacgtacgtgtgcgtaagctcagtttaaagttgatttgtgccattgcccgatcgccacctagtaccacatatgacgggtgccccataacccaacaagctcggtgtgaggaagagaccttggggacgttaggtggggtgccattgcccaaaaccaagcttgaccaatcccgacccaccccgggcataggtgtttgggagaccctcgaaggcaatgagagatgtcgattccgtggcataattcgactcactgctacttcgctagtacatccggagcaacccgcatgcacacttcagcagcctgtggagtggatactacctacacctactccatatcgactagttgagccggttcaagtgatagaggtgtcatcctctgaagaggatcttgaagaagacccagagga

SEQ ID NO: 2197 - DNA, 231 bp, Glycine max
  Peptide Sequence Number=SeqID_93882
atgaagacagggggagcagaaagcggatgtcacaagagatgtcttgacatcctggaaagactagtagccgacagaagatgctgcagtaagcatgaagacagggggagcagaagcagaaagctgatgtcacatttgcaacttgaagaatttccgctgtgcttgattactctgataatgaaagttgctgatcccacttgcataactgctcgtacctgctcaggaagtgtctaa

SEQ ID NO: 2198 - DNA, 282 bp, Glycine max
  Peptide Sequence Number=SeqID_93883
atggaatctcatcatccatacataacgaattggtgtgtatttacagacaaaagtattcggttattggggaaaaatcaatatacttttaatgtcgaatcgggatcaactaggacagaaatcaagcattgggtcgaactcttctttgatgtcaaagtaatagctatgaatagtcatcgactcccggtaaagggtagaagagtacgacctattatggatcatagcaatgcattacagacgtatgattattacgcttcaaccgggttcctctattccacctcttag

SEQ ID NO: 2199 - DNA, 849 bp, Glycine max
  Peptide Sequence Number=SeqID_93884
atggagaaaaaggttatctacaatcaggaacagcagaaactgtatcgcggtcagatttcctctattgaaaaactaacaaaatcctatcagaatcagttaaaccttggaaacataagcaaatccgaatatgtgaggctgaaggcccaggaaattgaattcaaaaagaaattaatttcattacaacaggaaattgcggaacaacaggtcgagttgaaagctttactcatccttccggctacatcttatcttgttattacagatcatttgtcaattcctgaaaaggaactttctgagttggaattacccaactggctgaatatggccaaagaaaatcgtccggacatccagattacaaaaaataaagagaaatacgcacaaaaaaatcttgaattacaacgagctctcagaactcctgacatagcgctctccatgggatatgaccggggtggaaatattatgaaggattttgtagggttgggtatttcatttgatcttccggttttcgacagaaataaaggaaatatccaggaggctaaactggaggttaccaaatccaattttgagacccgcaaaaacatccttaaatcggaaaatgaaatcgtttccgtatttcagaattatacccgaacgcaaaagatttctgaggaactcgatggatcggatgaaagtactttggatggtctattggccagtcatgagaaaaacttcagactgagaaatataagcatgctggaatatatggatttcctggaaacctacattggaaataaaatgatcatactcgatacgaaaaaagaacttaatcaatattatgaaaacctgcagtacgctgtagggcaagacttataa

SEQ ID NO: 2200 - DNA, 102 bp, Glycine max
  Peptide Sequence Number=SeqID_93885
atggctcacttcgtagcatgcaagaaggtagatgatgcttggcatgttgctgatttgttcttcaaagaggtggtaacattgcatggtttacataggagtatt

SEQ ID NO: 2201 - DNA, 201 bp, Glycine max
  Peptide Sequence Number=SeqID_93886
ggctgcaagtaccgtcccatacttactatgttatttttagagggtccaatgtcgattgggaagctgtgttgtgtgcccgcaagggatccggcaaaacatagagcttgggcatggattaatgcgaaagggaaaggaagaaaattctcttattgtgaatgggagatgaatcccagggcttgtttgaattgtttaacgttatga

SEQ ID NO: 2202 - DNA, 339 bp, Glycine max
  Peptide Sequence Number=SeqID_93887
atgggaggtactagagctgtggaagaagagggagctactgtctctggtgatgctgaagtagtggggacctctaatctcttacccctagccttccttggccctctaaatgtcactgttggatcatcaagattccaacagttcttcttaatatatgccaagttaatggcagggctcaagttcttcagggatctagaatatgattggactcctctggccttgcatagagttatgatcaaggcagggaatccaagtctagatgtatcatgttgtgtagtcagagagatctggtgggagattaggtaccccaaattcatatccatcttcataatgatgccataa

SEQ ID NO: 2203 - DNA, 198 bp, Glycine max
  Peptide Sequence Number=SeqID_93888
atggtggtgagtttcttctatactcatcttctccttgccttcgcgtctccaatcatccttctcctactttattccgctgccaccaaacttcaagaagcaaaggacttcattgatgaagaagatccaaggcctacaacctccacatggagctacatcatgtggttctatcatttttcattcataatcttcttgtgctga

SEQ ID NO: 2204 - DNA, 468 bp, Glycine max
  Peptide Sequence Number=SeqID_93889
atgactggaatgatagatttagaggtttccgtcagaggcagtttaactaccatgaccaagttcctcataagattggtggaggcaaaacaggcacaattattggaaggcaaagaatatcataagatgcaaaatcctactgtagaaacaaatgatcatccacatgcccctgcagattctaatatttacacccaaccagaagatgtgagttctgattctgcagcaagagaactaagaccaccaaaaatgggatactgtaaaatttgtgaggttcatctaccctattgcaaaacattggaaatgcataaccaagaaaatagtcatcaaagaatgttgaaactatatgaggaaatacagagactaaaaacttcaggttccagtactaacacccaaactacagatggatgttctaaagctgaacaaaggatagatattctcacccatcagtcagggacaactcagctgtcttag

SEQ ID NO: 2205 - DNA, 390 bp, Glycine max
  Peptide Sequence Number=SeqID_93890
atggcaatgagaattatcagcaaaattggcataacgtacaatactatgaagaagcttgcggtacaaagaagagtggaaggtgccgccattggcgacctttacgaactccatgagcgtgtccaacacaagttccttgagcgtctcatctccctgcggcgaagcgaggacgtcgaggagagacttgaggaactcgtcgaacttggaacggagccacgagaggtagctgaactcggattggtcgccgacgacggagggagcggcggaggcggagggggaagggagcttggggaggagagggaggaagtaggagtggagcgagaggagggattcgaggacgtggtgaggaggggaagaaggggaaacgaaggttgggagaagctggttccctag

SEQ ID NO: 2206 - DNA, 682 bp, Glycine max
  Peptide Sequence Number=SeqID_93891
atgggagaaggtcccaaatcagagccaaaaacagctgttggggggggggggaatgaggacgcggaaaaaattggagaaggtgcaaaaaaggcaagaacggcggctatgaaggaatgcatgcagaattggaatttttataggtgcaagactggtctataccttgaaatagaaagaactaagctgaagtcgatggtggatcagtttgctgaactaggagttcgaaacaaaaagttaaatcaatttattgccaaaagtcctcaactactattcggaagcccaaagacattctacagaattggcccacctaaccgattttggtttctcaggattttgtcactagtcacgcaagatggtaaatactgtttggttttagtttttggggccaaggctctgcagttgtcagattttgaacaaagacagacatggacagaggccaaattctcaagaaaatttagagaagttcaacctaagacagttctgaaatttgggaaaaatggatgcccaaaaaacaatgtgagttctgaaactactgttgccaagcacaggagttacctacaaaaaggtagaggggttactccaaaggttccaactgaagggaaactcattgataacaataatgcacagggtcataatttcaagcataagattggagaaggtgccaaatcagaggcaagaacagcta

SEQ ID NO: 2207 - DNA, 291 bp, Glycine max
  Peptide Sequence Number=SeqID_93892
atggagggtgctaataccttcctcaaacgtaaatacaactcccgaatctggaatattcttcatgaccggtttctttcggtttttccgacattttccacaaataaacgttggtggcgactccgcgcattttcctcctttggaagacgctctcgtgagcctcgcctcgctcgcccgcaaaagggtaggttgcgacagattgtctatctactaagcgcagaccttgcgctaagcaccatttcttcacgcgctaagccgagtttgctcgcgctaagcgcagagacccctgattga

SEQ ID NO: 2208 - DNA, 570 bp, Glycine max
  Peptide Sequence Number=SeqID_93893
atggagagaagtatgattgatgctgccagtggtggagcccttggagacatgacccttgctgaagccaggaatttaattgagaagatggcttccaactcccaacaatttagtgccagaaatgatgctattgtcattagaggagtgcatgaggtagccacgaattcatcttcatcatctgaaactaagaagcttaagggtaaactagatgccttggttaacctgacttttgcccttctatgcagcaatctggagcaattgagcagcatgaagcttatgctgcaaacatttacaatagacctccttaacctcaacaggaaaatcaaccacaacagaacaattatgacctctccagcaacagattcaatcctggatggaggaatcaccctaatctcagatggtctagccctcaacaacaacaacaacagcctgctccttccttccaaaatgctgctggtccaagcaggccatatgttcctcctccaatacagcaacaacaacaacagcaacagccacagcagccacagcaacagagacaacaaccaactgaggccctttcacaaccttctttag

SEQ ID NO: 2209 - DNA, 363 bp, Glycine max
  Peptide Sequence Number=SeqID_93894
atgttcaagatgtttaagatgatcaagatgtacaagataatcaagattgaatcaagaacacttcaaggttcaagaagaaatttgacttcaagaatcaagaatcaaggttcaagcttccaagaatcaagatcaagattgaagactcaagattcaagaatcaagataagacttaatgaagataagtgtgaaaagaacaagagagggtacatgtcttgtggatcagttctagtggagggtacatccactaggttcaaagagaacaagggagggtacatcccttgtggatctttgcttgtaaaaggatttttacaaggttggaaaagaaatctcaaggaccgcaggtcgcttgaggactggatgtag

SEQ ID NO: 2210 - DNA, 1597 bp, Glycine max
  Peptide Sequence Number=SeqID_93895
atgaattcattctccggagttaacgtgaccgaaccgcgcgcaggatttttgctgactcgccactggcgggataccccgaccggcatcgaggtggtgctgtggctggccaccgaccagggcccgcagcgcctggtcctgcctgtgctggagtcagtggcgtttattccccgggagttccaggcgcaaaccgaagcgctgattcgtgacaagcgccatacgcgcctgcgaccgctgaatctgaaatatttccggcgccgaccggtgctgggactctattgccgcagccaccggcagttgcaaagcatcgaaaaacgcctgcgtgaaaacggcattgcggtgtatgaagcatatatccgcccgccggaacgctacctgatggagcgctttatcacggcaccggtgtggttcagcggcgagccgcgtggcgacagcctcgtcaacgcgcgcctcaagccgcatcccgattaccgtccgcaactgaaatgggtgtcgctcgacatcgaaaccaccgagcacggcgagctgtactgtatcgggctggagggctgcggccagcgccaggtgtatatgctcggcccgccgaacggtgatgccagccagctggattttgaactgatttacctcgacagccggccacagctgctggagcagcttaacgcctggttcgcccgtcacgatcccgatgtcatcatcggctggaacgtggtgcagtttgacctgcgcgtgctgcaaaaacatgccgaccgctacggtattccgctgcgtcttggccgtcagcagcagccgctggagtggcgcgagcacggctttaagcccggcgtgttcttcgctcaggccagcggccggctggtgattgacggtatcgaggcgctgaaatcggcgttctgggacttcgcctcattcagcctggaagcggtgtcgcgcgagctgctgggcgaaggcaaagccatcaacaatccgtggcagcgcatggaagagatcaactggcgctttgcccacgacaaaccggcgctggccacctacaacctgaaggattgcgagctggttacgcgtattttccagcacaccgccatcatgccgtttttgctggagcgcgccaccgtcaatggcctggcagtggatcgccacggcggatcggtggcggcgttcagccacctgtatattccgcgaatgcaccgcgccggctttgtcgcgcccaatctcggcgaagtggcaccggaagccagccctggcggctacgtgatggattcgcgccccggactgtatgattcggtgctggtgctggattataaaagcctctatccgtcgatcatccgcacctttctgatcgatccggtcgggctggtcgaaggcctggcgcatccggatgacgccgattcggttcccggttttcgccacgcgcgcttttcgcgccgcacccactgtttaccggcgattgtcgggcagatctggcaggggcgcgaggccgccaaacgtgacggcaaccagccgctgtcgcaggcgctgaagatcatcatgaacgctttttatggcgtacttggcaccagcgcctgtcgctttttcgatccgcgcctcgcctcgtcgatcaccctgcgcg

SEQ ID NO: 2211 - DNA, 210 bp, Glycine max
  Peptide Sequence Number=SeqID_93896
atgtctacccaaggtgcagaggggatgggtaaggaaaaggatgggaaattggcaagattcaagggttgggtagtggctaatttccagggtcttaataaggtggatcttggcataaaatggatgaatgggatggttgaagatgaaatggtggaaggaaagaatcactctttccagcgagggcaacacccaaaggatgtgaaagacctttga

SEQ ID NO: 2212 - DNA, 270 bp, Glycine max
  Peptide Sequence Number=SeqID_93897
atgaaaaccatatccaaactatttaaagagcttgatgtttgtgtcaaagttactctaaagagtaaactccgagaaattgcctaccctgatctaaactctatgtgtcctcctctagaaaaggtcaacaccaaaggtgctcagaagaaactaatgaccaaacatcaaagatcaacaaagtgtgatccgtcttactcgaagtatgttgatgctttacattctgtgcaaaatagtaattctttagtcaaatgtagtgcatcatcatctgactag

SEQ ID NO: 2213 - DNA, 288 bp, Glycine max
  Peptide Sequence Number=SeqID_93898
atgtatcaatcatgtctaaaccaaagtcaagcttcaaaacacagtgtcgcaacctacccttcggcgggagggcgacgcgtgactcgcgggatgggtgttccacgaaaggaatacgcgcggagtcgccaccaacgtttatttgaggaaaacgtcggaaaaaccggaaaagacgagatctacgaactttttagtgaaaggttcgggagttgtatttacgcacggggaagggtgtttccctttgctcctacatattcctcaatttgggatgagaaaatcagacctacgtag

SEQ ID NO: 2214 - DNA, 498 bp, Glycine max
  Peptide Sequence Number=SeqID_93899
atggccaagtttgatccggatatagttctagagttttatgccaatgcttggcgcacggaggagggtgtgcgggacatgcgatcatgggtaaggggccagtggattccttttgatgcagacgccctcagccagttcctaggatacccgctagtgttggaggggggccaggagtgcgagtatagtcagagaaggaaccgggtcgatggatttgatgaggaggccattgcccagctgctatgcataccaggtcaagattttgcccagactgctgccgggagacgggtgcggatcatgcgcaccaacatgactaccttgacccaggcgtggatgacgttgctgctcagcaacatcctgcccaacgatcataactccgacctccctctgccgaagtgtcagctggtgtatgtcatcctgacacggatgagcgtccatgtggctcagttgatcgccgatgccatttatttatttgcaggtatgccgcctaccagcaccctctag

SEQ ID NO: 2215 - DNA, 489 bp, Glycine max
  Peptide Sequence Number=SeqID_93900
atgaccggcagactgcttgtcgggtcattgacatttgattgtcgcatcatgcactatatcattgttagaattttgatgcctcgttcttctaatctcgctcaagcctttgaggaggacttgattctgatgtgggctttcttgaccagtcgcctaatcgactggacccatttgattcattaccgcatgcataaggcattgcggtctagtgcacctctaccttaccctcagcttgtgactttgttacttcgacattttgaaattcctttggattctaagccttttgtgcaagttaaacgttcctttgctattggtgttggtgcagtaacctcatttggctaccgtaaggacatagatgggcaatggttgaagaaggacgcgcaacctccgcaagacaaacgtactccctctccttcgcctcaacgagatgactcctcagccctcatgcatgaagaatggatacccgcatcactcaacttgaggaggatgtga

SEQ ID NO: 2216 - DNA, 250 bp, Glycine max
  Peptide Sequence Number=SeqID_93901
atttgttggttgcgtactgcacgctaaagcattcgatgagggtgtcaaagatgtctatggacctaggtgggagtccaccgtaccaggtcaatgttgcccccttgagggacgtctggaagacactaatgtagctccatgtagagcttgtagaccttggatcttctccatcaatggattcctttgcttcttgaggtctgattgcagcagaatggagaaggagaaagatgaatggagacgccacttcaagtag

SEQ ID NO: 2217 - DNA, 717 bp, Glycine max
  Peptide Sequence Number=SeqID_93902
atgtggtcgcgcatgacccgcaacggcgcgctggccggcatgctggtcggcgcggtgacggttatcgtctggaaacagtacgaatggctgggtctgtatgaaatcatcccgggctttattctgggctgcctcgctatcgtggtagtgagcctgatgggccgccggccatccgccaccatgaccgagcgtttcgatcaggcggaagccgagtataaaacgagttgcgcagcgcatgtcgagccagctttctctgccgccgcggtcttttcaggggccgcgctgatcgtcagcctgatcgccagctacctgaaacgcacgcagcgcagccaatggctgggcgcggtgtgggtcggcgtgattgtcgccgcggcgctgtgtctggcgctcggcatcttcatcaatgaaaccaccggcgagttcccgcagaagcagcaggagctgttcgaaggcatcgtcgcggtggtggcggtactgatcctcacctatatggtgttctggatgcgcaaagtgtccaagtcggtcaaggcgcatctggaaggggcgatcgatcaggcgctcagcgccggcaaagggcagggttgggcgctggtggcgatggtgttcttcgccgtggcgcgcgaagggctggagtcggtgttcttcctgctggcggctttccagcaagacgtgggcgccgcggcgccgatcggcgcggtgctcggcctggcggccgccatc

SEQ ID NO: 2218 - DNA, 393 bp, Glycine max
  Peptide Sequence Number=SeqID_93903
atggttagaaaaccagaaaacttcataaagcttttggtacaaagaagaagaagaagttcaaaaagattcaaggcttgtaaaggattgttcaaaagcactgagggggaatcactctgtgcttactctagattttcactcctaaggcctgatcctcaggagttggctgctaagctctgtatcccggggaggggattcgagcttaatgctgatgggcagcccctgaagattttgaggaagaacatgaccaccttggctcagacatggagtgttctatccttctctaacttgattcccacctcccacacttctgatgtcactcttgacagggccagactcatttatggcattattatgaagatggatatgaatgtggggtacctcatttcccactag

SEQ ID NO: 2219 - DNA, 508 bp, Glycine max
  Peptide Sequence Number=SeqID_93904
gagagtgggggtcacaaggtgctcagtaggggagcttttgagccaggatgagcatcaagcttatcgataccgtcgacctcgagggggggcccggtaccagcttttgttccctttagtgagggttaatttcgagcttggcgtaatcatgctaactcacattaattgcgttgcgctcactgcccgctttccagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtga

SEQ ID NO: 2220 - DNA, 536 bp, Glycine max
  Peptide Sequence Number=SeqID_93905
acgtattctcaatctctggccgtggtaccgttgttactggtcgtgttgagcgcggcatcgtgaaagtgggcgacgaagtagaaatcgtgggtatcaaagcgactgccaagtctacctgtaccggtgttgaaatgttccgcaaactgctggaccagggtcaggcaggcgagaactgtggtgttctgctgcgcggtatcaagcgtgaagagatccagcgtggtcaggttctggctaagccaggtaccatcaagccacacacccagttcgagtcagaagtttacgttctgtctaaagacgaaggcggccgtcatactccgttcttcaaaggctaccgtccacagttctacttccgtaccactgacgtaaccggctcagtagagctgccagaaggcgttgagatggtaatgccaggcgacaacatcaaaatggttgttaccctgatccatccaatcgcaatggacgaaggtctgcgcttcgcaatccgcgaaggcggccgtaccgttggcgcgggcgttgttgctaaagttatcgcgtaa

SEQ ID NO: 2221 - DNA, 300 bp, Glycine max
  Peptide Sequence Number=SeqID_93906
atgactgttgcaaatgtggaagcaatgacttccaagattattttgatgatgccaaagaatcaagagttaaggtacattctttgtggcacaagtagagggtacatctacttgggttgttatactgagaacaagatagggtactacaactcttgtggatcagttcaagtggagggtacatccacttggttgttcaaagagaacaagggagggtacatcccttgtggatctttggcttgtaaaggattttacaagattgaaagaaatctcaagaactgttggttgcttggggactggatgtag

SEQ ID NO: 2222 - DNA, 288 bp, Glycine max
  Peptide Sequence Number=SeqID_93907
atggagaattggactaagtcaatcactgtgcatggctccaaactcgaagctggaggacacatgaacgaaaacgcaattcatggggctccgaaaaaggttgagaaatcaagcttatcgataccgtcgacctcgagggggggcccgctaactcacattaattgcgttgcgctcactgcccgctctccagtcgggaaaccagtcgagccagctgcactaatgaatcggccaccgcgccgcgagaggccgtttgcgtattgttcgctagcgcagtgtatactggcttactat

SEQ ID NO: 2223 - DNA, 291 bp, Glycine max
  Peptide Sequence Number=SeqID_93908
atgaagatcctccagaagaagtctaaatccaatgatgaacttccaagaggaatggagaagcttcaagagatcatcccctcgacaacattattggtgatatctcagaaagtggcaaggttagtactgcaaaagggaattgatcaaaagattgggatggatagacatgcaaaacacatatctacaccaatgagcactaattgttacttagataaagatgaatgctggtcagtctatagacataaaacaatatcgaggtttcaatccaaccccaacggaatcacatttaagtga

SEQ ID NO: 2224 - DNA, 249 bp, Glycine max
  Peptide Sequence Number=SeqID_93909
atgatgacaaaggtgatgaacaaaaagctcaaagatcaaagaacaactcaagtgaatcaaagaacatctcaagtgaatcaagaacaagtcaagagttctagaaaaaaaaatcaggaagaatccaagactcaagaagaaagcctagaatcaagaatcaagattcaaggttcaagatctcaagaatcaagatcaagattcaagactcaagattcaagaataaagaaaagactcaatcaagataagtattaa

SEQ ID NO: 2225 - DNA, 1137 bp, Glycine max
  Peptide Sequence Number=SeqID_93910
gctgggcaagcctgcgctgcccggtgatgtccagctcagcggcctgcagtccgcgccgacccaccagcgcttcatcgtgaagtaccgcgacggcagcgcgccggtggccaacaccaccgcattggcctcttcattgaaaagtgccgccgccggcttggccagcagccagggccgcgcgctgggcatgcagcaggtccgcaagctggccgtcggcccgaccctggtcaagaccgatcgtccgctcgaccaggccgaatccgagcagctgatgcgcaagttggccgccgacccgaacgtggaatacgttgaagtcgaccagatcatgcgcgcgacgctgatcccgaacgacacccgcttcagcgagcaatggggcttcggcacctcaaatgccggcatcaacatccggccggcctgggacaaggccaccggcaccggcgtggtggtggcggtgatcgataccggcatcaccaaccatgccgatctcaacgccaacatcctgccgggctatgacttcatcagcgacgccgcgatggcgcgtgacggcaacggccgcgacaacaacccgaacgatgagggcgactggtacggcgccaacgagtgtggctcgggcatcccggccgccaactccagctggcacggcacccacgttgccggcaccgtggcggcggtgaccaacaacagtaccggcgtggcaggtaccgcgttcaatgccaaggtcgtgccggtgcgcgtgctcggcaagtgcggcggctacacctccgacatcgccgatgcgatcgtgtgggcgtccggtggcaccgtcagcggcgtaccggccaacgccaatccggccgaagtcatcaacctctcgctgggcggcggtggcagctgctcgaccacctaccagaacgcgatcgacggcgcggtcggccgtggcaccaccgtggtggtcgccgccggcaactgcaacaccaacgtgtcctcgtcggtgccggccaactgcccgaacgtgatcgcggtggcggcgaccacctcagccggtgcacgtgccagcttctccaactacggtaccggcatcgacatttcggcaccgggccagagcatcctgtccaccctcaacaccggcaccaccaggccgggcagcgcgacctacgcgtc

SEQ ID NO: 2226 - DNA, 537 bp, Glycine max
  Peptide Sequence Number=SeqID_93911
atgagggtccaagacatttatagtagccaagatgaggctactacttcaccttcctctagtgaaagtgaagaagcaaaaggggaagaatctagtgaagaaatctacccccaagaagatggacaaccattagtggttaaagagaagtgtaaggagacacttgctagcattgccacacctcttgggcttaagtttattcctcaagtaaagaagttgttggatgagggtattattaggcaccaagtccctaaaataggtggtatgatgaatgttttgaatggtgcaaccctcttttgtaaaatcactcgtacacctaacatcttcatggtgtgtgtacatagagacccattaggtagtttttcaaacaatgatcaaggggttccaatgaaccctaagagaataaaggtcattcctgagtggcccgctccaccaagtgttgaggaaaaaagcccagagtttcaagaacctcgggatttgaggtcaaatccttttcaagggggagagaatgatgcaatcctacctcgcaagggcattggatag

SEQ ID NO: 2227 - DNA, 264 bp, Glycine max
  Peptide Sequence Number=SeqID_93912
atgggaatgtacaatgtgaggattattatattatcaaataagttagataagtgtctgaggcattataaacttcgtaccccattgcccagaggctcttcgctatgcaaaggtatgggggagggatattgtacgcaaccttacccttgcatatgcaaagaggctgtttccggattcgaacccatgaccaacaagtcaccaaggcacaattttaccgctgcaccagggctcgccctctgtctgaggcattataaggacgaaaaataa

SEQ ID NO: 2228 - DNA, 366 bp, Glycine max
  Peptide Sequence Number=SeqID_93913
atgggttgtagaaatgtgattcataaaagagaagaaaattggataatatgccaaccaaactcattggaatttaattggcagatcccaggcctatggcaggaaagcactacaatgctatcaggaaaggaagatgaagatcatggtgatgaagatgagccatgggatccagcttccacaattccaaccagaaacttgaagttcaaactgggtggcaagatttataccgctaaacttggatgcatgtcaacacccatggaggttcagattaatcagaatttgctttcatcccaacctcccccgaagccaccaaacttaaccccgcatgcaagggcagtgggtcattcccagctaagccacaatgggtga

SEQ ID NO: 2229 - DNA, 507 bp, Glycine max
  Peptide Sequence Number=SeqID_93914
atgtctcataggataagagtttacatcaagtactcagcagaattccgcaacaatgggtttagccttccatcacaaggaaacaccttttacaagcatgagaaggggtttgagagcaactcacagatacaccgtgggcaggatgtctcctccacctctaaggaccaaaaaatcactcaaaaacctagaatctacctaaaagctaaggtttttgctcccttgctctgttctgcgcctctattctctgtttttcactattctccgccaagctctcttttttctcttcatttcaggcttaaaaaggactttttgacctcaaaggcacgcttaacgccattttcgcgcttagcgcaagtaagtgaacattcgctgagcgagctgggcgcgcttagcgcaggaagagacaaacatctcgctgagcgagctaatgatgcattgagtgcgcagaagcttctcagattctccttcagattctcccaactcgctaagcgggctgagtgcctcgcttag

SEQ ID NO: 2230 - DNA, 207 bp, Glycine max
  Peptide Sequence Number=SeqID_93915
atgagatgtttaagcagggaatgtgatggaagcttgcttgtggggcttctatggaggttggatcttttagcttcaatgaggtcctttaatggtgattttccaccatggagatgcagcggaagacaaaggagaagaggtaagaggcgacgccatccactagggaataagccatggaagaaggagcttcaccaccaagatgagccttga

SEQ ID NO: 2231 - DNA, 671 bp, Glycine max
  Peptide Sequence Number=SeqID_93916
atgggtgatcaagaggagacacaggaacagataaaagccgatatgtcggctttgaaagaacaaatggcttccatgatggaggccatgttaggaatgagacaactcatggagaaaaacatggccatcgctaccgctgttagttcggctaccgaagcagacccaactctcctagctaccgcgcaccatcctcccccaaacgcggtaggacgagaaaggagcgggctggggcacaacaacaacccccatttgggatacaaccgggtggcttacccttatggattaccgcataattacacgctgccagtcatgcatgatgatgcgggtcatgtatcttcccccatccttgaaggggagcctcctcgacagcccgacgaggtccatgaagatcatcgagagtatgcccaaggggatgtcgatttctgtcccccgctccccgtcgaggggccggcgcccaacacattgcctcagcccaacctcacagcacaaccaatatttttgtccacagaaggaccacccccggcggccgaagaaagaaggaaacacgatctcctcgaggagaggttgagagctgttgaaggctttggtgactatccgttcgcggacatgacggatctttgcttggtaccggatgttgtcatccccccgaaattcaaagtgcctgatttcgacca

SEQ ID NO: 2232 - DNA, 57 bp, Glycine max
  Peptide Sequence Number=SeqID_93917
atgaagcatagctccaaactcgaaggaccgaacggtccaccgggtttttccacctaa

SEQ ID NO: 2233 - DNA, 396 bp, Glycine max
  Peptide Sequence Number=SeqID_93918
atggcatccttcagccaacttcagtcacagatgcaatctcagggacctcctgagcctctggttggtcctggtccctccggtcctcgggtgagcacaaaggggagttgtgttgatccctcaggaaacgatcctgagacgggtgactctgacaggtgcggcttgtacatagaagcagatcctgcctgcctggttgccgtggggagagtttatgagggatccactcttgttcataacactcctttgttgcctggccaagtaaaggtgagtgtggacgaggttaaagatgcacatgctgcggttcctgtacccactgctgaaaaatgtatgcgagcggggaattctgatatctatggattcctcgagcctcagtccattcagaggtctgggcaatcatag

SEQ ID NO: 2234 - DNA, 312 bp, Glycine max
  Peptide Sequence Number=SeqID_93919
cacaagatcagtttccaagtgaacctcactatcattcccctcccaaaaccttataaacttcaatggctcaatgagcaaagggaaatgatagttaaccaacaagtgaaggtgggcaaagatcaactaactatgaaagatatgagggatgaggaagaaaaactagaaaaacaaaagaaaaagaaggatagtaaggccttgtcttcaaaggacaaggggaaggaaaaggaggaaaaggattcctccaagaagatggttaagaaggaaaatcattttgcaacaaaaggtgatattataaagggcactccttcttaa

SEQ ID NO: 2235 - DNA, 195 bp, Glycine max
  Peptide Sequence Number=SeqID_93920
atgccaatctccccctgcagatgtatcggttggaatcacacctacaaagacacccagtggacccggagaagtccaatagggccctggggtttccagctctggttacgggcctctgtagtcctacagggtgcccgttccccccagcaaggtcacgtcatcataggtaagtatgcacatcgctcaactgatttctga

SEQ ID NO: 2236 - DNA, 354 bp, Glycine max
  Peptide Sequence Number=SeqID_93921
atgcgtcctccacctcacgagtttggagctatgcgtagtgattgcttagtgcaattctccattctcaacctttttcggagccccatgaattgcgttttcgttcatggatcctccacccacgagtttggagccatgcgtagtgattgcttagtgcaattctccattctcaatctttttcggagccccatgaattgcattttcgttcatgtgtcctccaccttcgagtttggagccatgcgtagtgattgcttagtgcaattctccattctgaacactttttcggagccccatgaattgcgttttcgttcatggatcctccacccgagtttggagccatgcgtagtgattgcttag

SEQ ID NO: 2237 - DNA, 87 bp, Glycine max
  Peptide Sequence Number=SeqID_93922
atggcagaaatcaaccaaggtaagacgatgaccgctcacgatcggtcacatatcgttcggctcttacttgcagtaatcgacgcctaa

SEQ ID NO: 2238 - DNA, 639 bp, Glycine max
  Peptide Sequence Number=SeqID_93923
atgggatcaagtcaaacaccttcgcttaaaaagaggttctatcaagtcaaggtcaagagcctagggatcaccagtctaaaagagttagggcagttgatgggtcagctccagcggcaagcttttcgcaaagcttacgataaaatctgggacctagccatggtagaagtctccataggggtcattgcttccctcgcccaatattatgatcagccattgaggtgcttcacctttggggacttccagctatcacccatggtagaagaatttgaagagatcctaggatgccctctagggggaaggagaccatacctcttctcagggttctatccctcattagctagaatttctaagatagttcaaatctcgacgcaggaattagaccacagaaagcaagtcgaaaatggggtggttggaataccgagaaaatgtttggaggcaaaagcaagaatcttggcaggtagaggcgaatgggccccgttcatagacattctcgctctgttgatcttcggaggagtcctctttccaaatgtggatgggttggtggacctagcagcaatcgacgcttttctcgcctatcatgaccacaaggaaagcccggttgtcactatgctagccgacctatatgacaccttcgactga

SEQ ID NO: 2239 - DNA, 451 bp, Glycine max
  Peptide Sequence Number=SeqID_93924
atggtggtgacggttaaaaagctcgtagttggaccttgggttgggtcgatcggtccgcctccggtgtgcaccggtcggctcgtcccttctgccggcgatgcgctcctgtccttaactggccgggtcgtgcctccgcatgggataacaccacaggattctgatcctattgtgttggccttcgggatcggagtaatgattaacagggacagtcgggggcattcgtatttcatagtcagaggtgaaattcttggatttatgaaagacgaacaactcccgaaagcatctgccaaggatgttttcattaatcaagaacgaaagttgggggctcgaagacgatcagataccgtcctagtctcaaccataaacgatgccgaccagggatcagcggatgttgcttttaggactccgctggcaccttatgagaaatcaaagtctttgggttccgggggga

SEQ ID NO: 2240 - DNA, 624 bp, Glycine max
  Peptide Sequence Number=SeqID_93925
atggttaggaccagaggattaggtcagcgagtcgctgtgactgcggatcacgtcgatgagccagtcatccctgcgccagatgttcaggatgacccgatagaggcaccagctgctgtagaggacattcctacggacattcctgtggacacaggcgcaaagcctgctgaggacgcgcatgagggattttcgggtggtccaagcgacccatccatgttgaccctgtatgcggatcacgttgcttgcagcgtatggacgggagaggagcgtcctgaattgaagctatcctctcatgggaggaaggtccacagtttaggcaggtctgtccctgccattgagggacttgttgctggtacaggactaagtcctctgatcgcgtgttcggtagacaccggtgatcggggacttttgtccgcgtttgtggagcggtggcaccaggagacgtctagtttccatctcccggtgggagagctcaccatcacattggacgacgtctcctctcttcttcatctttccattattggcgacttacacgcatttgagcccttgcacgtggacgatgcggttcaaatgttggtggacttgttgatggtctctccagagtctgctagggctgagacagtctag

SEQ ID NO: 2241 - DNA, 487 bp, Glycine max
  misc_feature (429)..(429): n is a, c, g, or t
  Peptide Sequence Number=SeqID_93926
atggtagaagtctctgcagaggccattgcctccctcgcccagtattatgatcagccgttgaggtgcttcacctttggggacttccagctatcacctatggtagaagaatttgaagagatcctaggatgccctctagggggaaggaaaccatacctcttctcagggttctatccctcattagctagaatttccaagatagtccaaatctcggtgcaggaattagaccacaggaagcaagtcgaaaatggggtggttggaataccgagaaaatggttggaggcaaaagcaataatcttggcaggtggaggcgaatgggccccgttcataaacatcctcgcactgttgatctttggaggagtcctctttccaaatgtagatgggttggtagacctagcagcgatcgacgcttttctcgcctatcatgaccgncaggaaagtccggttgtcgctatactagccaatctatatgacaccttcgaccgaagat

SEQ ID NO: 2242 - DNA, 108 bp, Glycine max
  Peptide Sequence Number=SeqID_93927
acaagaggaagatgttcaatattttcaaacacaatttagatttctcagaaagtttggattttgtgggaaatttagaagaggctgacattggaaaagcgaaaaatttgg

SEQ ID NO: 2243 - DNA, 336 bp, Glycine max
  Peptide Sequence Number=SeqID_93928
atgcacacacgaagctttacaaatccacaattccttaaaagtaggcctaactcacaaaaagtccccagtggagtcgccaactgtcgcaacgtgcccttcgcgggcgagcgagaggcgaggctcacgggtgcgctttccaaaggaggaaaggtgcgcggagtcgccaccaacgtttatttgtggaaaacgtcgggaaccgaaggaaaccggtcaaatgagaattctagttcgggagttgtatttacgcttgagaggtcgacaaaagcgaggctcttgctcctacgtaccctccaccaaagaggaaatcagacctacgtagttctttcttatgcgtga

SEQ ID NO: 2244 - DNA, 666 bp, Glycine max
  Peptide Sequence Number=SeqID_93929
atgaagtggttccgacaggtaaacaactcactcaagaagacttttactgatccaacacagatcccggttattggccgggatctttttttaccctttcacaccgcccgccattcgaccttaccgttgcgccatggccgcttctgcggtgtgctgacggcggggataaacggcgctatctgctcctgcttacgcgacgacagctttttgcaggctttgcgcagttgcgccaccacctccggctcagcaggaggctgcggtgcttactctttcgctgtcagtatcagcgcgccgttcagcacctgcacttccagccctgtcagacctaaaatcctcaccgcatctgactgcgaatgcggatatttagatgcgtgctcagcaaagatgtataaccagcttactcagacgcggcagaaaaacccgttgttcgagcttttcaacagccctgtcggcgctgaattatctggctgcggcaatcgaaatgatttcgtcttcagtcaacgccgccgcttcgtcactcaaagcaccgttcctcacgctgcgattatcagcccgcaatccctgacgtgccgatccaccccgcaaatttccgctctctgcctggtaaaggcgcgcctgcctgactacaccttaagcatccttgttatcactgtcctttccgctgtttaa

SEQ ID NO: 2245 - DNA, 765 bp, Glycine max
  Peptide Sequence Number=SeqID_93930
atggaagaaaacatgtgggccatcattgaccaatacaaagagaagttaagtctagctgcaacccataaacaaaggttagaggacgagtacacgaaggtagtaaacaccataactaaacacgctttaaggcacccttatcgaatccgttccaaaactagagtcatgggtgacatagaagaggtgcaagaacaaatgaaggccgatatagaggccttgaaggatcaagtggcttccataatggaagccatgttaagcatgaagagaatgatggaaagcaacatgaccgcagttgccgccgctagcatcgccattgaggtgaatcctacccatccctctgccataaaccaagcaaaccaacccgccccggacatggtgggacaaggaggaaaggtgttgggcagtaccggtggtccacacttggggtataataggaatgcttacccctacaacttaccccccaattatacgccgcccaccacgcacatgcctaacaagaacgttaattctgccgttcccgttacctttgagggtcaacaaccccaacctgtaggaggcacccgtgaagaacctcgggagcgtgctcaaggggacttcgacccatatcccactttcaccgttgaaggaccggcatttaatgctatgcctcaacccaataccgcgggagctcctcaaccccgccctctgcagccgctgcatttctcagtagagggccacctccggcagtggaagggagagggaaacttgatctcatcgaagagagattaa

SEQ ID NO: 2246 - DNA, 195 bp, Glycine max
  Peptide Sequence Number=SeqID_93931
atgaggcgacggaacttccagacagagctgagcataaaagtggtcggagtgattcagtgttcagttgcagccaagaacaatgctgtcacttgtatttggcccaaacgagtgggctcaatgattctttcttctgagttctatgaaactaatagacgcacgggaagctatggtagtaatacgggaaagctggggtag

SEQ ID NO: 2247 - DNA, 279 bp, Glycine max
  Peptide Sequence Number=SeqID_93932
atggttatcatctccttttccatcattgggggtgccactaggcccttccagaacattttggaagcgggggtccctaacccccttggctatgcatttctgttgttttgggtgaaaaaaattgtttccgtgaagaaaatccaagccgcttccgtaacgcttctgagacgtttccgtgagcaatttcgtgaagattttccgtcgttcttcaccgttcttcatccgttcttcgttcttcaaccgcaaaatctaaccgatcggtcacactgtaaccacggttaa

SEQ ID NO: 2248 - DNA, 405 bp, Glycine max
  Peptide Sequence Number=SeqID_93933
atggtagaaccatcgaagaagagaaagggatcatcctccaccgccgctgctactgcccctcgccgccacgaaccatccgaagcacccacagcacctattcatccctctttgtcatctccaagatcatccactttgttttcatccgatgatcagcgtctacggtacctttctcaattttcttctaggatcatcttagaccctaagtacctagacgtagatttatttaatgatgaaacgtttgattgctatcaagtgtttcaaaattctggcttggttgatttcatgtctttaaaattgccacattatcctaaacttgtaaaggtcttctactgcaatttaaaaattcaggatggcattatttcttctgagtcaagggcaccttttgaggcgcaggggatcctctag

SEQ ID NO: 2249 - DNA, 96 bp, Glycine max
  Peptide Sequence Number=SeqID_93934
atgggaccaactcattttatttcaaaaagaaagtcgtatctagtcaaggtgtccgccatcgccttggccttggctaacaagcggggaagttcttga

SEQ ID NO: 2250 - DNA, 669 bp, Glycine max
  Peptide Sequence Number=SeqID_93935
tgggagagttgatttgcgccatcgcccgattgccacctagtaccacatatgacggagtggtacctagagatatgtcgcgggggtcaggagaccttggggacgtcaggtggggtgctattgcccaaaaccaagcttggctaatcccgacccaacccgagcatagtcagtcagtgagaacctgtgacgtacctaagcagggtgatagggcactggtaatcgattaccagttgggtgtaatcgattacacagtgttacctgctactgcgcagttgatccatgatcgcgtggtgatggagtgtctagagggtgtttgggagaccctcgaaggcaatgagaggtgccgattccgtggcacaattcgactcactgctactatattagtacatctggaggaacctgcacgcacatttcagcagcctgtggagtggatactacctacacctactccatatcgactagttgagccggttcaagtgatagaggtgtcatcctctaaagaagatcttgaagaggacccagaggagttacctcctgaacctgatatggatgcccttgacttacctgaggatgatgaagacccactccctgatgttgattctccagaggatatcatgtcagcatctgaggcagactctacagaggagagtggccctggagggacaacaaata

SEQ ID NO: 2251 - DNA, 186 bp, Glycine max
  Peptide Sequence Number=SeqID_93936
atggagaaatctgaaaagaaaaactttaatgaaaagaaggcaaagagggcctacattacatgggatgacaatgatatggactcatctgaagattcggaaaatgaagtggtaaacctaagtctaatggccaagagttatgaaagtgatgaagaggaaaggacatggcacatctacatgttattttag

SEQ ID NO: 2252 - DNA, 1257 bp, Glycine max
  Peptide Sequence Number=SeqID_93937
gtagaggtgaatgggtcccgttcatagacatcctcgcacttttgatcttcaggggggtcctctttccaaatgtagatgggttggtcgacctggcagcgatcgacgctttcctcgcctatcatgacagcaaggaaagcccggttgtcactatactagtcgatctatatgacaccttcgaccgaagatgtgagaagagcagtacaaggattgtttgctgtactctggccctctatgtatggttggtttcacacctttttcgccaagaggtgaggcatgcttgcccgcaagaaagccaccgttcatgcacagagaaaagaggggcaaattgggaccgactcttagcaagtaaagaaggagcgtctgtcaactggatccctcgatggaaagaaggaagaaccgggattcttatttcgtgcggaggatttccaaatgttcccttgatggggacaaggggttgcatcagttacaatcccgtccgcaaggcgtgggagatggtgcaaaagaaggacaaagaactcagaggcagtaacaacgggcccatcggcggctaccgtaagtggttaaaagcccacatgcaaggtttggattggctcccgagtttgagaaccactaaaggggaggaagttgaggcaccggaggaagacgaagaggtgcaggcccttagggcaggacttgagcaagcccaaatagtcaaagaaaggttcaaatcagcagctcttaagatccgaaaggagaatgccgaactgagagatgtaaatatagctaccaccaaggccttggaacaagagaccaaaagggctcgaagggaagaacacggtcggaacaaattccgaggggctctgtggggcagtaacagtgagcttaagctccggagagaggaaagtgaccaatcacgagtagacagtttgatcttgaaggatgagttgaaggtttgcctaaggtccaagagaagcttgtctcagcgtttatgcgagatagagaccaacatgttggccatcatcagcaagtaccaagaagaattaaatctagccatggcccacaagcacaaagtggcggacgattatgcccgagtgtacgtggaaaaggaggctagaggaagggtgatcgactcgttacatcaagaggcaacaatgtggatggactgttttgctcttactttgaacgggagtcaagaacttccccgattgctagccaaggccaaagcaatggcggacacctactccacccccgaggagatccacggacttctcagctatt

SEQ ID NO: 2253 - DNA, 1248 bp, Glycine max
  Peptide Sequence Number=SeqID_93938
ggcccggcgactaggctgggtctcccgcaccatgaggagtatgtcccgatgtccgtccccaccatcgccgtgttcgtcggcagcctgcgcaaggagtcctgcaaccgcaggctggcccatgcgctggagaagatcgccggcgaccgtgcacgcttccagtacgtgcagatcggtgatctgccgctgtacgaccaggatttcgatggccagtacccgccgcagggcacccggctgaaggatcaggtgcgcgccgccgacgcggtgctgttcgtgacccccgagtacaaccggtcggtgccgggcgtgctgaagaacgccatcgacatcggctcgcgcccctacggtgacagcgcgtttgccggcaagccggcggcggtgatcggcgcctccatcggccagatcggtaccgccgtggcccagcagcaccttcgcaacagcctggccttcctggacatgcacgtgctcggccaacccgaggcgttcatccatttcaaggacggcctgatcgatgccgatggcacggtccacaacgaaggcacgcagaagttcctgcaaggctatgtggaccggttcctggcgctgatcgcggttccgtcaagggcgaggcctcgcgtaccggcggcctggccgcgctgttggccgagtccggactacgcgcgtggcatcggtgacgtgtaccgcaaccgcatctcgcgctggcgcgacccgacggcgtgcaagacatcgaccgggcgcgcagctgccggcagcttggactacgattcctggccgatccgttgcacggcgccgcatccaccggccgacgcgatgatgctggccgattacgtgactacctgccggatgacccgtcaaggtcgccgcacctcgatggcggtcagcctggaggccgcgcgccgctgctggactggcgcgtggctgagttcgcctggtcgctgccgctgggcttcaagcgcagtgaaaccacagctggaggtgctgctaagcgcgtcgcagtgggtcgcttcgcatggtggccgcgtccggcacagacgcggtcagccggtgcacagcttcagcgatcggcttcaccggttcgggccacgacgaggcgccgctggccagttcctcggctggccgcgcatctgggctgtgaccacacctgaactctacgtcagcggtgccgatgcagctggcggtggtgccgcaggcgtaaccgtcgcgctgtccggcgatggtggtgacgagctgttcttcggctatacccgctat

SEQ ID NO: 2254 - DNA, 156 bp, Glycine max
  Peptide Sequence Number=SeqID_93939
atgaatgtgaggactttgagtcctataaaggcaaggactttgagtcctatgaagaataaaggtgaggactttgagtcctatgagggcaaggactttgagttctctaaaggcgaagactttgagtcctctgaagacgaggactttgtgaatgtatga

SEQ ID NO: 2255 - DNA, 1146 bp, Glycine max
  Peptide Sequence Number=SeqID_93940
atggcttccagaaagagaaagagaattggttcaagacccacagtgcactatgacacaaggagattatcttcctttgaggcctggacccgatacacaaataatgttctaggaagacatatactgcctgagaggaaggtagaaatataccatactgagctggacgagtttaaggctgaattggagaggcgtaacttccataaaagcctcaccaatttagttgacaacaacatagatttagctttggtgaaggagttttatgctaacctttacagctccgaagggccttcaccaaaacaagtcaagatcataggccatttggtgaggattgatgcagacaacctcaacacctttctggagacacctgtggtactagctgagggtgaaaccttacccacatattccaaatactataggtcgtccactgatattagagaaattaaggcttccttatgtatcccaagtcgggggttcatcttgaactctgaaggccaccctgggaagattctcaggaaagatttaacaactcttgctcaggtgtggagtgttctctcgtactccaacctggctcctacatcccacactttggacctgacagtagatcgagctaggctgatctttggcctagtctctgagatggacatgaatgtgggagctctcatctctggtcagattacatctatggcccagtctaactcttctagacttgggttccccgctcttatcactgctttatgtaagtccagaggggttgcttctgacagcctgatcttcgaacgcctgagctcggtcattaacttggcctatatcagaaaaaattattggaaccctgatgatctgacagttactatcagaggggccaggaaagtgaggacaaggctagttgaggccccttccacatctacagctcctcctctagcacataccctaacacccgggactcagtcttctcttcacagggaagatgcaggtcccacagcccaggtaccacaacagatggaggatgagtcatccaagactaccactccagatcccttggttagaaggaagaaggcagatgaaacacaagaagctgcagtcacttctgagaaatctcttgaggccacttctgagccttcagaaccagtggcaaatacaacttcactttag

SEQ ID NO: 2256 - DNA, 285 bp, Glycine max
  Peptide Sequence Number=SeqID_93941
atggggggggggggggttgctttgtgcatgatagggtgtcctcgactatgtggacacgctgagcctattttcttgatgaatggtatcacattgcatttgggagttaagttactgtcacaacatgcccttttgcgggcgaacgaggcgaggctcacgggtgtgctttccaaaggaggaaagatgcgcggagtcgccaccaatgtttatttgtggaaaacgctgggaaaaccgaaggaaaccggtcaaaatgaaaattctatgttcgggagttatatttacgtttga

SEQ ID NO: 2257 - DNA, 212 bp, Glycine max
  Peptide Sequence Number=SeqID_93942
gtactaataccgaggaccttgacgtcgattttgagcgaatagcaaaccaagctgaggatgaagaagataaagatgcggggtttcccctagagctagaaaggatggtcacacaggaaaaccgagaaatgaagccacacgaagaagagacggaaatcgtgaacttgggtgttggcgaggaaaagaaagaggtaaaggttggcacaccgatctga

SEQ ID NO: 2258 - DNA, 153 bp, Glycine max
  Peptide Sequence Number=SeqID_93943
atggaggccgacatgaaggccatgaaagagaaaatggccgcaatgatggaggccatgatgagcatgaagaagataatggaagccaatgcagttgcagttgccgctaccagcgctgttgctaagatttctaaaaagcctaaaatcaatatgtaa

SEQ ID NO: 2259 - DNA, 861 bp, Glycine max
  Peptide Sequence Number=SeqID_93944
atgggatcaagtcaaaagccttcgcttgaaaagaggttttatcaagtcaaaatcaagagcttagaggtcaccagtttacgaaagttggggcaattaatgggtcaacttcaacggcaagccttccacaaagcctatggtaagatttgggacctagctagggtagaagtctccatggaaccgattgcatcccttgcccagtattatgaccaacccctaaggtgcttcatatttgaggacttccagctagtgccgactgtgaaagagtttgaagaaatcctgggatgcccactgggaggaaggaagccatatcttttctcttgggttctatccctccacgacaagagttgccaagggcaaaggccttggcaaatcaaggcgaatgggctttcttttattgacatcttggcgcttttgatctttggagttgtcctctttccaaatatggaagggttagtggacctagcagtgattgacgctttcctcgcctttcagcatggcaaggaaagcccagtcgtcgccattttggccatgaatgacacgttcgaccggggatgtgaaaagagcggcgcaagaattgtttgttgtgcactggctctctatgtgtggctggtttcacacctttttctccaagaaggaaggaagaatcaggattctatcttcatgcgaaggatgtacaaatgttcccttgatggaacaaggggttgtattaattataatcccgtcctcgccataagacagcttggctaccccatgagaggagtgccatcagacgaaagcatcacgcctttcatcgcacggggttttagtgaccccaatgcaaaggtactccaaggagttcgcaaggcatgtgatgcggtgtga

SEQ ID NO: 2260 - DNA, 175 bp, Glycine max
  Peptide Sequence Number=SeqID_93945
agcacaaaatttcgtgctcttctctccctctcccttcattcatctccttcttcttccaagctcttatccatggccttctatggtgaagcaaaggaatccattgatgaagaagatcttaggcctacaagctccaatggagcttacatcatgtggtatcaagagcatcttcatctag

SEQ ID NO: 2261 - DNA, 162 bp, Glycine max
  Peptide Sequence Number=SeqID_93946
atggcttcctatggtgaagcaaaggactccattgatgaagaagatccaaggcctacaagctccacatggagctacatcacatgtgcttggttcaatcccataatcccaggaatagaaattttgatcgttaatacttcaacaacatctcatagagttgaatga

SEQ ID NO: 2262 - DNA, 744 bp, Glycine max
  Peptide Sequence Number=SeqID_93947
atgggaacaaatcaaaccggcaagaggttctaccaagtcaaggtcaaaagcccagataccaccagcatcaaggaattagggcggttgatggaacccctccaaatgcaagccttccgcaagacttacggaaagatcttagagttgaccatagcagaggatgtcctctcaggggaagaaaaccatatctttcctccgggatgtctcccctctttgagcagaattgcaactgtggtcaaggattcagcaagaggtttggaccgcataaaacagactcggaacggcatagcgggcctaccacagaagtacctagaagacaaggcgaggggtatggccaatcaaggagactgggtcccgtttatggatgtgttagctttgctaatttttggggtcgtcctctttccaaacgtggatggtttggtagacctagcagcaatcgacgctttccttgcctaccaccatagcaaggagagtccggtggtagctgtcttggcagatctatttgacacatttgaccgaagaatagattgggaccagctcttggccgggataggaggtagaacaatcagttggttcccccgatggaaggaaggaaaagaaggagtccttttctcatgtggaagatacccaaacattccgctggtaggaacgaggggttgtattaattacaatcccacgctcgctataagacaactagggtaccccatgaggggagcaccgacggaagaaagcatgtctcctttcctg

SEQ ID NO: 2263 - DNA, 147 bp, Glycine max
  Peptide Sequence Number=SeqID_93948
atggtagtcaccaagggaatcaaggagcttgaaaagaaatttatgaagaagcatgataaaggcaaagggtcattaaagaacaatgacgactttttgcaaatccagaagaaagagattccttacaatccaaaccataagcccaaatga

SEQ ID NO: 2264 - DNA, 669 bp, Glycine max
  Peptide Sequence Number=SeqID_93949
gagcttgccacccagctcgcccaggcgagcaaggttgcttcctccagaagcaacagccttctggaggaaggatctggaaggcccaactttcaaagaagttacggaaactcatggatcgcgcaaaaacacatctttcgatttccgccacatcacggaatttcacggatcgcgcaagcctgcttccttttgatttctgacacgtctcaggacttcatttattgtgcaacaaaggacgccaagtatctcaaagcggctaaccagaggttgcatatcatggttagaacactaggtttaggtcgtgcgttaggagttggtagaggtagaggcattagtgaggatacgcatgaggctgatgttcctctgtgtcacagacctactgcttcagcacgtaggcaacaggttcatctgcgtgaggacgtgacagagagacctgaggatgtgcctcagttgcatgaggatgttcctcatgtgtctgatgccaccccagagatgacaggcgccaccgatgctgttcagacagagggagtggctactgatgggagcttggggtcacctgctgcagatgagggtttccccggtggaccacgcgacccatcgattttgactgattttgctgagcatgtcacacacagcatctggagtggacgggacgaagattttaatggttga

SEQ ID NO: 2265 - DNA, 756 bp, Glycine max
  Peptide Sequence Number=SeqID_93950
atggtcattgaccaatccctcttctatgatttgacccaattgtctagcaaaggtgtgccatttgaaggaacactggatgatgattggatatttgatttttctgtgcatgatgcctgccggttggtttgcaccaacaaagcggatatgaccggaaggctgcttgccggttcattggctcttgaaagccaaatccttcattatctaattgttcatatcctactccctagatcttcaaaccttgcacaggtttctgaagaagatctaatagtcatgtgggcctttcataccggccgacaaattgattgggcacatctagtccaatatcgcatgcataaggcattgcgattaaatgctcctctaccctatccacacttagttactttgttccttcaacattttaacatccctcttgattctgaaccttatgttccaatcaagagatctttcttgatcggtgttgctgtggttgcctcctttggttaccgcaaagagcgtgatggctcttgggtaaaaaagggtgctcaaccaaatgatgatgaaggacacttaccggttgaagggtactcttctctccttcagagtattttggacaggtttgatggacttcaaacctatgttggtgagaggtttgactccttggaacttcaagtgagcacgcaatttgaggagatgaactcaaggattacaaaggttgaagaaaatgtcactatcattcgcgactaccttgatttacctccaccaccaccatcagtttag

SEQ ID NO: 2266 - DNA, 216 bp, Glycine max
  Peptide Sequence Number=SeqID_93951
atggaagtccaagtgtcgaatccacaaagactttggttgtacttaagtgatgcaaacccaattattaatttgacctgccagactcccaacaaaggaggtttaacctctcatagccatgagaggttttacacttcaggggctaatatggatggaagaaggggttggatgactagaaggaagaaagagggaatgactaagaaggagggtttctcctaa

SEQ ID NO: 2267 - DNA, 681 bp, Glycine max
  Peptide Sequence Number=SeqID_93952
atggtagaatattcaaagaagcgaaagggatcatcctccaccaccgctgctgctggccatcgctgccacggaccatctgaagcacccaaaacacctattcatccttccttatcatctccaagatcatccactatgtttgcttcagatgatcaacatctacggtacatttctcaattttcttctaggatcattctagaccctaagtacctagacccagatttctttaatgatgaaacatttgattgttatcaagtgtttcaaaactctggattgattgattttatgtctttaaaattgccttactatcctgaacttgtcaaagtcttctacagcaatttaaaaattcaggatggtgttatttcttctgaggtgcatggtagttccatgatcattgatcaatctttgttcttctcattgacaaaattacccagtcaaggtgcaccttttgagggcaccattgttgatgactggaaattcgattattctagtcatgatactcgccgtatggtttgcaatgaccaggctgaaatgaccggtagattgctggccggatcattgacatttgataatcgcatcatgcactatataattgttagaattttgcttccccggtcttcaaatttggctcaagcctctgaggaggacttgattttgatgtgggctttccttaccggtcgttag

SEQ ID NO: 2268 - DNA, 201 bp, Glycine max
  Peptide Sequence Number=SeqID_93953
atggccatagaagatcagcaaatcagtttcgatatgtttcatgaagagggagctttgcttgaccaaaatttctgtttgaaggttcatgtgatggttgaaaggagacctgagaaaaagctaagcgcacatcactacgctaagcccaacatcttcactggaagtaaacttcaagcagtgggcttagcggagatgatgcgctaa

SEQ ID NO: 2269 - DNA, 979 bp, Glycine max
  Peptide Sequence Number=SeqID_93954
gaacaaccagaattcaacatccaacccatacaaataattcctggtcaagcttctgtccctgagaaactggttcccagaagacaacagggagtgaagattgctgaaaactctagccttgcaacaagtcctagggaagtagacacggagatggacaagaaaatccgcagtattgtgagtagcattctgaaagatgcttctgtgcctgatgctgagaaagatgttccaacatcgtccaccccaagtgtttctgtgcctgatgctgagaaagatgttccaacatcctccgctccaaatgctgaagccttcccttcacccagtgaagaggaatcaacagaagaagaggatcaagcctcagaggagacccctgcaccaagggcaccagaaactgctccaggtgacctcattgacctggaagaagtcgaatctgatgaagaaccctattgccaacagactatggcacagaagaagagtactccaatcactcctgccacatccagaagaagcaagggccaagaaatctggaagaaaggtgcctggcttgcggttgaaagagaactgggaagagatgccttggattgcaaggagaccatggacctcatcaaggctgctggactactgaagacagtcaccaagttgggagactgttatgaaggcctagtcagggaattcattgtcaacattccctctgacatatcaaacagaaaaagtgatgattatcaaagagtgtttgtcagaggaaagtgtgttagattctcccctgctgtgatcaacaaatatctgggcagacctactgatggagtgatagatattgatgtttctgagcatcaaattgccaaggaaatcactgccaaacgagtccagcattggccaaagaaagggaagctttcagcagggaagctaagtgtgaagtatgcaattctgcacaggattggagctgcaaactgggtacccaccaatcatacttccactgttgccacag

SEQ ID NO: 2270 - DNA, 243 bp, Glycine max
  Peptide Sequence Number=SeqID_93955
atgaagaatggtggaaaatcttcacgaaatcgctcacagaaacgtcttgaaagcgttgcggaagtgcctgggcttggattttcttcacggaaacaatttttctcactaatttcaagggaaaagagggaggtggttgccgcccagctcgcctggttgcttccaccagaaggcaccgccttctgttggaacaccctggaaggtccaagtgggcctggttgctatttgcacacccctttttactaa

SEQ ID NO: 2271 - DNA, 444 bp, Glycine max
  Peptide Sequence Number=SeqID_93956
atgtcagtgaaaaacctcgtcgggcgcctaggagtacatgacaagacaaaccacacaatagtaagtcaagtcactctcactagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 2272 - DNA, 489 bp, Glycine max
  Peptide Sequence Number=SeqID_93957
atgggtgatcaagaggagacacaggaacagatgaaagccgacatgtcggctctgaaagaacatatggcctttatgatggaggccatgttaggaatgaggcagctcatggagaagaacgcggccagcgcttccgctgtcagttcggctgccgaagaagacccaactctcttggcaactgcgcaccatcctccctcaaacatagtaggacggggaagggacacactggggcacgatggcagccctcacctgggatacaaccaaacggcttacccttatggattgccgcccaactactcaccacccgtcttgcaagacgatgcggtccatattgcttctcccgtccttgaaagagaacctcctcaacagcccgacgaggtccacaaagaccctcaagactatgctcgaagggatgtcgagttctatcccccgatccccgaagggccgtcacccagcacgttgcctcagcccaacatcacgacacaaccaata

SEQ ID NO: 2273 - DNA, 222 bp, Glycine max
  Peptide Sequence Number=SeqID_93958
atggtagtgggaaatgcaactatagaaaaacctagagaagaatgggatgatgatgaaagaagaaagcttcaagaacatgaaatagaacttatgagactccatcaacatgaagagaatgacaaaaagaataaaggaattgcactcaaagcctcgtcatcttctattcaagaaaaaggtgacaaagaggacttgaatgaaatagaagaagatgagattcaataa

SEQ ID NO: 2274 - DNA, 249 bp, Glycine max
  Peptide Sequence Number=SeqID_93959
atgagggttcactgtaatcaagcaagtcagagacctagcatgatcacagattcacctccactccttatgttcccacaaacccggtccccagcggagtcgccaactgtcgcaacctacccttcgatgggagggcgacacgagactcacggatgcatcttccaagaaaggaaaatgtgcggagtcaccaccaacgtttatttgaggaaaacgtcagaaaaaccgaaaaaagacgtgatctgcgaactttaa

SEQ ID NO: 2275 - DNA, 389 bp, Glycine max
  Peptide Sequence Number=SeqID_93960
tgtcttcttccctagggcttgttgcaaagctagggttttcagaaatcttcactccctgttgtcttttagggaccagtttctcaggaacagggcctggaccaggaatcatttgtatggattggatattgagtgcaagttgttcctggtttgatggagtttcggaggatgatggagatgatggtacagagggtcaaacaggggatgaggtttcttttggtgaggtagccatggagaagcagagctttgggagtgtagtgaacgtgctattaatgttgagtgagaagtttgagcacgttcagatagaagtaactgctataactcctctagcagacaaatgcccagcttgcccctcagtttttcaaactgatttgcatccaatgcctttgtga

SEQ ID NO: 2276 - DNA, 417 bp, Glycine max
  Peptide Sequence Number=SeqID_93961
gagatcttacctcctgtggcttcttgtagtacttctgaaatagccatagagggggataaggagaaggatttgcctcttgaggtaattctgcctcacagcagcaatttgaatataaagaagaaaagcagggtcaatgttccctttggtcaatatgacttaaaggtagcaagtgaggaagtggcccagcggataagtggcccagcggataagtggcccaactcattctgccacaaagtttctaaaattgattccatgccttcaatacaacaggacccaatagagctgcaatgtgctcttttaaaggaaatgggcttgacttatagggaagatgccaataaggttaaggggcttatattggatacggaaaatagagatgatatgatggcagctgagaggggaattaaaaaagatcaatag

SEQ ID NO: 2277 - DNA, 1032 bp, Glycine max
  Peptide Sequence Number=SeqID_93962
atgggcactctccaccgcagaggcaccaaatccatgtccgacctcctcatctgccacgtgcctgacgaaacccccctccaagacttccgcatcttcctccgcctcctccaccgttcttccctcacttcctcatccgacgtcgttttcctcttcccttctccttcctcatccatcaaattcacccatattattcttcaagagaacaccgcattctcttctttgctgcacctccacgcgcacctcaactccacgcgctggcgccaacaccccaaatccaccttcgaccccaatcgcttcatctccaaaaccacacaacaacaacaaccactttggggtcccaaaacaagaaccaactcaaaccggtcccactcactgagttacggatcggtgctgagtttcgacgcctccgaactcgacccggagaactcgctctcgagtttcctcgacaaagtcccactcactctccggcgctgggcgtgctacccaatgctcctcggccgagtcagacgcaatttcaaacacgtcatgctcgccgacgtgagaagcctcttgattttaaaggaccctctcgcccgagtgaggaatcggagccccgactcggtcattctcttcacgaaaacggagaagcacgggaagagaactcagcgcgcggtcgtctcctccgttatcatgggcggagctcgcggcgtacggcggctctccggcacggtggtggtggagatcgtccgcgccgccacgcagcacaggaagaagaaaaactcggtgtccgagtcggctgtactgagtcaactcgtcggcgggagcgagtttgtgtggaaaaacaagaacgttaatttgatagcttcgtccgagtcaatacccgagttaacaagtgcaagtgcaagtgcaagtgtaagtgctgcttcttcaacgacgtcgttttcggattccgcgatggttcaacgtggtgtgagtaatcacgaccttaattatgtcatcatgaggcaaatttgttcgtctgtggtagattcttctgtctatagcgattgttag

SEQ ID NO: 2278 - DNA, 351 bp, Glycine max
  Peptide Sequence Number=SeqID_93963
atgtgttgtaactttatggtggacatccatgatgcaggcctcaaagttagatatctttggggagttatgggtcggaactcagagatgctatatacgaatctccttcagaatatcactcaagatttgactcctgtgaaaccttgcttggtggaaggaattccagatatgtggatttggaatcatagtgtgtcaggtgtgtacacaaccaagagtgcgtatgcctggttatctaatgtccaggtgggagatggtgttcttagtcatagaggcttttactcctcacaagcaagctcgtcagattgcttcaatgttgatgggagtgtcatgaatgaaggatccctcggaatctga

SEQ ID NO: 2279 - DNA, 345 bp, Glycine max
  Peptide Sequence Number=SeqID_93964
atgaaatttctgcatattgagcattgtccaaggcaagagactttgcctcaatggattcaaggagccgcagacactttgcagacattgatcattttaaactgtgatagacttaagatgcttcctgagtgggtgacaacaatggctcatctcaaggtgctccacattgttaactgtcctcaactgctgaatctcccaagtgacatgcatcgcctcactgcccttgaagatttgagcatagatggttgtcctgaattgtgtcgaaagtgtgagccacaaactggtgaatactggtccttcatctctcacatcaaactcatttccattggagaaaaaagagaagggtag

SEQ ID NO: 2280 - DNA, 510 bp, Glycine max
  Peptide Sequence Number=SeqID_93965
atgtctgatttagaggtatcaggagtaccaaatttgaaggcactcgataccaacctgtacacatcatctcacactgtcgtccaaaacgtcttgtatatgacagtcgtaacccaaaatctgatgaatggtgttcgagatacccaattggttcctctccaaggtttcaatgtcaagttcgggtcttttgcaggatttcccggaggggtcgccgacacacgcggtggtgccgtagatgagcacgagagcgcggtggccgcaacgacaaaactaggagaggaggatgaggccaaggaggttgttgaggtggagggactccgtagcggggtcgaagctacagtagaccttgaggggtggcggtgtcaggcacacgctgcggagcgcgtcactggtgatggactagaccagactgcgctcttcgacgtttggaatgaaagggcttgtggcagcgttgctggaagctgtggttgtgttgggggcaataatgggaggtgggaccgacgaggaggttga

SEQ ID NO: 2281 - DNA, 1298 bp, Glycine max
  Peptide Sequence Number=SeqID_93966
atttttgctttactagtggtcatattgctcatctttggctggcacttggattacttcaatccggagttggaagtcaaaagatagagaacattgcaagacaatatatagatgagctacattctagatcatttcttgaggattttatggattttggcaacctttactttttcaagatacatgatttggtacatgatcttgcgctatatgttgcgaaaggggagcttctagtggtaaactcccatactcacaacatacctgagcaagtaaggcatttatcaattgttgaaattgattcatttagccatgcattgtttcccaagtccagaagagtgagaactatattgtttccggtcgatggagtgggtgttgacagtgaagctcttttggatacatggatagcaagatacaaatgcctacgggttttagatttaagtgattccacctttgagactcttcctgattcaatatctaagttggagcatctgcgagctctccatgttacaaacaattgcaaaataaaaagactccctcattctgtatgcaaactccaaaatttgcaatttttatcactaagaggatgcatggagcttgaaacattgcctaaaggattagggatgttaatcagccttgaacaattgtatataactacaaaacaatctattctgtcagaggatgaatttgcaagcttgagaaatcttcaatatttgagttttgaatattgtgacaatttaaagtttttattcagaggggtacaaatcccttcccttgaagttttgctcattcaatcgtgtgggaggctagagtccttacctcttcattttctccctaaactagaggtcctgtttgtaatacaatgcgagatgctaaatctgtcgttgaacaatgaaagcccaattcaaagattgaggctaaaacttctgtatctggagcattttccaaggcaacaggcattgcctcattggattcaaggtgctgctgacactttgcaaacgttgtcaattttaaattgtcatagtcttaagatgcttcctgaatggctgacaacaatgactcgtcttaagacgctccatattgttaactgtcctcaactgttgtctcttccaagtgacatgcatcacctcactgcccttgaagtcttgatcatagatggttgtcctgaactgtgtcgaaaatgtcagccacaatctggtgtgtgttggtccttcatcgctcacatcaaatgcgtttgcattggagaaacaaaagggaaacttcattctcaaatgctgtctaggctgcgattgaggttgcgtgattag

SEQ ID NO: 2282 - DNA, 819 bp, Glycine max
  Peptide Sequence Number=SeqID_93967
atgtcttataataatgacaagccaggcaaccacaattttgatcttcttaagaagctggttctccctgatggttcggttctccgtgctcagttacctggtaggcccactcgtgattctctatttgttgatccagccagagatgggactagcttgctcaaaatatggaacatgaacaaatgctctggagttgctggtgtatttaactgccaaggtgctgggtggtgcaagatagagaagaaaacccgcatccatgatatatctcctggtacactcactgcctctgtctgtgcttctgatgttgacctcatcacacaagtagcaggtgctgaatggcttggagagacaattgtttatgcttacagatcaggtgaggtgattcggctaccaaaaggggtttctgttccagtgactctaaaagttctggagtttgagcttttccacttctgtccaatccaagaaatagcaccaagtatttcatttgcagcaatagggctactggatatgttcaacactggaggatcagtggagcatgttgaaattcatcgagcttctaacaacaaaccagaactgtttgatggtgaggtgttatcggaaatgacctcttggctcagttctaaccgagcagcaacgacaactattgctcttagagtcaggggaaggggcagatttggagtttactcctcccagagaccactgaagtgtgtggtaggtggcactgaaaccgacttcaactacgactcagatactgggttgacaaccttctccatcccagttcctccagaggagatgtacagatggtcaatagagttccaagtttga

SEQ ID NO: 2283 - DNA, 729 bp, Glycine max
  Peptide Sequence Number=SeqID_93968
atggaagcaggaaccacaacagcaaaagcaggggtgcaaatgacaaagactaagagaagcattaccaggccttcgtacctcaaagattatgacaattctgttagcacttctcttcttttctctggaggtcctggccctcgaagccagcttcttataccagcacccctatcacttgccataagattaaatgaactagtatggacatggagtgatggaggcaccatcaccacaccacccgtgaagttctatccaacctccgtttctccactttccaaaagaaaatggccgaatattttgtctttgatattgctgaatcactgctggggaagcttgcttcttatgtttctgaagaagcttctcaagcctagctatgatgtgtatgaagatcttaaagggatccaagacacattgtccattgtaaaagatgtgtttttggatgctgaggagaaaaaggagcaaaagcacggattgcgcgcacaaatggctgaggcagattcaaaatgtaaaacctttgtagacaatagcttctgtcaatctagaatttgcaggaaattttctgcaaactttcctgcaaaagaaatctgcaggaaactttcctacgaaataagcctcaacaaaattcacaagaaatttcctatggatttgaaaatcacaagaaaatctgcaggaaagtttccagtcaatttgtatttccgcaggaaattacctacggattttcttgcaaaataa

SEQ ID NO: 2284 - DNA, 135 bp, Glycine max
  Peptide Sequence Number=SeqID_93969
atgcattggttacgatggttcttacgtattgtcaatccagtattgacagcggaagaagaggaagcgcaaacgaagaagaaaggggcacaccagcaacgaggtagggtgagggagaggagaagaatgagcttttaa

SEQ ID NO: 2285 - DNA, 1749 bp, Glycine max
  Peptide Sequence Number=SeqID_93970
atggttgttctgagcgactgcagagacatttgcaaggtgctggtgtggttcacacacacaaggtccctccggaagggtctccaactccatgggcaagttatcaaattagggttcgaagccattccattggtgtgccaccacttgatcaacttctactccaaaaccaacctccctcactcttcgctcaaactcttcgattcttttccccacaaatccgccaccacatggagctccgtcatctcctccttcgcccagaacgacctccccctccctgctctccgcttcttccgccgcatgctccgccacggcctcctccccgacgatcacacactccccaccgccgccaagtccgtcgctgccctctcctccctccccctcgccctctccctccacgccctctccctcaaaaccgcccaccaccacgacgtcttcgtcggaagctccctcgtcgacacgtacgctaaatgcggcgacgtcaacctcgcgcgcaaggtgttcgacgaaatgcctcacaaaaacgtcgtctcctggagcggtatgatatacggatattctcagatgggtctcgacgaggaggctttgaacctgtttaaacgtgctctggagcaggattatgatataagggttaatgattttacgctttctagtgttttgagggtgtgtagtgcttccacgttgtttgagctggggaagcaagtgcatggactgtgctttaaaacaagttttgattcttcatgctttgtggctagctcgttgatctcgttgtactctaagtgcggggttgtagaaggaggttacaaggtttttgaggaggtgaaagttaggaaccttggcatgtggaacgcaatgttgattgcgtgtgctcagcatgcacatacagggagaacatttgagctgtttgaagagatggagcgtgttggggtgaagcctaacttcatcacatttttgtgtctgctttatgcgtgcagccatgcagggttggtggagaagggggaacactgctttgggttgatgaaggagcatggtattgaaccggggtcgcagcattatgctacattggtggatttgcttggtcgtgctgggaagttggaggaagcggttctggttatcaaggaaatgccaatgcagcccacagaatctgtttggggggctttgttgacagggtgtaggattcatggaaacactgaattggcttcctttgtggctgataaggtttttgagatgggtgctgtgagttctgggattcaggttttgttgtctaatgcttatgctgctgctggaagatgggaggaagcggcaagggcgaggaagatgatgagggatcaaggaataaagaaggaaactgggttgagttgggtggaggaggggaatagggttcatacatttgctgctggggataggtctcatgggaaaaccagggaaatttatgagaagttggaggagttgggagaggaaatggcgaaagccggttatgttgcagacacttcttttgtgttgaaagaagtggatggggatgagaaaagtcaaactataaggtatcatagtgaaaggttggccattgcgtttggacttattactttccctccagaatggcctatcagggtaatgaagaacttgcgagtttgtggtgattgccacactgccatcaagtttattagcaagtgtactggaagggtgattattgtgagggacaataaccggttccaccgatttgaggatgggaaatgcacttgtggagattattggtga

SEQ ID NO: 2286 - DNA, 354 bp, Glycine max
  Peptide Sequence Number=SeqID_93971
atgcagttattcacagctttaccggttgttgatgcaattttaaggctcgaacatgaagaatatacctacgctataggaagtagcacagggccagagaattggtggcgtattaacccaaaatggaaaacatgtggggatggaaaactacaatctcccattgatctgcttgaccaaagggttcaagagcttcctcaattgggtaaacttaagaaagcttacaaatcagctcctgctgtcctaaagaatagtggtcatgacatcgtgggatatgaggaaaatgcaaggccaacgcaggaacttggaggaagacaagtttggttatatggacctatggagaatgaaaagcctacttaa

SEQ ID NO: 2287 - DNA, 309 bp, Glycine max
  Peptide Sequence Number=SeqID_93972
atggctattgcagcagcggctgtggtggtgccattgggcctgctcttcttcgcctccggcctccttgttaatctcattcaggcaatatgctatgtcgtggtaaggccggtgtccaagaatttgtacagacggatcaaccgggtagtggcggaactcttgtggctggaacttgtatggcttattgattggtgggcaggagttaagccttacccttgcatatgcaaaaaggctgtttccggattcgaacccatgaccaacaagtcaccaaggcacaactttaccgctgcaccagggctcgccctctcatag

SEQ ID NO: 2288 - DNA, 837 bp, Glycine max
  Peptide Sequence Number=SeqID_93973
atggcgcagaagaagaaagctagggtttccgacgacgaggaaatggaagtgcaacatgatcaaaccagcctttaccaggttcttggcgtggagagaacggcgtctcagcaggaaataaagaaggcgtactacaagttggcgttgcggcttcaccccgataagaaccctggtgatgatgaggaagctaaggagaaattccagcaactgcaaaaagtgatatcgattctcggggatgaagagaagcgagctctctatgatcagactggttgtgttgatgatgctgaccttgctggagatgttgttcagaatcttcaagagttctttagaacaatgtacaagaaggtgactgaagctgatattgaggagtttgaagcaaactatcggggatctgactcagagaaaaatgatttgattgatttgtacaagaagtgcaagggtaacatgaataggcttttttgttcaatgctttgttcagatcctaaacttgattcacaccgattcaaggatattctcgatgaggctatagcttcaggagaactaaaggcaaaaaaagcctaccagaaatgggctaaggaagtatctgaaatcaaaccgcccacaaatcctttgaggaggagggaaaagtcaaataagcagtcagagacagatctatgtgcaatcatagcacaacgccgaaatgagagaaaagggcagtttgatttaatgttctcatctctagtttcaaaatatggtggtggtgatacgccagaaccctctgaagaggagtttgaagctacacggagaaagctggagactggtagatcctctaaaaactcgaagcaatcaaagcgaaagtaa

SEQ ID NO: 2289 - DNA, 1560 bp, Glycine max
  Peptide Sequence Number=SeqID_93974
atgagccctatgcaatgtacgtgccatctatggaatgagaatgatcgaagacaacatggagggcatcgtagtttgagtgaaataattcgtagagggaagagtgtatatcgaggagtaatcaagtgcaactaccagcgtttcgaagcatttgtgtgggataactccgatccagggaagagaggaagaccagtttatgtgggtgcttattctactgaagttgacgccgccaaagcccatgatttagtgtcggtgaagattgggggcttaaatgcattaacgaattttcctgtgagatgctattcgaaggaaatggacgagatgcgatggatgagcacaagggattatatttcagctgttagatggacgggcaaggactatagtgacggtgactctccttaccgtggcgtctacagatcatacatggtcccaataggcaagaaatgggaagcgaggctgggtcgtgagggttcaccaaacttgcacttgggaacttattacactccggaggatgcagccagagcttttgatattatttcaataaaaataaagggaagggacgccattaccaattccgatttgaacagttatgaggtggatggcattatgaagagccaaattacaacagcaatggatgggtcgattactttgaaggtagatggagtcgacaacgaaactgaagcatatccccctcaaactcaaagcgtattccagcacaatcatcaacaattcatcaactcatcatccttttctcgtcgctatcaaaaccacaatctcttttcaagcaacccttatgctcttggtggttttattggcggtgttggaagtagtggcagtggcaatgcatatggcaattcaattgttaaccttgcagcacagactgcacagtttacaaatcagaatgatacactgcaacagccacttcagactcagcagagccaagtgaatgttaacaatttcaatcagaatatacgcagcaacaacatcaacaacaacaacaaacagtttctgtctcaggattctaaccgttctgtgctttctcatgccccccaaaatcttaatttggataagtgtgtccctttccctgattggccatctggttttggcttgctaggggggaacttggaattggaacctttaagaaatattaattccctgaatgtgcaacctctagaacaagtcatggtgaatgaaagtacaggagcaacaaacggtgtttcttcattagggacacaaatccaaccagtggaaccatctaatcaggaatttggagctacacagctaccgtttcttgaagtgaaccaaagttttgagccttacaacttccaagccaatactttgaaccagataccacatgggaacttaaactccagcctttctgatagttttcagaaccctagttctgaaacaaacaacaatggttccccaggtgagaccagtggatgtccaattgatttggacatgagagattatctcaacagatcttatatagaagacaaagattttgcttgtgattttgacatgtttggagcattagtgaatgaggatagacaaggcctctag

SEQ ID NO: 2290 - DNA, 1225 bp, Glycine max
  Peptide Sequence Number=SeqID_93975
cattcagaataatcccaacatcaagagactccccaattctatttgcaagctccaaaatttgcaattcttgagtgttctgagatgcaaggagctggaagcattgcccaaaggattcagaaaattgatttgtcttcggcatttggggataactacaaagcaacctgttttgccttacactgagattaccaatttgatctcccttgaacttctgtctattgaatcatgccataatatggagtctatctttggaggggtgaagttccctgctcttaaagcattgaatgttgctgcctgtcatagtctgaagtctttgccactggatgttataaattttcctgaattagaaactctgactgttaaagattgtgttaatctggacttagatctgtggaaggaacaccatgaagaacaaaaccccaagttaaggttaaaatatgttgcattctggggcttaccacagctggtggccttacctcaatggcttcaagaaactgccaactccttacggaccttgattatttcagactgcgacaatcttgaaatgcttccggagtggctgtcaactatgactaatctgaaagtacttcttatatatggttgtccaaagcttatatctctcccggataacatccatcacctgaccgcacttgaacatttgcatatcagtggttgccctgaattatgcaaaaaatgccagccccatgtcgaagatgaagaatatacctacgctataggaagtagcacagggccagagaattggtggcgtatcaaccaaaaatggaaaacatgtggggatggaaaactacaatctcccattgatctgcttgaccaaagggttcaagagcttcctcaattgggtaaacttaagaaagcttacaaatcagctcctgctgtcctaaagaataggggtcatgacatcgtgctgctcaatgacataaaatcaagtgtggacaaggatatagatgtaggactaatcaactcaagagagatcaagtttaaaagcagaccgtactacagatatgttggttctcttacaactccagcatgcactgaaggtgttgtttggacaattgtgaagaaggtcaggacagtctcaagcgagcaattaagtgccttgaaaggagctgttcatcatggatatgaggaaaatgcaaggccaacgcaggaacttggtggaagacaagtttggttatatggacctatggagaatgaaaagcctacttaa

SEQ ID NO: 2291 - DNA, 291 bp, Glycine max
  Peptide Sequence Number=SeqID_93976
atgacaataaaaaacttcgtaccccattgcccagaggctcttcgctatgcaaaggaaggcctcaaagggcaggttgaagaggagaagggtggaatcaaggtcagtgataccatattcggagaaagtcaggcaaacacagcaagggagacaatgcagttgttggacttgcatactttctcgaatgtaactggtgctgttgtagttatcttgtatcagtatttttcacctggattgatcgagaatcttaatagaaagtgtgcttctgccgatatagaaaatatattcttttga

SEQ ID NO: 2292 - DNA, 834 bp, Glycine max
  Peptide Sequence Number=SeqID_93977
atgacggaaccaacggagccatgcacgtcatcctcattggcgagggacccaaccaccgtgattcacccgaggcgcgagcccttcgagcacggcctcttgccaatcccgcgcttcatcttctccgacccggcgcaaaccctaattccgttgaagcagaagcttctcgagttatcctccaatcagcgagtcgactcggcggcaatctccgagtcactgcagatctccattgagcacgccaggctcgtactcgatactctcgcctcggttctgcactccgacgccgaacctctcgtcgccgccaagctcgacgaaatcgattccgtcggcgtcgatgtccatgatctggttttgttcctctacattcaatcctacaagaggctcctcccgcgaacgcacaaggactccgccgccgtcaccgacgtctggccttccacctccgccttcgatggctacttgtctgctctctcgccgcttcagcttgtgcgcagtaacagtcggcggggtatgccatcgcaggttgatgaagaggcgcatcagttgtcgtatctgcaaaaacacctggctaacattgtgtctcttctagcacagcctgtggagggagaaggcgaagaatcgctgataggtatcatcgtagtcaaaatcgcaattcagcacctaggattgcatgatcctacgatttttttggccacggttgatcccgattgggccatgaatcgtaatcttgcaggatcggtctggattgtcgttgaagatcatggaaacagtgaattatgtatttcaagtgagcgggatgttcactgggtttgtgggttgggttccacagcccaattataa

SEQ ID NO: 2293 - DNA, 1617 bp, Glycine max
  Peptide Sequence Number=SeqID_93978
atggcatctatcaaacaaggtgatcaatctataactgattactttacaaaattgcgagttatttgggatgaattggaaagttatagacctgatccagtgtgttcatatgatccaaagtgtatgtgtgatgctcttactagtgttatggagaggaagaaacaagactgggctatgtcttttcatatgcagcaagagagacaacttgccagtaatgatgtaatgggaaacataagtctgattaatgcagccaacaccaattcatccaacttaggaaattcatgcacctattgtggtaaagacaatcacactgtcgataggtgttacatgaagaatggttttcctcagaattatgcttccaaaggaggaagaggaaaccaaagtggctttggcagaggaaacttaggaggaaaaggaagcaagctttgcacatattgtggcttcactaaccacactgtagatgagtgctatagaaagcatggttaccttcctagacacaagttatacaagtctctaggttcaaacatcaataatatcagtgccgagaaagaagaaagtgatagctcagctcagcagaggttgccaaatagagggttattactcatcaagtttggagagtgggtagctaatgccattgtcgccttcattgaagctgcgaagtcgaaccacaaattgtcttccaaggttgatagtgcttttgccaagttactatgcaccaaattagatggtcatgagctatttaagcactgcaaaggcttgcagagggagaaaaatgaattggctggagagatggagaatactgctgctgagaaggacaagcttgccaaggtagttgttgacttaaaggccaagttgaagaagtcagagtccaggccgggttcttccctagtaaataaggaccttggacaccatgaagttggtggttatgatggagacaaccatggggtcgtcttggttgatacccttgaagtcaacacagttgatgtcgatgtccctgatggcatggaggtgacactttggggactgactggattgccctcgatagttgttgctcgcatctttgctggtggtgtctttgtcttcctcgatcttctgctctgtctcttcttctgttggcaccgtggtttctgtggtgatccttttggcttccttaaggattgtagtgcaattgaccgtcagaggacttcgtttttgaacctggatatcccttccattttggatatagtctttggctcgttcatgcaactcatccctgctactggaattgaaacacttaacaagagtgtcgaagctgtcgatggaccaaagggacgttgggaatacacggcacatgattgcgttgtcattgggtatgtcaaattccttgatacagtcgacaaatgggtgtcaacgagtatttcgcctttcaggacggtgtatgtgggagagactaggatcatcttgagtattgactatgtgtcgggagtatcagtatctgttgtggttgttggaggaggattgaagcctttgaaaggggtctcacgtttgaggctagattgtgtgctaaccataggtgaaaaaaagaggttgcgaggtgggctcctagatctcgcacgtcggactgagagttccttttgttaa

SEQ ID NO: 2294 - DNA, 1294 bp, Glycine max
  Peptide Sequence Number=SeqID_93979
cggcgtcaatcatattggtggcgatgatggtgatcatggtgatgatcacattggtggtagtagtggtggtgagggtgatgacaacgacaacgaccacggtcatgtgatggtgacagtagagattaacgatcatggtagtggttgcggtggagtttatgatagttatggtggaaacagtcataacatgataatggtcatggttatgatagcaccaatggcttcagacgccaaactctcctcttctgagtccctcaacggtttgaaattcggccaaaaaatctattttgaggatgttggtcttgctactccagccacctctcttacttcttcttcttcttcttcttctgctgctactgttacttcttcttcttcttcaaggaaaggaagaggtgggtctgttcaaccagctcaacctcccaggtgtcaagttgaagggtgcaaagtagatctgagtgatgcaaaagcttactattctagacacaaggtctgtggcatgcactctaaatccccttcagtcattgttgctggtcttcaacaaaggttttgtcaacagtgtagcaggtttcatcagcttcctgagtttgatcaaggaaaaagaagttgccgtaggcgactagctggccataatgaacgtcggagaaagcccccaacaagctccctcttaacctctcgctatgccagactttcttcgtctgcttttgataatagtggcagaggtagcaactttctgatggaattgacttcatacccaaagcttagtctgagaaattcacttccaactcctagatcatctgagctagctcctggaaatcaaacctccacacttagctggaatggcaactcagagacatcatctgaccttttcttgcaaggttcggtgggtgggacaagcttcgccagcccgggacatcctccaggggaaagttacattggggtcaccgacacgagctgtgctctctctcttctgtcaaatcaaacatggggttctagaaacacagcaccaagtcttgggttgagtaacatgataaatttcaacgggacacccttgacacaacttgctgcatcatctcatggtgcatcaatccatcaacttccaaatacctcgtggtttttcaagggcattgattctggtaactgttcgcccgaggtggtccctgatctaggtctcggtcagatttcacagcctctcaatagccaacttcatggtgagctggacctgtcccaacagggcaggaggcattatatggatctagaacagtccagggcatatgaatctgctcattggtcactttaa

SEQ ID NO: 2295 - DNA, 510 bp, Glycine max
  Peptide Sequence Number=SeqID_93980
atggcagacaagaagcggaaggagaggaatgaaggcaaccgccaaagaccgaagtcgaagaagaagcggccaaacactcaacagaaggagaggggcccttgtttgccctcatctttgcaaaaacagcttgactgtttaaaccctaccacttcctttgacagcattgattctgacgactacaatgacaatgatgtacacgagtacaaggaagaacgagctgaggaggttgaggatgatgattactcgaatgaaaatgctcttagtgacgattctggagaggaagatgatggaaggcacacaaggatgctacaagcaattactagcatgccaagtgaggcttttcaagcttcacaactggttcgacctggcagccaccactttccatcatgcccgaacataataccagacaaacaaccactgaccacctggaagaggctgtcaatcgccttacctagggacagaccactgtggcccaaaaccatgctgcattatcccaagcttagtccgtag

SEQ ID NO: 2296 - DNA, 645 bp, Glycine max
  Peptide Sequence Number=SeqID_93981
atggctgaatcatttatcttcagcatcgctgagtctctcataacaaagcttgcttctcatgctttccaagaagcttctcgggtggtgggtttgtacgaccatctccgagaccttaaaaagactctctcattagttaaggcagtgctgttagatgctgagcaaaagcaggagcataaccatgtgcttcgggaatggctgaggcagctcaaaagtgtcttctatgatgcccaaaatgtgttggatgaatttgagtgccaaacactgcgaaagcaagtgctcaaagatcatggtaccatcaaagaccagatggctcaacaaatcaaagatgtcagcaagcggctagacaaggttgcaactgatgggcagaagtttggtctccgaataattgatgttgacacacgagtcgttcataggagggacacgagtcgcatgacacactcccgtgtgagtgactcagatgtgataggaagggaacatgataaagaaaagatcatagagcttttcatgcagcagaatcccaacgatgatgataaaagtctctctgttatccccattgtggggattggaggcttgggaaaaactacacttgcaaagtttgtgtttaatgataagaggatagatgagtgtttcaaattgaagatgtgg

SEQ ID NO: 2297 - DNA, 429 bp, Glycine max
  Peptide Sequence Number=SeqID_93982
atgcggtcaatgtttcggtgttcggcgcaatcgagcacggaccagtccttctcgatgatttctgggatggaaacgaaggacgcgccctcggggagggaaatgggggcgtcgagaaattcgggagagagtgagaccactgctgcagaggctgtggaagatgggttggtgtttggtttgaagaagggggcggaacttgcatgctggagggggagtgaagacgaagtgaatatggaaggtggtttggatcatttaaaggcaccgtttttgtcaagcaataataatggtgagctcagtgaagtcactcgtctcaaatgcgattttttctccaaattgcctgataaggttcggtgtggtctcgatcctgagctctcttttcacattgactactcaaaggcaactggcttaacaaaaggtattgtcgagttttaa

SEQ ID NO: 2298 - DNA, 567 bp, Glycine max
  Peptide Sequence Number=SeqID_93983
atgtctgtgataggggcgtattcacattttctctacggagaggtttatcagaaggatcaacagtgcccacagtacttggtgagtgggaggggatatttgttttctcacaagagtagttgtgggagcatatgggttggaagcagaaagagtgaaggtaaaattaaaaggaggaatttgcgtgtggaagctatgtggcctgatttgtcaagaccgaatgagttagagatggaagagattagtgattctgagcagcttgatcaaattcttgttcatgcccaacagaactcacagcctatcctcattgattggatggctacttggtgccggaaatgcatctatttgaagcccaagttggaaaaattagcccctgaatatcacaacaaagccaaattttatttcgtggatgtgaataaagtacctcagactctagtcaagcgtggcaacatatctaaaatgccaacaattcagctgtggaaagatggagagatgaaagcagaagtcattggaggccataaggcctggctagttatggaagaagtcagagaaatgatccaaaagtatttatga

SEQ ID NO: 2299 - DNA, 159 bp, Glycine max
  Peptide Sequence Number=SeqID_93984
atgaattcacggtctttttatatggagaggtacgggtgtttgggcttgaagtattcctttactagagagggggactttaatgcaataaagaggcgaacggaaacaagtagctttctaggtggattccagagtgctgaacaaatttcaagagtttattaa

SEQ ID NO: 2300 - DNA, 114 bp, Glycine max
  Peptide Sequence Number=SeqID_93985
atggaaaaccccgaagttttggtatgttgtgacaatgatgcggtgggtggagagagggaatcgtgggtgctttggcagaagaaggaggaggggcgtgtgaagtgtgaagtgtga

SEQ ID NO: 2301 - DNA, 345 bp, Glycine max
  Peptide Sequence Number=SeqID_93986
atgtctaattactcttactcttcttcttatccaacgtggaatagttccaactcttcaagcgctatgattggaaggttctacggaaactcctattctcatcagcaacttcaacctataaatggaagccctttgggttcgtggcgaatccccaccgccgccacaactgctcatgcgcaaagtaaccctattttcaaccgtgaatgctcgttgcatcctttgcctttgttttcaggtgaggaaatggtgaacgcgaggatggggttctccggttcgcagaaccggtttggtaattatgaccccaagtccagcgtaaacgaccatctgagtttggatcttcatctgtaa

SEQ ID NO: 2302 - DNA, 984 bp, Glycine max
  Peptide Sequence Number=SeqID_93987
atggccaacaccaaacacctcacatttactttcaccatcgttctcacgctcctcttctcattcgccacagcaaaatccccaacggctttgggtgtccagaaggagaagctcagccaccttcacttcttcttccacgacatagtgagcggtccaaagcccaccgcggtgagagtggcccaggcccacatgaccaacacctcctccacgcttttcgggctcctgatgatggccgacgacccattgaccgtgggccccgagcccgggtccaaactcgtgggaaaggcccaaggaatttacggatttgcgtcccaggaagatatgggtttattgatgatcatgaatttcgcgttcaccgaagggaaatacaatggcagcacactaagcttgttggggtggaacgcggtgttgtccaccgtgagggagatgccaatagttggaggaagcggggctttccggttcgcacgtgggtatgctcaggccaagactcacacggttgattacaagacaggggatgctgtcgtggagtacaacaaggagaagctcagccaccttcacttcttcttccacgacatagggagcggtccaaagcccaccgccgtgagagtggcccaggcccacatgaccaacacttcctccgcattttttggaattctggtgatggccgacgacccattgaccgtgggcccagaacccggatccaaactcgtcggaaaggcccaaggaatttacggatttgcgtcccaggaagatgtgggtttattgatgatcatgagtttcgcgttcaccgaagggaaatacaatggcagcacactaagcttgttggggcggaacgcggtgttctccaccgtgagggagatgccaatagttggaggaagcggggctttccggttcgcacgtgggtatgctcaggccaagactcacacgtttgattacaagacaggggatgctgtcgtggagtacaacgtctacgtgttccattattaa

SEQ ID NO: 2303 - DNA, 1593 bp, Glycine max
  Peptide Sequence Number=SeqID_93988
atggtccactaccatcgctcccatcaacccagaaagaccaacactgacgaagagtcacagaacaccgtcatgttggattgctcaacctctgcttactacaagagaaccaggcccaagttgttgtctttcctcttcctcatcaccttcctctcttgctgctacgtctttgctcctcttttccttggcccttctttccctctatctctcttgtactctcctgcaaccgaaaatgatgtgaaccgagatggagttgatgcaaatgattctccttgctcttctgtttctactggaactatatgttgtgatagaagtggttatcgttccgatgtttgtgtgatgaaaggtgatataaggacacactctgcttcctcttcagttttcctctacaattcaaggagcaacaacaatgtttcgagaaattttgaagaggaacttcaacatgaaaagatcaagccttatactagaaaatgggagacaagtgttatggacaccattgatgaattaaacctcgtcccgaagaatctgaatttgggtggtgttggtggttgtgatgtccaacatgatgttccagcagttttcttctctaatgggggctacactggcaatgtttatcacgaattcaatgatggaatcatacctttgtacattacttctcagcatttcaagaagaaggttgtgtttgtgattcttgagtatcatagttggtggatcatgaagtatggagacatcctttctcgtctatcggattttccaccaattgattttcgaggagacaataggactcattgcttcccagaagccatagttggtctcagaatccatgatgagctaactgtggattctgcactgatgaggggtaacaagagcattgctgattttagaaaccttttggataaagcttattggccaaggatcaaggggctaattcgagacgaagaaaggaaagcacaagagaagttgagagaacaagtctcatcatctgaatcatcagaagcctcacaacaacagtatataattaggcaacaagtgcaagaaaatccaacgaagaaacctacgttggttattctctctagaagtgggtcaagagctataactaatgagaatttgcttgtgaagatggcaaaggaaattgggtttttggtgcaagttttgaagcctgacagaacaacagaattggcaaaggtttataggtctcttaatgcaagtgatgtcatgattggtgttcatggagcagctatgacacattttctgttcctgagacctggttctgtgtttattcaagtggttcctcttggtaccacatgggctgcagaaacttattatggggaacctgcaaggaagcttggcttgaaatacattggctatcaaattctgcctagagagagcactttgtatgaaaaatatgataaaaatgatcctattctgagagaccctacaagcattaacaagaaggggtgggaatacacaaaaaagatctatcttgacagccaaaatgtcatgttagacctcaggagattcagaaaaaggttacatcgagcttatgagtatacactctccaaatcaaaactgagtctccaacaccaacaaatgtga

SEQ ID NO: 2304 - DNA, 1209 bp, Glycine max
  Peptide Sequence Number=SeqID_93989
atgttggggactgctctgcaatttggttgtgttcgtggtgatgatcggttttacattccggtgaaggcaaggaagaaccagaaccagcgtaaaccggttcagagagagaagggtgttggtgaaactgagagaactgattcagtttcaaagagggaacttgttgcttctgagaatgggaattccaatgagtcttcatactcgttgaagaaaccatcttcttgcccttctgtagagcctgctagtaacattgataggtttctggaatccacaactcctttagtcacagctcaatatttggccaagacaacaatgagaggttggaagacttgtgatgtggagtatcaatcttactttgctcttgatgatctctgggaatcgtttaaggagtggagtgcgtatggagcaggagtccctttggtacttgatcaaagacaatctgttgtgcaatattatgttccgtatttgtcggctattcaactatatggtcaatcagataagaagtcaaatgctaagccaaggtacaccagtgaagatagtgacggtgattactgccgagattcaagcagcgatggaagcagtgacagtgaatttggaaaaaggactgaactttttacagcacaaagaaatagtcactatcatacaggtgatgcttcgtttcaaatgagcaggctatctgtacatgatcacaatacaatgcaagagggattttctagtgacgatagtgaaactgggaatcctaaagatcttctttttgagtattttgatcatgatcctccttatagccgtgaacctttgtctgacaagatacttgatcttgcacgcgactatcctagcctcaagtctctaagaagttgtgatttattaccggccagaaatggaggtactcaggccccaattttggtttatccaaatgacattgatggcggtgtgccaaagatttccttaccaacttttgcaatggcttcctataagttaaagggatctatttggacacaaaatggagttagtgagagtcaagtagtaaattctctcttgcaggctgcagataactggttaaggctgcttcaggtgaatcaccctgattatcagttcttcgtatcgcatggcacatacaacagactgatgatggagttgggatttctaatgtggattcttgttactcattgcataagcagcacaaaagatgagcttgtctcaagtgaagaatga

SEQ ID NO: 2305 - DNA, 219 bp, Glycine max
  Peptide Sequence Number=SeqID_93990
atggatgatcaatccacaaagtgtttgattgcaaagatcccaacaatgagttttttaacctctcattgtcatgagaggcttaaaattacaaaaatggtgaagagtggtggaagagaatggagggaaaatggagaggaattgggaagattgctccaaaatgaatgggtcccccctcttggatgtgccctaggttgctcttcagtgtgggaagctaaatga

SEQ ID NO: 2306 - DNA, 120 bp, Glycine max
  Peptide Sequence Number=SeqID_93991
atggctcatggtcgtcaagcgcttaccttcgataaggttgagttggtcgtaggatctctacttcaaatgggagtaccgtttccgttccataaaccaaggaatacggtgttgccccagtag

SEQ ID NO: 2307 - DNA, 255 bp, Glycine max
  Peptide Sequence Number=SeqID_93992
atgacaattgaggaatcaatacatgttacttttgatgaaactaatattacctctccgagaaaggaatttcttgatgatattgcatattctttggaagatatgcacaatcaagaaaggaatctcaaaaggaagagaaatgaagaaaacaaggatgttcaagatgacatagcccaagaaaatgatgatcttcctaaagaatggaaaaccaaaagaaatcatcctcttgacaatatcatcgtagatatctcaaaaggg

SEQ ID NO: 2308 - DNA, 507 bp, Glycine max
  Peptide Sequence Number=SeqID_93993
atggtgggttacacaccttcgagttttatagatttggtcttcgccagcaaaaggatcgaagtgggtctgaaaagaggcaaatttaatcatcctgcttggacgaatgagaaaactgggcaaatgaagaggcctgtagaattcaccccaattccagtgtcctatgctgacttgctcccatatctacttgataattcaatggtagccataaccctagccgaggttcatcaacctccatttctccaagaatacgactcgaacgcaacgtgtgcttgtcgcggagaagccccggggtgttccattgagcattgtagggctctgaagcgtaaggtgcaaggtctaattgatatgggctggctgaaatttgaggagaatcgcgtgattttcaactttcaccggaagtgggtgcaagccattggtctgtttgctcaagtgacctgtgctcctgagtttggacttctaagatcgttcaatcagagattactcgtccttcacgttgatgggggtgcc

SEQ ID NO: 2309 - DNA, 465 bp, Glycine max
  Peptide Sequence Number=SeqID_93994
atgggacccctccaaaggcaagccttccgcaaagtgtacggaaagattttagatttcaccgcagcggaggtatttacggaagctgttgtatccctcgcccaatactatgaccagccgttgagatgcttcacgtttggggacttccaaattgtaccgactgttgaagaatttgaggagattttaggatgccttcttgggggggagaaaaccgtatcttttctctgggtttcttccctccttgagcaagattgcagctgtggtcagagattcggcgagagaattggatcgtatgaagcaaactcgaaacggcatagtgggcctaccgcggaaatacttggaaggcaaggcaagggatatggcgagtcaagaggaatgggtcccgtttgcagatatactagctttgctgatctttggggttgtcctctttccaaacatggacggttcggtggatctagccgcaattga

SEQ ID NO: 2310 - DNA, 331 bp, Glycine max
  Peptide Sequence Number=SeqID_93995
atggctccgaaaaagctttctgtgaagagatctaggagggatgtcacagctgaagggaccagtgccgcccccgagtttgatagccaccgtttcaggagcgccgagcaccagcagcgcttcgaggccatcaaaggatggtcgttccacagagagagacgcgtccagctcagggacgatgagtacatagattttcaggaggagatagctcgccgacattggacgtcgctggtgactcccatggctaagtttgaccctgatatagtcctggagttttatgctaatgcttggcccacagaagagggagtgcgagacatgcagtcatgggtgaggg

SEQ ID NO: 2311 - DNA, 174 bp, Glycine max
  Peptide Sequence Number=SeqID_93996
atgtcgtatgccgacctgctaccatccttgctcagcaacaaaatggttgtggtgagcccgggaaaggtctatcaacctccattttcccaatggtacaatcctaatgccacatgcgcctatcatggtagcgtcttggggcactctgtcgagcaatgtgtagcctttaagcacaag

SEQ ID NO: 2312 - DNA, 210 bp, Glycine max
  Peptide Sequence Number=SeqID_93997
atgctatgttgcgaaggaacagggccgagaggagaaggaaacttctgcaaaacagaacagttgcatccattcttgaggaggagactcatttctccgacttattatcacctgatttaccatcatcaagggaatctgccactcaattacctgaagccattaccatggcagaagagcatgaccagaggattacccttgtgggccttggattga

SEQ ID NO: 2313 - DNA, 126 bp, Glycine max
  Peptide Sequence Number=SeqID_93998
atggcggccacttctcactttgagtgcgatgttccaatacttgtgaccactacagttttggcagagtttccaaaacgtagtgctccaatagttgtgatcagtgtacttggtctcattttgattgag

SEQ ID NO: 2314 - DNA, 447 bp, Glycine max
  Peptide Sequence Number=SeqID_93999
atggcggcggaaaaaatcagtcgcgactacttgacgactgagttggctgttgttttgtcttgtcaatccctgagtgttctatgtgtgatgagaatcatgaaactggccaaatacaggctaaaggcccaagtggagaaggacgaaggcccaagtggagaaggacaaagcccccgagtggagaaggatgaaggcccaagtaatccttgtggcgtctacccagacttatcttccttcattggaagtggcgtctacccagacttatcttccttaaccggaagtggcgtctacccagacttatcttccttcaccggaagtggcgtctaccctgacttatcttccttcatcggaagtggcgtctacccagacttatcttccttcaccggaagtggcgtctaccctgacttatcttccttcaccggaagtggcgtcatccaaaaaactctatag

SEQ ID NO: 2315 - DNA, 432 bp, Glycine max
  Peptide Sequence Number=SeqID_94000
atgtccaaatcttgtgaatttgggatgaccggccctctcgatgagtcgatctcttgctttctcataagggtggacccttgggtactagaacctatcgccatcagaggactacacgtgctcaccttcagggggctatgcaccctcaccttcagagggctatgcatcctcaccttcagaggactgcacgtcctcaccttcagagggttgcacgccctcacctttagagggctacgcgtcctcattttcagtgtgctccatatccacaccttaagagaatttaagttcctgggccatcccctgatattggagggcgaccaactgtgtgagcacaaccagagaggggggctatcacgcaactactatgcatatcggggcaagatttcacccgtgccgttgcaaagagataagcgcagatcatgcgcaccaacatga

SEQ ID NO: 2316 - DNA, 258 bp, Glycine max
  Peptide Sequence Number=SeqID_94001
atgtttattcgaggaaaacgtcggaaaaaccggaaaaagtgtggtctaagaactttaagtgttaaaggtttgggagttgtttttacacacggggaaggtgtttcccttgctcctatgtattcctcaattgtgatgaggaaatcagacctacgtagctctttgagaactgatacgaaatcagagtgtggtaacggaagcaaacaaccaataacgaagggtttttacgaaaaatcagcaaggaaaaataagcaatattaa

SEQ ID NO: 2317 - DNA, 588 bp, Glycine max
  Peptide Sequence Number=SeqID_94002
atgggtgatcaagaggagacacaggaacagatgaaagtcgacatgtcggctctgaaagaacaaatggctttaatgatggaggccatgttaggaatgaggcaactcatggagaaaaatgtggccaccgctgctgccgttagtttggctgccgaagaagacccaactctactagctaccgcgcaccatccacccccaaatgcggtaggacgaggaaggagcacactggggcacaacagcaacccccatttgggatacaactgggtggattacccttatggattgccgcctaattacacgccgccagtcatgcaagatgatgcgggtcatgtctcttcccccatccttgaaggggagcctcctcgaaagcccgacaatgtccacgaagatcatcaagagtatgcccaagggtatgtggatttctaccccccgatccccgtcgaggggccggcacccaacacattgcctcatcccaatctcacaacacaaccaatattcttgtccacagaaggaccacccccgacgaccgaagaaagaaggaaactcgatctcctcgaggaaagattgagagttgttgaaaggcttcgttga

SEQ ID NO: 2318 - DNA, 324 bp, Glycine max
  Peptide Sequence Number=SeqID_94003
gggtagcacccacaagacacccagtggacccggaggagcccaacagggcctcagggtttccaactttggttacgggcctctatcagtcctacagggtgcccgtaccccctggcaagctctgattacgggcctctgtcagttctatggagtgcccgtcatccccagcaaggtcatcaggcctcctactaaccgagctttcatcaagaagtattgcgcctccagacaggcagagggcgagacaccccaacagcctggggatggccaacaacaggcaacaaaggcatcgtcgccacctccagagcccctcagctcatccacaaaaag

SEQ ID NO: 2319 - DNA, 228 bp, Glycine max
  Peptide Sequence Number=SeqID_94004
atgtcttcgatcactccatatggtcttgtgatggagcgatcggctaactggagggtcatgcgtgtgggcattatctctatctctccaagtcactggcacatggagagaggccttaccttgatactagctcccaagtctatgagagctttacccacaacaaccttgccaatggaacacggtatagtgacacttttaggatctttgtgcttcgagggaaggatgcgttga

SEQ ID NO: 2320 - DNA, 569 bp, Glycine max
  Peptide Sequence Number=SeqID_94005
gtggtctagtagacaacgatcgtagatgtgaggctttgcgtgtccgcttcatggcagacggcgaagccgatgcgtccgaaggagcaggaggaggaggaagagaaagaggaggaggaggaggaggaggggaggcagaaatcattgacaacagtacttcaaagtctcggggaaggaatgacatgaagtccttgaatgatgaaggaatgaaattgggggttaccaggggaagggttgattgggcacgccttccactcaggaaaccagccgcgccacctgcgttactgaagccgccttctcgcggggagaggcgggatgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtga

SEQ ID NO: 2321 - DNA, 354 bp, Glycine max
  Peptide Sequence Number=SeqID_94006
atggctagacatgatacatgtcagggtttggtttggttcaaggataaaaagggatgccccacattatttctccacattatttcagccagcccacatcaattagactttgcaccttacgcttcgaggtcatacagtgctcaatggaatgccccggggctcctccataatatgcacatgttgtgttcgagtcgtatcctcagaaaaatggaggttgatgaaccttggctggggttatggctaccatgggagcaagtcagcataggacaccagaatgggggtgaattctacaggcttttttgctgcaaaactcatttctttgttggtgttttggttcgtgttaaaggtggtgtttag

SEQ ID NO: 2322 - DNA, 822 bp, Glycine max
  Peptide Sequence Number=SeqID_94007
atgaggggagcgccaaccgaagaaagtctctcgcctttccttgtgagggatctaggcgcgcaaagtctcaaggttatacaaagaatccacaaggcgtggaggagtccgttgaggaaagacaaggagcttaggggcatccaattcacacgcgggggtagattggctctccaagtgaaagttatcgatgaggaggacttcgaagctccgaaggaagatgaagaagtccgagctctaaaattagagctagggaaggcaagactcgccaaggagaagttcaagtcagctgctacacacatccggaaagagtgcaccgagttacaagaggaaaatgcggccactgcaagagcccttgaacaagaaaccaaaagggcccgcaaggaagaatatggccgagagaaattccgaggagcattgtggggtagcaacaatgagctcaagctccgaagagaggagagagatcggtcacgggtgcatgacatgatcttaaaagaagagttagttgcttgcgcgaggtccaaaaggagtttggctcaacacttggaagccacagagcaaagcatgctagctatcatagggaaatacaaggaagagttgaaccagtctgtggcccatgaacaaaagctagtggaggattttgcacaagtgtacgccgaaaaagaagcaagagggagggttcgccttgaccttaaatggaagtcaagacctcccgcatctattagccaaagcaaaagccatggccgaagtgtgtacagcccccgaagagattcatgggctaatcaattactgtcaacacatgatagatttgatggcccatataattag

SEQ ID NO: 2323 - DNA, 69 bp, Glycine max
  Peptide Sequence Number=SeqID_94008
atggaggaatcacagagatcgttaaagatgtcgctatcgctgccggaagacaccgaattatatgtttga

SEQ ID NO: 2324 - DNA, 426 bp, Glycine max
  Peptide Sequence Number=SeqID_94009
atgacaagcagagaccaagtttggtcattctgcacccttgtatcatccagaggcggcgggcccgatgatacgcggagataccttacggttatccgcacccttttgtcatccagaggtggcgggcccgatgacaagcagagaccaaaatttggtcattctgcacccttgtatcatccagaggcggcgggcccgatgactacgcggagataccttacggttatccgcacccttttgtcatccaaaggcggcgggcccgatgacaagcagagacaaaatttggtcattctgcacccttgtattatccagagggcggcgggcccgatgatacgcggagataccttacgaggcggcgggcccgatgatacgcggagataccttacggttatccgcacccttttgtcatccagaggcgggcgggcccgatga

SEQ ID NO: 2325 - DNA, 128 bp, Glycine max
  Peptide Sequence Number=SeqID_94010
atgaatcccgagatgtctttgaaaatcaaagaggaagtgaaaaagcagttcaacgttggcttcttggcagtggctcgataccctaagtgggtggcctacattgtgccagtccctaagaaagactggag

SEQ ID NO: 2326 - DNA, 225 bp, Glycine max
  Peptide Sequence Number=SeqID_94011
atgacctcctatggtgaagcaaaggaatccattgatgaagaagatcctaggcctacaagctccaatggagcttacatcaattttcccccaccagggacatccgacaaggtcaatgcacccccctacaagcatacacaacatccaacgtatgaaacatgggcaccatcaagtacaatgaccatggatgaattaaagctcataagcattcacctcagagatgcttaa

SEQ ID NO: 2327 - DNA, 204 bp, Glycine max
  Peptide Sequence Number=SeqID_94012
atgtgggaatcaactgtagtcaatcttgcacatgcatacagaaagttgacgatgtaccaagatgcaatttcatattatgagaaagcacttgcattatcaaccagaagtgtgagcacttatgctggtcttgcatatacttaccacttacagccttttatgtatgagttgccttggaaatttagatttgtggtttcattagggtaa

SEQ ID NO: 2328 - DNA, 297 bp, Glycine max
  Peptide Sequence Number=SeqID_94013
atggctgaagctcattcaatctcttctcccatggtttctaactgcaagttgtctaaacatggtgctgatgtttttcaggatccttctctctataggtgctccacctcagggactgccatttttcttggtcctaacttagtctcttggtggtctcgcaaacaaaagagtgttgtttctattgctcacaatccagtttttcacagtcgaacaaaacacatggagattgatgtgttttttgtcagagagaagattttggccaaacagctctcaattgttcatattccagatctggattag

SEQ ID NO: 2329 - DNA, 1677 bp, Glycine max
  Peptide Sequence Number=SeqID_94014
atggcgcctcctctcacctcttctcctttatcttccgttgcaactccatggtcaccacttcagctcccgccaattaccgaagagtctgtctcctctttaaatggaatggacgttttgaattcgggtcactgttcattgtcttcttgcttccttactttctcttgtgctttttggcttttggtttccttttcttcttcctccatcttccaaaggggctcgattgagcaacccatcatggatcgggaggtcatctcgataggcggttcctcgtttaaggatactcgccaaggtgcctttgatagcgagtcctcctctttggagagggtaaaggtctcacatcaaactggtgggggtgcttctcgccttcgcgaaagggcgcgaccttctgctactggtgtgaggagaggtgatgatgatggagatgtgagggcgtctcctcgtgtgcaatgtagcataagtgttgggtcgatgtcatccaccccaactgttgctagctatgagtgggtgaagcttgtaaacactaaggactcttgtaagctgggcgttcaggcttgcgggagtgatgacttcctattcttgagggcggtgcctgtgtgctttgttggagcacttgaatgtgaccccttcccagcttcacccgaacagttagacgatgattggatgggtctccccttgaatagtgtgtccaagaagttgtttgagtttgattcaaatatctttcatcattttaaggaccattttttcaaggtcctggctactggtgtcgtggctgatgatatgtcattgatgttcaacagggatggggagccttgtttcctattctactggcagtctgatcccaccaggttcaagttgtataatgaggatctgctgacccgtgtggaaagggtcggcaaagcgatggagcagctaccggcctcgctgggcatgcgagccattttgtctcttctgtcggtgaacgatccttttgttgtcgtggatggtaaagtgcctgaccttaccctcgtttggtgtcgacgaatgactaacatgtgtttgtgttattgtcttgcttgttttgcaagtattatgggtgacttcgcctgtaggccactcatgatgcaagtcggacctgtacgtgagactgtgtcaccatctgctgctactccgtctgctggagaagggggtcaacctgctggtgaggttggcccagttgttgctgttgttgaggtcactctagtgcttcttcctctgtcttggcaaagaagaagagggatgattgtgttaggccatctggctacgagaagtcgaaggccccttgagtctttgtgccctgaggctcctactgttgctgttgtgactcttgctactcttgcttctttaccttcacctgttgttattgttgttcaagaggttacttcttctgttgttgaagttgttgtgctagccactcaggttgattctattgtggtgtcgttgttcaccgtcgcggcacctttattaagtgatggtgtaatagccaccaatgctcccacggtgttgcctccttcctctacgactttgatggtttctccctctactgttttagtggcggtggtgtcgccttcttcgtcctctcaccctcgcatcttgcttgatcacctatacacctttagtgatgttgactcactgtggggtgcaacttataagccggagtag

SEQ ID NO: 2330 - DNA, 414 bp, Glycine max
  Peptide Sequence Number=SeqID_94015
atggaaagaactctacagcatactctgggtgtaccattgtacaccccagaaaacaaccaacgaaacttcttaacgactcacaatggcacaaacgccatgatccccgttgaagttggggaaccgtcgacaaagagactattgtaccaacaacaacaaaatgaagacaatataagggtggaacttgaaaccaccgatgaagtccgagaaataacgaggattaaagaagttgtcaaactacgagcaacaaggagatacaatacaaaggtgaagctagaaaagatccccaagcgggaaagcttggccctaacagggaaggtcccttcagggtcacaaccaaccttgacaatggagtgtactgactacaagagctggatggcagagcaatcccacgaacatggaatgccatccacctga

SEQ ID NO: 2331 - DNA, 315 bp, Glycine max
  Peptide Sequence Number=SeqID_94016
atgtctgagtctgaattagcctcttctgatgatcaatctccctcatccttcacatcaagtactccaaccattcaaatcgtctcaaagtcgttctctgaaaggcttctggggaaattctttgatgcctcccagttcgattttgtgtatgagcaaagtgagctgtggtctccccctgtaaggaggactgtgtttttggcctcacctggtaacatatgctctcaggatgaaatgttgagaaagctgaagaaggcaaagaggacttggaagagatcacccatgtcttttggtgctcttgaagttgatcatggcagctaa

SEQ ID NO: 2332 - DNA, 354 bp, Glycine max
  Peptide Sequence Number=SeqID_94017
atgaccggaaggcttcttgccggttcattggcttttgagagccgcatcctccattaccttattgttcgcatcttactccctagatcttcaaaccttgctcatttctggaaagttgtcatcatcaaaaagggggagattgtagaagcaaagcttcatggtgaatcaaaggtgattcaaaggttgaaagttcaagaaaagaatcaagaacaattcaagactcaagaagaaagtttagagtcaagaatcaagattcaaggttcaatgatctcatgtgagaatcaagatcaagattcaagaatcaagagaaggcttaatcaagataagtatgaaaagtttttctcaaaaatcgagtag

SEQ ID NO: 2333 - DNA, 273 bp, Glycine max
  Peptide Sequence Number=SeqID_94018
atgaagacaaaagctcgcagtagaatcactgacaatatagtaagtgaaactgagcatgaggctccataccaagatgatgagcttctagagcttcaagtgttggaagttgacgctgatgtcattaatgagtcttttgcagatgttgatggaggtggagaagagatagatgcagatttactcaaacaactagacttggttgaaccagacgaggatgaatgcatattaagtgagaatgacattgagagtgattttgatgatacaaatacttcttag

SEQ ID NO: 2334 - DNA, 675 bp, Glycine max
  Peptide Sequence Number=SeqID_94019
atgcatcacaaagaagctccaggcccgctcgaacacgtgcgacagcggcaggaagctgagcgacacatcctcttcgccgaccgtcagcctttcatcatgcagggtgaagagatcctgcagggcgcactcttcaaaacgctgccaacgttgagcggcaaaagccgctggatcggcagcgcgctcgaaggcgctcagatgctgtgcgatctcgcagccgcgcagatcggccccctcgtcgaagacgataatgtgccgcagctgtgggcagacgccgcgcagcgcgatggcggcgtcaagctgcgcctgctcaccgacgaacagtatgcggatgtcggcgtcgttggtgacaaacgccgcctgcgccggcgtattggtggaatagagcggcacgctgacgccacgcaggtgcaggatcgcgagatcggtcaacgaccaggccatcgtgttattggcgaaaataccgatgcgttcttgcacttcgacgcccagccccagcagcccggcggcgatgcgatcaatgcgggcggcggccgctccccaggtcagttgcaactcgccgttgggcgaccattggcgaaaagctgtgcgatcggctcggtgggtgatttgatgctgtatacgatggatcagatgtctacctactctcaggcagggggaaaagcgatttcagcgtag

SEQ ID NO: 2335 - DNA, 963 bp, Glycine max
  Peptide Sequence Number=SeqID_94020
atgaccgccgccattctgcgcgaatgcggcgaagtgctgtataccgccggcaacttcaataacgacatcggcgtgccgctgacgttgctgcgtctggaaccgcagcatgattttgccgtgatagagctgggcgctaaccacattggcgaaattgcttacaccaccgcattgacgcggccgcagaccgctttggtgaacaacctggcggcggctcacctggaaggctttggctcgctggccggcgtcgcccaggcgaaaggtgaaatctttaccggcctgccggccgacggcgtggcgatcatcaacgccgataacaacgactggccgcactggcagagcatgctgggcggcaaaaccgtctggcgcttctcgccgcaggccgccgcaggcgtggacttcttcgcggacgacgtgcgggtaaacggcgcgggcacgcagttcacgctgcacagcccgttcggcaccgccgagatcgcgctgccgctgccggggcggcacaacgtggccaatgcgctggcggcgacggcgctggcgatgtcggtgggcgccaccctcgaagcggtgcgtcaggggctgaaacagctgcaggcggtgccggggcgtctgttcccggtggcgctggccgaaggcaagctgctgctggacgacagctataacgccaacgtcgggtcgatgaccgcggcggcgcaggtgctggcagagatgccgggctaccgcgtgatggtggtcggcgatatggccgagctgggtgcggaagcggaagagtgtcaccgtcaggtgggcgaagccgcccgtctggccggggtcgacaaaagtgatcagcgtcggcggtttgagccgcgtgctgagcgaagcctccggcaacggcgaacattatcaggacaagactgcagtgatcgcgcgcgtggcggaattactgtcggaacatgcggtcattaccgtgttaatcaaaggttcacgtag

SEQ ID NO: 2336 - DNA, 213 bp, Glycine max
  Peptide Sequence Number=SeqID_94021
atgggtgaagtagaggaggtgcaagagcagatgaaggccgacatggaggccatgaaagagcaaatggccacaatgatggaggccatgatgagcatgaagaagataatggaagccaatgcggttgcagttaccgctaccaacaatgttgctaaggagaacccgatgcccccacctggcctcaaccaaatgattaatcaacttcatatagggtag

SEQ ID NO: 2337 - DNA, 312 bp, Glycine max
  Peptide Sequence Number=SeqID_94022
atgggtgccaaatacctcgaagtggtcaaacgagggtcgcatcccaacaacggatggtctccgggcgaaattaggagtatgacagttgcccctctttacttgtcttttattggagataaaagggaaacgcagaatgaccataatttgtccctgcgttttgttggacacgatcgagcctgggcggcaagacacataatgaccataatttgtctctgcatgccaccggacacgatcacttctggatggcggaaatgtgtgcggaatgaccataatttgtctccgcccacctctcaacttgctgttcttgaatga

SEQ ID NO: 2338 - DNA, 273 bp, Glycine max
  Peptide Sequence Number=SeqID_94023
atgggaaatcagcccagaaacaattttaatgcaagaggattttctggattccaacatggccaacaatataatcaacagcagggacaatggaggaaccaccctggaaatcatttcaacagagatcaaggtggaccatccacaaggccacagcaacaagggcctagtctctatgatcacacaatgaagttggaagagactctagctcagtttatgcatgtttctatgtataatcagaagagcacagagtctcccataaagaatcttgaggtctaa

SEQ ID NO: 2339 - DNA, 321 bp, Glycine max
  Peptide Sequence Number=SeqID_94024
atgggtgaagtagacaaggtgcaagatcggataaaggccgacttggaggccattaaagagaaaatggccacaatgatggaggccataatgagcatgaagaagataatggaggtcaatgcagctgcaattgtcgctaccagtgccattgctgaggtggacttgactcccccatctagcctcaaccaaataaatcatgccatctcagatatggtaggggagacaggcaaagaattgggaagtatgggaggccccctgtcataccctaatttcgtccggggacctttgcttgatgacatgcaacttttgttttggtccttgtga

SEQ ID NO: 2340 - DNA, 495 bp, Glycine max
  misc_feature (46)..(46): n is a, c, g, or t
  Peptide Sequence Number=SeqID_94025
atggcgcccactaggcacccttgggacccagataagtccaataggnccctgggatttcccgcactgatcacaggactctgccagtcgttcggagtccccgttgcacctactaaagtgattcggccgcccatcacccgggcttttattgagaagtactgtacccagagacaggctcagggtgatgctccacaggccgcaggcgcaccaccaccacctcatcaggctggccaggctggggcatttgacattgagcagtatttacggcatttggttcgccagcaggcggccaaccaccgagcacatagccagggcttcgcttctttctcatgccctaccccagaccagttcaggacagaggttgcatggcccggagattggcccgaggcccaagcaggagaggcacccccagaagctcccggcgatggagaagaggcccacgaggacgaggagatggccgatttgcttgacttcttgggagggagtggagatacgtga

SEQ ID NO: 2341 - DNA, 255 bp, Glycine max
  Peptide Sequence Number=SeqID_94026
atgaacagaaaccaaagatcaacaaagcgtgatctgtcttattgggagtatgttgatgctttacattctgtgcaaaatagtaattcttcagtgaagcgtagtgcatcatctttttaccagccaattccaagaaggatgccaaaagaagaaaaggttcaagtagctgatgactcgctcagtgaggcagatctgctcagcgagtggcatccacgaagtaaggcatacagctcgcttagtgggttgggaaacctctag

SEQ ID NO: 2342 - DNA, 291 bp, Glycine max
  Peptide Sequence Number=SeqID_94027
gtcttctggaagttactaaggcctattccggaagaagtcattccagaaaacacttccggaagaccttcttccggaatgggccttagtaacttccggaagcacttcttccgaaagttactaaagtccattccggaagaaggtcttttggaagtgttttccggaatcacttcttccggaatggaccttagtaacttccgaaagaagatggacgaagatcaatggaggtatgactttgcgatgtcacaagaagttcatatggattatgattatgataatcaagaagaatgtggg

SEQ ID NO: 2343 - DNA, 255 bp, Glycine max
  Peptide Sequence Number=SeqID_94028
atggttctttctagttgggggtttgcaaaaaaggggaaagagggcagagtaaattgttcagcccttctgggatttgagcattctctcgaaattagtaaggaaaattgtttccgtgagaaaaatccgagccgaggcacttccgtaacgcctccaagacatttccgtgggcgatttcatggagattcttcaccattcttcatcgttcttcatcgttcttcgttcgttcttcattgttcttcggtcttcaaccggtaa

SEQ ID NO: 2344 - DNA, 250 bp, Glycine max
  Peptide Sequence Number=SeqID_94029
ctcgctaagcgaagcgattgtctcttctacgctaagtgcaagattggtgctaagccaaatatcacttactcgcgctaagcgccagaatggcgctaagtgcaccttcaaggttagaaagccctttctaagcctgatttgcacagaaaaaaagagagagtatgacgacgtgaaagaggtcagaattgactgtgaattgtgtgcagagaacaaaggaaaagatgaacaaggaagcaaaggtcctaacttttag

SEQ ID NO: 2345 - DNA, 663 bp, Glycine max
  Peptide Sequence Number=SeqID_94030
atgttatctgacaactttagcattgataaggaaacccttaggaaagatttttattctccggagaatgaacctcaaaggagatggtttttccaacattataagggtacaaacagaaaacaaatccaagacaagttctacgaatttgtcgaaagagtcaaacaagacatcataggtgatccaacaacaaatgccataacaaattggcaagtgaaggatggtgagttaatccaatcggaattacctcccgcaacacaatttcaactaccgaatatcaaagacagtaacaataaacctgttatggcaattccattcaagacaaaagatgtcaacgaggaagtaacctctaaagacattaagagcctaatggaacaagcaaattataccaataaatacttccaagctttaggagaaaccattaaaactaaggtagttcataaacaaaaatcaattgaggaagcttcgccaagcatccccattgaaaaaccgttattcaaacctttcaaagttagtgagaaggctaaacgaaaaattagggaacttagaaaaactaaatccttaattgaaggcgtaggtgacaatcatagtgaattactaaacaagattggtagtttaattaaggtcattcgagatactccccaagcctcgaaaaatacttccaaaatg

SEQ ID NO: 2346 - DNA, 909 bp, Glycine max
  Peptide Sequence Number=SeqID_94031
atggagctcatcgagaacatggcggccagtgatcaagcaatccttcgtgatcgaagctatgtgcctacaaaaagaagccttttggaacttggcacgcaagacgcgacattggcacagaataagctgttgacgaggcagattgaagcccttaccgaaaccctcagcaaactacctcaacagttacaagcgaaggatgccccacatgcggaggaacccatgagcctggacagttgtgtaagccaacaggatacttctcgagaagtaaactatatgggcgtaccaaatcgcggataccagggttacaaccaggggaactcatctggattccaccaagggggagcaggattcaatcatgggccaccaggattcaatcaaggaaggaacttcacgcaaggttcagggtggaggaatcagggaaaccagtataaggagcagaggaatcaacaaccataccaaccgccataccagcatcctagccagggccccaatcagcaagacaagcccaccaacatagaagagctcttgctgcaattcatccaggagacacggtcccatcagaagagcacggatgctgccattcggaatctggaagttcaaatgggccaattggcacaagacaaagctgaaaggcccactagaactttcggggctaacacagagaagaatccaaaggaagaatgcaaggccgtgctaactcgagggcagaggaaagcacaagaggaaggtaaggttgaggaagaagaccagacagaagaagaccagacagaggaagataagacagagacacaggaggacaggacagaagtcgaagagaaggtggcatcaccacctaagacaaagagccagaaagcacgggaagccaggaaagaagaaccaccagccctaccacaagatctcccatatcctgtg

SEQ ID NO: 2347 - DNA, 564 bp, Glycine max
  Peptide Sequence Number=SeqID_94032
atgtcaatccttgccctaaaaaaaacacaaagagaaggaaaattcccaatccaagaaagggagaagacacaaaaagaaaagaaaattcccaaaccaagaaagggagaagacacaaaaaagaaagaaaatcccaatgaaagagtgggagaaagcaaagaaaagaaagaaaaattctcgatcaggatcggaagaaaaagaaatatgcagaaaggtctttggaccagacaatatctgaacagtacaaaattgtcaccaagtaaccaagaaaaaggaaaccacgacctaaagtgtgtttcctctaaatggtcatttagaaatgaaatgctaaacatccaaaatctcatttacggttatgagaaaatttcatcagcatactctccttccccgatagacacattgtttttcatccaaaaagcatatgttgctctgatcggctggaagttttgtctctttactaaagcatgttcgcattttggtgaagaaaacaccgagactatttttagtctcacagttgtcaagaactacgtaggtctgagttcctcatcacaaattgaggatacgtag

SEQ ID NO: 2348 - DNA, 598 bp, Glycine max
  Peptide Sequence Number=SeqID_94033
atgtcttttgctttcatgctttccaagactacaatgtcttcagtcatttatgatttcaaaaactacaatttcttcatttacatttcaaagacttcaatgtcttcagtcatttacgctttcaaagactacaatggcttcatttacatttcaaagacttcaatgtcttcagtcatttacgctttcaaagactacaatgtcttcacttacatttcgaagacttcaatttcttcagtcatttacgctttcaaagactacaatgtcttcacttatatttcaaagacttcaatgtcctcagtcatttatgctttcaaagactacaatgtcttcattttcatttcaaagacttcaatgtcttcattcatttacgctttcaaagactacaatgtcttcatttacatttcaaagactacaaattctttagtcatttacatttcaaagacttcaatgtcttcagtcctttacactttcaaagacttcaatgactcaatgtccttgtcgcaacctacctttcggcgggagggcaacgcgaggctcatgggtgcatcctccaaggaaggaaaacgcgcggagtcgccaccaacgtttattcgaggaaaac

SEQ ID NO: 2349 - DNA, 386 bp, Glycine max
  Peptide Sequence Number=SeqID_94034
atggcttccatgatggaggccatgttaggaatgaggcagctcatggagaaaaacgtggccgccactgtcagttcggctgccaaagcagacccaactctcttggctatcgcgcgccatcctccctcaaacacagtaggacggggaaggaacacgctggggcacgacggcaaccctcatctgggatacaaccgaacgacttacccttatggattgccacctaactactcaccacccgtcatgcaagacgatgcgggccatatttcttctcccgtccttgaaggggagcctcctcaacagcccgacgaggtccacgaaaaccctcaagactatgcccgaagggatgtcgagttctatcccccaatccccgaagggccagcacccaacac

SEQ ID NO: 2350 - DNA, 450 bp, Glycine max
  Peptide Sequence Number=SeqID_94035
gaaagagagggatggggtttctctgcttttggcatagcgggcccggcgggaggcccgcacgacgggctattagctcagtgggctctcagccacatggatagtttaatgtgctcatcggcgcctgaccctgagatgtggatcatccaaggcacattagcatggcgtacttctcctgtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctgggggaccaggagattggatctagccataagaagaatagaatgcttggctga

SEQ ID NO: 2351 - DNA, 300 bp, Glycine max
  Peptide Sequence Number=SeqID_94036
atgagatgggttaatagagtgggttcctattccatagatccaaagaatcattttttacaattcacccagtggaatagcaaagatagtaccaacaaaagatgggaatttatgtggctagccctgtccttctccatttggtaccatagaaatgccaagatattcaagaaccagccgttcactcctgaaaaggtcatggatgatgccttgttccacacctggtcctggataaaatgtgtggagaaggacttccaaatgcactttaatttctggtcaaccaatctaaaggatgttctttcttag

SEQ ID NO: 2352 - DNA, 336 bp, Glycine max
  Peptide Sequence Number=SeqID_94037
atgaggaaagacgtggagagggagagagggagagaggaagtgattcagaccttttccttctcttttttggagatgagactgagagaaggattagcagatgagttgctgttaaggaaggaagagagaagaagaagttataatatagtacctcacaagaaacctcttctatgtggcattggcgatttgtgtgggtctgtttggcgatccacttgcgacgttggctggggtacgaaagggggtgccatggcttctggttgggaaaggagtggctctaggtgggtgcaggagaggaagaggaggccaaggaaaaagagggtgcagaggaagaagaagtga

SEQ ID NO: 2353 - DNA, 399 bp, Glycine max
  Peptide Sequence Number=SeqID_94038
atgacttccaagattattttgatgatgccaaagaatcaagagttaagcaaattccaaagattcaagaatcaagtttcaaggattaagattcaagaatcaagtttcaagaatcaagattcaagaacaatcaagatcaagattcaagaatcaagagaagactcaatcaagataaggtacaacctctgtggtacaagtagagggtacatctacttgggttgttgtactgagaacaagagagggtacatctcttgtggatcagttcaagtggagggtacatccacttggttgttcaaagagaacaagggagggtacatcccttgtggatctttggcttgtaaaggattttacaaggttgaaagaaatctcaagaaccggtggttgcttggggagtggatgtag

SEQ ID NO: 2354 - DNA, 372 bp, Glycine max
  Peptide Sequence Number=SeqID_94039
atgggtccaatcctcaatcctttgaaggtgttggacgtgcgtgttgttaggagattggagaaggaaatctctcaagtattgattcaatgggaagctactgaagttaaagatgctagggaagatttgcaagacatcgtgaactcttatcctcagttcaaccttaaggacaaggttgtttttgatgagaagggaaggacacatgtcagacgatccgcatcacatgggagtcaggaaaagcacacggttgaggagatagaacatattgctgaaggacttcgcacattagggggccatgaaagtgatcttctctctaatgcctcttcctctctgaaattctctggaattctgattatattccctttctctctctga

SEQ ID NO: 2355 - DNA, 312 bp, Glycine max
  Peptide Sequence Number=SeqID_94040
atgaagaataatgttaaggaggtggtcatgatgctaaggagcctcatggcttatgctgaaataacagatggaatcgttggagacaattctgcagaattatttgtcatagtggttttcgtgctttgctcatccaagaaaatttcatttggatttcatcctcagctaaatgctggaaaatttttgtttcttgagttttctgcagcagatttgattgaccttattacacccgaggatttggagctcaccaaacagctgaatgaattggggctccctctttccttccagacaaacaaagagtcccttgaatgttaa

SEQ ID NO: 2356 - DNA, 192 bp, Glycine max
  Peptide Sequence Number=SeqID_94041
atgttagtgaaaaacctcgttgggcgcctaggagtacatgacaagacaaactacacactagcaagtcaggtcactcttactaggcttaaaggagcactcaaatcgggtgtatttacccctaaggcctacactctgaagaatccgtcagggcctctccctcctgattcaggtccaacccagaaaacattttag

SEQ ID NO: 2357 - DNA, 654 bp, Glycine max
  Peptide Sequence Number=SeqID_94042
atgccttatgaccattaccaaaaatctcaaactacgaagaagtttctattgagagaagacgaactcgtgaacatagccaatttgcaaggcaccaccgggatagtattcaacggcgaaaggacatggacaagggatgcagacacaaaatacttatctggtgatcaaggcagaaccattttaactgaagcagcaacacaagatccttctgtcaatcaagttccctacaccacagcacggttatcccgttctcagttcaattacttcttccccgtttctgcgagtcccaaattcattcgcctcttcttctacctagcttattacccttcctttccccacactgatgcctctttctccgttcaatctaacggattcaccttcttaaaaggtttcaatgcctctctaaacgctgacacagaagccaccaaaaccatcttcagggaatatgtggtcaacgtcaacgatggtgagattctcatcctcagcttcactccctcgcaaccaaactcctacgctttcatcaatggaatcgaggtacaaggtggagaaaaagagaagaaaatgggtttgagcttatcgtatccgagtcgtattggaatcgtattgaagccgtgtctagccttaggaagccgtatcccagccgtatcttgtatttaa

SEQ ID NO: 2358 - DNA, 192 bp, Glycine max
  Peptide Sequence Number=SeqID_94043
atgtcatcaagcttcaataggatagatggacctatggcatccctctatgaccttaaatcaggaaagtttcactcggtcatataccaaagtgtaacaatccatttccatccttcaatggtttatgcggggtgttcatgggtcggctcgaaccggtttttggccaaattcaagactcaacccaatcaaatttga

SEQ ID NO: 2359 - DNA, 192 bp, Glycine max
  Peptide Sequence Number=SeqID_94044
atggtggagaaaagcatcgaggtattcatggatgacttctcgatttttggatcctcatttgacaattgtttgaggaacctagagatggtacttcagaggtgtcagaagtttcttagggcatgcaggattctacaagaggttcatcaaggatttctcgaagattgccagacccttaagcagcctgctgaataa

SEQ ID NO: 2360 - DNA, 945 bp, Glycine max
  Peptide Sequence Number=SeqID_94045
atgccttctcgcaagcgccgtgccgtgcccacaccgggggaagcgtccaactgggactcttcccgctttacatccgagatcgcttggcatagataccaagacaacattcagctttggaacatccttccggagaggaatgttgaacttgggcctggtatgtttgacgagttccttcaggaactccggagatgcagatgggaccaggtgctgactcacctaccagagaagcggatcgacgtggctctggtgaaagagttctattcgaacctttatgatccagaggaccacagtcccagattctgtagggtgcgaggacaagtcgttcgctttgacgctgacacgattaacgacttcctcgacaccccagtcatcttggaggacggggaggagtacctagcatacaccagatacctcagcactcaccccgatcctgacaccatcgctgccacactgtgtactccaggggggcgttttgttcttaatgccgatggtctcccctggaagctgctgaggaaggacatgacgacactcgctcagacatggagtgtcctctcttactatgatcttgtgcccacttctcacacttctgatgttaatcttgatagggcccgcttgatctacggtttggtgagccgcatggatatggacgtgggcagctttatatctcagcagatcagtcagattgcccagtccagcacctcgaggctcggattcccagcgttgattacagcgctgtgtgacattcagggggtggtttttgataccctgatcttcgagtcactcagccctgcgatcaacttggcctacgtgaagaagaactgttggaaccccgccgatccatcgatcacctttccagggactcgccgcacacgcaccagagcttcgacgtcggcatcagaggcccctcttcctgcccagtctccgtctcagccttctactcagtga

SEQ ID NO: 2361 - DNA, 156 bp, Glycine max
  Peptide Sequence Number=SeqID_94046
atggaccctaagagaataaaggtcattcctgagtggcctactccaccaagtgttgaggaaagaatccatgagtttcaagaacctttggatttgaggtcaaatccttttcaagggggagggaatgatgcaatcctgtcctccaagggcattggatag

SEQ ID NO: 2362 - DNA, 327 bp, Glycine max
  Peptide Sequence Number=SeqID_94047
atgcacatcaggccgcagacgcatcgccaccacctcggcaggccgatccagctgggtcactgggcgtggagcgttatctacagcattgggttcgccagcaggcggccaaccaccgtggatagcctcagtcagcaggagcagggttccaccccttttgtatgccctactccggagcagtttagggctgaggttgcatggcccggagactggcccgatgcccaggcaggggaggagcctataggatcccccggtgaggtagatgaatcccatatgaatgaagatatgactgacctgctcggtttcttgggaggcagcggagccacgtga

SEQ ID NO: 2363 - DNA, 462 bp, Glycine max
  Peptide Sequence Number=SeqID_94048
atgcagctggcacgacaggtttcccgactggaaaagcgggcagtgagcgcaacgcaattaattgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaa

SEQ ID NO: 2364 - DNA, 165 bp, Glycine max
  Peptide Sequence Number=SeqID_94049
atggataagagcttaaaggtaggagaagatgaatggagggagaaggagagaaggagcatgaaattttatgcctcaaatgagctacggttcagcacactaatccaagatcaagtccaagattctccactaagtgtgcttaggtgtcatgaggcatgtaaagcatga

SEQ ID NO: 2365 - DNA, 471 bp, Glycine max
  Peptide Sequence Number=SeqID_94050
atgccgcgcgcgctcaaaaaccttgccctgcctcttctctttgtcaccgtgaaatcactcttctctttctcctccagcctgaaaactgccggaaaccgctccctcgacacccacattgtccttgctcaaacccacagaaccccctacactgccggaaaacccacattctcctcgcttgaacccacagaaccccctacactgttcttggaagtctggctcaaagaaaacccaacatacactgttgctactagggtgctgaaacagtcgtgggtgctcaaagctcaaagctttctctgcgaggtacgtaggtcaacttcgtctatgctaagtttccatgggtgttcatgttttattgatgataataataataataataatacgtcttcagttgcagtattgctgattaaggtacaaggaaagcttaaagtttcatgccattttgttagatctcactgccattgtcactgttag

SEQ ID NO: 2366 - DNA, 990 bp, Glycine max
  Peptide Sequence Number=SeqID_94051
ggttgcacgccctcaccttcagaggactgcacgtcctcaccttcagaggactgcagatcctcaccttcagaggactgcacgtcctcgtctttagagggctgctcgccctcgccttcaaaggactacaagtcctcgccatcagagggctacacgccctcaccatcagaggactacacgtcctcgccttcagaggactgcacgtcctcaccttaagaggactgcacgtcctcgtcttcagagggctgctcgccctcgccttcaaaggactacacgtcctcgccatcagagggctgcacgccctcaccttcaaaggattacacgtcctcgccatcagagggatgcacgctctcactttcagaggactacacgtcctcgccatcagactacacgtcctcaccttcagagggttgcacgccctcacctttagaggactacacgtcctcaccttcagagggctgaacgcgctcgccttcatagggctacacgccctcaccttcagaggactacatgtcctctccttcagagggctacatgccctcgcctttagaggactacgcatcctcgccttcagatgggctatacgccctctccttcagagggctgcaagccctcgccttcaaagggcgacactttccttttatcagttcttgggccaccccctgatctcggaggagggccaactgtgcgagcacaaccagagggaggctatcgcgcagctattgtgcataccggggcaagatttcacccgtgccgctgcaaagagacgagtgcggatcatgcgcaccaacatgactactcttgcacagatatggatgacgttgctacttagcaacattctgcccagtgaccataatgccgatctccccctacggaaggatcgctcccacaagacacctagtggacccggaggagcccaacagggccctggggtttccagctctggttacgggcctctgtcattcctacagggtgcccgtcccccccagcaag

SEQ ID NO: 2367 - DNA, 139 bp, Glycine max
  Peptide Sequence Number=SeqID_94052
gagaatgatagagcttatccagcggaagttgttgcagcccagatacgtacactgctatataaacatgaaggttgcacgggttttttaatcaagtcagagattgaagaagttgatctctatgttcagagagcaatctctg

SEQ ID NO: 2368 - DNA, 821 bp, Glycine max
  Peptide Sequence Number=SeqID_94053
atgaccggccctctcgatgaggaaatctcttgctttctcataagggtggacccttggttactagtacctactgcctttagagggctgcacgccttcgcctttagaggactgcatgtcctcgccttaagagggttgcacgtcctccccttcagagggctacacgtcctcgccttcaaagggctgcatgccctcgccttcagagggctgcacgtcctcgccttcagagaactgcacgtcctcgcctcaagagggctacatgccctcgccttcagaggattacacgtcctcaccttcagaggattgcacgttctcgcctttagaggactattcgtcctcgcctttacagggatacatagggctccacatccacgccttcagggaactcaaggtcctctgcctttaatgcttaaccaaaacttgcactcccggttcctaggccacccccctgatctcagaggagggccaactgtgcgagcacaaccagaggaggagggatcgtgcccacaagacaccctaatggacccgaagaagtccaacagggtcctggggtttccagctctgattatgggcctctgtcagttctacggagtgctcgtcgcccccaacaaggtcattaagccccctattaacagggttttcatcaagaagtaccacgcccccagggaagcgcagggcgaggcaccacagcagcctggggatggccagcagcaggcaacagacgcaccaccaccacctcctgagtccacctcagctcatctacaaaggctggagcattgcctacgacatatggccgaccagcaggcgaccaaccatccgggcag

SEQ ID NO: 2369 - DNA, 771 bp, Glycine max
  Peptide Sequence Number=SeqID_94054
atggcatctaagaagaggaaagctccctctacacccacccaagctagatttgatagatccaggttcacatcccaagaggcttgggagagatacacatatattgtggtgcctaggaagattctacctgaaaggaatgtcattctccatcactctgagtttgatgaatttactgaagaactcaagcgcaaaagctggcacaaggagttgacaaactttatggatggcaatattgatgtggccatcgtaaaggagttttacacaaacctctatgaccttgaggataaaccacctaagcaggtgaagcatgactcttctaggcttgggtttgcaaccttaatcactgctctttacaaagccaggggagtcatttctgattctttgacattggagagcctcggtccagctattaatgtggcttatgtgaagaaaaactactggaacctagatgacctctcagttacttttagaaggccgcgcaaggccaaggggaagaggtctgaggctcccccatcttctgagagccttcagggcttgggcttgccttccattatgagcatgaaggagtttgaggctcaggtggcatggccaggagaccagccttcttcttctggagggggtggggcctctatagcccaggagcctgatattgaggagccaccagcactagcaccagcaccagcaaaggatgaggataagctcactcctcctaaaccctcttattttgatgcaagtacacacatggttcaggaggaggagactactccagattag

SEQ ID NO: 2370 - DNA, 537 bp, Glycine max
  Peptide Sequence Number=SeqID_94055
atgattatgaggggccaagacatttatagtagccaagatgaggctactacttcaccttcctctagtaaaagtgaagaagcaaaaggggaagaatctagtgaagagatctacccccaagaagaaggacaacctttaatggttaaggaggagtgtaaggaggtaagtgtctcctccaagaggttagctaagaaggaaagacattttgaaataaagacaaatattaatgaaatttcccttcttagacaacctccacattttctcctttgtaaaaagacacttgttagcattgccacatctcttaggcttgagtttattcctcaagtaaaggagttgttggatgagggtttggtccgcaagagattaaatccttgtgctttgttggtgcccaaaataggggttcccatgaacccaaagagaataaaggtcattcctgagtggcccgctccaccaagtgtaagaaaaatttggggcttccaagacttaacaaacttttacaaaagggaaaaagcccagagtttcaagaacctcgggatttga

SEQ ID NO: 2371 - DNA, 336 bp, Glycine max
  Peptide Sequence Number=SeqID_94056
atggctcaacctccacctcgtgagaaaactcttagggagatggctgcacctgatttcacttatgaaagcttgtgcattcaatatcctgatgagggtgttccatatgttctcaagactagactaatacatttgttgtccaagtttcatggtcttgcaggttttcctcattctctggagagagtggcaaaagattggctatactaccttgctcccaggtccattttcagctgggatgaccttaagagggtgttcttggagaaattattccctgcatctaggaccacttccatcagaaaagacatttcaggcatcaggcaacttagtggagaaagctag

SEQ ID NO: 2372 - DNA, 303 bp, Glycine max
  Peptide Sequence Number=SeqID_94057
atggattgctctaggtgggaatggaagagggataagaggctgcggtgtagaatgaagcttgataggtttaggtgcaggtgctgttactggtggaggcacttgaatttggttgccagacctcaagactctgaatggaggcttttgtctcttgctgaaattgcatattctggatggtcatttgcctcactaactcttctaaggaaggttgaggaggagcctcagttgcttattgtctttgttgtgactgctgctgttgctgctgctacattggaggaggaacatatggcttgcttggaccagtag

SEQ ID NO: 2373 - DNA, 237 bp, Glycine max
  Peptide Sequence Number=SeqID_94058
atgcataagaagaagaaaaagaagaagcaggaagttgagtccttgcacgacatagatagcaccgttaaatttggagtgagggaagctgatggaaagcatgttagttctaggaaccctagaattgagaaatgtagttctatgttagataatcttgtgggctcactagattttcctaaggtatggtaccctagagatataggatttttcagcccttgtattttagggcacctagactag

SEQ ID NO: 2374 - DNA, 285 bp, Glycine max
  Peptide Sequence Number=SeqID_94059
atgacagaggcttctggtaaatctgtaaagagacaacctccatattttctcctttgtaaaaagacacttgttagcattgccacacctcttgggcttgagtttattcctcaagtaaaggagttgttggatgagagtttggttcgcaagagcttaaatccttgtgctttgctggtgtccaaaataggtattattaggcaccaaatccctaaaataggtggtatgatgaatgttttgagtggtgcaacccttttttgtaaaatcctcattcacccaacaccttcatga

SEQ ID NO: 2375 - DNA, 369 bp, Glycine max
  Peptide Sequence Number=SeqID_94060
atgtcgatctccccctgcggaagtatcagttggtctgtgccgtcccgacatagggatcgcgcccacaagacacccagtagacccggaggagcccaacaaggccctggggtttccaactctggtaacgggcctctgtcaatcctacagggtgcccgtccccccagcaaggtcatggatcgcgtccacaagacacctagtggacctgaaggagtccaacagggtcttaggatttccaactctaattacgggcctttgtcagttctatggagtgtcctttacccccagcaaggtcatcagaccccctatcaaccggactttcatcgagaagtactaggccccaggcaggcacatggcggggcatcacagtag

SEQ ID NO: 2376 - DNA, 396 bp, Glycine max
  Peptide Sequence Number=SeqID_94061
atgacaaaaggtgcagaattgaccataatttttctctgcgtgcctccggactcgattgtctctggatgggataaaggtgtgcagatgaccataatttgtctccgcatgtcatcgggcatgccgcctgtacatgacaaaaggtgcagaatgaccataatttgtctctgcgtgccaccggactcgatcgtgtctggatggcgaaaaggtgtgcggattaccataatttgtctccgcatgtcatcgggctcgccgcctctggatgacaaaaggtgcagaatgactataatttttctctgcgtgccgcctttggatgacaacacatgcgtaatgaccataatttggctctgcgtgccaccggactcgatcgtctcaggatggcgaaaggtgcacggatga

SEQ ID NO: 2377 - DNA, 435 bp, Glycine max
  Peptide Sequence Number=SeqID_94062
atgcggtgtgaaataccgcacagatgcgtaaggagaaaataccgcatcaggcgccattcgccattcaggctgcgcaactgttgggaagggcgatcggtgcgggcctcttcgctattacgccagctggcgaaaagggggatgtgctgcaaggcgattaagttgggtaacgccagggtttcccagtcacgacgttgtaaaacgacggccagtgccaagcttgcatgcctgcaggaaagctttcaagtaaaacaccagaaagctcatatttatgcgtgtaaagctgatcttccagggcaaaaggaggaggaagcgagggcgcaatcagctgatggcagagtgtttaagattgttccatggcaccatctggagcatagcaccagcaactccctgagcatacaggccttaagccatgatttgactggttcagataggtaa

SEQ ID NO: 2378 - DNA, 480 bp, Glycine max
  Peptide Sequence Number=SeqID_94063
atgttggtagtgacaactgcaaccggattggcttccattatcttcttcatgctcatcatggcctccatcattgtggcaatttgctctttcatggcctcctatgtcggcctccatctgctcttgcacctcctctacttcacctattactcttgctctagcataggttcggtgaagctggaagtaacaaggatatcaacaatcctaaacgtgtttggcagtagactaagcaatgatgtaacacgatccatcttttgccccaatttttgcaagatggttacttccatacttcaacttgactcgatgaaccttttcgtagaagcacgagcttggttcaaccccataacccagggaatggcaattttgatcgccaatacttcaacaacatttcatagggatgaaagactcgggaatacgcatgctatgcatggaaaatgtaattatgagattgagatgcccgaagagacatcctttcttagttaa

SEQ ID NO: 2379 - DNA, 222 bp, Glycine max
  Peptide Sequence Number=SeqID_94064
atggagctaatgccaaatggatttagctctggggaactctctcaatgtgtgagtccacatcccttccactccattacacttgcaacaaaaagaaaagaaagacaaatgcctccttcaacgaaaagcaatagtaggaaggctacctctataggtgcccgacaaagccacctaaaagaagatttcgctctgagtagcaacccaaaggaaatgggtcccaaatga

SEQ ID NO: 2380 - DNA, 748 bp, Glycine max
  Peptide Sequence Number=SeqID_94065
ggtggacccttgggtactagtaccctcaccttcagagggctacacaccctcgcctttagagggctgcacgccctcaccttcagaggactacacgtcctctccatcagagggctacacgtcctcgtcttcagagggttgctcgccctcaccttcagagggctacacgtcctcctcttcagaggattacacgtcctcctcttcataggactacacgtcctccccttcagacggctacacgccctcgcctttagaggactacatttcctccccctccaaggactacacgtcctcgccttcagagggcggcacgccctcaccttcgtagggctgcacgccctcgcctttagagggctacgcgtcctcactttcaggatcgcacccaagagacacccagtggacccggaaaagtccaacagggccctggggtttccagctctggttacgggcctctatcagtcctacagggtgctcgtacccccccgacaaggtcacatcatcatagggatcgcgcctgcaagacacctagtggacccgaagaagtccaacagggtcttggagttgtcaagctctaattacgggtctctgtcagttctacggagacgaaacaccacagcagcctggggatggtcggtagcgggcaatagacgcaccgccaccactttagagttcacctctgctcatccacaaaaaagtttgagtattgctacaccgcatggccgaccaatagacaaccaagtccaagccaaag

SEQ ID NO: 2381 - DNA, 423 bp, Glycine max
  Peptide Sequence Number=SeqID_94066
atggttatgggagatttcatcagcagactctccttccctgcatgtttgcattttagtggagaaaacaccgagactttttcaagtctcacaagttatccagaactacgtaggtctgagttcctcattggaggatacgtaggagcaagagctttgcttagactcgtgtcggccgcagagacccataatctttgtcatactgaccctgagggatcatgtgacgtgcaccctttgtcatccagaggcggcaaaggctgcaccgatgatacgcggagataccttacggttatccgcaccttttgtcatccagagcagatgacaagcagagaccaagtttggtcattctgcacccatgatacgcggagataccttacggttatccgcacccttttgtcatccagagagcagatgacaagccgcgcctaa

SEQ ID NO: 2382 - DNA, 120 bp, Glycine max
  Peptide Sequence Number=SeqID_94067
atgagctcaaagggaagcttccaatctggtggttgcatgataggagaggtgggttggtcaagcacaaagcctatatgtcctttagaagaagcttggacaatggcagtgcaatactgctga

SEQ ID NO: 2383 - DNA, 270 bp, Glycine max
  Peptide Sequence Number=SeqID_94068
atgaattgcgtttttgttcatgcatcctccacccacgagtttggagcattgggtagtgattgcttagtgcaattgctcgtctctaccctgtttcagagccccatgaattgcgtttttgttcatgcatcctccacccacgagtttggagccatgtgtagtgattgcttagtgccaatttgtccattctctaccctgtttcggagccccatgaattgcgttttcattcatgcatcctccacccacgaggttgggagccatggggagggaatg

SEQ ID NO: 2384 - DNA, 552 bp, Glycine max
  Peptide Sequence Number=SeqID_94069
atggcagagccatcaaagaagagaaagggatcatcctccaccgctaccgctgctgcccatcgccgtcacggcccatccggagcacccacagcacctattcctccttctttgtcatctccaagatcatcaacattgttttcatccgatgatcaacgtctacgtcaaggtgcaccttttgagggcaccattgttgatgactggaaattcgattattcgagtcatgatgctcgtcgcatggtctgcaatgatcaagctgaaatgaccgtgacctcctttgggtatcgtaaagatcggaatggacaatggctgaagaaggatgcactccctcctcaagatgaacgtactccttcacctccccctcaacgtgaagatttcgcactcatgaatgaagtcctctccgaattacggggtcttcgttcttatgttggtgaccgcttcgactcgttagattcacgctttgccggtatggacattcgccttacacagcttgaagaggatgtcggatacattcgtcagagtttcgatcttccaccactacctccgtcttcttag

SEQ ID NO: 2385 - DNA, 207 bp, Glycine max
  Peptide Sequence Number=SeqID_94070
atgccacctcagcatgggcctcagtggattgaagcaaagagtcatgttcaaacaggaaattacgagtgtggatactatgttatgcaatggatatggtgcatcggtggtgctgacaaggactacaaggaggtacccccacctcctttgtttaaacttgcagggggacacatcaaccaagctgtgaccttcaacagatcttattacaag

SEQ ID NO: 2386 - DNA, 246 bp, Glycine max
  Peptide Sequence Number=SeqID_94071
atgaaacaccttagtgatcaaggggttcccactgaccctaagagaataaaggtgtctgagggaagaagtctagagtttcaagaacctttggatttgaggtcaaatccttttcaagggggaggggatgatgcaatcctacccctaagggcattggataaaagacttcaagaagattggaccaaagttgcaggagaagaccctaggattcttatgagccttagggtagactttgggcctatgggctaa

SEQ ID NO: 2387 - DNA, 458 bp, Glycine max
  Peptide Sequence Number=SeqID_94072
ggtacatctacttgggtttgactgagaacaagagagggtacatctcttgtggatcagttctagtggagggtacatccactaggttcaaagagaacaagggaggatacatcccttgtggatctttgcttgtaaaagtgtcatctccctcatctgtgacctccataaacgtggcagcaggagtgtcctctggcatccctcaggtgtctcctttggctctggctgtggctcctaggctgcataagccatggtggaggctctgcaacatcagcactatcatgtttgtgctcgaagtggagaggccggagggtgttgtgagtgctggagctagagctggggtagaggccaagttaatggccgggctcagggactcgaaagtaaggaaatctgggacgactcctctggcgatgcataaagcagtgatcaaggcaaggaagccaagcctagaggagttggactag

SEQ ID NO: 2388 - DNA, 315 bp, Glycine max
  Peptide Sequence Number=SeqID_94073
atgaataacacacttttgttttcaaggtttggaaaaccagaaaactttagaaagctttttgcaaaggaagaaaaagaagaagaagaagaagaagaagaagttcaaagagattcaaaggttgtaaacgaatatgtggaaaagttgtttgtaaaggttgaaactggtaatcgattaccagagagtaaaaactctggtaacttagaaaattttgagaaaaactcttttcaaaaacaaaagtgtgctatgttgttttttgaaaaatcttttcagtacttcccttgtgaagtcttcttgatttcttctcttgaaacttga

SEQ ID NO: 2389 - DNA, 321 bp, Glycine max
  Peptide Sequence Number=SeqID_94074
atggcctctggtaatcgattaccaagggtgggtaatcgattacaaggcttaaaaatgaagacaggaggccaagatggtctctggcatcaggttgtggaggcctctggtaatcgattaccagtctgtgtaatcgattacacagaggaatgggtcactggtaatcgattaccaggttttcatgtcctgaagctatgtgattcgagtttagcctctggtaatcgattaccaaggctgtgtaatcgattaccagggatgaaaagccttgagataccccttttacttgcatgtagtggtcatgagacgcattgtgttgcggcgtag

SEQ ID NO: 2390 - DNA, 147 bp, Glycine max
  Peptide Sequence Number=SeqID_94075
atgaagatgctcttgataccacatgatgtagctccatttggagctttggaatggagaaagaagaaagatgactggagattccacttcaaggagaagatgagtcaagaagaagctcaccaccataggaagccatggataagagcttga

SEQ ID NO: 2391 - DNA, 282 bp, Glycine max
  Peptide Sequence Number=SeqID_94076
atgcatgggttgataatcattgagaggctactgagccaaattgtagaagcaaagcttcatgatgaatcaagattgattcaaagatgttttgatgataacaaagatgatgacaaaggtgatgacaaaaagctcaaagatagaatcaagaacacttcaagattcagaggaaagttgaagaacacttcaagatcaagaggaaagttgatttcaagaatcaagattcaaggatcaagctttcaagaagtcaagatcaagattcaagactcaagattcaagaattaa

SEQ ID NO: 2392 - DNA, 414 bp, Glycine max
  Peptide Sequence Number=SeqID_94077
atgcaaaaatctggtccagttcctgtacccactgatgaggtttccttagtggggcagacacttcacaccttccttgcttggtcgacacatctggtcaagtctttatcacaacaggtagttgtgtctcctgcaaaaccacctccaaagcccgatgatccgctttatctgatgacattgaccatcccagagcttttctcgaggccttatcaggttagatgggatgccaccgtgttcggggtctttaatccagatttccccctctacataaagcacgaagacctctccaaaatcgcacacggtggtcaatgtctcagcatatcagtgttacagttgtggattttgaatctcactgaaacatgtatgcgagcggggaattctgatatctatggatacctcgagccacagtccatttag

SEQ ID NO: 2393 - DNA, 195 bp, Glycine max
  Peptide Sequence Number=SeqID_94078
atgaagaaacaacaatggaagagaagcgaaagacaaaggagaagaggtaagaggcggcgccatccactagggaataagccatggaagaaggagcttcaccaccaagatgagccttggataagaagcttggagaggatgcttcaatggaggaaaagaaagagggagagaaagagagaggggggagcacgaaattga

SEQ ID NO: 2394 - DNA, 387 bp, Glycine max
  Peptide Sequence Number=SeqID_94079
atggcttctatcacggaagccatgctaaaaattcaaaaatcaatagaagacaatgctatggcggccgcttccaatacaactagggaaacggaaccggtgctacaacccacattgaacttaggtcgggagaaaagcacgacgggtttcaatcggaggtatagtcctcaagcctacccttatggtttgcctccagacttcactccccgtaccgctccagacgatttgagccaagcccctaccttcgaggggcaactccctcctcatgccgactatcctctacaggaagatgatgaaggagaagcccatttaggccctctacttcccccaagggaaccgcccccccatgagttgcctcaaccaaacataatccgccatgccccgccttaa

SEQ ID NO: 2395 - DNA, 366 bp, Glycine max
  Peptide Sequence Number=SeqID_94080
atggaagaaagttcagggtttcctgtgttatttggtggtgaaaattcaaaccctcctgatgatggtggcaaagacaagattctggggctgcaacttagtgcaagacttcaaaacaatggtctcaaagataagatatttctagggttggaacttattgcaagacttcaacaccgcaccagaggtttaagacatttaactaggatacatggtgtggatttgacgaacgaaactcaggatacatacctatatttgtttcattcccctctatgtcagtttccctcccacaccaacacacctactttcaattcactatcctttatctatcacaatctcaaaaactcactctctatctcttttaacatttag

SEQ ID NO: 2396 - DNA, 183 bp, Glycine max
  Peptide Sequence Number=SeqID_94081
atggggtgttacaagcaaacaccttccattctgatgcaatcctaccccccaagggcattgaatagaagactccaagaagattgggtcaaagatgcaagagaagacccaagggttctcatgagtcttagggtagggtaccctagaaatgtaggatttttcagccctcgtattttaggcacctag

SEQ ID NO: 2397 - DNA, 201 bp, Glycine max
  Peptide Sequence Number=SeqID_94082
atggagaagtctgaaaagaaaaatcttagtgaaaagaaattgaagaaagcatacatcacatgggatgaaaacgatatggaatcttctgaagattcagaaaatgaagagataaatctctgccttatggctaaaagttatgaaagtgataaagagatgcatttgctgatctgcataaagagtcaattaaacttgcaaagttag

SEQ ID NO: 2398 - DNA, 360 bp, Glycine max
  Peptide Sequence Number=SeqID_94083
atggggatcgcacccacaaagacacccagtgaacctgaagaagtccaacagggccctagggtttccagctctggttacgggcctctatcagtcctacagggtgcccgtaccccccccccccggcaagggcatgtcatcataggtaaggatcgcgactgcagacacctagtggacccgaagaagtccaacagggtcttggagttgtcaagctctaattacgggtctctcaagggcatcaggccccctactaatcgagctttcatcaagaagtactgcgccccagacaggcgcagggcgaaacaccacagtagcattgggatggccggcagcgggaaacagacgcactgccatcacctctag

SEQ ID NO: 2399 - DNA, 396 bp, Glycine max
  Peptide Sequence Number=SeqID_94084
atgtcctgcccagtgatcataactccgaccttcctctaccaaagtgtcagctggtgtatgccacccaccaggcaccctctagacccggataagtctaatagggccctgtggtttccagcattgatcacaggcctctgccaatcatttggggttcctatcacacctagtaaggtgatccggccgccgatcacccgggccttcattgagaagtattgcacgcctaggcaggcgcagggtgatgcaccacaggtcgcacatgcaccgccaccacctcatcaggctgatcctgctgggtcattaggcatggaacagcacttggttcgccagcaggcggccaatcaccgggggcaggtgcagatacacgagtgtctctaccagctcagcctcagtcagtag

SEQ ID NO: 2400 - DNA, 114 bp, Glycine max
  Peptide Sequence Number=SeqID_94085
atggaagagatacatggagaagacgatgaagaacaaggaattaaacttgtagaccttggatcttcttcatcaatggaatcctttgcttctcgaagatcaatggtagtggaataa

SEQ ID NO: 2401 - DNA, 801 bp, Glycine max
  Peptide Sequence Number=SeqID_94086
atgacgccgtttcctccgatgcacgccctttcgaggatgagtcgatgcatgccctttcgaggaggagtcgatggtggccgagcacggcagcgtgacgatagtgacggtgaccatgacgatgacaattgggaaggcatggagagcaccaaattggacgaggcgttcagcgtcgcgacggcgttggtggatgccgccgccaccgtcgatcggctctcacagaaggtaggttgcagcctctgtttcattggaaattttcaggaaacaattggtgcaaggatcatcaacaatctgttgctcaatgttgcaatgtctgagtatgttccagctggggtagatggcaaacgttgtctggaaaatgttgtcaatgaagctgtgttgcttgttgctcatagagaagccaaggaagttagaatctataatggaggatttcattgtgcataccaggttgatcatcctgttacagaaatgattgttggtcaggatcttgttgaatggcaaatccttgttgccattggagaagctcttccattgagtcaatcacaatttcttcctacccttttttcatgtataagtacatcggcccaaattctgttatatactctgcaagtccgagtggggactggagttaaagaaggagacaaagttagcatgcactatgatcatatgattgctaagcttgttgtgtggggagaaaatcgtgttgcttccaaacatcagtttgacagaaggagctcttgtattgaatttaaagagaatgttgctggttatgttggatgtaactttttcccaaacacacattaa

SEQ ID NO: 2402 - DNA, 264 bp, Glycine max
  Peptide Sequence Number=SeqID_94087
atgttattcaccatgtggtcaagcgctttaaaaatgtacgcacgtttgaatgcttcccaaaatgaatatgtgatgtggaattgcatatgcacgctggaaatggctccgaagaagctttccgcgaatagatctaggagggacgccgcagctgaagggaccagtgccgctcccgagtttgacagccaccgtttcaggagcgccgaacatcagcagcgtttcgaggcaatcaaaggatggtcgttccacagagagagacgcgtctag

SEQ ID NO: 2403 - DNA, 408 bp, Glycine max
  Peptide Sequence Number=SeqID_94088
atgggtgaagtagaggagatacaagagaagatgaaggccgacatggaggccatgaaagagcaaatggccatgatgatggaggccatgatgatcatgaagaatataatggaagccagtgcagttgcagttgccgctaccagcactgttgctaaggtgaatctgatgcccccatctggcctcaaccaaatgaatcatccaacctcagctatggtaggcaaagatttgggaagtatgggcggcccccatgatgtgcaaattcaaaacgagcacgccttcccgccatatggcttgcctctcaactatacgccacccaatgtggcgtacactcccaataagaatgtcaataactccactcctatatccattgagagccagcaaccccaaactgatcatgcacatgtctcctaa

SEQ ID NO: 2404 - DNA, 273 bp, Glycine max
  Peptide Sequence Number=SeqID_94089
atgcggggttaccttatgtttacccgcacctttcatcaaccaggggcaaacgagcccgttgacgcgcagagactagcattgtcttctgcatcttttgccatccagggacagcgagtcaggtggcaggcggagataccttatggtcatctgcacctttcgtcaaccaaggggaacgaattcgacggtatcaggatgatgttttaccttcgtcgtccggaaacattcaagcccaacgacgcgcaagattcttctctgctgggcagggacaattga

SEQ ID NO: 2405 - DNA, 324 bp, Glycine max
  Peptide Sequence Number=SeqID_94090
atgactctggcacagctaggggatcctcctagagttccgctggttcaacaatatgacacatttgttgaaccagatatgcctcaacaaccggtggcgatagtggcacctgatgaaccagacattgatgtgcatcgtcctagacatccagatgtttatgtagcaattattgataaattggagaggcttctaaacttgaggatctcgaccgaaggaacaaaagcctatactattgctcaagaatgtctgagcatcaccagaagctgcattggccaaccaactagaggtcacaaatcgaggcgtaggcggcgtatggacgatcattga

SEQ ID NO: 2406 - DNA, 609 bp, Glycine max
  Peptide Sequence Number=SeqID_94091
atgtttccatggctagccttcggacacatgatcccaaacctcgaacgagccaagctcctcaaaagggggtcaccacgtgagtttcgtatccaccccaagaaatatacaacgtctccccaaaccacacttatcaaattcgttcagcttccactccccaaagttgacaacctcacagaacacgcagaggccaccagcgaagtcccctacgacgtcgttccatttctcaaaacagcctacgatgccctagaggaacctttgacccactttctagaatcttccaaaccggattgggtattctacgactttgttcccttctggacgggttctgcggcttcgaaactcggtatggagagcgtattcttcagcattttatacggacaaaatttgaaggctacactgtcgctccactgtggttgcgtttcccgaccggcgtcgcatttcgaagtttcgaggtcacgagaatcgcaaactacagtttgggcgatagcgaatccagggagtcggactcttgtcggatgggtgctgctatcccgaactacgatcttgtcgccattagaggctgtaccgaatttgaaccttagtggttttaaggatgtttctaaattctaa

SEQ ID NO: 2407 - DNA, 306 bp, Glycine max
  Peptide Sequence Number=SeqID_94092
atggtggtgcacggtggttcctcggttgagcaatggtttaccaactttaattctcgcgttctcactctcctcctccttctccttgtggcactgcaactctcattctctctcggtgactctcactctcgctctctcactgtgactcaactcctcgtggtgcgacgtgtccaccgtgccaccaccgcgttcttgctctgtgactctcgttctcgctctgactctcgccctctcgttcttgctctcattcacaactctactcactttggttcttattctcggtcacgaaaggtttgggttcttctataa

SEQ ID NO: 2408 - DNA, 498 bp, Glycine max
  Peptide Sequence Number=SeqID_94093
atgactaccctgactcagacattgatgatgttgctgcttagcaaatcctgcccagcgatcataattccgacctccctctgccgaagtgtcagttggtgtatgccaccgaccaggaaccctctagacccggataagtctaacagggccctaggttttccggcattgatcacgggtctctgccagtcgttcggggttccggtcacacctagtaaggtaattcgaccgccgatcacccgggctttcatagagaagtactgcacagctagacaggcacagggtggcaacccacaggccccagacgcaccgccgccacctactcaggctgatccagctgcgtcattcgacacggagtgggcagaggtcgcatggcccggagattggccagaggcccaggcaggggaggcacccgcagaggctcccgacgatgcagatgaggcccgcgtggacgaggagataactgatttgcttgatttcttgggagggagcggagccacatga

SEQ ID NO: 2409 - DNA, 206 bp, Glycine max
  Peptide Sequence Number=SeqID_94094
gtgttttgatgataacaatgatgacaacaaaagatgatgacaaaggtgatgaacaaaaagctcaaagatcaaagaacaactcaagtgaatcaaagaacatctcaagtgaatcaagaacaagtcaagagttcaagaatcaagaagaattcaagactcaagaagaaagcctagaatcaagaatcaagattcaagattcaagatcttaa

SEQ ID NO: 2410 - DNA, 486 bp, Glycine max
  Peptide Sequence Number=SeqID_94095
atggccttccaatcttttgaggtagtaagcattgcctccgtagattccctctctgagcaaccttgcctgtctgatacagcaatgatggtggcccgggtaatgttggggtacggctacgagcccgaaatgggtttgggcaagaacaacggcgacagaaccagcctggtaagcaccagaggaaaccgcgggaagtttgggttaggctataaacctacgcaagctgacataaggaaacgtatctcggaaaggaagaacaaaggccaaggctcgcggttgggacaacaagacaaaggggccccgccctgccacatcagtaaaagctttataagtgtgggtttaagacacgaaggccaagtcgctgcgatatgcaaggatgactccccgaggagatcggatttggtacagccatgtcctcctggttttcgactaggaaattggcgagtggaggagcgcccagacgtttatgcggttgggcctaggctttag

SEQ ID NO: 2411 - DNA, 207 bp, Glycine max
  Peptide Sequence Number=SeqID_94096
atgatggtctatgttaagaatgatgtgaaaatgggaatgttgattgatgttggaaatgcattggcatgtgcatgttgtgtatgttcatggggggctaagggcactgaccttcgaaggtctttggcatttgctttgggccacgttcatacgttggattttgtgtatgttcgtggggggcgaagtgcactgaccttccagggtctttga

SEQ ID NO: 2412 - DNA, 126 bp, Glycine max
  Peptide Sequence Number=SeqID_94097
atggatgctatgtttgtcatcatcaaaaagggggagattgtagaagcaagcttcatgatgatgaatcaagttgattcaagtagttttgatgatgacaaagttgatgacaaaaagcccaaagaatga

SEQ ID NO: 2413 - DNA, 420 bp, Glycine max
  Peptide Sequence Number=SeqID_94098
atgactaagacaagtatgcaagtggggaatgccgatgtgtatggattcctcgagccgcattccatccagagatttggacaatcacaatttgaatcagaaagttacattaagaacttgatgcagaattcaaagcgggatgtgtacctaagagcctacctgaatggtgctttgaaaggacttgatgatactccacaaagtaaatccaaggttgctactaggtggattgttgttaaatgcaatagacaaaaaggaagcattgagtgtgggtattatgtcatgcactggatgtcaactataatcttaggaagtttcaagaataattgggaaacgtatttcaatgatgctagatcattgaaaccagaaagattaaaggcacttcgcatccgatgggaaaagttttatttgaaagttaaaaaatga

SEQ ID NO: 2414 - DNA, 339 bp, Glycine max
  Peptide Sequence Number=SeqID_94099
atgcggggttaccttatggtgaaccacaccattcgtcaaccatgggcaaacgagcccataaatgcgcgcagactaacatcatcttctgtaccttttgtcgtcctgacccgtgaacttatggttacccgcacctttcgtcaaccaggggcaaatgagcccattaacgcccagagattaaatcatcttctgcatgttttatcgtccctacccgtgaagtcaggatacatgcggggttaccttatggttatccacacctttggtcaaccaggggcaaacgagcctgttgacgcgcggggacttacatcgtcttctgcaccttttgtcgtcctgcacctttaa

SEQ ID NO: 2415 - DNA, 312 bp, Glycine max
  Peptide Sequence Number=SeqID_94100
atgggggggtgcaaatactgggttgcttccagaagcaacccagctcgcgtgggcgagctaaggtcgcctgggcgagctgggcggcaacctcctccccctttttcctataaaaaggctgaagggggctattctaaggatccctcagccccctggctatgtatttcagccgttttgggtgaaaaaaattgtttccgtgaagaaaatccaagccgaggtgcttccgtaacgcttccgagatgtttccgtaagcaaatccgtgaaggttttcgtccgttcttcatcgttcttcatccgttcttcgttcttcaacgg

SEQ ID NO: 2416 - DNA, 684 bp, Glycine max
  Peptide Sequence Number=SeqID_94101
gtgaggcatgcttgcccgctagaaagccaccgttcatgcacagagaaaggaggggcaaattgggaccaactcttagcgagcaaagaaggagcatttgtcaactggttccctcgatggaaggaaggaagaaccggagttcttatttcatgcggaggatttccaaatgttcccttgatggggacgaggggttgcatcagctacaatcccgaccaacgtggagacacttcgaaaggtccgcaaggcatgggaggtgttgcaaaagaaggacaaggaactcaggggcaaaccgctaaaagagaggaagttgaggcaccggaggaagacgaaaaagtgcaggcccttagggcggaactcgagcaagcccaaacagttaaagaaagtgcttgtagggaagaacacggccggaacaaattccgaggggctctgtgggttagcaacagcgagcgtaaacttcgaagagaggaaagggaccaatcacgattggacagtttgatcgtgaaagatgagttgaagttttgctcaaggtccaaaagaaacctgtctcagtggttatgcgagacagagaccaacatgttagccatcatcagcaaataccaagaagaactaaatctagccacggcccacgagcatagagtggcaaacgagtatgcccaagtgtacgcggaaaaggaggctagaggaagg

SEQ ID NO: 2417 - DNA, 573 bp, Glycine max
  Peptide Sequence Number=SeqID_94102
atgattatgcggggccaatacatttatggtagccaagatgaggctactacttttccttcctctagtgaaagtaaagaagcaaaaggggaagaatctagtgaagagatctacccacaagaagaaagacaacctttaatggttaaggaggagtgtaaggaggcaagtgtctcctccaagaggttagctaagaaggaaaggtattttgaaataaagacaaatattaaagttatttcccctcttagacaacctccacattttctcctttgtgaaaagacccttgttagcattgccacacctcttaggcttgagtttattcctcaagtaaaggagttcttggatgagggtttggttcgcaagagcttaaatccttgtgctttgttggtgcccaaaataggggttcccatgaaccctaagagaataaaggtcattcctgagtggcccactccaccaacaccactcattgagttggtgaggaaccatgttccttcatgcaaagatacccaggaaatgggggtgttgaggaaaaaagcccagagtttcaaaaacctcgggatttgtggtctaatcctctga

SEQ ID NO: 2418 - DNA, 276 bp, Glycine max
  Peptide Sequence Number=SeqID_94103
cagcctgtggagtggatactacatacacctagtccatatcgactagtggagccagttcaagtgatagaggtgtcatcctctcaagaggatcctgaagaggacccagaggagttacctcctgaacctgttgtggatgcccttgacttacctgaggatgatgaagacccactccttaatgttgattttccagaggatatcatgtcaacatcagaggcagactccacagaggagaacggccctggagggacagcgaatagtgacgactcttcatcgtag

SEQ ID NO: 2419 - DNA, 714 bp, Glycine max
  Peptide Sequence Number=SeqID_94104
atggtgctgctcaccggctggtttaacagcgcgccagcgggatcagcggcagccggtgcctccgcagccaccggcggtatgacgatgtcaggcgcagccgatgctgctggcgttgctgcctctgccggcggtgctgactctgccgactgtgcggctgcggatcggcactgccatccagcccctgcggcggcggtacgtcagagagcgcggcgctgtcctgggttaccgccggcgtctctgcccaggcaggggcgagcagcagcgtggtggtcagcgcgctggccagcagcgtgtacgtcaatgttttcatgctgcgctgtcctctttggccgttgcctggccatcacgcttgcgcgcctcacggcgatctttccagctcagccagaacagctcaaagacggtacggatgatggtgccgagcgacaccagcggattgtcctgcttatattccggctggatccacgcatcggcccgcgccagcaccacgcgcaccagttcacggcggcgcgccagcggcatcgcgccaaagcgcaggcgaatgctctcctcatcaccggagatcttgctcaccggaatggtgatggcacccgatttcagcagcagatcgatctcttcgatttcatcgtgctcatgccggttgtccggcgcatccagctgcgcgccgcccatcgacaaatcgctggtttgcgtgcgcgaagagatgccgctggcgta

SEQ ID NO: 2420 - DNA, 325 bp, Glycine max
  Peptide Sequence Number=SeqID_94105
agcaaatagaggaaatgctgagacaattaacaaattgaatgctaagcttttagcaaaggcaaataaggagaagacacttgaggaaaagatgttgcagatgatggagaatcatgaccaccaaagtcaagagatgcgacaacagatgcaacaacaaaatgagcaaattcgtcaacaaaatgagcaaatgcagcgtatactacaacacttgtatattcagtctatcataccagctcctagtctatcacctatcatagcagatggaatagagcaccatgttaatgatgctcaagttgatcgtcctcatgacatgggaaatgatcattga

SEQ ID NO: 2421 - DNA, 573 bp, Glycine max
  Peptide Sequence Number=SeqID_94106
atgggtgatttggagagtttaaggtggaacccagcagaagagcgagccattagagttgattttgagacaaaaggttcacgtattttgaaaaatgcaatgaacaagatgagaaatgccttggatgaaccttggggttctacaaatttcctaaacaagagctccattgccaaggaaaatcggtctattgacagaggagcctcagcatactgcggtggttccatatctactacagctcactttgaaaagttggataaatatcaacatcatcgagaggaaatcttacaacattcgacaaaggaaggcacatttacacaggattcccctaacactgctacttttgttaatgataatgaaatatatttgaatgttgttggaggtccaaattataagggaaacatttatagactaggtactttgagcaaaaggtttagttgctcaaaatcaggttcatctacttttgttgctcctgtggaaggccaaatagaggaaatgcatgagacaattaataaattgaatgctgagcttttggcaaaggcaaataaggagaagacacttgaggaaaagatgttgtag

SEQ ID NO: 2422 - DNA, 228 bp, Glycine max
  Peptide Sequence Number=SeqID_94107
atggctctgaagaaactctccacgaagaggtctagaagggatgccactggagaaggctctagtgccgcctcagagtttgatagtcaccgtttccacagtgccgagcaccagcagcgcttcgaggccatcaagggatggtcattccacagggagaggcgtgtccagctcagggaagacgagtaccctgacattcagggagagatagctcgcaggcattgggcacggcta

SEQ ID NO: 2423 - DNA, 555 bp, Glycine max
  Peptide Sequence Number=SeqID_94108
atgagtcttcattcttcatctagtgttaatggtgagggttctactcctaaggaccccttgtataagatattagatgagttgagatcccttaagttgtggaaagaaaaacaagagagaaaagaaaaagggaaaaaaagagtggaagaaataagtcaagatgaaagagagaaaataagagaggaagaaagaagaaaaataatgaaagaaatgaaaagagaaaaacatgcctcctatagtagtcataactcttgcaaaagcctaagtgaagaacttcgtaactattacgaagaaagaaagcctcaagaggctaacattaacctcccatacttccatgggaaggacaatgtagaggctaacttagattgggaaataagggtaaagcaacaacttaaaaataagtctacttcaaaatcttatggctctcactcttatccaaagaaagaaaaaggtcaaggcatcttaggggtgacaccttctaagcccaatgatgataaggggaaaacaatagaaaagcaacccctaaggctagtatgcaagaaaaaactagctccataa

SEQ ID NO: 2424 - DNA, 663 bp, Glycine max
  Peptide Sequence Number=SeqID_94109
atggactccacgtcgtcaccttcagaggattacgcgccttcacctttagaggactacacagggctacgcaccctcaccttcagaggactacacatcctcaccttcagaggactacacatcctcaccttcagagggctacacgctctaaccgacagaggactacacgtcctcgccttcagagggttgcacgccctcaccttcagaggactgcacgtcctcaccctcagaaggctacgcgccctcaccttcaaaggactacacgtcctcaccttgagagggctacactctcttacctttagagcaattaacatcctcaccttcagagggctacacgctcttaccttcagaggactacacgtcctcgccttcaaacggttacatgccctcaccttcaaaggaatgcacgtcctcacctttagagggctacgcaccctcaccttcagaggactacacatcctaaccttcaaagggaggactgcacgtcctaaccttcaaagcgctacgcgcccgcaacttcagaggactacacgtcctcaccttgatagggctacacgctgttaccttcaaaagactacacgccctcgacttcagagggttgcactccttcaccatcatcggactgcacgtcgtcaccttcagagggttacgcgccttcacctttag

SEQ ID NO: 2425 - DNA, 510 bp, Glycine max
  Peptide Sequence Number=SeqID_94110
atggatttcaaaaacaaagctaataacaatgctctagatcaaacacccgtgtcactacataaaagtggtgagagcatttcgggttttacaaagggacatcattttgaaatccgatcacgccaatgtgaccgaggttcagtgaagggttcctctcggtgtggggttccaacggagaaaaatggcaatttgtggtggctactggtggctgtgggtgatggagaagaagcttggcacattggaaatggttttggaagaaagaaggagaaggaaatggcgtttttccaaagctacttgaactacaaggctcaaaaagcacaagtgactaatgctctcagaaacggaaatgttgtgcacactgcagacgtcttctcaaagatcccaatgctccagacccaatttcgagaagatgcaatgattaacaaaggttgggcagcatttttaccgagacaacttcatgtagcttccttgagaagcttcattaagaggcttcctcgagaagcttcctcgtag

SEQ ID NO: 2426 - DNA, 498 bp, Glycine max
  Peptide Sequence Number=SeqID_94111
atgagtcatcattcatctagtgttaatggcgagggtactagtcataaagaccctttatctagaatcttagatgagttgagttccctcaagttatggaaagaaaaacaagagagaaaagaaaaaggaaaaaaaagagtggaagaaataagtcaagatgaaagaaagaaaataagagaggaagaaagaagaaaaataatgaaagaaatgaaaagagaaaaacatgcctcctatagtagtcataactcttgcaagagcctaagtgaagaacttcgtgactattacgaaggaaggcataggtcacatcttagacctcactcccataaaagagaaaagaaaagaaagcctcaagaggctaacattaacctcccatacttccatgggaaggacaatgtagaggctaacttaatttgggaaataagggtagagcaacaatttaaaaagaagtctacatcaaaatcttatgactctcactcttatccaaagaaagaccaaggttga

SEQ ID NO: 2427 - DNA, 736 bp, Glycine max
  Peptide Sequence Number=SeqID_94112
agggctacacgccctcgccttcatagagctacactccctcaccttcaaaggactacacatcctcatcttcaaaagactacatgtccgcaccttcagagagctacacgccctcaccattggaggactacacgtcctcaccatcagaggacttcgcgtcctcacctttagagggctgcacgccctcgccttcagaggactacacatcctcgccttaagaggactgcatgtcgtccccttcagggggacacatgccctcgccttaagaggactacacgtcctcgccttcagagggctacacaccctcaccttcagaggactacacgtcctcgctttcagaaggctacacgtcctcgctttcagaaggctacacgccctccccttcagaggactacatagggctacacaccatcgccgtcagaggactacacgtcctcgctttcagagggctacacgcccttggcttcatagagcaacacaccctcaccttcaaatgactacacgtcctcatcttaaaggactacacgtccgcaccttccgtgagctacacgccctcaccttcaggaggactacacgtcctcaccataagaagactacacgtcctcgccttcagagggagcacgcccccttcttcggactgcacatcctcgttttcagagggctacatgccctcgccttcagaggactacacgccctcgccttcaaaggctacacatcctcatcttcgcgggacctctag

SEQ ID NO: 2428 - DNA, 1689 bp, Glycine max
  Peptide Sequence Number=SeqID_94113
atggatcgacaacacctgtcacaagctcatctatatgtactaaacaacacatcagaggttatgtcgtacatagattgtcacagagaacatgtctcagatacgaacccaaaaatgaaaaagatgaagttgttggatatgatatcaatggctattctttttacacaaggtcacaggatgcaaaaagtatcgtgcagaacagtgggtgtttttgataataatctgattcaagcatcgatgccttactatggagtcattgaagatatttgggagcttgattacgatgaatttagagtgtctatcttcaagtgtcaatgggttaatggaaataccaaagtacgactcatgacaacacctccaaggttcactccacattcagatattcctttggatgctatgtctaggaggcctagacaatccactcggctgagaaggttgactgttcgaaccttggatcagccacagcctatagttaacgtcaatcctaccattgggagaggatcaggccctcataaagaaaagtttcataaaactttaaagaatctaatatgggatgacattttgggcaaatttgacatccccgagggtgacaatgcgaaaaagaaggtgatgccaacggtcgctactcgctggaggcaatttaagtcctccctgacaacaaaatacatttatgctaatagtgagggtcaagcaaaagattatccttctgttaagtatggtattgatgcaacgacttgggccgaatttgctaaaagccaccaaaccccaaattggcaggcctcacgtggctccgacacttcctctacatctataactcaacgacagttggctgaaatcatccataacttgaaggaagaatggaggaaagaagtagaagaagataacaagaaccaacatgaagcgtggagaaggaaggtagaagaggaaaaccaacgcactttggagataattaaacaagagttgaaacaaacaatcaaattggagttatcccaaattgcatcataccactcacccccacttcaaccaccagatatacaagtattaggtgaaagggttagaatgaaggggagttgtgcagaagctgacacaaatccattaggtaaagatacttcttatgtgcacgatgataccataggcttgtatgtagttgctgagcagtcaactaaactagtggcattgggaaaagtctatgacagttcttcgaccatacacaatgtcccttatgcagatgatgtggttagggtgagtgttgtcaaagtataccacggtgatgctcaggtccctttcccaacatcagaaattcaatttgtgaggcaggccgttggcactttcgtggggtggccgatacatcttgtgaaacccatatctgatgaggattcacaaaagcgtctgcccattccggttaaatatgctaaaattgacaatgtagtggctgcaattgatccattgggagaattggtaaagaaattgtttgatagttaccaaaacccaattcagttaccgtgggatgggaaaaaatttgggatacctaatgtcaaagatggctttttcatcacacacatagatgttagtgagattattttaggtgacaagtgtttgaacatatccatactacaactgtggctgatgtttatgaatgattggagtacaagcataggttatggatcattgtatggtttccttgaaccttag

SEQ ID NO: 2429 - DNA, 363 bp, Glycine max
  Peptide Sequence Number=SeqID_94114
atgagatttaagcgtgttattagatctctactgtactcatttgatgagtatgctttctactcatgtgttcttaactttgtttttatcttgtctcttaagtatcatgatcaagagaagggacgcaattcatctcgatatggcagtagttcaagaagacccataatcccatcgtcaactaggccaagttcctctggtgatcatactgatagtcgtactggccaactaagttcaagtggaaatcgaccatctacctcacatagaaatattcaacctatgtatgagacaaaacaaccaacttacatgcactctagatccactagaggcaactgcgatgcaggtatgcaaaagttagtgaatcattaa

SEQ ID NO: 2430 - DNA, 381 bp, Glycine max
  Peptide Sequence Number=SeqID_94115
cacaaacccgtgcctacctccagtccccaagcgacctgcggtcctggagatttctttcaaccttgtaaaaatccttttacaagaaaagatccacaagggatgtaccctcccttgttctctttgaacctagtggatgtaccctccactagaattgatccacaagagatgtaccctctcttgttcttagtcaaacccaaggagaagggagacacaaaagaattcaggcgattagtccttccttcttttggaaaagggagaagagagacacaaaaagaattcaggcggttattccttggcgaattctttttggcaaagggagaagagaatgaaaagatgaatagcacaagttttcaaggtttagaaaaccagaaaacttcataa

SEQ ID NO: 2431 - DNA, 633 bp, Glycine max
  Peptide Sequence Number=SeqID_94116
atgttaggtggtgaagatttggctggtgcagacgtgttggcatttgcgtcaccatggctcggtgagggctcaggccagggtgtcacccaccacaaattggttggtcatttggagtctttctatgttgagaagctacagattgttgatgtggctagttgtaggactgaaattgaaggcttggaggagcatattgttaatcatgaaggtgacattgagcctactatttttgtgcttaatgggttggtggctatgactagatattgtaggtttttgctctttggctttgaggaggatgagcttggttttgagagtggaagtcaaaagaagcctaaaacacatgactctttggtaggaaagaggaggtcatcacttgaaagtacaccatcaacctccacaaacacttgcatggctgcgatggggacaaatgatgtgaaagtggatatgaagctgaacaaggttgtgtggagccacgggatccgaagcgtctcgaggagaattagggttcgcattgcccataagaggaacaatgatgaggatgcaaaggaagagctttattcccttgttattgtcatcaaaatcgccaaggatgagctcaaaggtttgggaaccaaggttattgatgatgaagattga

SEQ ID NO: 2432 - DNA, 579 bp, Glycine max
  Peptide Sequence Number=SeqID_94117
atgataaaaacaaacactagtactagtggttcaccaaaacttcatcgcaaaactattcaaaggaaccgtaggattcacattaaatctctctgcttcaagtatctttcctctattccttacaatgacctcaaacccaccaaggacatgctttaccagcaggatcagcttgatctagcagccacgtacataaagcatctaaaggaaagaatacaaaaattgaagggggagaaggagattttcaatattggctcacagttgcctctaattgagataaaggacttgggtttgggcattggagtgaagttgataagtgggttaaataagaacttgatgctctatgaagtaattagtgtcctcgaggaagacggtgcagaagttgtcactgttaacttctctacagttgctgataaattttttacacgggtcatgctcaggtggcttgggggcttgctgtccttggcaaccttatcgagtcaaagcgaggaggatacatcatgcattttcggcaacattacctctgctacattggtagagtttggaagaaaaggttggatcttactggaaaagactgaatattaa

SEQ ID NO: 2433 - DNA, 438 bp, Glycine max
  Peptide Sequence Number=SeqID_94118
atggtgagcattgtaacaaagttgcaggtgttaactgttgtgggtgaaggagacacaatcatcaaagctttagacgatattgttccagaagatgactgtggaaagaaggaaactaacaaatgtaatgataataatgacacaaatgaggaatcaaagggaaaagttgttcctgatgttggtcacaacaataacggattggaaacagttgcaagaggtgaaaaacctacttatccatctttaaaagcgaaaagaacagattgggataagcttgaacctcaacttaagaaagaggttggtacacttggttcctctaccctaacacttcatttcaggagaaagaagaaaaacttgatggtgatgcttcgttcaacaaatgttcttgctaccgctacagaattagcaccactagcatttccattatcagaaacagaaccttga

SEQ ID NO: 2434 - DNA, 225 bp, Glycine max
  Peptide Sequence Number=SeqID_94119
atgttacactcacatttgttggaaactgctgaactgcctgcatcttctctctcgcactcattttactgcattttcgccttcttttgcatcaaagcatcaacgatacaaagtagatatgcgtttccagacgaactcgctaagcgcgcataccgcgctaagcgagttcatcttgtgaggatgaacactcatcctcttgttgagatacttgtggctaagcgaggctga

SEQ ID NO: 2435 - DNA, 207 bp, Glycine max
  Peptide Sequence Number=SeqID_94120
atgtcattgcctagcgctgttcatgtgttctccattatcaagtgcgaagcttctggtgactgggaagcacgttattctgttgttttccctgatttccttcgccaaaagaaaaaaagaagaagtagagatgagagtcgtcatcgcaaaaaagggcaggacggacgaaatcagtgtccctatctttgctttccggagccacatgaatga

SEQ ID NO: 2436 - DNA, 135 bp, Glycine max
  Peptide Sequence Number=SeqID_94121
atggatggcgaggagctaccttcacccatgaactttgatgttgtcaagcaatactacgcttataatctagggcaattgaggatatcacggggcaaaattgtcttaggcagtggtcagatgccaggacgaagctga

SEQ ID NO: 2437 - DNA, 591 bp, Glycine max
  Peptide Sequence Number=SeqID_94122
atggataatgaagagggcatgcaggaacagatgaaggccgatctatcggctttaaaagatcaaatggcttccatctcggaggtcatgttaaaactccagaaaactatagaggataaagtcacgacaaccgcctccagtacagttagggaagcggagccggtgctgcagcccgccttagatacgggccgagacagaaacatggcagtgtttggtcggaggtatagtccgcaagcttacccctatggcttgcctccagacttcactccccgtgccaccccggaagatttaagccaagcccctaccttcgaggggcaactcccaccttatgacgactatcccgggcaagacgatgaggaaggagatacccatctcggccccctgctccacctcaaagatccatccccccatgaactaccccaaccgaacatagtcctccatatccctgcttcacccacacccgtaaaagaatatgttcccttcgtggaagataagggaaagattgaggcgcttgaagagaggttgagagcagtcgagggcctcggcaattacccattctcagatctagcggacttatgtcttgtgcccaacatc

SEQ ID NO: 2438 - DNA, 198 bp, Glycine max
  Peptide Sequence Number=SeqID_94123
atgaagaactatgcaaatatacccaagggttatccacacccagcacaacatctactgatcctgacccttgagtcaggcgacaggcagatatacccagcggtaatccgtacaagcataacatctgttgatcctgacccttcagtcaggcggcagacagatatacctagcggtaatccgtacaaacacaacatctgttga

SEQ ID NO: 2439 - DNA, 144 bp, Glycine max
  Peptide Sequence Number=SeqID_94124
atgtcagtgaaaaacctcgtcggacacctaggagtagatgacaagaaagactacacactagaataccagtcaagatcactctattttgcaagaacgctccaaccatataggatcagcataggcttcaaggaacattcaaactaa

SEQ ID NO: 2440 - DNA, 312 bp, Glycine max
  Peptide Sequence Number=SeqID_94125
atgagtcatcattcatctagtgttaatgatgaggatactagtcataaggatcctttatctagaatcttaaatgagttgagttccctcaagttatggaaagaaaaactaccacccccaaagaaaaatagtcatgactcttgtaagagcctaagtgaagaacttcatgactattatgaaggaaggcataggtcacgtcttagacctcacttccatatgagagaaaaggaacgaaagcctcaagaggctaaaattaacctcccatacttccatgggaagtacaatgtagaggcttacctagattgggaaatgaag

SEQ ID NO: 2441 - DNA, 252 bp, Glycine max
  Peptide Sequence Number=SeqID_94126
atgccggaaatcaaaaggaagtattgttacgcaatccaaaatccaagccaaggcgcttccgtaacgtttccgtgggtaattttgcgaagaacggcgctaggcaatcaattcatggggctccgaataagatggtggaggatacacgaacagtgccagacaatcaattcgtggggctccgaacttgatggtggaggatgcatgaatgacaatcaattcatggggctccagataagatttgagggtggaggatag

SEQ ID NO: 2442 - DNA, 513 bp, Glycine max
  Peptide Sequence Number=SeqID_94127
atggggacaaatcaaaacggcaaaaggttttatcaagtcaaggttaaaagtctagatgtcactagcctcaaggaattgggacaattgatgggacctctccaaaggcaagccttttgcaaagtgtacgggaagattctagatttgaccgcagcggaggtatttatggaagttgccgtatccctcgcccaatactatgaccagccgttgaggtgtttcacgtttggggacttccaaatgctgtggttggagattcagcaaactcggaatggcatagtgggcctgcctcggaagtacttggaaggcaaggcaagggatatggcaagccaagagaagtggggcccgtttgtagatatattagctttgttgatttttggggttgtcctctttccgaacgttgacggtttggtagacttagccgccattgatgctttcctcgcatatcaccatagcaaggaaagtccagtggtggctatcttggcagatttgtttgacacctttgattcggagatgtga

SEQ ID NO: 2443 - DNA, 657 bp, Glycine max
  Peptide Sequence Number=SeqID_94128
gtcgactctagaggatccccagaactcgagcaagctcaaacagtcaaagaaaggttcaaatcagcagctctgaagatccaaaaggagaatgccgagctgagagatataaatacgactaccgcaagggcccttgaacaagaaaccaagagggatcgcaaggaagagcatgtccgagacaaattatgtggagctttgtggggcagcaacagcgagcttaagctccggagagaggaaagggaccaatcacgagtggacagtttgatcttgaaagatgagttaaagttttgctcaaggtccaaaagaaacctgtctcagtggatatgtgagacagagaccaacatgttagccatcatcagcaaataccaagaagaactaaatctagccacgacccacgagcatagagtggcggacgagtatgcccaagtgtacgcggaaaaggaggctagaggaagggtgatcgactcattacatcaagaggcaaccatgtcgatggaccgatttgctcttaccttgaacgggagtcaagaacttccccgattgctagccaaggccaaagcaatggcggacacctactctgcccccgaggagatccacagacttctcaactattgtcagcatatgatagacttaatggcccatataattagaaaccgctag

SEQ ID NO: 2444 - DNA, 420 bp, Glycine max
  Peptide Sequence Number=SeqID_94129
atgccatttttttttccggaaaagcttcttacctccattttcaaaaagctttgcttcttgttttctctttttcgtgcggcattgcctttggttcgtgggggtagcagcgttgagcgcagcggtgaaggtgaaggtgaaggttccggcgtcgagcttttcggtggtcggtggcggcaaacgagatacgcagatggtggttttttcatcgcggacatggatgaagatgagtggatgtatgaaataatgtctgaacgaggggatatggattatgaaaatgcagaatcatgtggtgcgaatgaaccacatgttgattgttcggatgcgttcaagacttctcaggttataatgtgtttgagtgccgagaggatgttttgcggtgggctcgatccgtggctcatgaaaacagatttgtggcggtga

SEQ ID NO: 2445 - DNA, 105 bp, Glycine max
  Peptide Sequence Number=SeqID_94130
atggagaaaaggttgtcaccatcaaaaaagggggagattgtagaagcaagcttcatgataatgaatcaagtagttttgatgatgacaaaaagcccaaaagaatga

SEQ ID NO: 2446 - DNA, 255 bp, Glycine max
  Peptide Sequence Number=SeqID_94131
atggctgaaaggcccactaacagctttggagccaacaccgagaagaatctcaaagaagggtgcaaagtaattttcactaggagggaaagtactgagaagaaaaagagaattgataaggatgtgcatgatgaggaaggagaaaagaaagaagaggagaaaaagataagagagaataggaaatttgaagattcaacctacaaggatgacgctccagttggtagaccgctccatcacaagaccgttcggggtagttga

SEQ ID NO: 2447 - DNA, 603 bp, Glycine max
  Peptide Sequence Number=SeqID_94132
atggtagaatcgtcaaagaaacgtaagggttcatccgcctccgcttcggcttcaagagctcatcgttccgaagccactagcgcatccacagcaccaattccaccctcattatcctcttctacattgttttcttccgaagaacagcataaacggtattcaaatcttttctcatctcgttccattatcgaccctaagtttattgatatgaaattcttttttgctgaaacttttgattgcattcaagcctttcagaacctaggtcttatacctttcatgtcattacaattgcctgtttatcctgaattggttaaatctttttattgtaatcttgaaattcaggacaacactttgatttctgaggtttttgggataaaaatggtcatcgaccaatcccttttccatgacttaacccaattgtccagtgacggtgtaccatttgaaggtacactgaatgacgattggaaatttgatttctctgcacatgatgtccgccagttggtttgcaccaacaatgcggatatgaccggatgcctttttgtcggttcattggcttttgaaagccgcatccttcattatctgattgtgcggattttgcttccatga

SEQ ID NO: 2448 - DNA, 153 bp, Glycine max
  Peptide Sequence Number=SeqID_94133
atgactaaaggttatgggaattttacggaagcattatgggtgtcccggaagccccagaatcccatttttcaacaaaacggggggtgtggtggccccctagctcgcccaggcgagctcagcttggccaggcaagctaggttgctccaaccttaa

SEQ ID NO: 2449 - DNA, 1821 bp, Glycine max
  Peptide Sequence Number=SeqID_94134
atgggtttgtgtgctatttgttctaatgtgggtggagtaaatattatagcaattggatgcaatgatggaagttgtgttatttgggattttgaaacccgaggcattgctaaaattctgcgtgatgatgaatgttcttctcccataaccagcatttgctggtcaaagtatggtcatcgaattcttgtatctgctgctgataaatcattgatattgtgggatgttatgagtggtaagaaaataacccggatagttctgcaacaaacccctctacaagctcgtcttcatccaggatcctcgaccccatctctctgcttagcatgtcctctttcatgtgctccaatgattgttgacctgaatacaggagacacaactttacttatagtttctgtctcagagacatgcaatggaccaacccctcctccacgtaataaatgttctgatggaattacctccttcacaccaactgctgcttgttttaataagtatgggactctggtttatgtgggaaactcaaaaggggaaattcttgtcattgattacaaaaatggtgacgtgcgtgctgtagttccaatctctggtggttctgttgtaaagaacattgtgttcagcaggaatgggcagtatctgctcacgaattcaaatgatcgaataatacgaatctatgaaaaccttctgcctctgaaagatgaagtcagagccctggatgacctgagtgggaaccacaacgatctaaataatattgagaatttgaaggctgttggatcaaaatgtttaactttattccgggaatttcaagattccatcacaaaggtacactggaaagcaccttgtttcagtggtgatggtgagtgggtagttggtggttctgccagcaaaggtgagcacaagatttacatatgggatagagctggacatcttgtgaaaatccttgaaggacctaaggaagctctgatagatttagcatggcatcctgtgcatcctattgttgtatctgtttcgctgaatggtttagtttatatatgggcaaaagattatactgagaactggagtgcatttgctcctgatttcaaggagcttgaggaaaatgaggaatatgtagagcgtgaagatgaatttgatctgattcctgagactgagaaggttaaaggacctgatgttgatgaagatgaggaagttgatattgtaaccgtggagaaagatgccactttcagtgattctgatatgtctcaagaagagttatgttacttgccatcaacccctagtcatgatgttcctgagcagcaagagaagtgtgtggaaagttcttcgaagttgttggacagcaataacactggatcccctctttcagaagaagctggaccaaatggtcatatgatgaatcatgcatcaagtcctcttgaagatgatgctgggcgcatgaaaagaaagcggaaaccttcagagaaggtgttggaattacaagccgaaaaagttaagaaaccctcaaaatctagcaaatcggaaaaacccaagagcagatctttggccgatgaagataatggtaatagttttcatggtgttgttctctcctttgcttctctaattttgacttgttttggtgttgtatcatgctggtttgaaatgttttcatgtgggagtagtggtgctgtgagagttaatgggggtgcaggtgctgctggtcgctttgatgacgccgagagtgtgagagtggggttttttaaatgcagaaaaatgctcctggaaataggagtgatgcaggatgcatcatttggccagaacacaaaaatgttgggtcttgcaaatctattagagataaagtga

SEQ ID NO: 2450 - DNA, 561 bp, Glycine max
  Peptide Sequence Number=SeqID_94135
atggatgactcctcaaccattgaagaaatgatgataaattctgaatttgaagaagttttggaagcatttaaaaaaatgcatgatcaagtgcaatggcttgttgtttcaaacaataagctgagaagtgatctaaaattgcatatcactaaattggctttagcacaaacggaaattaaaagagtagggaagaagaagacaaacacacaagagttttatactagttcggcaacaacccgtgcctacatccagtccccaagcgatcggcggtccttgagatttcttttgaaccttgtaaattcctttacaagcaaagatccacaagggatgtaccctcccttgttctctttgaacaacctagtggatgtaccctccactagaactaatccacaagagatgtaccctctcttgttctcagtcacaacaacccaagtagatataccctctacttgtaccacaaaggatgtaccctccaatgtgttaagacaaagttctcaggcgattagtcctttgaaactttgtgaagggggaaacaaaagaattcttaggcggttagtcctttga

SEQ ID NO: 2451 - DNA, 214 bp, Glycine max
  Peptide Sequence Number=SeqID_94136
atgactagaggcaatccatctgacttacaaccctttgatcctgagatagataggacatttcatagattagttaggcatcattttgtaccttttgatcatcctgagcattccattactggtgagtctgtgcattctgttattggtgattttgaacatcctgattttgagcattataattttgaacattctgagaacatggcacaacctccacccc

SEQ ID NO: 2452 - DNA, 237 bp, Glycine max
  Peptide Sequence Number=SeqID_94137
atgggaaaacctagaagagtagaagtcagagatctgtgcactcagccagcctgcccagtgaggatgttgtttcttctcgcgcttagcgtgtccactcttgctaagcgaaaattcactaactctcgcttagcgagccatgctcactatgcgagccttcggaagctgaagagtccaagagcctttaaaacactgaggttggcggagtttcgagaaagggagacaagtttggagcaatag

SEQ ID NO: 2453 - DNA, 606 bp, Glycine max
  Peptide Sequence Number=SeqID_94138
atgaatggagctccacgttataactcaataatctatagttcattgccaactataattgttggtattctcaacaaggatcttcgtaaaaggactctccttaagtatcctcaactttatggggcaggacagagacatgaggcctacaacaagaaattatttttgttaacaatgttagatactttgtggcaaagcatggttatcttctgggcacctctctttgcatattggagtagcacaattgatgtggcaagcattggagacctttggactttaggagttgttattttggttaatttacacttggccatggatgtcataaggtggtattgggtgacacatgttgtcattagggggtccattgttgcaactttcattagtgtcatgatcattgattctatccccaatcttcctggctacttggccttctttgatgctgcaggaactggattgttctggttattgttgcttggaatcatagtaacagcattgcttccgtatttggttatttgtagagaagcagagaagattgggtatgacagggttgttgaaagtggacagacttcattggttgctatccgaaggatagaggttttgttatcactgtag

SEQ ID NO: 2454 - DNA, 174 bp, Glycine max
  Peptide Sequence Number=SeqID_94139
atggggagaccagtcaaggttacgctatgtgagattggcacaagcttaaaggagcactcaaaccgggtgacccccaaggcctatattccgaagagtccgtcagggcctctccttcctgattcagacactgctcatgaattatacaatacccacgacctcacactcgtgttttaa

SEQ ID NO: 2455 - DNA, 537 bp, Glycine max
  Peptide Sequence Number=SeqID_94140
gatgaggatagtgttatgcataagaagaaaattgctgacaagaaaggtactgatggcaagaaaaatgaggtgagaggtggaagtgaaaaagttgtggacgaaggtgtggaagtacatgcttcaaagcatccatcaggggcagattatcttattatagagtttacagatgcctggcccgggacttattcttctcttcacagaaaagatgaaggtcccacaaaccaggtaccacagcagatggaggatgagtcatccgagactaccactccaaagcccttggtcagaaggaagaaggatgatgaaacacaagaagctgcagccacttctgagaaatctcttgaggccacttttgagccttcagaaccagtggcagatacagcttcacctcagcaggcagtacaccctccactcctaaggatcagactacaccagtcctgtctccgaacacctctcctacagctacccctgtgctttcacttaacagatgaggaggacgttcagacacaggatattcaggaccaatcacaggatttttaa

SEQ ID NO: 2456 - DNA, 339 bp, Glycine max
  Peptide Sequence Number=SeqID_94141
atggcaggaactagtgacggtggtggtgaatatcatcaacttgacggatctcatcgtttgttactggatgtgatgactacacagatgcaacgtttgctgaatcgtaacaatgaagagctctatggacgaattgaaggattggagaaccaattgaatcagaatgttggaagacattatggtgggaaccgagggggaaacgatggacctaggaaaaacaaaattgagggagtaaaactcaatgtacctcatttcaaaggcaagagtgacccagacgcctaccttgacttggagatgaagattgagcatgtattctcctgcaatgattatactaaagaatag

SEQ ID NO: 2457 - DNA, 324 bp, Glycine max
  Peptide Sequence Number=SeqID_94142
ttttacagatttggtcttcgccagcaaaagatcgaagtggatccgaaaagaggcaaatttgatcatcctactaggacgactgagaaaactggggcaaataaagagggtgaggatgagggagaaacccatgctgtgactgccattcctgtacggccaagtttcccaccaacccaacaatgtcattactcagtcaataacaaaccacctccttacccaccacccagccataaccctagccaaggttcatcaacctccacttttctgaggatacgactcgaatgcaacgtgtgcttatcgtggaggagccctggggcattccattga

SEQ ID NO: 2458 - DNA, 296 bp, Glycine max
  Peptide Sequence Number=SeqID_94143
ggaccagtgccacccccgagtttgatagccaccgtttcaggagcgctgagcaccaacaacgtttcgaggccatcaaaagatggtcgtttcatcgagagagacgcgtccagctcaaggacgatgagtacaccgactttcaggaagagatagctcgccggtgttggacgtcactgggagtgcgggacatgcgatcatgggtgaggggtcagtggattccctttgatgtagatgccctcagccagttcctaggtgacatgctggtgttagaggaaggccaggagtgcgagtttagttag

SEQ ID NO: 2459 - DNA, 762 bp, Glycine max
  Peptide Sequence Number=SeqID_94144
gacatcgtatccgacatcgtggatcctgcagcttcactacttgacttttatcttgcattgtacagcaactccagtattctcgggcaggatgtcctggacattgtatccgacatcgtggatcctgcagcttcaatgcttttagcaattccagtattttcgagcaggatgtcctggacatgcccgatcttattctttgacataacgttggacatcatgtgcagcaactccagctttccttcattgtctaagtacgctctgcagaaaccaagcgagaggaaggaggaggccatcgacattgactcactttctgccaaagtgaccaatatcactagactaagcggcgtgacccacagaggtcacatctttgtggcacttgacatgccagtacgacccacgaatgccaaaggaaaagctaaggtagctgtggaggataccaacgaagcaagccccactccagacgaggatgttccggcggggaggttcgctgttgtcacaacatgcccttttacgggcgagcgaggcaaggctcacgggtgcgctttccaaaggaggaaatatgtgcggagtcgccaccaacgtttatttgtggaaaacgtcggaaaaaaccgaaggaaaccggtcataaagaatattccaagttcgggagttgtatttacgtttgaggaaggtattagcacctctcacgtcgacaaaagcggggctcttgctcctacgtaccctccatcgaagaggaaatcagacctacgtagttcttttttaagg

SEQ ID NO: 2460 - DNA, 198 bp, Glycine max
  Peptide Sequence Number=SeqID_94145
atgtctctcaatcaagttcctgtgaaaagaaagaaagcagaatggtgtgataaaaatactgaggttatgttgaaagtgtgcatagaagaggtgaatgctggaaataaacctcatagccacttcactaagcttgggaaggacacaggtcttggctgggatggggagaagaaaaccattgcagctagtgatgaatggtga

SEQ ID NO: 2461 - DNA, 189 bp, Glycine max
  Peptide Sequence Number=SeqID_94146
atgaagcttaaactcaaaaagaaaggaggagaatcaagtttgtcatcatcaaaaaaggggagattgtggaagcaaagctaccatgatgattcaccaagatgttttgatgatgccaaagctcaaagagttctttcaagattaaagaatcaagcattcaagattccactcaaagattcaagaatcaaatga

SEQ ID NO: 2462 - DNA, 558 bp, Glycine max
  Peptide Sequence Number=SeqID_94147
atgcagatgctccagttcctgtacccactgatgaggtttcctttagtggggcaggcacttcacaccttccttgcttggccgacacatctggttaagtctttatcacagcaggtagctgtgtctcagccaaaaccacctccgaagcccgatccggaggtcgatgatccgctttatctgatgacattgaccatcccagagccacaatccactgaaacatgtatgcgagcggagaattctgatatctatggattcctcgagccacaatccattcagaggttccactgcagtggacactggcagatggtggtcatcctgcctaaggaacacttagttgtctggttttgttcattgcataacaggccaaacaactaccttaaggggattattaatagtgctatcaagggtcttgatgatgctccacagcctaaatcaaaggcttctgctaggtggattgtcgtcaagtgtaatagacaaaaaggaagtactgagtgcggctactatgtgatgcactggatgtccaccatcattttaggaacttttagaaataattgggaagcg

SEQ ID NO: 2463 - DNA, 542 bp, Glycine max
  Peptide Sequence Number=SeqID_94148
atgactagaggcaccccaagtgacttacaaccctttgatcctgaaatagataggacatttcatagattagtaaggcatagtgtgcatcttgattaccctgaacattttgtaccttttgagcatcctgagcattctgttattggtgagtctgagcattctgtggttggtaattttgaacatcctgattttgagcattataattttgaacattctgattttgaacattctgaaaatatggctcaacctccacctcgtgagaggactctaagggaaatggctgcacctgatttcacttatgaaagcttgtgcattcaataccctgatgaggatgtcccatatgttcttaaaactggactgatccacttgttgtccaagtttcatggtcttgcaggtgaagaccctcataaacgtctgaaagaattccatattgtcagctccaccatgaaacctccagatgtccaagaagatcacatatttctgaaggcctttcctcattctctagaaggagtggcaaaggactggctatattaccttgctccaag

SEQ ID NO: 2464 - DNA, 120 bp, Glycine max
  Peptide Sequence Number=SeqID_94149
atggcccccccttacaggatactgggctgccttgcagcgacgttctctgcttgtccagcgccgagaagggatgacgatcggtcggtcatgaccctatccttcatttgcatccgtccctaa

SEQ ID NO: 2465 - DNA, 416 bp, Glycine max
  Peptide Sequence Number=SeqID_94150
gccgtaatatccagctgaacggtctggttataggtacattgagcaacagaatgaaatgcctcaaaatgttctttacgatgccattgggatatatcaacggtgtgaaagttggaacctcttacgtgccgatcaaagtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 2466 - DNA, 492 bp, Glycine max
  Peptide Sequence Number=SeqID_94151
atggatgagaagagaaagaaaaaactagaggaagcaactcaatccggaagcactgacaccgtcattgatcctccatctcccatcaaacgacacgtgaagtggaagctagcccgcaccaagaaaactggtgacatgacatctgaagcagcaaaggaaattgctgacaagattgatgcgcttgaggagcaggcctcacagggttcctttgttacccatggacgtcatgatatactgactgctgccattgggcgaccagaacaccctggtcgtgtgcgtgctgtaggagccggtataaccatcaaacaatactttggatcagcttcaaggacctcctccattgctcccgaatacctgcaacagttgacgcaacaaatcaaggaccaactagaggattcaatcacagaaaaagtcactcgacggctaatgttatccctcagccaaatgcaatcacagggactccactgcctcatgaacctgatgttggtcctttag

SEQ ID NO: 2467 - DNA, 505 bp, Glycine max
  Peptide Sequence Number=SeqID_94152
ggccttggtttttccggcattgatcataggtctctgccagtcattcggggttcctgtcacgcccagtaaggtgatccgactgccgatcacccgcactttcatagagaaatactgcacagctaggcaggcacagggtggcgaccctcaggccccagatgcacctccgccacctcctcaggctgacccagctgggtcatttgacacggagcgatatttacggcatttggttcgccagcaaccggccaaccaccgggcgcacgtgcagacccatgactccctatatcagcttagcctcagcctgcagagtcagggttttgcttcttttccatgccctactccggatcagttcagggcagaggtcgcatggcccggagattggcctgaggcccaggcagcagaggcaggggaggcacccgcagaggctcccggcgaggcagatgaggcccgcgtggacgaggagatgaccaatttgcttgatttcttgggagggagcggagccacatga

SEQ ID NO: 2468 - DNA, 324 bp, Glycine max
  Peptide Sequence Number=SeqID_94153
atggctctgaaaaagctttccatgaggaggtctaggagagacgccgcgacggaagggtccagtgccgcccccgagtttgatagccaccgtttccgaagcgccgagcaccagcagcgcttcgaggccattagaggatggtcgttccacaaagagagacgcatccagctcagggaggatgagtatacagattttcacgaggagatagctcgtaggcattggacgtcgctggtgactcccatggctaagtttaaccctgaggtagtcctggagttttatgctaatgcttggcccacagaggagggagtgcgagacatgcgttcatgg

SEQ ID NO: 2469 - DNA, 228 bp, Glycine max
  Peptide Sequence Number=SeqID_94154
atgcatgaacgacaatcaattcatggggctccgaataaaagtggagaatggagaattggcgaacagctaggcaatcaattcgcggggctccagactcgttggtggaggatgcatgaacgacaatcaattcatggggctccgaataaaagtggagaatggagaattgagcgaacagcgctaggcaatcaattcgcggaactccaagactcgttggtggaggatgcatga

SEQ ID NO: 2470 - DNA, 508 bp, Glycine max
  Peptide Sequence Number=SeqID_94155
gcgagagtcaagctatagctcaatacaatcaatccttaaccaaagcttacaggactgcagtgcaagatggagtggttgctggtttaggcctggggaaccaatactcttcagttgcagcatcaaagaaaacattgcctatggtaaggatggggcaacaaatgaagaaatcagagctgccactgaagttgctaatgcagcaaaattcattgatagatttccacattgctaagattcttgcttggagttttagtgattcaaatttttcaattggtgatgcattagtgacagaaaatttgccttcatttgttcatcataaaaagtggtttcctggagcacaagctttcgcggtaggtgtcaccagtattgtgtttgtgttaatcattggttttggttatgtcgcatttttcgttctccgcagaagaaagacacaagaagaagttgaagattgggaactggagtattggcctcacaggataggtttccatgagatcgatgcagcaacaacggg

SEQ ID NO: 2471 - DNA, 1152 bp, Glycine max
  Peptide Sequence Number=SeqID_94156
atggacacatttaaaggacaaatacaagaagctatcaagttggagttgtcacaaattgcatcacaacattcagccccacttcagccaaatgatatacaagtattagcagcaagggtaagcacgaagggaagctgtgcagcaacagagacaaatgcattagctaaaaaaccctctaagttgaatggtgacaacgtcgggctgcatgtaactgccgagaactccaacaaattagtggcagtgggcaaacagtgcgacagttttggcaccatccacaatgtgccctatgctgatgatgttgttcccgtgagtatggtggaagttatttttggtgatgcggaggaagcagagaaggatgtgagctcaccattgaagactgttgaggaggaaaaggtagctgaggttattgatccattgggagagttggtgaagaacttgttcgacatttaccaaaggcccgttgaggtgtcatgggatggtgctaaatttgggatcaataatgtcaaagatggcttcttcatcacacacgctgatgtgagcgagataatattaggagacaagtgtttaaacatctccattctacagctatggcttatgtttattcatgattggagtgcgagcattggttatggaccattgtatgggttccttgaacctcagtgtatccacaatgcaagcagtagacgtcaagagtgtgaaaattacattggaaggtggttgaaggaagcaggaaaacaaatttacatagcaccttatttaaaccaggcccattggcagctcgttgtattgtgcccaggcgacaatgtagtggtttggttttgttctttgaagaagaagccggatgctgccatcaagggtgcagtaaacagtgcaatgaaattagtcaccaaaactgcagagggaaagccacctcagcatgggcctcagtggattgaagcaaagagtcatgttaaaacaggaaattacgagtgtggatactatgttatgcaatggatatggtgcatcgtaagtggtggattgaaggatgactggattcactggttttctgatcgatcaccgctaacagaagagaccatgaccacactccggcataaatgggcggcctattttatccaaatgaagaaatgcgaaccaagaaaaaatttgataacttag

SEQ ID NO: 2472 - DNA, 600 bp, Glycine max
  Peptide Sequence Number=SeqID_94157
atgtggggcatcccttttatccttgaaccaaaccaagccctgacatggagagaatgtcaatccttaccctcggaagcggaaagaatagaagggaaatttccaatcaaagaaaaggaaagaaggaagatttccaatcaaagagaaagcaaaaaagaaaagaaggaaaattccccaatcaaagagtgggagaaagcaaaaagaaaagaaagaaaattcccaatcaaagaatgggagaaagtaaaaaaggaagaagaagaaggaaagaaagctcctgatcagggatcgaaggaaaacagaagaaatgtgcagaaaggtctttggaccggacaatatctgaacaatacagaattgtcccaaatttgggggagtttgttgggtgacaacaattgtggtaagaagatgacagcacacacagcaaaatcaataagcaacaaggtagcagctggtgtctcgctaagcgaggcctatgcgcttagcgagagtcatgtgctaagcgaggtactcagcccgcttagcgagttgggagaatttggaggagaatctgagaagcacatgcgtgctcagctcgctcagcgaggcgttggtctcttcatgttctaa

SEQ ID NO: 2473 - DNA, 882 bp, Glycine max
  Peptide Sequence Number=SeqID_94158
atggcaaagttaataaaattctttgagttgaacacaggggccaagattccttctgttgggttaggcacttggcaagctgaacctggtgttgtagccaaagctgtcaccatagccattcaggttggatacaggcatattgactgtgctcaagcgtataacaatcaagcagagctggtgctattttatctattggagttgctagtgtgttcagatcatgttccagaagatgtgcccaaagcattggataaaacattgcaggatttgaaacttgactaccttgatctctatctgatccactggccagtccgcatgaaaagtggatcagttggattcaagaaagaatatcttgatcaaccggatattcccagcacatggaaagcaatggaagcactctatgactcaggcaaggcaagagccataggagttagcaatttctcttcaaagaagcttcaagatttgttggatatagcaagagtgcctcctgctgttaaccaagtggaattgcacccaggatggcagcagcaaaagttgcatgcattctgtgaatctaaaggaattcatctaactggatattctccactaggctccccaggagttctcaaaagtgacattcttaagaatcctgttgtgatagagattgcagagaaattgggtaagacaccagcacaagttgcccttaggtggggattgcaaacaggccatagtgtgctgcctaagagcactaatgagtccagaatcaagggaaactttgatgtctttgactggtctattccagaagaattgttagcaaaattctctgaaattaagcaggcaagtattggtggagggtataaagtggtacaagacagaccagagagtagaattgaggaagatgttgaataa

SEQ ID NO: 2474 - DNA, 274 bp, Glycine max
  Peptide Sequence Number=SeqID_94159
gcatgaattcagacttaagcatgatgattggatgaacacggtaaaacctaatcttcatcctggtgtttcagcacaattgcatgaaaaatttgaggtatttgatgtagagattgaaaactctaaatctgttagaagtgagatgcgtgctgttataaattcgcttttgaaggatattctcgtgattcaaatttgtcaccatgaacaggtcagggcaaccacaggatttgaagaacttggagcaaatgccatattggcagtgtctcttgcagtctaa

SEQ ID NO: 2475 - DNA, 468 bp, Glycine max
  Peptide Sequence Number=SeqID_94160
atgggtccgaaatctaccctaaggctcataagaatgcatctctggccaaatctacttggagtcttctatccaatgcccttgcggggtggtggattgttaagaccagtagaaggtgttgtttgttactcacatgttgtcactgttgtccatgaaggagatgaagttcctcaagctgaaataggggagcacgatagtggcagaggggaagttagggagaggtccaaatgtgtgaagtttatcaatggccttcgaccagaagtgaagatgatggtgaactgccacgacatccacaactttgcacaactgaccaacatgtgtaggatctttgatgaggatcagcgggagaagctcgcattctacaggaatgccaatgctaatcatgggaaagagaagaagcttgtgactcatagttgtgctaagccatattctgcccctcctgggcaatatgacaaccattttgggggatag

SEQ ID NO: 2476 - DNA, 358 bp, Glycine max
  Peptide Sequence Number=SeqID_94161
tggggctcgcttagcgagtggctctcacttagtgcaattccagacccgagagggatttgggcttagcggggtcacacagctttactactccatatggtctgacttccttgatgcaacacctgttttcctagatggaagtccttctttagcagctttttatcatgatagtgatgaggacaacgcaaggaataagggcaaggaacctttagaaggacttggaggacctatggcaagggctagaacaaagaaggccaaggaagctcttcaacaagtattaaccatgctatttgaatttaggcccaagttacaagtggagaagcttcggattgttaattgcaccatgttccaagaagagtag

SEQ ID NO: 2477 - DNA, 345 bp, Glycine max
  Peptide Sequence Number=SeqID_94162
atgaagcatagctccaaactcattgggtggaggacgcatgaacgaaaacacaattcatggggctccgaaaaaaaggcgaggatggaggcttgcactagagggtcctcactagtcaatcatgaaatagctccaaaatctttgagtggaggatgcatgaacgaaaacgcaattcatggggctccgaaaaaaagcgagaggatggaggattgcactagagggtcctcactagtcaatcatgaagcagctccaaacactttgggtggaggaagcatgaacgaaaaagaaattcatggggctccgaaattaaaggcgagatggagggttgcactagaaggtccttactag

SEQ ID NO: 2478 - DNA, 378 bp, Glycine max
  Peptide Sequence Number=SeqID_94163
atgcctaaatcatctcccaacatgcatgtgaagcaagaagtatcaacaagagtcaaagcaaggctattatgcaagcaatcaatggggcaaaacacaccgaataaaatagatgatgatggctcaaattctcaccaagggaagttgaactttggtgggaaatttgggcttttgggtgttctggcctttcccttgtcggtttatttctcttttctctttggttcagcatggaacaagcatggaggtgactacttcaggcatccctcagattcttctgttctttcttccaagggtaagggtagaaattcctatcctgggttaagctttatggtcgaaaagttgaggtttggctcaaaaaggcttgtggaaggcagcacatga

SEQ ID NO: 2479 - DNA, 719 bp, Glycine max
  Peptide Sequence Number=SeqID_94164
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatcgttattgctgatcgtaagagaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 2480 - DNA, 282 bp, Glycine max
  Peptide Sequence Number=SeqID_94165
atggcaaaaattaacccaggtaagacgatgaccgctcacgattggtcgcatatcattttggctcttacttgcaggtacatagggacggatgccagtggggctagggtcaccaccgaccgatcgttgccccttcctgtcgctaaacaagcagcgaacgtcgctgcaaggcagcccagggatggccttaagcctagggtgcatcctgaagcaatggggcatgccacattgcccccactctcttgctattcatgcctaaacgtgcgcccaccaagtgctcggtga

SEQ ID NO: 2481 - DNA, 48 bp, Glycine max
  Peptide Sequence Number=SeqID_94166
atggagaattgcactaagcaatcactacgcatggatccacactcgaag

SEQ ID NO: 2482 - DNA, 282 bp, Glycine max
  Peptide Sequence Number=SeqID_94167
atgggggtgcaaatagcaaccaagctcacttgggccttcctgagggggaaggagggcagagcaaatgggttcagcccttctggtattgagaaatctctcgaaattaatgagaaaaattgtttccgtgaaaaaaatccaagccgaggtacttccgtaactctttcgagacgtttctgtaagcgatttcgtgaggattcttcaccgttcttcatcgttcttcattcgttcttcggcctccaaccgaaaaatctaaccgatcgttcatgttgtaacctcggttaa

SEQ ID NO: 2483 - DNA, 274 bp, Glycine max
  Peptide Sequence Number=SeqID_94168
atggacgatgatcaatgggcatattacagtgcgatgtccgaagaagttgatatggattttcgagatgaagaagattgtggtgtgaatgaagcacatgttgattgtttagatgcttttaatacttctcaggtctttgcaacccgagaagatgttttgaagtgggctcgaacagttgcccatgaaaatggttttgttgcagtaattatgaggtctgatacatatactggtagcagaggaagaacttcatttgtgttaattgggtgtgaaattagcg

SEQ ID NO: 2484 - DNA, 336 bp, Glycine max
  Peptide Sequence Number=SeqID_94169
atgaccatgattacgccaagctcgaaattaaccctcactaaagggaacaaaagctgcccgggggatccactagttctagagcggccgccaccgcggtggagctccaattcgccctatacacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcaggggtgaccgctacactttgccagcgctgatgtccggcggtgcttttgccgttacgcaccaccccgtcagtagctga

SEQ ID NO: 2485 - DNA, 825 bp, Glycine max
  Peptide Sequence Number=SeqID_94170
atggagagaagtatgatagatgctgccagtggtggagcccttggagacatgacccctgctgaagccagaaatttaatcgagaagatggcttcaaactcccaacaatttagtgccagaagtgatgctattgtcattagaggaatgcatgaagtagccacaaattcatcaggtgagactaagaagcttgaaggtaaactagatgtcttggttaacctgcctaaagcttatgctgcaaacatctacaatagacctcctcaacctcaacagcaaaatcagccacaacagaataattatgacctctccagcaacaggtacaatcccggatggtggaatcatcccaaccttagatggtcgagtccttcacaacagcaacagcaacaacaacagacttattttcaaaatgttgttgacctaagtacaccatacgttcctccaccaatccagcagcaacaacagcaacagccccagaaacagcaaacagttgaggcccttccgcaaccttcccttgatgaacttgtgaggcaaatgactatacaaaacatgcagtttcaacaagagaccagagcctccattcagagcttaactaatcagatggggcagttggctacacagttaaatcaacaacagtcccagaattatgatagattaccttctcaatctgtccagcatcccaaaaatgtgagtgccattacattgaggtcaggaaagcagtgtgaatctaaagagaagcatcatatccctcttccattctctccaagagcaatttccaacaaaaaaatggaagaggcagagaaggagatcttggaaacatttaggaaagaagag

SEQ ID NO: 2486 - DNA, 279 bp, Glycine max
  Peptide Sequence Number=SeqID_94171
atggagagaagccataaattcaacaatgggaagagatcccaagaagtttctcctacacttaaatgctataagtgtaatcaacccggtcacataaaggcaaactgcccctcaaatgagtcatggctcgagaagaatgagaagaaaagctataaagaaagaagatccaagaaggcgtatatcgcttgggatgacaatgactcatccgatggtttggagaaggagatcaaacttctatccaaggactatgaaagtgatgagaacatctctcaagaagtttaa

SEQ ID NO: 2487 - DNA, 440 bp, Glycine max
  Peptide Sequence Number=SeqID_94172
ttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacggg

SEQ ID NO: 2488 - DNA, 544 bp, Glycine max
  Peptide Sequence Number=SeqID_94173
ccagaggaaagaaagcaaaagcgattcccgtagtagcggcgagcgaaatgggagcagcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggggtgaaatgccactcgaacccagagctagctggttctccccgaaatgcgttgaggcgcagcagttgactagacatctagggggtcaaggtcggccagtgagacgatgggggataagcttcatcgtcgagagggaaacagcccgggatcaccagctaaggcccctaaatgaccgctcagtgataaaggag

SEQ ID NO: 2489 - DNA, 1005 bp, Glycine max
  Peptide Sequence Number=SeqID_94174
atggtggaagaatttgaagagatcctaggatgtcctctagggggaaggagaccatacctcttcttagggttctatccctcattagctagaatttctaagatagtccaaatctcggcgcaggaattagaccacagaaagcaagtcaaaaatggggtggttggaataccgagaaaatgtttggaggcaaaagcaagaatcttggcaggtaaaggaaaatgggccccgttcatagacattctcgcactgttgatcttcggaggagtcctctttccaaatgtggatgggttggtggacctagcagcgatcaacgcttttctcgcctatcatgaccacaaggaaagcccggttgtcgctatgctagctgacctatatgacaccttcgaccaaagatgtgagaagagcagtacgaggattgtttgttgtactccgactctttatgtatggttggtttcgcacctttttcgccaagagataaggcatgcttgcccgctagaaagccaccgttcatgcacagagaaaggaggggcaaattgggaccgactcttagcaaacaaagaaggagagtctgtcaacttgttccctcgatggaaagaaggaagaaccggggttcttatttcgtgcgaaggatttccgaatgttcccttgatggggacaaggggttgcatcagttacaatcccgttcttgctataaggcaacttggataccctatgagaggggcaccactagaggaagagctcgtgcctgtcatttcacaaggtttcaataagaccaacgtggagacacttcagaaggtccacaaggcatgggaggtggtgcaaaagaaggacaaagaacttaggggcagtaacaatgggcccatcggtggctaccgtaagtggttgaaagcccacgtgcaaggtttggattggctcccgagtttgagaactactaaaagggaggaagttgaggcaccggaggaagacgaagagatgcaggcccttagggaagaactcgagcaagcctaa

SEQ ID NO: 2490 - DNA, 456 bp, Glycine max
  Peptide Sequence Number=SeqID_94175
atgtccccctgcaaaggtatcatggtctgtgtcgtcctgatggggtacatcgcacccacaaagacactcaatggacctaaagaagtccaacaggccctggggtttccagctctggttacgggtctctgtcggccctacagggcgcccgttccccccagcaaggattgtgcccgtaagacacctagtggacccgaagaaggccaacagggtcttgagttgccagctctaaatacgggtctcttactgcgcccccaggcaggcgcagggcgaaacaccacagcagcattgggatggccggtagcgggcaatagacacaccgccaccacctctagagttcacctcagctcatccgcaaaaaggttagagcgttgcctacgacacatggccgaccagcaggcgaccaagtccaaagccaaaggtaagcaaagtactaggtcagtgaccgacaagtcataa

SEQ ID NO: 2491 - DNA, 336 bp, Glycine max
  Peptide Sequence Number=SeqID_94176
atgactattgaagaatccattcatgtttcttttaatgagtctaatgttatttctccaagaaaggatgtgttggatgatgtttcagatttcttagaagagatgcatactcatgaaagggattccaaaaggaaaagagatgaaagcaataaggattttcaagactatgaaactaaagcaaacaatgatcttccaaaggagtggaaagcttccagaattcattttcttgacaacattatcagcaatatctcaaaagagttggaaattggaggaagttactggaagttaaagttggaagttggaaatggaagttactggaagttggaagttagaatttga

SEQ ID NO: 2492 - DNA, 267 bp, Glycine max
  Peptide Sequence Number=SeqID_94177
atgttgaatcaatttgtgccatttatacagggtttcattcacaacgttgtggatgtgaaaacggacggtaactgtggatatcagtccattgccactttatttggtatgggggaagattcttggttgttggtgcacaacgaattgattaaagaacttggcagatggtcgcatgactacaccaacctcttcggtggcacagagagatttaaacaattaaggttgtccctacttgttgatgggttttctaaggttagtgtggacaagtga

SEQ ID NO: 2493 - DNA, 363 bp, Glycine max
  Peptide Sequence Number=SeqID_94178
atggtggttatatcactgtcaatgaaactcaaggaagagcactgttctattggtttttcgaggccactcacaaaccagaaccaaaactcattctcttatggctcaacggagaatcacaaaccagaaggtcaggaagtgagtgcagcaggagtaaacattgataatcacatgaatgaaggcagtggctggttaactcagcataacaatgcaaagcctattgctgattccagtttttccaaggctaaaccagaagattctttgaactcacaattcaaactgccagaagcttcacaactactttgtcacagcttagagggcaacgctggtgcactcacaaattttgaggtccttgatttcttatga

SEQ ID NO: 2494 - DNA, 324 bp, Glycine max
  Peptide Sequence Number=SeqID_94179
atgtaccctctcttgttctcttttaacctagtggatgtaccctccactagaactgatccacaagagatgtaccctctcttgttctcagtcaaacctaaggagaagggagacacaaaagaattcaggcggttagtcctttgttcttttggaaaagggagaagagagacacaaaaagaattcaagcggttagtccttggcgaattctttttggcaaagggagaagagaatgaaaagatgaatagcacaagttttcaaggtttggaaaaccagaaagcttttggtacaaagaagaagaagaagtttaaagagattcagggtttgtaa

SEQ ID NO: 2495 - DNA, 360 bp, Glycine max
  Peptide Sequence Number=SeqID_94180
atggatagtttggtggacctagccgcgattgatgctttccttgcatatcaccatagcaaagagagcccggtggtagctatcttggcagacttatttgatacatttgaccaaaggcagaacaatcaactggtttccttgatggaaggaaggaaaggaaggagttctcttctcgtgtggggactacccaaacatcccgttgatagggacgagggcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggc

SEQ ID NO: 2496 - DNA, 561 bp, Glycine max
  Peptide Sequence Number=SeqID_94181
atgaaaaatattgttttctcacatattaaagtgtgttgccagagagaaaacgttgatgacacagctggtgctgctcagcttcaaatggtctgtatgatgctggtgcgattcccagcattcgagctgcggaaatctacgggcttaatgtacttgcagaacaaattcaagatatggaaccatgaggaggctacactgcttaacacttttggtaatcatgattttcccgacagaggaatttctaagctctgccttgtaaatgagcttgatgatagcttgcttcttgatgcttcatttgatggaaacattcagatttggaaggactatctcctgaagggtaaacaaaaacttgtcattgcattctcttcaattcatggacataaaccaggtgtgaggagtctgagtgcagttgttgattggcaacaacaatgtgattatccatatgcatcgggtgagatatcatctattatgctatgggatgttgataaagagcagcttgttaattctaaatcttcatcatcagattgcagtgtctcagtgttggtaagcctcatctttgcatga

SEQ ID NO: 2497 - DNA, 936 bp, Glycine max
  Peptide Sequence Number=SeqID_94182
gtcgactctagaggatcccccgccctcgccttcaaagggctacatgccctcgccttcaaagggctacacgtcctcgctttccgaggactacacgccctcaccttcagaagactacgaatcctcaccttgaaaagactgcacatcctctccttcagatggctacatgtccttgccttcagaggactgcacgtcctcgccttcagaggactacatgtcctcgccttcaaagggctgcacgccctcgccttcagaggactacacgtcctcgccttcagaaggctgcacgtccttgcttttagagggctcctcatctgcgccttaagaggacttaagtgccttggtcaccccctgatctcggaggagggccaactgtgcgagcataaccagagggaggctatcgtgcaaccactatgcatactggggcaagatttcacctgtgctgctgcaaagagacgagtgcagatcatgcacaccaacatgaccactcttacacaaatatggatgacgttgctacttagcaacattctgcccaacaaccacaatgccgatctccccctacggaagtcctctatcagtcctaccaggtgcccgtcccccccagcaaggtcacgccatcatgacatagggatcacgctcgcaagacacccagtgaacccggagaagtccaacagggtcctggggtttccagttctgattacgggcctttttcaattctacgtagtgcccgtcgcccccaacaaggtcatcaggccccctaataattgggctttcatcaagaagtattgcaccccccaggtaggcgcagggcgagacaccccagcaacctggggatggctgatagcgggcaatagatgcaccatcgccacctccaaagcccctcagctcatctacaaaggctggggcgttgcctacgacccgtggccgactagcaggtga

SEQ ID NO: 2498 - DNA, 624 bp, Glycine max
  Peptide Sequence Number=SeqID_94183
atgtcgactagattgttcccgacatcagagagccaagaatcaaggaaaaaggtgcctggaaatgtcctgatgcccatggacaacatttcattccactccattggcaatgtgaaaggtggaaatttaaagagtgatgagtatcagaaagtgtttgtcagaggaaaatgtattagattctcccctgctgtaatcaacaagtacctgggcagaccaactgaaggagtggtggatattgctgtttctgagcatcaaattgccaaggaaatcactgccaagcaagtccagcattggccaaagaaagggaagctttctgcagggaagctaagtgtgaagtatgcaatcctgcataggattggcactgcaaactgggtacccaccaatcatacttccactgttgccacaggtttgggtgctgtgtccaaggatgatttgattgctgaactcaaggacacatgcaaggtgctagaggcaaccatcaaagccaacacagagaagaaaatggagctggaacgcttgatcaaaagactctcagacaatggcgttgatgatggagaagcagctgaggaagaagaagatgcagcagaggatacagaatcagatgatgattctgatgccaccccatga

SEQ ID NO: 2499 - DNA, 237 bp, Glycine max
  Peptide Sequence Number=SeqID_94184
atgagggttcactgttatcaagcaagtcggagacctagcatgaccacagattcacctccactccttatgttcccatggacccggattgcttcaacaaacaaagccttgtttcaagattcactaaagaccaagccttgccttaaaacaaagtgctttcaagacatgcaaggctctggtaatcgattaccaggaagtgtaatcgattaccagaagacagggttgagaaatagttgttga

SEQ ID NO: 2500 - DNA, 525 bp, Glycine max
  Peptide Sequence Number=SeqID_94185
atgtccccacgtgcttcccggtggttgacgttgaaggcgcacataaagggaatcacaggagcaccctacagggcacgttgtgatggtttgaccgtcacagatgtgtcctggttgctgtacacggagcatcggggggttagggcgtttcaggagatttcatctttccagggtcagcttagatggggtcctatggtcgtcacggttcgaccggagagggtggtacgccagttcggttacatccagagcatccctccaccgcctgttagtgcacgattatcacacgatcagatagatgacaggtggatgcagtttgtagatcacttactacctgcgggtcagctttgtctagtgcctgggcaggtatctgcggattacatggagtggtttttccgcatatctcacccattcataacaccgacccaggcaggtgaccagcagagggatgcaccagctgcagaccctgaggactacatacagccgcccagcccccaggttccagtagcattgagccccctccacatgtga

SEQ ID NO: 2501 - DNA, 210 bp, Glycine max
  Peptide Sequence Number=SeqID_94186
atgggtgatactgagggccctccaaagggttttgtaggggtataccaccaaatgcttgcccttcagtggtatatccgagccaaggctcgaagtcggctagattgtgatggggaatttcatgggtctcttccacggagtggagttattgacattcttattgggagtgtacgccccattgggtggcgtatagttgagaggcaagccatatga

SEQ ID NO: 2502 - DNA, 144 bp, Glycine max
  Peptide Sequence Number=SeqID_94187
ggcagaggtcgtgtggcccggagattggctgaggcccgggcaggagaggcaccagcaaaggctcccgacgaggcagatgaggcccgcgaggatgaggagatgaccgatttgcttgatttattgggagggagcagagccacatga

SEQ ID NO: 2503 - DNA, 210 bp, Glycine max
  Peptide Sequence Number=SeqID_94188
atgggtgaagtaaaggaggtgcaagagcagatgaaggccaacatggaggccatgaaagagcaaatggccacaatgatggaggccatgataagcatgaagaagataatggaagccaatgcggttgcaattgccactaccagcactgttgctaaggtgaacccgacgcccccatctggtcttaaccaaatgaatcatccaacctcagatatg

SEQ ID NO: 2504 - DNA, 315 bp, Glycine max
  Peptide Sequence Number=SeqID_94189
atgtgggcatgggaacgctgcacgactttggctccaaagagaactcctcctgtaataaaaaataaaccactcggacacaggtggctgcgacgagaaaaccaacatattggcaatgatgatctaatagttttccgtcgcaaattcgatatcatgaaacgacatgagtttctgtgggagccttacacaacaactgttatgtcaatgttgcctcccatttgtttggttggtagtgtggcgtggtgcgcagtggtgccactcatttgtttccatgttgtagaatggcaccaacacaatagagtgttgcgacaattttga

SEQ ID NO: 2505 - DNA, 201 bp, Glycine max
  Peptide Sequence Number=SeqID_94190
atgaagaagattcaaggcctacaagctccacatggagctacatcaaaggctctgtgtagagcttgtaggccttggatcttcttcatcaatggagtcctttgcttcttgaagataaatggcagcgaaatggagaaggaggaaaggttattggagacgccacttcaaggagaagatgagtcaagaacaagttcaccaccataa

SEQ ID NO: 2506 - DNA, 345 bp, Glycine max
  misc_feature (22)..(22): n is a, c, g, or t
  Peptide Sequence Number=SeqID_94191
atgagaggtgttaaagcttttnatcatcctggcgccgagctatttttccgcaggacctcccctacagtatcgtcaccgcaaaacggctcgtctcgccgtgaccttctcttgaattctcaaaacttctttcgctccatccccgctggggcagagaacccatcgctgtctcggctgtgctaccggaggctctggggaagtcggaataggagagcactcatcttggggtgggtttactacttagatgctttcagcagttatccgctccgcacttggctacccagcgtttaccgtgggcacgataactggcacaccagaggtgcgtccttcccggtcctctcgtactag

SEQ ID NO: 2507 - DNA, 441 bp, Glycine max
  Peptide Sequence Number=SeqID_94192
atggctgagaagacaaagaaaaaactggaggaagctgctcagtctggaagcactgagggcgtcattgaccctccatctcccatcagacgacatgtgaaatcgaagatggcccacaccaagaaaattgggcagatgacgtctgaggcagcaaaggaaaccacagagaagattgagcaggcatcacaaggtttgtttgtcccccatggacttcaggatctcctaactgctgtcattgggcgaccagaacactctggccgtgtgcgtgctactggatccagtgtcaccataaagcaatacttcggattggctccacgaagctcccgtaattcttcctccatggctcccgaagaactcgagcagctgactaaacaaatcagggaccagctggaggagtcgatcatggaaagagtgtctcggcagctgatgttatccttcagctag

SEQ ID NO: 2508 - DNA, 482 bp, Glycine max
  Peptide Sequence Number=SeqID_94193
ggggcggagcctatggaaaacgagctttgccgcggccctctcacttccctgttaagtatcttcctggcatcttccaggaaaatctccgccccgttcgtaagccatttccgctcgccgcagtcgaacgacccgagcgtagcgagtcagtgagcgaggaaagcggaaatatatcctgtatcacatattctgctgacgcaccggtgcagccttttttctcctgccacatgaagcacttcactgacaccctcatcagtgccaacataggaacaaaagctggtaccgggccccccctcgaggtcgacggtatcgataagcttgatcctcttggtactacagtctcagaaaaatattccgacgatgtggcttggaaaacggtcaagccaatatcagcgtcacttgcagatatcgaattcctgcagcccgggggatccactagttctagagcggccgccaccgcggtggagctccaattcgccctatag

SEQ ID NO: 2509 - DNA, 385 bp, Glycine max
  Peptide Sequence Number=SeqID_94194
atgccatttgatcggaaaattaccaagactgaaaggaagaatagaaagaaaaagaaacaagcaaccactagaacatcagaaaataacatagctgaaagaggaggagaaggaaatagaccaccaaggaggaggactctgggtgactatgcgtatcaacaaggcccaaaacattacaatagcaaagtcataccttctttcagcaacaagggcgtggaattaaagccagcactgcttagtctaattggctcacatctctttgctgaaatggatcatgaggatccatacacacatttgtctgccttcatggaactatgcagtatgatgggagcttctgacgaggatgttgaaactgtctacctcagatcttttccatcttcattagcag

SEQ ID NO: 2510 - DNA, 342 bp, Glycine max
  Peptide Sequence Number=SeqID_94195
atgatagatcaaggtcgactggaagtcggcgatgaggggagggaagagcaacatatatgtatgcagtccgcagatgagagaagttttgaaaggcctaaacctttggtgatatatttcaccaaggacgcagcttcaccaaagccccgatacccctcggtagttaaacctgttcctttcccatatcgaaacagccacgcagtcccgtgtgtagatgcaattggctttgatgttttgatgatgatcatgatgatgtgttgcaatttgatgcaaatgggcttttcaagattaaaattcaagacaatacttcaagattacaagtcacaacatcaagatgatcactag

SEQ ID NO: 2511 - DNA, 931 bp, Glycine max
  Peptide Sequence Number=SeqID_94196
ttggcccagggcttccccggtatcaacagggacacccggatttctttattccgcgaagtgatcttccgtcacaggtactattcggcgcaaagtgcgtcggctgtccctcctgttcagctactgacggggtggtgcgtaacggcaaaagcaccgccggacatcagcgctggcaagtgtagcggtctcgctgcgcggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggggagcggaaatggcttacgaacggggcggagatttcctggaagatgccaggaagatacttaacagggaagactataaagatacccggcgtttccccctggcggctccctcgggcgctctcctgttcctgcctttcggtttaccggggtcattccgctgttatgggccgcttcgctccaagctggactgtatgcacgaaccccccgttcagtccgaccgctgcgccttatccggtaactatcgtcttgagtccaacccggaaagacatgcaaaagcaccactgggcagcagccactg

SEQ ID NO: 2512 - DNA, 459 bp, Glycine max
  Peptide Sequence Number=SeqID_94197
atgcctcaaaatgttctttacgatgccattgggatatatcaacggtgttggaacctcttacgtgccgatcaacgtctcattttcgccaaaaagttggcccagggctttcccggtatcaacagggacacccaggatttattttatttctgcgaagtgatcttcccgtcacaggtgctccagtggcttctgtttctatcagctgtccctcctgttcagctactgacgggggtgcggtccccgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattttaa

SEQ ID NO: 2513 - DNA, 252 bp, Glycine max
  Peptide Sequence Number=SeqID_94198
atgtcaggatttacacgcaattctcctcaaatttcagccagcccgtatcaattagacttcacactttatgcttcggggtcatacaatgctcaatggaatgccccagggctcctccacgataagcacacgttgcgttcaagtcgtatcctcagaaaagtggaggttgatgaaccttggctagggctttctcgctgcaaaattcacttcttggttggtgttttggtttgtgctaaaggtggtgttcgtcattga

SEQ ID NO: 2514 - DNA, 624 bp, Glycine max
  Peptide Sequence Number=SeqID_94199
atggcgatgattcttttatggcagctcggtggtgttaccgcagctggcgcagcaggatctcggttataccgccacctggtccgggctggtgctgtcgcccggcgcgctcctgatcgtgctcaccatcccgctggtgctgaagctgatgccgattgtgcagacgcgctacatcatcgcctttggctttacctcaccctgacgcccaacgtggatttcaccacgctggtgctgatgcgcagcgcgcagtcgattggcctcggcttcctgtttgtgccgctcaccaccattgcctttatcaccgtgccgcagcgcctgaatgcggatgcctccgcgctgttcaccatgttccgtaacgtggccggttcgatcggcatctcgctggccactgccggcatcaccgaacgtgaacagcactgggcgcaggcgattcgtgactttaccagtgcggtgggcgatccgctgacgctggccagcggtcagctctatcaggagatgattgcccaggcgcgtattctggcttacatcgacgtgttcatgggcctgagtattgtcgccgtgctattgattcctttttgttggttgctttcgccgatcaagagcgaaggcagtgcaggagcacattaa

SEQ ID NO: 2515 - DNA, 758 bp, Glycine max
  Peptide Sequence Number=SeqID_94200
agtttgacgagttcaaggaggaactcgaaagaagacattgggatgagaagctgactaatttttctaacaacagtataggcattgccattgtgaaggaattttatgccaacctctatgaccccgaggataaatcacctaagtttgcactcctgaggcctgatccaaagaagctggctgctaggctttgtatctcagggaggggatttgagcttaatgctgatggacagcctttgaagattctgaggaagaacatgaccactctagctcaggcatggagaattttttccttttctaaccttattgctacctcccacacatatgatgtcaccttggacagagccaagttgatttatggtattattatgaagatgaatatgaacttggggtacctcatctcccaccagatctctttgattgcacaacatgacacatccagacttggattccctgccttgatcacagctctatgcaaggacagaggagtccagtcagattcaagatccttggagaacttgagccctggcattaacttggcttatattaagaagaactgttggaatctcaatgatccaacagtgacatttagagggccaaggaaggctaggggtaagagatcagaggtccccacaacttcagcaccacctgaggcaccaactccttcttcttccacaactccagttatcccatctgcatccactcagagaccacttcctgctcctatatctgcaggaccatcagattttatttttacaccatag

SEQ ID NO: 2516 - DNA, 1066 bp, Glycine max
  Peptide Sequence Number=SeqID_94201
atgatgggaaaattcagagtttgtgatcatgaatataaattatgttttactggagttactgttgttaggcaatgtgatatggaacagttcccttttaggaaattcagatatgttgctttttccagtgtcattgctggtcattttaaaattggactcttggttgatgttattggcgtggttgatgaagtggtattccgatatgtgtcatccaaaaatacgagggttgttttgaatttaaaggatttaagtggacaggtgctatcctatacactctgggaaaattactgcctacagtttttgtcttatttgaatgatattgaagatgaaagactgatcgttattctcttgactcatgctaggattaaggaagcacagggatcatatccggcatcggtcagtaattctttcaaggcgtccaaactcatgatcaatgacctcgtgctggaaattcaagaatttagagaaagtcttttagatttagggatcgaggttagatcaatttttgcgcctattggacaagggagttcacaggtttcaggctcatctcaattatcatcaaaagatgtgtttctgtcaaagactgaagtaaaaaatatctctgagattaatgccagttcagaggagtttgtttgtgttactgtcgccaagattacaaccatagtgatgaacaactattcatggtgctatccggcttgtggtcaatgttataaaaaagttgacatgcaaagtgtgtcgttcacatgtccgtgtggcaaagagaacaatcaacatgtactgaggtatcgggttgaggtgatggttagtcacaagggtgaacaaaccaaatttttgatctgggattgtgaatgtgcacagttaattggtcagtcagcggatgaagtcaacatgctcaaaatagaagatggggatgttgatttaaatgcctctcctcaagcactagataggctattgggttgtttccttgcattcaaagtgaaggtgcaaccaaggttcaggaattctgttgttcttaaatattcagatgaaccagagttgatcaatgttatgctagatatgattcccgata

SEQ ID NO: 2517 - DNA, 177 bp, Glycine max
  Peptide Sequence Number=SeqID_94202
atggccgaaaagggaaaggcggatcatctaaagggaaggctcagggccattgaaggaggatgcaactacagaacgtttgcaaaagagggggacggatctttcaaagaacacgcccaaaaggtggagggatctggcggcccaggtggtacccccaatgatggaaagggagaacgatga

SEQ ID NO: 2518 - DNA, 210 bp, Glycine max
  Peptide Sequence Number=SeqID_94203
atggtgaaagttggaacctcttacgtgccgatcaacgtctcatttcgccaaaagttggcccagagcttcccgtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 2519 - DNA, 295 bp, Glycine max
  Peptide Sequence Number=SeqID_94204
gtcatctattgtttgcagggattgcgcccgcaagacacccagtggacccggagaagtccaatagggtcttagggtttccagctctgattataggcctcggtcagttctacggagtgcctgccgcccccagcaaggcaggcgcagggcgatacaccacaacagcctggggattgcagatagcaggcaacagatgcactgctgccacctccagagcacctcagctcatccacaaaaaggttagagcgttgcctacgacacatggccaaccaataggcgaccaagtccaaagccaaag

SEQ ID NO: 2520 - DNA, 420 bp, Glycine max
  Peptide Sequence Number=SeqID_94205
gaagaccctgaggaggactggaggagctactcctgagcctgctgtggatgcccttgaccttctagagggtgatgaggatccacttcttgaggtggattctcccgaggaagtcatgtcggcatctgaggcagactctacggaggatagcggcccgagggagatggcgatcagcggaggctcttcatcctatatgggagtgaagttattgacattcttatcgggagtgggcgccacattgggtggtgcaaagttgggagccaagtcatatggtaggaaggaatgcttgctagatgggggagtcaagtccacctcagcaatggcactggtagcggcaattgcagctgcattgacctccattatctttttcatgctcatcatggcctccatcattgtggccatttgctctttaatggcctccaa

SEQ ID NO: 2521 - DNA, 168 bp, Glycine max
  Peptide Sequence Number=SeqID_94206
atgggtgccaagcacctcacgaggaccaaagaatggtcgcacgtcatcgagcaaaggttcccggacgaaattaggggttggattaagtggttgactgttagggacgaattctccataatccaggataagagaatggcttctgaatcagaggaaacaacccgtttttaa

SEQ ID NO: 2522 - DNA, 579 bp, Glycine max
  Peptide Sequence Number=SeqID_94207
gcggagataccttatggtcatccgcgcctttcgtcaatcgaggggaacgactttgacggtatcaggatgatgttggccgttcgggacgatcgagtgcgatggcgaagggaagtgtcgtggtttttcaaccttgtcattttcaagatgctgaagtacttaacacccatcgttaggcaatccgtggagttccgcgacatgtcggatgtcgaagggaagcattgttgcgcaatccgtaaagttccgcaatattccagatgtcaaagaaggggttattgcatagtccgtaaagtttcgggtgtgcaaatagcaatcaagcccactcgggccttccaggatgttccaacagaaggtggtgccttctggcctaggatcttcttcatcaacggattcctttgcttcttggaatatgaatggcagcggaatggagaaagggggagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 2523 - DNA, 1032 bp, Glycine max
  Peptide Sequence Number=SeqID_94208
atgtttgcttgcagtcctttcgctaagcgtctgcttctcgctaagcgcataatcattcatgcgctaagccacgagtttcaagtgcttagcgcacaaccctatcatctaaggctgattaattccgctaagctagccaagtacttgtggctaagcgaggctgattcgctatgcccagaattggagaggcgaaacctgcacaagcgtctcgccaaccttcaggaaggaagcatagatgtggcagtggttaaggaattttatgccaatttctatagtccaacagatcaagctcctaaatgtgctaaaataagaggccatttaatcaagatagatgcagagagcttaaatgagttcctccagactccagtgttattagaggagggggaatctttacccacttattctagattttgcagactaaggtctgatcccagagagatggaggctagactatgcattacgggcatggagtgttttctcagaaaagatcttaccaccctggctcagacatggagtgttttctcatactcaaacctagctcctacttcccgcacttcatatttgaacacagacagagctaggttggtctatggtttaatcacaaggatggacatgaacatcggcggcttgatctctggacaaatgaccatgatcgctcagtctaactcttctcgattaggcttcccagctttaatcacagccttgtgtagatcgaggggagtgggatctgatgcccttacctcctatgaaaatgtaagaccgaccattgacttagcttacatcataaggaacttttggaatgcaaatgaccaaatagttaattttccagagacaaagaagactaagctcagagcagctgatattccctcttcctttacaccaatagttggcatctctgcatcttctactttagccccacctccatctttagcagagttatctgcccaaagctctcagacttcagatgccaaatttcaaagcttgtttgaaggacaggttctcattatacaaagcttgcaggaactagttcagtag

SEQ ID NO: 2524 - DNA, 249 bp, Glycine max
  Peptide Sequence Number=SeqID_94209
atggttgcctatgtttcgaaagcccaatctgaagtggaggagttaaaattatcattggaagccgataaacttgaagacatgaagccgaaacttgataatctatatatggtgttgggggacgaggtggtcatggaaaccgaggaggacgagctggaagaggaggtcgccctcaatgttcttactgtaagaaagtgggccacacataagacacttgttattctattcacggattccccagaaaatcggtga

SEQ ID NO: 2525 - DNA, 336 bp, Glycine max
  Peptide Sequence Number=SeqID_94210
atggatgaagaccagtggatgtatgatagtatgatgtctgaagaagttggtatgaatgttgaaaatgaggaagatgtcggtgttaaagttgattgctctgatgcctttaatacttctcagttgtttgatagtcgcgatgaagttttacaatgggctcgatcgtttgctcatgacattggatttgttgccgttataatgagtagaaaatgtggatgcccgtttaagttgcatgcgaagccagtttcgggaggagacagatggatagtgaagttaatttgtggggttcacaatcacgaaatggcaaagtcattcattgggcatccatatgcgggttga

SEQ ID NO: 2526 - DNA, 933 bp, Glycine max
  Peptide Sequence Number=SeqID_94211
atggtattcttggatgcactgcgtgacttgacacagagtagaggttacgcttggggcgctgctgcacttgtgcacatgtatgataatttaaatgacacatccaagagcactgtgagacagcttgtaggatatatcactctattacagtgttggatctatgagcaattttcgtctgttagtttcactgttcctgccgaggattacgatgagaagagacagcgtgcatgtcgatggacctctggcaaggcactgcccatttccacgtatcggaggcgtatggatagactgacccctgatgcggtgtgctggagtccgtacggtgaccaccgctcatttagagaatttgaggtcatctcattatttttcggccatttcaaatggggccccttggctgtcattcaccgaccagagagggttgtacaacagtttggctacatccagactattccgccacatcctattgcatcttcactctctattgaagaaattaatgatagacggatgcagtttggtgagtacattgcacctgtagggcaattatgtgcaattcctgaccactattctccagattacatggattggttttacatgatctcgcacccattcatgagtctagcacagccaagggatcctcctagagttccgttggttcagcaatatgaagaatttgttgaaccatatatgtatcagcaatcgatggcagcagcggcatctaatgaggcagacgttgatgtgcatcatcttcgacatgcaatggatgactttgtagcaattgctgataagttgggcaagctactgaacctaaggatcttgatcgaaggaacagaagcctatactgttgttgaagaatgtgtgggcatcgcaagacactatattggtcaatcaactgtaggtcacagatcgaggcgtcgacgacgtacgaatgatcattga

SEQ ID NO: 2527 - DNA, 657 bp, Glycine max
  Peptide Sequence Number=SeqID_94212
atggcgtatctgcttcatcttccaattataggtgccttccatggctttgagcctctacatgtcgacgaagtcatcttgatgtttgtggagttacttgaagtctctggagaggaagctagagctgagacaacacaatacgcttttcgagacttgagtcatagtggaagctatgcatggggagttgtcgtcctagtgcatatgtatgatcatttgattgatgcttgtaagagcgacgaccgacagcttgctggttacatcactttattacagatctcaccacatgtctgccggtggattgctacgaaggcttctttgaagtcattacctacatcaacgtacaggaaacgtctagatggattgacgattcctgatgtttgttggatgccttacaatgagcaccatggagtgcgggactttgatttgatttcatgcttttcaggtcatctacgatggggtcctgttgtgagcattcctccacagactacggcttccatgttatcatttaaagatattgatgataggtggatgcattactttgactattttgcagcagcagggcaaatttgtgttgtgcccgaacagtgtgcttccgattacatagagtggtgtagaagcaagcttcatgatgatgaatcaagattgattcaaggaggataa

SEQ ID NO: 2528 - DNA, 687 bp, Glycine max
  Peptide Sequence Number=SeqID_94213
atggacccttgggtactaaaacctatcatctttagaggactacacgtcctcgccttgaggactacacgtcctccccttcagagggctacacgccctcaccttcaaaggactacacgtccccgccttgagaactacacgtcctcaccttcagaggactacacgtcctcaccatcaaagggctacacgccgtcactttcggagggctacacgccctcaccatcagagggctgcatgccctcaccttcagaggactacacatcctcaccatcagagggctgcacgcctacactttcagaggactacacgtcctcaccatcagagggctgcacgccctcaccttcagaggactacactagggttgcacggcttcgcctacagaggactacacgtcctcaccttcagagggttgcacgccctcatcttcagaggactacacgtcctctccttcagagggctacacgccctcaccttcagaggattacacgtcctttccttcagaggacttcacgtcctcaccttcagagggctacacgcctttgccttcatagggctacatgccttcaccttcagaggactacacgtcctcgccttcagagggctacacaccctcaccttcagaggactacacgttctcgccttgagaactacatgtccttcacttcagaggactacacgtcctcaccatga

SEQ ID NO: 2529 - DNA, 611 bp, Glycine max
  Peptide Sequence Number=SeqID_94214
atgggtggtggtgcatggccgttcttagttggtggagcgatttgtctggttaattccgttaacgaacgagacctcagcctgctaaatagctatgtggagatcattgcaattgttggtcttcaacgaggaattcctagtaagcgcgagtcatcagctcgcgttgactacgtccctgccctttgtacacaccgcccgtcgctcctaccgattgaatggtccggtgaaagtgttcggattgcggcgactcgtaacaaggtttccgtaggtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaacccccggcgcttcgtgcgccaaggaactcaaatctgttaagtgcgactcccgggggcccggagacgaacgtagcgaaatgcgatacttggtgtgaattgcagaatcccgtgaaccatcgagtctttgaacgcaagttgcgcccgaagccattaggccgagggcacgcctgcctgggtgtcacacatcgtttccccaacgcaaacat

SEQ ID NO: 2530 - DNA, 273 bp, Glycine max
  Peptide Sequence Number=SeqID_94215
gtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgcccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaa

SEQ ID NO: 2531 - DNA, 771 bp, Glycine max
  Peptide Sequence Number=SeqID_94216
gggccacacgacctcgccttcagaggactactcgtcctcaccttcagaggactacacgccctcgccttcagagggctacacatcctctgcatcagaagactacacgtcctcacctttagaggattacacatcctcgccttcagaggactacacgtcctcgcctttggtcagggattgcacgccctcgcctttaaaggactacacgtccttgcgttcagaggactacacgtcctcaccttcagagggctgcacgccctcaccttcagaggactacacgtcctcgccttgagagggttgcacgccctcgccttcagagggctacatgtcctcctcctcagaggactacacgtcctcgccttcagaggactacacgcccttaccttccgaggactactcgtcctcacctttagaggactacatgccctcgccttcagagggctgcacgtcctctgcttcagaagactacacgtcctcaccttcagaggactacacgtcctctccttcagaggactacacgtcctcgcctttggtgggttgcacgccctcgcctttagaggactacacgtccttgcagttcagaggactacacgtcctcaccttcagagggctgcacgccctcaccttcagaggactacacgtcctcgccttgagagggttgcacgccctcgccttcagagggctacatgtcctcctcctcagaggactacacgtcctcaccttcagaggactacacgcccttaccttccgaagcctactcgtcctcacctttag

SEQ ID NO: 2532 - DNA, 570 bp, Glycine max
  Peptide Sequence Number=SeqID_94217
atgaaaacaatacgaatctggggatcccaggtcatgtggctccgcatgccaccggactcttgggtcacggtaacaaaatggtggggtggtcgacaaaagcagggcttttgctcctacgtatcctcaatttgtgatgaggaaactcagacctacgtagttcttgataactgtgagactaaaaatagtctcggtgttttcttcactaaaatgcgaacatgctttagtaaagagacaaaacttccaactgatcagagcaacatatgctttttggatgaaaaacaatgtgtctatcggggaaggagaattttggatgttagcatttcgtttctaaatgaccatttagaggaagcactgggttcaacaaaaaataggagaaaatcactcaaagtgtatcaatctcacacatggcaaggattgacattctcaccctgggtcaaggtttatgataagttgggattttggctcaaggcttgtagaacggctggtcatgatatatgtcagggtttggccagcggttcggggataaaggggatgtcctacattatttccatgatacacatgcaacaatga

SEQ ID NO: 2533 - DNA, 321 bp, Glycine max
  Peptide Sequence Number=SeqID_94218
atggaaattgtgaacaaggaaaaagaaaaggttcgatatgatttcctggctgacaaagccattgcagaaattgaggcaaagtgtggccaaaaaattgaagaatgcaaagaagaacaaaggcagcagttgatgcgcattgaagatgaacacacgttgctcatcaaagcattgaggtgtgaacttgaagatgagtgtcagaagctggaagaggagttgcatcttcaaaaatccaaagaagacaggcaaagggctttgttgcagttgcagttgaaagtgatgagtgacaagcccaaagaggaccaagaagtgaattcaaaacag

SEQ ID NO: 2534 - DNA, 531 bp, Glycine max
  Peptide Sequence Number=SeqID_94219
atggagattcttccactatacaaaagaatagtagggttacaaggatgtgtttacaaaattgactcactctatggtggctcactcaaacttgaggatagagtcttcccaagctatttatcttctctctcaaagaggctctctaactttctcgctttctcactccaaggagtggattcactcttgtcttgggatcgactcactctacgaggggcttactcaatcttgaggatagagactttccaagctatttatcttctctctcagagaggctctctacttggatcagttaggaatgaaggctcctacccttatttatactactccacctccacaatgaatggtggagattacttgtatcatagggtggagattaattatctagaatgctccacacattctaggagtctctacactcttctactcccttccatatccttccataagattccagaaggttccacacatctccagaatattctaaaggtttccacattctttcacaagcttctagagaattctacactactctag

SEQ ID NO: 2535 - DNA, 55 bp, Glycine max
  Peptide Sequence Number=SeqID_94220
atgccaccctttaactctactgctctgcaagtctaccaaacctccatatttggag

SEQ ID NO: 2536 - DNA, 357 bp, Glycine max
  Peptide Sequence Number=SeqID_94221
atggcacctccagactctattccttcagtagagcagtttaatgagatggatgagtcatttgaggccaccatcccagagccatttgatataggagaagaggcagaggagacacaggtgagacaggtagctgctgccactcccgcgcaatcccttgaggctacttcagagccttctgcaccagtgagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 2537 - DNA, 522 bp, Glycine max
  Peptide Sequence Number=SeqID_94222
atgcctcaaaatgttctttacgatgccatgggatatatcaacggtggtatatccagtgatttttctccatttagcttccttagctctgaaaatctcgataactcaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 2538 - DNA, 276 bp, Glycine max
  Peptide Sequence Number=SeqID_94223
atggagaggagtatgattgatgctgccagtggtggagcccttggtgatatgacccctactgaggctaggaatttgattgagaagatggcttccaactcccaacaattcagtgcaagaaatgatgctattattcttagaggagtccatgagcaatctagaatcaatgagcaacctgaagcttatgctggaaacatttataatagaccccctcatcagcaaaaccaacaactgcagaataattatgatctttcaagcaacaaatacaatccaggttga

SEQ ID NO: 2539 - DNA, 498 bp, Glycine max
  Peptide Sequence Number=SeqID_94224
atgggtgatcaagaggagacacaggaacagatgaaagccgacatgtcggctctgagagaacaaatggcttccatgatggaggccatgttaggaatgaggcaactcatggagaaaaacatggccaccgctgccgccgttagttcggctgccaaagcagacccaactctcctagctaccgcgcaccatcctcccccaaatacggtaggacgaggaagcagcacattggggcacaacagcaacccccatttgggatacaaccgggtggcttacccttatggattgccacctaattacacgccgccagtcatgcaagatgatgtgggtcatgtctcttcccccatccttgaaggggagcctcctcgacagctcgacgaggtccacgaagatcatcaagagtatgcccaaggggatgtcaagttctaccccccaaatccccgtcgaggggccggcacccaacactttgcctcagcccaacctcatagcacaaccaatattctt

SEQ ID NO: 2540 - DNA, 231 bp, Glycine max
  Peptide Sequence Number=SeqID_94225
atgagaggattggatcaggggcctcacaaacagcatttctccacctggtgggctgacctaaaggcactcaatcaagatcacaatatgactgttgtctctaaacaattctgctggaagatgggtaggggtgatcaaattttgttttgggaagatgcctgggctgaggatggaattccactcaaagatcaatttccagatttgtactcaaagatgcctcagcaatgtctttag

SEQ ID NO: 2541 - DNA, 378 bp, Glycine max
  Peptide Sequence Number=SeqID_94226
atgacaaatgatggaacatacgaatttggggatcccacggtcatgtggctccggatgcccccggactcttgggtcacggtaacaaaaagtggggtggtcgacaaaagcagggcttttgatcctaccacttcgtttctaaacggccatttagaggaaacactggatccaacaaagataggaaaaaaatcaatcaaagtgtatcaatctcacacagggcaaggattgacattctcaccctgggtcaaggttcatgataagttgggattttggctcaaggcttgtagaacggttggtcacgatatatgtcagggtttggccagcggttcggggataaaggggacgtcccacattatttccatgatatacatgcaacaatga

SEQ ID NO: 2542 - DNA, 369 bp, Glycine max
  Peptide Sequence Number=SeqID_94227
atggtttctagaggtatcatccccttcgaaaaacatattgcagtagtagggactaccagcaacaatatgttatcaaagagaaaaactctagatgagggttcactgttatcaagcgagtcggagacccagcatgaccatagattcacctccactccttatgttcccatggacccagtccccagtggagtcgccaactgttgcaacctacccttcggcgggagggcgacgcggggatcatgggtgtgtcttccaagggaggaaggcgtgcggagtcgccaccaacgtttattcgagggaaacgtcggaaaaaccggaatgtgtggtctacaaactttaattgtgaaaggttcgggagttgttacggggaag

SEQ ID NO: 2543 - DNA, 267 bp, Glycine max
  Peptide Sequence Number=SeqID_94228
atgaaacctttgatccaattcaagtgtgtgtgcaaggaatggaactccttgatttcagaaccctatttcatcaaattgcaccttagcaaatctgctgcaaaggacgatttggaacaccttcaattgataaaaaatgtctgcctcggatccatccctgaaatccacatggaatcgcgtgatgttgtagcaattgcgttgactatgctctcacttgacgtatctgaaaagactgagatggaagtttatggcgagggtgacagtagttga

SEQ ID NO: 2544 - DNA, 246 bp, Glycine max
  Peptide Sequence Number=SeqID_94229
atgcatgcgcatcgttgttgtcctgtaagtcggaggacaagagaagagttggtcaatccaaccccaagtccaagcccaaaggtaagcaaaggcttaggggcaggcacaagaaggtacggggcccatgatcgacaggtcgccgtcctacgttcggctcaagccgttaaagaagcgctcctaggaggcagcctagttccttccaaatttatacttgttagttattcactcatgtatcttaggtcatag

SEQ ID NO: 2545 - DNA, 309 bp, Glycine max
  Peptide Sequence Number=SeqID_94230
atgaccaagcaacaaagatcaacaaagcgtgatccatcttattgggagtatgttgatgcattacattttgtgcagaatagtaattcttcattcaaacgtaacgcatcatcatctgagcaaccaattcaaagaaggaccatgccgatgttggatcaatttcatccatgcattcatgattccattgtaaacattgttgatgtgaaagctgatagtaattgtggatatcgtgcaattgctgccatattaggtatgggtgaagatttatggtcattggtgcacaaccatttgcttaaagaacttacaaaatag

SEQ ID NO: 2546 - DNA, 315 bp, Glycine max
  Peptide Sequence Number=SeqID_94231
atgaggagcacaggtcgcttgagcaaacagaccaatggcttgcacccacttccgatgaaagttgaaaatcctgatgagtcattagagacatctaacaacaactttcaaaatcctcaaatttcagccagcccatatcaattagaccatgcaccttacgcttcagagccctacaatgctcaatggaatgccccggggcttctccgtgacaagcacacattgcgttcgaatcgtattctcggagaaattgaggttgatgaaccttggctggggttatggctaccattgaattatcaagtagatatgggagcaagttag

SEQ ID NO: 2547 - DNA, 522 bp, Glycine max
  Peptide Sequence Number=SeqID_94232
atggggaaaaatccaaacggaaaaagattctatcaagtcaagattaagggcctagatgtcaccagccttaaggagttgggacagttgatgggacccctccaaaggcaagccttccgcaaagcgtacggaaagattttagatttgaccacaacggaggtgtttacggaagccgttgtatccctcgcccaatactatgaccagccattgagatgtttcacgtttggggacttccaaatggtaccgactgttgaagaatttgaggagattttgggatgccctctcgggggaagaaaaccgtatcttttctctggctgtggtcggagattcggcgagagagttggatcgtatgaagcaaactcgaaacggcgtagtgggcctaccgcggaaatacttggaaggcaaggcaagggatatggcgaatcaagaggagtgggtcccgtttgcggatatactagctttgctaatctttggggctgtcctctttccaaacgtggacagtttggtggacctagccgcaattga

SEQ ID NO: 2548 - DNA, 228 bp, Glycine max
  Peptide Sequence Number=SeqID_94233
atggcattgacggaactagcctgcatcaatactgccactttgactggcggaaataaacacatggatgatggatggatgcatggacggatgcgtggagttgatggtgggcatggggtatctcgccaatgggagtggcggaacccatgcatgaagaacccgccggtggtgctagcggatacattaaaaaaaagaccccctccgaaaaaagtttgcaaacaaaccttctga

SEQ ID NO: 2549 - DNA, 197 bp, Glycine max
  Peptide Sequence Number=SeqID_94234
atggagtttgtgccaaatcaatgccctttgatgggttcctttgggaatttcgttgagagggtcaaaagggttggtaccctcttcgtctctgccatcattgggaacatattctctgcgatcttgaccttctgctttgcgttaggtacaacccccgctctcttttgcgttgtgattgtcagtgtcttgctatggacgag

SEQ ID NO: 2550 - DNA, 222 bp, Glycine max
  Peptide Sequence Number=SeqID_94235
atgaagggccacacatttcttacacctaaggtcgtgcaaggaaagcaaatgttgggtgcgagaacttatgaagcaaagagtgcaagtggagagctcaaaaaagcaattattatgcatgagtatgcactatcaattgtggatcaccttggctttatgagatactttgagtttctgatgacgccacttccagagagggaagataagtcagggttgacgccataa

SEQ ID NO: 2551 - DNA, 585 bp, Glycine max
  Peptide Sequence Number=SeqID_94236
atgcataaaccttatgcatatattattaaggctcaatgggataagcatttaaagctcaaacttcatgcaacaacttattggtttaatcatgcattcaggtacaatgagaagtttaataataagagaagggtcatcgattcagttgttgatttacttgaaaaaagaggtttgtgtgagaacctgactcaagtcattagtgagatggagatgtatcaagatcgacaagaaagttttgatcgaccaagtgctcttcctataagcaacacaatccggcctataattacatttcttgatgatcaatggtggtcattatttggaagtagtgctccaattttgaaaaagttggtggaagaagcatctcctgagcttgatattaatgaccttgagaatgctttgtatcatgagaatgcaattacacttggtgcatcaaatgccaataatgaaggtgataaaaatcttgacaatatggactttcaagttgaaagtggtgatcatggtggtggttcgatcggtgtagaatctaatgttattccaaccttatcagagtgtgatggaatcaatctaggtgattattatgatttatga

SEQ ID NO: 2552 - DNA, 315 bp, Glycine max
  Peptide Sequence Number=SeqID_94237
atgaagtctatgtggaggcaagaatttgtcattgttaatgatcttgtgcttgtcattggatttgtacatgttagacttgttaagcagggatgtgggtctagtttgtctgagtttctagaaaattgtgaggtggaaagtgtgaaggagagtaaaaatggagtgatatggcagatagtacggaagataccacgaacaccacacaaggagcctccgatggtcaacataggactatccagttttgcatgcatgttgccaaaaatattgagtagcttgtggcgggatcaccgtaatcaccacctccaaccgatactctaa

SEQ ID NO: 2553 - DNA, 999 bp, Glycine max
  Peptide Sequence Number=SeqID_94238
atggcattagcagataccactaattctcagccaatcagtcaacatgtgtcaaccagagagtggaaaactatcaataacatatttagcattcatagtaatttgtacgatgactttgtggctgcatcttcagcctctactggacacatggataatgaaatccttgatcattcctttggagctcaacacgcaaataattcacttcatcatactaatgaatcatgtttacataagaatgcagaagatgcatatgatgttgtaccagattatgagaatgaactatcagattgtgttgataatactgttgatgacattagcataggatatgttaatctaggcgacccttctcaaatatgtccatattgccaagttgctatgtggtatcaagaaaggacgaggaaaaatagaaagcaaactaatcccaaatatagtctttgttgcaacatgggaaatttacaacttccttttctcaagaatcctccaatgcttttgcaacaactactatgtgatgatgaatcacacaaaaatagaaattaccaacaatatatcagggcttataatatgatgtttacatttcactctcctggggctaagatatatacaagtctgctcaaaggaaaaggtccaacaatttacaaaattcatggacaatcatgccatttgattggaagcctgttaccaatggctgggaaaccaccacaattttcccaactgtatatatatgatacaaaaaatgaaattgaaaacagaattggtgcaagtaggcaaaatctacttgatttagagcttgtgtcgaagttaaaagatatgcttgatgaatacaatgtctttgtgtcgcaacctacccttcgacgggagtatgaggcaaaaagccaaaggagcatcttccaaaaagaaaaacgcgtggtagtttccaccaacgtttattcaaggaaaacgttcgaaaaacaaaaaagacaaaggtatgcgaattttgaaaatgagggttcgggagttatttag

SEQ ID NO: 2554 - DNA, 549 bp, Glycine max
  Peptide Sequence Number=SeqID_94239
atgtgtgtgacccgtgccacagaactgaacgaccaaggagaagagtggatgtgtgactcgcgccgtggagcaatcacgggaggtggtaaagacggtgtcggagatgatggtggaggcgatggcttcggaggtggtggtggatgtggcggcgtgcacgacggcagtgtccccgagctggaagatgtcattgtcgtaggggaccttgtggtaaccgcggtggcggttgatgtcggcacagtggtgctgccacacgcggacgaggaagtcgatggcggaggagctggcggtggcggtggtggttgcgctgaaggaagaaatggtggaggcgacgacggatgtgctgaaggaggaaatgatggaagcggcggcggtagtggctgcaccgaagaagagatcgagtttgaagagcatggaggcgtggaacgcgtcaagacggaggtgagttccatgaagagcggaatccatggaagcttgggctgcggcgaggttgaccatggcggtctcgaggcggtccaggctggcatcgagaggttcgacatctgccattga

SEQ ID NO: 2555 - DNA, 687 bp, Glycine max
  Peptide Sequence Number=SeqID_94240
atggtgtatgattttacactatttgatgatgttcttactggcagtgccaatcctgactacttaatagatgttataagggagttagttgatgtattgcaatggagcctggatggaaaacccaaaaaggtggtcttcactatgaaggataagtgtgtactcattaaagaacgtgcaagtgatattaaacaacagatgattgatgaggaaggtgaatttgattcgaaggacattccggaggctattgataggatacttggcaaaaagttagcttttagatttaaggctataccaaacaatacccggtattctatgtcacaaatttcagaggatgaagatctaattatgttattattgaagagacttcctacatatgagcttgctagaattgagcttgaaatgtcagattcgtctgtgaaacatggagatgatatagcctacattcaatccttattagctattggagattttgatcatgaatcatctaagtcagtaactcctgcaaagagaggatttatgatctctgaatctcaattggaatcagtaccatttgaagacctgtcattgattcagttatcctcgccgttgacctccaagggtcgaaccactgtccttccactcaactacgcagttgcactcgtcggctcaagctaccaccgtagcacgcctcagccgccgccagttaacaag

SEQ ID NO: 2556 - DNA, 531 bp, Glycine max
  Peptide Sequence Number=SeqID_94241
atgtgttcaataaacattttaattggaagcagatatgttggaggatcctttgacgttgagtccctcgtggagaatttacttggtcaacttgctggtcaccaagcaattttggtgaatgtatatgatatcataaaatctactgaccacttaatcatgtatggaaaccaaaacgaagaaggtgatatgtctcttatccatgaaagaatgcttggtcttcttctaaagatagaattgagttcaactcaacgtgattatgcccagactgctcaagcatgtgggaaggctctaatagcattaataaatgaggtacttgatcgggctaaaattgaagctggcaagttagagctagaagctgttccatttgacattcattccatacttgatgatgtcctttctcttttttctgtgaagtctcggaacgtaggtttagagcctctttgcatatgcaagggtaaggctgcgtacaacatccctcccccataccttcgcatagcaaagagcctccgggcaatggggtacgaagttttttaa

SEQ ID NO: 2557 - DNA, 129 bp, Glycine max
  Peptide Sequence Number=SeqID_94242
atggcgagtttggtctcagtgaaggactcaccactacgagtggcgatatgtccatgcaaggcacaaatcaccagcctacgtcgcaggcagttgtgcttttcagtggctaggttgcaggagcttttttag

SEQ ID NO: 2558 - DNA, 498 bp, Glycine max
  Peptide Sequence Number=SeqID_94243
atggcaaagctggcggaacaagccaagcgctacgaggagatggtggagttcatggagaaggtctcctctttcgtcgagaacgagaagcagaccgtggaggagcgagtgcaacctcctctccgtcgcctacaagaacaaggaggagagccacgacaacaaggaccacatggccggaatcctcaaactcctcgacacgcgcctcgtccccttcaccgcctccaaggtcttctacgtcaagatgaaaggagactaccaaaggtgcaactctggctttgtaccatgggtctcctcaaggtcgtgattttggaaattttgttcaggtgtcaccattttgggaacaattccaagcttagtaaaagcttggaagagtacgcaatgtatggagggcttggattggacaaagataaaaaaatggttgtcatttttgacgaaaatggagttccttacgttcttaggagacatggagatataggtcctcttcttagactgatactgtga

SEQ ID NO: 2559 - DNA, 237 bp, Glycine max
  Peptide Sequence Number=SeqID_94244
atgaccccaaagatgcttgcgaatcattcaaggaatttccctgttgcgacttatgcaaaccacaatggttggaggtgggacatcttaaggcttctcttaccccctactctatgtgatcgtattgcgcctattcctcctcctaaggacactgttgatgatgttcctctttggaaaggcttgaatgatggtagcttctctttaaagggaagcctacatttatctcacaaactcgtctga

SEQ ID NO: 2560 - DNA, 783 bp, Glycine max
  Peptide Sequence Number=SeqID_94245
atgggtgtaccccaaaaatggttcagaaatatagttcggggcagattcctcagatcatccaacaaagacatcgttctcgttctccctcgcacaagtatttgcaccaatgaatgcgaagaagccatgcttaggaatgaagagttcagtttcccaacaccaatttcttcaatcaccaaggaagatgcttcggccattaagatccaagcttacttcaggggacatcttgccagacgagcatataaggctttgaagagcctagtgaagctgcaagcattagttcgtgggcacataaaggattctatgcagctagagggtgagttggattctatacgcataggagaacaaaaactttatgttaacctccccagattcacttgtaacaactttaatgaggtagaaaagaaggggaaagagatagaactagggacaaagaagaagaaggggaaagagatagacctagggacaaagaagaagaaggggaaaggaaagcatgacaacttcatgactattgagaaggttttgcaatccaaggagaagaaggggagagacttagaggtagacaggtggaaatggttggatctaaagttagagagatctgatgaagatggacttgtgagggagagtttcattttgaaaggatcggaagtgataaaggcaccttcacagcaaatgatgaagaggcaaggttgttcagaagggaagaaagtgatggaaattgatggagaatcctccattcttggcatagattcaagaggagaggagtcctactactatgatgaatag

SEQ ID NO: 2561 - DNA, 1006 bp, Glycine max
  Peptide Sequence Number=SeqID_94246
atggatggcaaagtagattggtctgaacttcccatagagctatggcccaagattggaaaatatctccagaaccacgtggatggcaaagtagattgtgtttgtgggtcatgtcgatcttccatccctccctctcttccaaattctccttctttccctatgcaaattccccacccatcgaaccattccatagaaaccttgctcaaccaagccacagtctatgttattgagccaactgatgcaaatggagcctctaatttagagcctttggcaatttcaaccaaatggaggctgattaaggttgaggaatcaaagaatcacaatcacaatcacaatcaccccttgactttactgagtccaatatctgatcgcaaaatcttgtaccctcatggctctaattcccctatgttgtggaacttgttggactttcgagtcactgagttgtgcaaatcatatacccccaatatctcatctgccactgtgagcaaagttgtgttctttcccaattccccttggattggtgccgaagattctgtggcttgttgcatctttttggagggcaagttggggttcatgaaacatggggatgagaaatggaaccttgtggataacgagaacttcttctacgatgatgttattgtgttcaagggtcagttttatgtgactgataagtggggtaccatttcatggattgatacctcttctttgaaattgctgttttatcctggggactttgtggttgatagtctgcttgcacaatttttgggcagtgccacaaaatgtcttaaagaaagcgacattgtccgtgactcagccaatattactggctcaaacagcaatgacctcaacaaaccttttaggtttaaagggtatcatttcaagcgttggcaacaaaagatgatgttttctttaactatgaggaaagctgcctatgttttgaacactgatattcgagtggtacctgaagatgttgagaaggaagtgaaggataaaatgattgtggaattag

SEQ ID NO: 2562 - DNA, 357 bp, Glycine max
  Peptide Sequence Number=SeqID_94247
atggcctacttatggaaaagggagttatatgttgtgtttgatcgcaccttttcttttatggtgttcttgcctttcttcatattcttcttcactcatcatgtggatcctatcattgaacaagtagagtttgatgttgaaattgaacccgtttccatggttgttcaaatcattggctggaaacttcctcatcctcttatgcctctaggcagtctgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaa

SEQ ID NO: 2563 - DNA, 270 bp, Glycine max
  Peptide Sequence Number=SeqID_94248
atggagacacaggtgtggaaagtagtgtatttgcctcttgaatatgctgaaagtggcaaaatcactaaaaaggctgatgtttattcctttggggtggcacgaccactattggaagaatatgccattgaggaactgattgatctaaggcttggtaaccactattcagaacatgaggcacgtccattccttccaagtgcaatcacaaaagatgtctttgatttgaaattgcatgatttggctcgacatggaagtctgagaccaaacatttaa

SEQ ID NO: 2564 - DNA, 120 bp, Glycine max
  Peptide Sequence Number=SeqID_94249
atgagtaacaagaagtgcagtgtcacggtggcaaccgagggtgcggtaaagttgtgtcttggtgacttgttggtcatgggttcgaatccggaaacagtctctttgcatatgcaagggtaa

SEQ ID NO: 2565 - DNA, 180 bp, Glycine max
  Peptide Sequence Number=SeqID_94250
atgtaccatgagaggaaaaaacacatagatgtgaaactacacttcatcagagatgtgattgaatctgagaagataaaggtggagaagtgtgtggtggttttgagagtggctgaaaacagagaggcaaaaatcaaagttgctgcagaaaatagagagttcaatagagagagaaagagctag

SEQ ID NO: 2566 - DNA, 363 bp, Glycine max
  Peptide Sequence Number=SeqID_94251
atggccatcaaaaaatccaataagctaccccaagcagatgtgatcaagcaaattgtgagaaggtgttcaagttttgggaagaagcagcagggctacaatgaagagggtggtcttccagaagatgtgccaaaagggcactttgcagtgtatgggtattcgtctaaggctgaggaggtgttcaaacaaggctgccgaggtgttcaagcatggccgacgattctacgtgttcccctacgtccacacccaattgatgctccacgagctgagacgatgtttttggagaagaagatcatcggcgtgaggaaagagtcgcgagttcgagaacaagatttcagaaactttcatgtggaagaaacaggatga

SEQ ID NO: 2567 - DNA, 615 bp, Glycine max
  Peptide Sequence Number=SeqID_94252
atgaccggaaggcttcttgccggttcattggcttttgagactcgcatccttcattatctcattgttcgcatcttgcttccaagatcttcaaaccttgcacaggtttctgaagaagatcttattgttatgtgggcttttcataaaggcctacaaattgattgggcatacttagttcgatatcgcatgcataaggcattgcaattaaatgctccattgccatatccacacctagtcacccttttccttcaacactttaacatccctcttgattctgaaccttatgttccaatcaagagatcctttctaataggctttgctgtcattggatcctttggttatcaaaaagagcatgatggctcttgggtgaaaaatggtgctcgacccgttgatgaagaaggacatttacatggtggagaagattcctctcttcttcaaaagattttggataggttcgatggtcttcaaacctttgttggtgaaaggtttgatactttggagttacaagtggacatgcgcttcaatgagatgaagtcaagaatcaccaaggtcgaagaagatgtttctcacattcgtacaagctttgatctaccaccaccactgccaccatcatcttag

SEQ ID NO: 2568 - DNA, 1074 bp, Glycine max
  Peptide Sequence Number=SeqID_94253
atgagagaacattctaacgtaactgcattctatttgcacatgggaacaccacaagggtcccctccgcagtctgatgttcagccagaagctatgtctaggaagactagacaatccacacggctaagaagtttgactttaagaaccttggatcagcctagaccaacgattaacgttgatgctgcaactgggcaaggattgggccccataaagagaaatgtattggaatcgctaaaggacctagtatgggatgacattttggccaaatttgatatcccaaaagcaccaaatgcaaagaaaaaggtcatgtcaattgtgaccactagatggaggcaatttaaatcttccttcaccaccaagtttgtctgtgctaactctgaggggcaacataaacatgatcctttggtaaaatatggtctagatccacaaacttgggaggaatttgctgcaacccataaaacccttaactggcagggaattaggaaaaagatgcatgaaattcaaaaatacaatgactgtccccatttactatctcgtgggggatatgatttgtttgaaaagaaactattatacaagaaaattaagaaaagagaacatgaggcaatgatgactgagaatgcaccacagattgaagaccccctatctcccattgaaagacatgttaagtggaagttgacacacacaaagcgggcatcacgtgcctccaacagttcatccacatccatcacccaacaacaactggttgaaataataggaagccttaaggaagagtggaggaatgagattaaggaagaagtcagaaatgagattagagaagaaaacaaacaaagcacaaaggggagcaatgttgaaactgtcgtgaacccatccggggaagaacatgttgctcatgtgatactgactatggggttgtatatgcaacgtcaacattctacacacttggtggccttgggaaaaatatatgagggagggtttaccatacacaacttggtgtatgcagatgatatcgtaagggttagtgttgaaaaaattattgatggtgacgctgaagtcctgttgtcgatgttagaaatttag

SEQ ID NO: 2569 - DNA, 1860 bp, Glycine max
  Peptide Sequence Number=SeqID_94254
atggcggcaccaccacctcctcctccttcgacgccgtcgtttttgtcgccgacgcagaggtacgcggcgggcgcattgttcggcctggcacttcacgaggcccacctcaaccaaaccaacccgttaccgttacccgcttcggaggactcgctctctgaggaacaacgaaccagcagtagcagtggctccagcagcgactccgtttcggaagacccggatctttgggtccacagcaattcgggtttgctccgccccgtttttaagtttctagatattgattccgctgcgtggtctggactggaggaaaccgctggttcttcttccgctacgcatcatgtgggacccttcttgagattactttcgcaagaattggatgatggttcttctcaaaggttagatcaagaacgtgctttgtcaagtgcggttgatggtatagcacttgacatgcggagaaactcagagtcttccgagtctaaaagagagaagcttcgcgaatatgagcatcaatgtcgtgagaagttttcaattgatgatgttcagcctcactgtgaaaaggtggatgcacatttggaagttcagaaggagatggatgctgctcctttacttgactgtaaagagacacagcagggatctgttgattggaaaattgatgagagaccgattgaggaagtaaggatgctgagcgatcagaggaaggtgacagttctgtatgaacttctgtctggttgtctatcaaatttaggtgaagatgtcgggcggagaaggaagggctatgatgctcggcatcgtgtggctctgcggttgctggcaacatggcttgatgtcaagtggacaaaaatggaggccattgagaccatggttgcttgttctgcgatggctttgattaaagagaaagaatcgaagaacgaagaaactcaatcaaaagaaagcaagtgggctaaattgaagcggggtggtataattggtgctgctgcattaactgggggaactttgttggctattactggtgggttagctgcaccagccattgctgcaggtcttggtgctttagctccaactttgggtactctgatccctgtaattggtgcaagtgggtttgctgcagctgctagtgctgcaggaactgttgctggttctgttgctgttgctgcatcatttggagctgctggagctggacttactggaagcaaaatggctaggagagttgggggtgttgatgagtttgaattcaaggctataggagaaaaccataaccaaggcagactaggggttgagatcttagtctctggatttgtctttgaaaaggaagattttataaggccatgggaaggacagaatgacaacttggagaggtatgcactgcagtgggagtccaagaatctgattgctgtgagcactgcaattcaagattggcttacttcaagacttgcgatggagctgatgaaacgaggggcaatgatgactgttttgagctcactcttaactgctttggcttggccagctgcattacttgcagcaactgactttatagacagtaaatggacaattgctattaacagatcaaacaaagctggtaagttgcttgctgaagtattgttaagaggataccagggaaataggcctgtgacactcataggttactcacttggggcaagagttattttcaagtgtctacagtatttggctaaaactgaaaacggtgctgaactagtagaaaaagttgtgcttcttggagcacccatcccaatcaaggatgagaactgggaagcagctagaaagatggtagcaggaagatttgttaatgcttattcaaggaatgactggatgcttggagttgccttccgtgccagcaaaagatag

SEQ ID NO: 2570 - DNA, 1059 bp, Glycine max
  Peptide Sequence Number=SeqID_94255
atgggaacaagtcctctatatgtttttattgatgtcttcagcaaggttccaatgggatcaaatgatgatatcttgggggcattatcattagtaatgtatacaatagcacttattccattagcaaaatatgtttttatagtcctcaaagcaaatgacagtggagaaggaatgtttgcactatactcgctgatttgcaggtatgcaaatgtgggtctgcttccaaatcttcaacaagctgatgaacatatctctagttttaaggtcaaactgcctactccagaaatggaaagggctttaaaaataaaggacactttggaaaggacatcgtttttgaggaacctattattggagttggttattctgggagcttccatggttattggagatggtattctaaccccaaaatatcaggttgacattgactttgaaaaggaaccaataggaatagggaaagatggaaataatgtttacgtaagagatatctggccatccactcaagaaattgtagaggcaaataataccgtgtactcatgggaccccaagtcaacatatattcatgaaccttcatacttcaatggcatgatcatggatcctcctggagctcatggtgtgaaagatgcctattgtctactgaattttggtgttagtataacaaccgatcacatttctcctgaaatttcaaaaactatgtctgagaatgatgataccttacagtctttggtgaaaatgggatacaagcaggtagaagtgatagcattgactccgcagacccttttggcaacaaacaggttctttttagagatttgccagaaagggttccaaagaggccagaatttgcagcttcacagaagaaggcacaatttgtcatggaagctaaagaaaaagagcagcaaagacatgagaaagaaagtgtatgtgtgcccagaggcaacatgcgatcaccatgacccttcaagagcacttggggacctcactggaatcaagaaacacttcttcaagaaacacgaagagaagaaatggaagtgtgacaagtgctccaaatgctatgtggttcaataa

SEQ ID NO: 2571 - DNA, 1944 bp, Glycine max
  Peptide Sequence Number=SeqID_94256
atggctttgggatcatgttcctcttccttcaactatgatgttttcctcagcttcagaggtgcagacacacgtcatggttttaccggaaatctttacaaagctcttgatgacaggggaatctacactttcattgatgatgaggagcttcagagtggagaggaaataacaccagcacttctgaaggcaattcaagattccaggattgccatcactgtggatccttctgatgtcagacaccaggaaggtagttatggagaagcattggctaagcatgaggaaaggttcaaccacaacatggagaagttggagtattggaagaaggctctgcatcaagtagctaacttgtctggctttcatttcaaacacggcaagattaatcatgctcctttgcctgttgcggattacccggttggactagagtcaagattactagaagtaacaaagcttttggatgttgaatctgatgatggtgtctacatgatagggatccatggaattggcgggataggaaaaacaacacttgctatagccgtttataatttgattgcttgtcattttgatggttcatgttttcttaaagatttgagagaaaaatcaaacaaacaggagttacaatacctccagatcatccttctttgggaaatacttggagagaaggaaatcaacctagcaagtgttgaacaaggagcttcaattatacaacataggcttcagcggaagaaggttctcttgattctagatgatgttgacaagcatgaacaattacaggctattgttggaagaccttgttggtttggtccaggcagtagagtcatcatcaccactcgggacaaacaactgctagcatctcatggggttaaaagaacatatgaagtgaaactattgaatgagagcaatgctcttcaattgcttacatggaaatcttttaaaacagaaaaggttgatccaagttataaggaggacttgaatgatgtagtaatttatgcttctggccttccattagccttggaagtgataggttccaacttgtttgggaaaagtatagaagaatggaaatctgctatcaaacaatataaaagaattcctagcattcaaatcctagagatacttaaagtaagctttgatgctttggaggaagaacaaaagaatgttttccttgacattgcctgttgcttcaatagatatgctttgacagaggttatagatatacttcgcgctcattatggtgattgcatgaaatatcatattggagtgttggttgaaaaatctcttataaaaaagtttagttggtatggtagattacctagagttacaatgcatgacttgattgaggacatgggtaaagaaattgtcaggcaagtatcaccgaaagagccagagaagcgcagtagactgtggttactggaagatataattcaagttttggaatacaacaaggtgccaagtagcattgtcctgatgccagaactgactgaaatcttcgccgtgggattgaaagggtggcaatggctaaaacaggaagagggtgaaaaaacaacggggtcaacagtatcttcaaaggaactgcatgaagctggaaacactgtgttttgtttgccaagagataggattcctgagtggttcgatcagcaaagcagtggaccttcaatttctttctggtttcgtaataagttccctgacatggttctttgtcttattgttgcacctattcaagacaaattttttcgtcccatggtgttcatcaatggcaaccaatgttccccttatagttgccatttcaggacaggaatgcaccatgcatatctttgtgatctacaagagataaaatccagaaatagtccatatgagatgcctttcgaaaatggatggaaccatgaatatgccatggaggatgttcgatttactgatccttttatagcaagagaaaatcagacgatgatctag

SEQ ID NO: 2572 - DNA, 2397 bp, Glycine max
  Peptide Sequence Number=SeqID_94257
atggaggtcgaggtgccaatctcgcttgatttgaataatcaacttcagccagagaccgtagtttcagttcaaaatggggatcctggtgtttcctcttctgttgcaaatgctgttaacccgcagcagccagctacaaaaaaaccgaccaggcagtgggctgcatggactcgacaagaggaggaaagtttcttcaccgcgttacgacaagttgggaagaattttgagaaaatcacttcccgtgtacaaagtaaaaccaaggatcaggtcaggcattattactaccgacttgtgagacggatgaacaaacttcttggtccaggattatgtttggatgccaaaaactctaaagatactaatgctgcaatgcttcgctggtggtctttattagaaaagtatagctgcaaagcctcaaagcttcacctgaagccccggagatttaaaatttttttagaagccttggagcaccaattattgaaggatcggaagaagaatgtgaggaagcgacccttacagggggggaattgtcttcctgctgcacctaccgcagtctcaaatcaaagtagagcatcaggaaatgatgcccgtgcagttaaactggtacttgttgacaatcaaaatattttaaaattgggaccttctaaaccatcaacgaagcgcactgtaaacatgggtgttaaccatagtaacaccaagggagattcaaataccatgaaaccaacaaggcaacgaaagaaatctggtacgatttcaacggctgcttataaaaaatgggagaaggctgcaattgctggtgtttctttagttgcagatgctgctgagcatttggagcgagctgcaactgttaaagaaattgaacaagaccaggagaatccaggagaaagatgttctgatcccgctgattatgtcctgccctctttagccaaatgtccacaaaagcaatttgttgataacaatgtgaacaatattatgaaacttaagctccagttatttccaattgatgaacctactcgaagagcattggaaatggataagcataatccacacctggagcttacacttagtactcgaaagaagatatcatcaattttagaacatctaaaccgtaaatggggtaattcaagcatagcagctggagaagtaatgctttttccttatggtattcaaagggaaaatttagttaattatccgagatggacccaggaatctactcttagtgcagctgatatatatgcaatgattggaagtccacccatcttccgtttaaggtatggttggttctccaatactgagcttgggttattaaatatgcaagtgcctgaagcatctggctccatgctcagacaatacaaaagtagtgtggacaatgctaaggatccgattgtgaattcagtttcatttcctacaccattgactaatactctttccatggagctctctgaagattgcagaacatccatgaacagaaaccatactcttatgactgcttcaactgatttgtctaatgctagaggaaacaatgtttacctgaatacaagcactgtggaatctcgtgatcctacagccaatacaccatggcatggaaaagatgttagggatggagctgtgactacacagttggaagacatggatgagttgaaattaagcagtggagcaggactgtcagctggagagtgggctgacagccttaccaacattagtgtgggggacctactttcaggagtgtcccaggatcttgataactgcatcaatcctcctattgcagagagttgttatgatgttcagcaaattccttttagtagtgattcttttgatgctgctattgctgctcacatatctagacaccaagacaggatgggacgatcctctctggcatcccatatgtcttccatctgggatgctgaagaaacttgtgatgcctttttatttaaaaaggatcctattcttcaagaatatcgtccttgtttatctccagttgcttctttagagtctgagaaaaaggttactaaaagaagctttgacaaattggatgagctgtcacctgaaagagagaggcttgtggatgattgtgctcaaacagaccctatgcctatggacagttccgagtctgatgcagatgtccaggagcatttaggaaaggattttagtgcgctggcagatatgtattggcctgattccttgggacctttggatttggaaataccatcatcaactaaataccatagcgaagatctaatttttagtgatagtcttagtggactgaatcgcttgatagccagcagcctggatgcattccagaattgctccttttttgggtttgacaagaaggaagcaccatcaacagttgaggctcgagaatctgccactctttcagattttaaaattggaagtggcatctga

SEQ ID NO: 2573 - DNA, 321 bp, Glycine max
  Peptide Sequence Number=SeqID_94258
atggctgctgaagtatattaccaggctattgcctcgcaaacatcagtcgctgatccagtgttgtcctcttcaagaagcaatgctggtgacacttacaagaaatcaactttaatccttattgggcatggtgagtcgttatggaatgagaagaacttattcacagggtgtgttgatgtccttctaagcaagaagggtatagatgaggcaattgaagctgggaaaagaattagcagcattccttctgaagctggagtttatgcctatactaggatattatttgtctggaaggctgcaatggcacttgcagacctctaccaatag

SEQ ID NO: 2574 - DNA, 267 bp, Glycine max
  Peptide Sequence Number=SeqID_94259
atggaggattcaccaccattcttaaccaatgaggaggtggatgcattatgcaaagaccttgcaaatatgaacattcaaccactttcaaatgatattggtcctttaaatttggatgatgttgatgttgatgaagcacaagacaatcccattgaaaacatgaatttaaatgaaagcaatgttaaacatgaagttacaatgggagattcttttggattctttaacgaaggaattcctaaaaatgacaatgacttagtttatgttccttga

SEQ ID NO: 2575 - DNA, 1192 bp, Glycine max
  Peptide Sequence Number=SeqID_94260
tggtgttggaggcctaagtggaggtggtctaaatgtagttgacatcggtgaagatgccagatggacgatgatcaccacgaaaaatgcgatggtgacaacaccgttacggtcatcgtcaaaaccccaaaacaatcgtctctcaacgatgaatacactagccgatggcgtccaaacctgggtgtgcgtcgttgtgggcaccgtcgacgggaactgttgtatgggtgtgcatcgttgtgtgtcattgtgggtcgttgtgcgtcactgtggctgggagatttgccagcgtaaagaggttgtggaagtgtgggagatgaagaacttctcttgtagaagtttcgaaagtgtgggagatgaagaaaaatcaagaacatacctattgggaatcaagagtcaattttgggcgagaggattaaagaagcatctgaagaggcttaatgccccaaagcattggatgcttgacaaactgggtggtgcatttgctcctaagccctcatctggaccacacaaatcgagggaatgcctgccactcatactcattttgcgaaaccggctgaagtatgctctaacataccgtgaagtcattgctattctgatgcagcgacatgtccttgttgatggcaaagtcaggactgacaaaacataccctgctggttttatggatgttgtatcaatccctaaaacaaatgagaacttccgcctgctgtatgacaccaaaggtcgattccgtctccactcagtcagggatgacgaggctaagttcaagctttgcaaagttcgctcagtgcagtttgggcaaaagggtatcccatacttaaatacctacgacggtcgcactatccgctacccagaccctctcatcagggctaatgacaccattaagctggatttggaggagaacaagattgttgatttcatcaaatttgatgttgggaatgtagtcatggtgacgggtggaaggaataggggtcgtgttggagtgatcaagaacagagagaagcataagggaagctttgagactatccatgttcaggatgctactgggcatgaatttgcaactcgaatgggcaatgtgttcaccattggcaagggaacaaaaccgtggatatctcttcccaagggtaaaggtattaagctatcaatcattgaggaagctaggaaaaggattgccgcccaacaagcaactgctgcttaa

SEQ ID NO: 2576 - DNA, 1479 bp, Glycine max
  Peptide Sequence Number=SeqID_94261
atggcaagggcttcggcttcatcaagcccgacgacggcggcgaggatctcttcgtccaccagtcctccatcagatccgacggctaccgcaccctcctcgagggcgaccgcgttgagttcgccatcgccaccggagacaacgacaagaccaaggccgtcgacgtcactggcgtcgacggcgcccctctccagccccgcgcctctgccgccaacaaccgcgccggaggatccggcttcggcgccaggcgcaatggtggcagcggcgccgcgtgctaccagtgtggtgatttcggccacctcgcaagggattgcaacaggagcagcaataccggcggcggtggaggcggcagtggcggtggttgtttcaattgcggcggcggatcttgctttaggtgtggcggatttggacacatggcgagggattgtgccaccgggaagggtaacattggcggtgggagcagcggtggcggttgttttcggtgtggggaggttggtcatttggctagggattgcggcatggaaggagggagatatggcgatggtggtaacagtggtggcggcggcggtggaaaaagcacgtgctttaactgtgggaagccagggcattttgcaagggaatgtgttgaagcttcagggtgaggtgaagaaggggtcaaattcagcgacattcagcatcgtaaacaagtgtagctacccggtttggccggggattttatccggcgccggaacggcgcaactcgccaccaccggcttcgccctgcaacccggccagtccaacgctgtcgcggtccccaccgcctggtctggccgcctgtggggccggaccctgtgctccacggactccgccggaaaattctcctgcgtcaccggagactgcggatcctccgccgtggaatgcggcggcggaggcgccgtcccaccggccacactggcggagttcaccttgaacggcgcggggggactggacttctacgacgtcagcgtggtggacggctacaacctccccatgctggtggaggcgcgcggcggcgggaactgcacagcgacggggtgcgcggcggacttgaatggagggtgtccggcggagctgaaggtgaagacggtggcgagtggtgagggcgtggcgtgcaagagcgcgtgtgaagcgttcggggatccgcggtattgttgtagcggacgttacgcgacgcctgagacatgcaaggcgagctcgtactcgcagctgttcaagagcgcgtgcccacgcgcttatagctacgcctacgatgatgccaccagcacctacacttgtgcctccgcggattaccgcatcactttctgtccctcgacctccaaaagttcgataaagtcagggagtgggaaattcccagtagcagtagatatctcagttggccatgcttatgctgacaaatcagccaatgtcatgctagtagctattagcgctgttttattaacaatattgtggcaacaactcaattag

SEQ ID NO: 2577 - DNA, 642 bp, Glycine max
  Peptide Sequence Number=SeqID_94262
atgacccaagtgagcccattggctgtggagaaacagatggcgatagaggcatcaaagatctctgtctttctaatggaggaaccacctgatgataataaggtggcccagtgtatggaaattgctgaggggagtataactatgtgtctacacctacagacggcaaaggccaaatttgacatacctgaaggtttaactgcgaagaagaaggttatgtccaccgctgggaccagatggaggcaatttaagtcctccctgacgaccagatatgtatatgctgagaatgacgatgaacaaaacaaggatccatctgctaagtatggtattgatcgaaatacatgggaagaatttgcaaagactcgacagacccctacttggaagggaatacgcaaaaaagcacaggaaattcaaaaattcaatgaatctccccatgtactctctcgtggaggctacaatgtgcttgaaaaaaaattaatggccgagaaaaccaagtcaagactgaatgaaggtgacaatagtcaaaatgcagatatggtcgtcgaccctccatcccctattgcgagacatgagaagtggaaaaaggctaggacaaacaaatttggacaaatgacatctgcagcagctcaagaaatcgcagacaaaatt

SEQ ID NO: 2578 - DNA, 1029 bp, Glycine max
  Peptide Sequence Number=SeqID_94263
atgaaacaagaggaatggatgattacgacagcgttgctatcgttgctgtttgtttcatcttttccgccgttgagttacggagttgttcctcctcgtactctgctcaataagctgtcggagggcaaatatctcaacactcaggagctctggttcgaccaaaccctcgatcacttctctccctatgatcaccgacaattccggcaacgttactatgagtttctagactatttccggattcccgatggaccaatttttttggtaataggtggtgaaggtatattgaatggggtagcaaatgactatcttgctgtactggcaaagaagtttggagcagctatggttactcttgaacatcgctactacggaaagagtactccatttaattctttggagacagaaaatttgaaatatctttcgtccaagcaggcactctctgatttggctgactccataaatgcaaagcttaatagaacaaaaattgaaaacccctggttcatttttggtggttcatattctggagcactcagtgcatggttccgtcttaagtttccccatttaacatgtggaagtctggctagttctgcagttgttcttgctgtttataactacacagaatttgatcagcagattggtgagtcggcaggtcctgaatgtaaagaagcgctgcaagaaactactcaactcattgaacacaaacttgcaaccagtggaaaggaattgaaggcctcttttgatgctgctgatcttgaaatagatggagactttttttatttcttggctgatgctactgctatagcgtttcaatatggaaatccagataaagtatgcaagcctcttgttgaagcaaagaaggctggagaggacttggtggatgcttatgccaaatatgtcaaagagtactacattggaacttttggtactgatgtgcagacatatgatcagaagtacttgaaaagaactgctatgaacgaggacaattctgctcgattatggtggtttcaagtttgcactgaagttgcatactttcag

SEQ ID NO: 2579 - DNA, 645 bp, Glycine max
  Peptide Sequence Number=SeqID_94264
atgtctttctctattattacctctagggttcccaaaacttgcgagagatctctctcgtcgcacctctctgtcggaacgatgatctttgcacagggcaaccacgaccaccactaccaccatcagccgcagcttcccggctccattgacacctctcgacaacaattcacttcggatcactttgagctcttctccgtcaagcaggaatccgcgtccttcactcttctgccgttacgcagtcatgattctagtgaagttcagtgcgtcattttattggttgctcttgatgtagttaagtcagctggtggcggattcttcaggaggtttgccaaaacacctgctttctttgaagatattgggggtagttcagtattgttcttaccttgttctctgtacaattggactctacctgagggtgcttgtctatttcatggcatgccattggatgttaagatttatactacccatcaattggaattcttggaagttgtagacctcatttttacactatttgatgaggacatgaccaagagcaagggcaaggatccacttgaaggacttggaggacctatgacaagggctagagcaaggaaagccaaggaagctcttcaacaagtgcagtccatactatttgaatacaagccctag

SEQ ID NO: 2580 - DNA, 150 bp, Glycine max
  Peptide Sequence Number=SeqID_94265
atggaggaagaggaagatgatgaaggacgaggctcgagtgatgacgaagaggaagaaggaggtgaagaagaagaaagtgataatagctctggtagttctgggaaaaaatgtcatcctaacgtgatattagcatgctttttagggttttga

SEQ ID NO: 2581 - DNA, 828 bp, Glycine max
  Peptide Sequence Number=SeqID_94266
atgttggagatgattgggaggaaattgaaaaagaatagtgtagcacttgacgttgtcaattttggtgaagaagatgagggtaagacagagaagttggaggcactcctttcagctgttaacaataatgataccagccacattgttcatgttccatctggtccaaacgccctttctgatgtactaataagtactcctatttttactggtgacggggaaggtggaagtggttttgctgcaggcagtgtatctggatttgagtttggtgttgatccaaacttggaccctgaactggctcttgctctaagagtttcaatggaagaagagagagccagacaggaagcagctgccaaaaaggcagcagaggatgctgctaaacaggagaaagatggtgagcagcaagctagcccacaggatacaacaatgactaagggtgttagtgcagcagcttctgaagctgagactaaaagaactgatttgacggtcaacgagaatgctcttctacagcaggcccttgcaatgtctatggatgatcccacaattaaccacgacatgagagatacagatatgtctgaagcagctgctgaagatcctgagttggctctagctctccaattgtctgtagaagacagctcaaaggactcggcaagccagtctgacgtgagtaagctgttggcagatcagtcctttgtatcttctatccttgcatcgcttcctggggttgacccaaatgatccatctgtcaaagatttgctggcttccttgcaaaatcagtctgagcctcagcagaagaatgaagacaagccaccaaatgaagaggagaaaaaataa

SEQ ID NO: 2582 - DNA, 48 bp, Glycine max
  Peptide Sequence Number=SeqID_94267
atgacggaattttaccctcaaactgatttgtattcagaagtacagacg

SEQ ID NO: 2583 - DNA, 279 bp, Glycine max
  Peptide Sequence Number=SeqID_94268
atggttcaagttgatgatcggctcagacgagtatgcaagtaccgcaggtggagcggggtagccaaaatggctagcgggcagggcaagtaccgcagatctccttatgtggtgactcgtggtccacaggtgtacccctcgaatcttgccaacaaggtcaagggtatggagttttatagtgaagttaagcagccagtaaaatataacccaagatttcaacaaattttagttgagatcaaggaagacaataagggtatggagttttatattggaagtagatga

SEQ ID NO: 2584 - DNA, 642 bp, Glycine max
  Peptide Sequence Number=SeqID_94269
atgaggcgtgccctaactcatcaagtagctcatcaattgtcggaatcgggaagcaatcgcaaacggttaccgaattcaacgcacgataatcaacacatattctccaggttccgtccttcttcttcactaagaggactgcggtatggctggacgttcattggaggggttgaggggaggaaggttatatggtggtctatggctcactacggcggaaggttgggtcgtgggtatgaggctcagcacgtgaagagaggaagtaggttgggtgaaaaggtggaggaactgggcgattcgcggttggaggaagttgtgggtgctgccgctatcaatgaggatagtgaggcgtttatggcggataacaccgaagaggcgaaaggtctcaatgatggaagacccgaaagtgcatggaggctaatttgtagcaaaggcccttctcacggtggagggccatttcatctggggttctttggacgtataaaggcttgggtcttgggtttgggtgagtgtggtgggtcgacggtgaaggcaggattatgtaggtttgtcatgattcatattctccaagaaaaggtcctaaggcttattctaagtccaactcttgagaaggtacttcaatgtgcaaaggtatctaaggtttactaa

SEQ ID NO: 2585 - DNA, 1722 bp, Glycine max
  Peptide Sequence Number=SeqID_94270
atgaacctttatcatgatatttctgttccagagaatgtgcacaaatggtttgtgtggggttactggtcctcaccactgatgtatggacagagtgctatagctgtgaatgaatttcttggtcatagttggagaaaggttactcataattccaatgaaacactaggagttttgatactgaaaactcgtggatttttcccagaagcttattggtattggattggattaggagcattaattgcattcagaaaggatcaagccgggctatcccaagagaaattgattgagagaaatgcttcaacagctgaagagttgattcagttaccaaatggaaaaatctcttctgatgagtccttgagctctaaaacaaagattgtagaagaagcaaacttatcatccagatctttttctggaagagttagtgatgataaagctaacagaagtggaaggaagggtatggttcttccttttcaacctctatctctcacatttgatgagatcaaatattttgtagacatgccacaggaaatgaaaaagcaaggagtttttgaggaacgtctagaacttttgaagggtgttagtggtgtctttaggcctggagtactaacagctctgatggacgtaagtggtgccagtaagactacattaatggatgttttagctggaagcaaaactggtggatatattgaaggaggtatcacaatatctgggtgtccaaagaggcaagaaacatttgctcgcatctcaggatattgtgaacaatttgatatccactcacctaatgttacagtttatgaatctttattatattctgcatggcttcggttaccccgtgaagttgatcacgcaactagaaagatgttcattgaggaagttatagagctaatagagcttacctcaataagagaagcgcttgttggattgccaggagagaacggactttcaaccgagcagcgcaagaggcttacaattgcagttgaactagtagccaacccatcaataatattcatggatgagccaacctctggccttgatgctagagcagctgcaattgtaatgagaaccgtgaggaacacatcatatacaacagttagactcttatttaccatgctaatagcattattatttgggatcatattttgggacattaattggcctgaaaaggagaaaagagcaagatcttttcaatgctatgggttcaatcctataatagcggtagagagaaccgtcttctacagagagagagctgctgcaatgtattcagctttgccatacgcacttgcacaggttattattgaacttccccacatcttggttcagatcctgatgtatggaattatagtatatgccatgatgggattcgattggaccacatcaaagttcttgtggtatcttttcttcatgtacttcactttcttatatttcaccttctatggtatgatgaccctagccattgcccccaacgcacatgttgctgccatattgtccagtgcattctatgcaatgtggagtcttttctcaggcttcattattcccttatctagaatacccatatggtggaagtggtactattggatctgccctgttgcatggaccttgaatggattggtggcttcgcaatatggagacaacagggacaaacttgagaatggtcaaagggttgaagaatttgtgaagaattattttggtttgaacatgcttgttgttttatttcattcaatttag

SEQ ID NO: 2586 - DNA, 270 bp, Glycine max
  Peptide Sequence Number=SeqID_94271
atggctggcctgaacaactttagagggtcagcatctcgccttgcaaaggaaacattgcagtcaaattctttaagcatgatggaattccacttgacaagttattccttgaaagatccaacaattgaatacggttcaaataacagagatgaatgggtagatttcctgagaggtgatttcctcgcatgttcaagattatcaattgatgcatactttctccaatccatgatggtattggacccgacaacatattttcactcaggtccagcataa

SEQ ID NO: 2587 - DNA, 504 bp, Glycine max
  Peptide Sequence Number=SeqID_94272
atgacaacacccccgagatcccctccaccaccagattctcctagtgcaaccacaaaaaggaagactagacaaactaccaggctccgaaggttgactgcacgaagcttatatcaagcacgaccaactgtccacgtcaacactagtactggtagaggatctggcccgcataaagaaaaattccatagttacttgggggtagtggcgcgggagaaaatccctattgttcatgctacttggaaagatgtccccgacactctaaaagttattgtatgggatgacattttggccaaatttgatattccagaaggtttaactgcgaagaagaaggttatgtccacggttgcgacaagatggaggcaatttaagtcctccctgacctccagatatgtatacaatgacaaagacgatcaacaaaacattgatccatctgctaagtatggtttcgatcgagaaacatgggaagcattttcaaagactcgacagacacctacttggaaggtttaa

SEQ ID NO: 2588 - DNA, 259 bp, Glycine max
  Peptide Sequence Number=SeqID_94273
atgcaaagatggaaggcaggatccattcttggattcaacagccttcccaatagcgcagaaattaagtgcattgagagtgagagacaagcactcctcaacttcacacatggcctcatagatggctatggcattctctctacatggagggaccatgacactaacagagactgttgcaaatggaaaggcattcaatgcaacaatcaaactggtcatgttgagatgcttcatctccgtggtcaggatacacaatatttgagtg

SEQ ID NO: 2589 - DNA, 150 bp, Glycine max
  Peptide Sequence Number=SeqID_94274
atgtatgcttatggtgaatgtgggaactgggaagtgttgctgatcgctccaaggcaaaaagatacagtttgtgtcgatttcttaacaccgccaactccagtccaatccctcaactgcaaaggcaactcccctattaactatgccaaataa

SEQ ID NO: 2590 - DNA, 3771 bp, Glycine max
  Peptide Sequence Number=SeqID_94275
atgaagacaaagaccaaagttcttctgaaagttctgtatggtctctccaggttcaaggtagccaatgagtaccaaagaagcaccactccaactggcagaagaattttccacagggatgtggaaaaggaagaatttcagtatgccagcactcaatgtctctcatcttactacagtgtctttgtggttcgtctagcaatcatggccatgctagccatattgattggtctgctcactttcctaacatggcatttcacaaagatttatacaacaaagtctcttaatagcttggcatatgacctgcgttatgaacttcttcaacgccccatcttgaggatgtggaacattttgaattctactgctgaaattacaactgctcaggttaagctgtctcaatatgtgatcagaagccacaccaaccttgccactcaagcagaccaagttgaggttgagttgactgataactttttctatgctattcttatgtttgattccatttgcaatttgaagtttgagtattgttccaactcttaccagatgtatgacgcgatgagggctgtaacatgggctctgtttgttagtaaaaaggctctcaattcaataactgtcaaatacaagaatggatttgtccaagcattccatagggacctgaaggataacaataccttttacatttattctgatcttgctaattactccatggctgccagtggctacaatgctatcaattcgcattcttcgcgtgaagcttggaacgataaagacattcatggtcacaaggctgcagtttggtatcgcgaaccacttgatcccgtcagtggtgagaagattggaaaagtaatgccaattgcaccagaagactcgatcaatatagccggcctctcccaagtacctgacggtgtagcttcgtggcacgttgctgttagcaagtttacagattcacctttgctttctgcagcattgccagtttgggactcttctaataaaagcattgtggcagttgtgggtgtcacaactgcactttacagtgtggggcagctcatgaaagagctagttgagaaacatagtggtcacatgtatttgacctcccaagaaggttacttacttgcaacttccacaaatgcacctctactgtcaaatactaccaaacctcctaagcttaagatggctgttgactgtgaaaatgaagtaataagagagggagctcagtggcttcagaaaacctatgggaacaatttccctcaaagtcatgagcttcatgtagagaatgtcaggctaggccgccaacaatattacatcgactcattcttcctgaatttgaagagacttcctctggtgggtgtaatcatcatacctagaaagcatatcatggggcaggcagatgaaagagccttcaaaacattggttattctgatatctgcatcattgtgtattattgtcattggatgtgtttgcattttgatactgactaatggagtatcaaaggaaatgaaactcagagcagaactgatcagtcatctggaagcaagaaggaaggcagaggcatcaagcaactacaaaagtcaatttcttgcaaatatgagtcatgaattgaggacaccaatggccgcagtgattgggttacttgacattcttatatctgatgaccgactcacaaatgagcaatgtgcaacagttactcaaataagaaaatgctcaactgccctgcttcgtctacttaataacatcttggatctgagcaaggtggaatctggaaaactggtcctagaagatgcagaatttgacttgggacgggaacttgaagggcttgtagatatgttttctgtgcagtgcattaaccacaatgtagagactgttttagacctttctgatgatatgccaaagctagttcggggcgattctgctagagtagttcaaatttttgcaaatttgatcaacaactcaattaagtttactctatcgggtcacattattctgagaggatggtgtgaaaacccaaattcttgcagtgataatacaaattttcctctagagaaaaagaaatcacggtgttcacaaaagaccagagcaaagcaacatgaaaaccatgcaaagaggacttccaatagagataacaaaatcatactttggtttgaagttgatgatacaggctgtggtattgacccaagtaaatgggaatctgtgtttgaaagctttgagcaagctgatccatcaactactagactgcatggaggtactggtcttggtctttgcatagtcagaaccttggttaataagatgggtggagaaatcaaagttgtcaaaaaggagggcccaggaacactgatgagattatgcttgcgtctcagtgcacctgtagatgccacagaacaacattgtcaagtagattttgctaacaagggcttagtggtacttcttgcactacacggcaacatgggtcgatcagctacatctaagtggttacagaaaaatggtgtggtcactatggaggcagcagaatggaatggattaacacaaattcttagggtactctttcatgcaagaagttcatctcataataatggctttgatgcaaactattcagttcatgacaatttaaagtcaagattactgagcatacaggaattgaggaaccctgtttttgccattgctgttgacattggactacttgacttgagcacagatatatggaaggaacagataaatttccttcacaaatactatgggagagcaaaattcgtgtggatgctaaaccatgactcctccaattccataaagatggagcttcgcaggaaaggacatacactgacagtgaacaaacccctttacaaaacaaaaatgattcatattttggaagccatcataaaggagagaaatgaagagctgcaaaagaaaaatatgactactccaagagctactgtgaaagagggagatttgcatgagagtcttgagattgattatactcaatgtgatgttgcaagctcggatggttcagacatatccgaaaagggtggttctaatcctgttagtgcctgtggagataaacaaagagagaaggtagcgagatctgatccatcatcacaacaccagataaataacttagttggattaacaatggaagataataatcataggaaagaagagttatgtcagagcagcctcaactctaatgatgtcagtgcaaacgccacaccaaaatcatcctccactaaacaatcatcaacaggagctcaagatgaagattctgaatatggtgaaacacgtagggccagtagctcaagtagagcagtgattggaaagaaatctcttgaaggtttgaggatattgcttgcagaagatacaccggttattcaaagggttgcaaccataatgcttgaaaaaatgggagccgtcgttgtagctgtaggtgatggacaacaggcagtggatgctctaaatggcatgcctggtgttgaagattgtataagggagtctctcctgaaggaaagaaacacaagatcatctcaaactgagattctcggttgccctccatatgatttgatcctaatggattgtcagatgccaaagatggatggctatgaggcaacaaaagcaatccggaaatcggaagtgggaactgacttgcacattccaattgttgctcttacagctcatgcaatgtcatgtgatgaagccaagtgcctagaggtgggcatggatgcttatttaacaaagccaattgacttcaaactgatggagtccaccattctttcactcacgagaaggacatcctaa

SEQ ID NO: 2591 - DNA, 867 bp, Glycine max
  Peptide Sequence Number=SeqID_94276
atgactttagatgataagatatttttctacattcatcaagaagtttctacatactacaacatctccataagtgaggaatcatccgattcggattcctcctcgagtgatgaggagggaggaaaagcaaaacgtcagaataagaagaagaagaagaaagattccaattccaatttcggtgccagcgtgttgagccatggcttaacaatagcgtcgaaggggcaggaggatttgctgaaggagctggacaaggtgttgcaggaatgtagtgctttctcggtgcagaaggtgtcggagaaggcgaagaaggagggggatgtggtggatgcgtcggtggcattggcgatatctccggtggatttggagaaggaggagaagaaggagatgatggaggagaagtgtgccgcgtattggactacattggcccctaatatggaggattacagtggaaccgctacgaagcttattgcggctagttctggacaattggttaagggaattctttggtgtggggatgtgacagtggagcagttgcggtggggaaatgaggtcatgaagaggaggatgactctgggttcacaaggggagattagtcctaaaaccttgaagcggataaaaagggttaagaaagtgaccaaaatgacagagagtgtggcaaatggggttctcactggggttgtgaaggtctctggatttttcactagttcagtggcaaattcaaaagccggaaagaaatttttcagccttctacctggagaagttgtgcttgcatcattagatggattcagtacgggtatcgccattcctcctggcgggataaacttctcagtgcatacgtggacaatcccgcctttggaactgacgggatag

SEQ ID NO: 2592 - DNA, 486 bp, Glycine max
  Peptide Sequence Number=SeqID_94277
atgaagaatattgatgcggcatggggagttgcatgggaatcgggaaacgatcgcatataccaccacactcgatcacaacattcaatcaacggtgcaagacatgacccaaaaacttcacgccaacaagcacattgcctagcgggtgcagttttacgtgctcccctatgcccacacccgatcaatgctccacgagctcagtgggtgtttcttgaagtagaggatcttcagtgtgaggggaagagtcgcgaattcgagaacgagatttcgggaactttgaacacccaaaccgccagtaccactggcgagtttggtgattctgaaggaaccactgcttgcaatggcgatatagccatgcatagggaactgccagtgcaacagtggtgcaacagtggtgcagtggtgcagaacggaggagatggcagcacagtggaatcgccagtacgaacggcgagttgcattgagaaggaaccgccagcctggctggcg

SEQ ID NO: 2593 - DNA, 378 bp, Glycine max
  Peptide Sequence Number=SeqID_94278
atgtctttttacgacactgctagagtcccgcacccgaaactagctactgttcttcgatacactcaggagtcctgcgcgcgtaaccctagctactgttcatcgttgttgaaggtagtcctctactctctgaaaagccccttaaattcgtctttgtcctggactttgactccctcattgggtgcctttgtgtttatattacagccctcgaagtgtactgtgcctctgtgtcttcaatctctgcgaagcagcagcagagaagttttccgacaaaggggggaagagatggtcgaaggagaatgggttcaggcgtttgagtgcattgccttaaagaccacgtacctcaaatttgggggcatggctaatacttcatatttctag

SEQ ID NO: 2594 - DNA, 165 bp, Glycine max
  Peptide Sequence Number=SeqID_94279
atgaggcccaatattggtgatggacctttcattcacacgatgggtatggtggaaaaagaagccatggggaaggtgggtcgtccaacaatggtagtggtaaccatgagtgtaatattgaatgctggtttagttgctaaattgaggaatgtatttgacatattataa

SEQ ID NO: 2595 - DNA, 954 bp, Glycine max
  Peptide Sequence Number=SeqID_94280
atgactagttatgcatccacatcacaaacaaaatataggaactttacatttcctgctcttatagcttttggtgattcagtcttggatactgggaacaacaattatattgaaacaatagtgaaggcaaatttcaaaccatatgggagggatttcattggaggacaagccacgggaaggtttagcaatggcaggatcccttcagactttttagctgaaatacttggaataaaggagaccttgccaccctatcttgatccaaatctgaaggtcgaagacctcttaactgggtcagtgttgtcagtggaggatcaactgaatatgttcaaaggatacataggaaaactgaaggcagctgtgggagaagcaaggacagctctcattctagcaaaaagcatatttatcatcagcatgggaagtaatgacattgcaggaacatattttatgacatcattccgcagagagtataatattcaagagtatacaagtatgctagtcaatatatcttcaaattttctacaggaactatataaatttggagcaagaaagattggagtagtgagcctatcaccaataggatgtgtgccgttgcaaagaacaatagggggaggcaaagaaagggattgtgtagaatcaataaaccaggcagccacggtctacaactccaagctttcttcttcaataatggctctcaacaaaaagctttcagaagctagacttgtctaccttgaaaactatagtgaattcaataaactaatccaacaccacaaacaattcggatttgaagtggaggatagtgcatgttgtggaccaggccctgtctgtaattctttgtcctttaaaatatgtgaagatgcaactaaatatgtgttctgggacagtgttcaccccacagagcgaacttataatatacttgtctcagatattgtaaaaaagaacattcataagtttgtttga

SEQ ID NO: 2596 - DNA, 273 bp, Glycine max
  Peptide Sequence Number=SeqID_94281
atgaaaaggattatgatggggttaccttgttcgttgcacgcgatgaagatgatggtgccggtttcgtcaccgatgaggcactcggtgataagagtgggacaaatgttatgcaaagaagagggtcctcccttcagcaagacaatgtttgaggacaacacctttgcaaccatagtgggtgacatggagggagggaaggggaaagggttttgggtttggtttgagatatatcaaggcaaaaggagaggaatgggcacgaggggaatgaaaggttaa

SEQ ID NO: 2597 - DNA, 2949 bp, Glycine max
  Peptide Sequence Number=SeqID_94282
atgggttccattgcagaggaggaggctatgccaaacctagtaggcagtgaggaaaggattcttgtttctgttcgtgtgagacctctgaatgaaaaggagctcataagaaatgatctttctgaatgggaatgcattaatgacacaaccatcatgtacaggagcaacctttcagctacagaaaggtcactgtatccaacagcctacacattcgatcgagtttttaggactgacagccccacaaagcaggtgtatgaagaagcagctaaggaagttgctctttcagttctcagtggcatcaactcaagcatttttgcttatggacaaacaagcagcggaaaaacatacaccatgagtggtataacagattttgccatagcagatattttcaactacatagaaaagcacacggaaagggaatttgttttgaagttttcagcattggagatctataatgaatctgtcagggacctccttagtgtggacagtacacctcttagacttcttgatgatccagagaaaggtacagttgttgagagactcacagaggaaactttaagggattggagccattttcaagaacttatttctttctgcgaagctcaaaggcagataggggagactgccctgaatgaagtgagctccagatctcatcagattctcagactgggaagagaactttacagcacctcatcgctaagattcctaaataatgtgattcttcttcagacaattgaaagttctgctcgtgaatttctgggaaatgacaaaatgagctccctttctgcttctgtgaatttcgttgatcttgctgggagtgagcgttcatcccaaacaaattcagctggtacgaggttgaaagagggttgccacataaatcgtagtttactaactctaggaactgtcatccgcaaactgagtaaggggagaaatggacatattcctttcagagattcaaagctaacccgcatactgcagtcctcattagcaggcaatgctaaaactgcaatcatctgcaccatgagccctgcaaggagccatgtcgaacaaacaagaaacacccttttatttgcaagttgtgctaaagaagtgacaactaatgcaaaagtcaatgtagtggtgtctgataagctgttggtcaagcaactgcaaaaagagttggctagactggaaagtgagttgaaaaattcagggccaacccgccttaaatttgattctgcagcattgctgaaggaaaaagacctccaaattgagaggctaaagaaagaggtaatggatgtttcgatgcagcgggaccttgctcaatctcaaattaaggacatgctacaagtggttggagatgatgcgtcctcaactgagctggacagtttaggtcatcaatatcccaaattacgtgtgcgaagttcatttgactttgaaaatcaaacagccgaacgaccaaatttatcaaattttgactgcattgagagtgtcagatcttttgatgcatctcaatattcagatggacacagtattagttctgatgataactatttccaactccctgatttgcaaaagaacctacccgtcaggatttcttcccctgcgatttctattgtaagtggtgatgctgcaaagaatgatttggatcagaaaaacgttgaagatagtttaggggaccgttgtagggaagttaggtgcattgagtcagatgatctaactacaaacacacacacacactctactgcatcatctccagcagtctcaggattaactgaagttgataatagagacaaagaaaatctagatttgtgttcatctgggttaaaggacaacaaagaaataaacggcttgcaagaacgttttgttcttccctctcctgagaaaatatctccatgtccgacacaaagtagtgcatctagttctaaaaccatgaaattaaccagaagcagaagttgtaaagcaagtctcatgagagatccattttcagattggtttgaccaagaagaaatgattcagaatacccccccaataggaagacccgggggccttcaaaggaagacttatacactcaattataatcccaatgctgagaggttatcatgggctggttacgagaattctctgggaagagcttctgatgcacagaatatgaaatcttccacctataatggaagttacaaagataattctttggcacctgtaagaaaagaaaagaatgatcttgaaagttcaaatatgcaagcgaatcttgaggttcaagagacaggaatggagtccgatgttactacaaagaagttcaaagatgttggtttggacccattgcaatctgaggaagaaaaacagttggaatggccttcagaattcaagcggctgcagaaagagattattgaactctggcatgcctgtaatgtttcattggttcacaggacttactttttccttctgttcaaaggagacccttcagattctatctatatggaagtagagctaagaaggctgttctatctcaagcaaacttttgaccaagggaatcagactgtggaagatggacttacccctgaatcaagcaagaggtatcttagaggagaaagacagatgttgagcaagcaaatgcagaagaagctgtcaaaatctgaaagagagaacctgtacaataattggggaattcgtttgagttcaaagaacagaaggttgcacttggcccatcgcttgtggtcagaatcagatgacttagagcacattagagagagtgccaccattgttgcaaagctggttggttcagtagagccagatcaggcttttaaggagatgtttgggctcaactttgccccaaggcgcacaagaaagaaatcgtttggttggacagccagtttatcaaggatgtgcaatcccaaggttacagatttcttttgtacaatgtgcttgactaagaacaactgcacttactgtgctcaaaagaatgcacaataa

SEQ ID NO: 2598 - DNA, 273 bp, Glycine max
  Peptide Sequence Number=SeqID_94283
atgcagggtatcaggcgcatggatgctgccctggacgcaatgcgtccacttggatttaggacacaactgattctacgaacggttaatgagcttctcgatgttgggtggagggaaaaaaaactagtcaatactaaaggcatgttaagggctgcaggcatgtcatcaggaaaaagttcagtgacaagtttccagggatcacctgtacctgcaggactaatggagggtggtctgattgatgttcaacaattttcactcaaagctttgcttctataa

SEQ ID NO: 2599 - DNA, 708 bp, Glycine max
  Peptide Sequence Number=SeqID_94284
atgagtggggataaaccgaggaaggcgttaaagttcaacacacaagggtatgtaagggtggaggtggcattagaagtcggtggcactaccctgcaacgtgaagcatcttttctgggaacatgcttcgatgatgggcaaggagggttctcgagcatggctctcgaggctgctgcttattgcttgaagtgcattgcttgcaggggtgatggtgagttggcagttgaaattggtggagatggtgccactcattctttgatgaggacagttgttgccaccaatggtggggtggaaatcatcgttggtttgttgagttcttgcaccgatgatactaggcggtatttgttgtatattgttgacacagattcacgattcttaatgagtcttgcttttctcatgtccccagatgggagaatcctcatattcccaaaagggttgccaaaaggttcaacctttgagtcatttttgtggtggggttgccctaattgcaaatccttgtgcgtggcagagtcaaagtggaactcagaacgcgtgctcaaggtacgagcagtcacaggaggagaagggtctgaggctatggtactgaatgaggtttatgccttcccaaacatcttccatgtctttgttgttggtgctgatgtggctgcttcttgggggagagagagctttgtggttcaggttgtttctgctgtggcagctggtggtggttga

SEQ ID NO: 2600 - DNA, 654 bp, Glycine max
  Peptide Sequence Number=SeqID_94285
atggcgttcgctcactacttgctcgcagttcccgttgagccctctcccaacttcccgacaaaccctcccaaaccaaacccatcgctgtcgtcgtcgtcgtcgtcgtcgatttcctcacactgtttcaacctctcttcgtctctccgccccaaacactcgctattctccaggttccgcaggatctgtcacaaagctaaggctaagccgcaggaacctgaagtgactgtggcgagtgatgcatttacgcaattcaagcatctgcttctgcctattacggataggaatccctatctctctgagggtacaagacaagctatagcaaccacctctgctttagctaaaaagtatggagctgacattactgttgtagttattgatgcacagcagaaagagtcactgcctgagcatgagacccaactatccagcatccgttggcatctatctgaaggtgggttgaaggactataacttgctagagcggcttggtgatggcaacaagccaacagcaattattggtgatgttgctgatgaccttaatttggatttgctcttcaatcctcatactagctacattttggctacaagaaagctcagatttgttaagattgatcctttgtctagaagcatcctcataggatttgaaaagacttcagag

SEQ ID NO: 2601 - DNA, 2148 bp, Glycine max
  Peptide Sequence Number=SeqID_94286
atgggatccaaaaatgcaaacgggaagaaccacaaggacaaaaggaagaagtttaaggataatttgaattcaaatcattcatccactggtgatgccaaggttatcattatcagtgatcctcgatattcaaaggctcacacggatcctcggtttcgtgaggctccaaagcgtgaaacgaaggtggccattgactctcgcttcaaccgcatgttcactcacaagagttttttgccctcttctgctcttattgacaagagaggcaagcccaagaacaacccaacctctcagcttggttctctgcgccattactacaaagttgatgaaaaggaagttgagcagagtagtgatgaggaagaagataatgaagaggaattggtgaaagccaatcgaatgaaaccggagagtgacaaaggaactgaattagaagagaccagtgaatctgagtcagaagaaaccagtgaatcagagtctgatgtggacacagatacagatgaaggtgcagatgaggaagtttacgaggaagaagcctctgatgtccatgaagacatagcaacgattgacaaagaaactcatagggttgcggttgttaacatggactggagatatgttaaggctgttgatttgtatgtattgttaagctcatttgtcccacctaatggactgatcaaatcggtaacggtctatccatctgagtttggtcttcaacgtatgaaagaggaggaagttcatggacctattggtctatttgatgatgaagatgaaaaaaatgatgaagatagcagcaatgatgacattgacaatgagaaactgcgtgcatatgagaagagcaggatgcggtactattttgctgtggtggaatgtgactcaagtgccacagcaaattacatttacaaagaatgtgatggtcttgagttaaaacagtcatcaaatgcacttgatttaaggtttattccagacaacatggaattcaaacacccgcctcgggatgttgctactgaggtacctgcaaattatgagtgtaaagatttctattctcgagcacttcagcacagtgaggttaatcttacttgggatgatgatgaacctcttcgtgcaaagacattgaaacagaaattcactgatgatcagctagctcagatggaagtgaaggaattcttaacatctgatgagagtgaaagtgatgatagcaaggataataatgagacagatgatcagcctgataaaagggcaaaaaaacgagctaagtaccgtgctttgctccaggccggtgatgattcagatggaggcaatgaacatgataatgtccagaatatggaggtcaccttcaatacaggtttggaagatttaagcaaacatattatggaaaagaaggataaaaaatcagaaacagtttgggatgcacatttgaggaaaaaatgtgagaaaaagaaaaccaggaaaaacaaaagaaagtattcatcagatgatgatgatagcgatgatactgatcaagaggcaactgaagaagcagatgacttcttcattgaggagcctgctgttaagaagaggaagaagcttgaaaataaagacgaagaacctaaagagatgaatgggctagacgaagcaagcaaagaggagcttgaactgctgcttgctgatgataaggggacagatactggtctcaagggatataatctaaaatttaaaaaaggcaagggcaaaaggacggagaatagtattgatgaggagaagataccaagtaatgcatacgatgatccacgtttttcagcgcttttctcacctgactatgcaattgaccctaccaatccacaatttaaaaggagtgcaacatatgccaggcagctagcacagaagcaacagaaggataatgcagatccaccagcggaaagggagcctacaaaagtaaaaggaatgcaattgtcttttgatgattctggcatgatgaagaagggtgaggaagaaagattagatgctttgaagtcaacgaaagataaatatgaattatcatcattggttaaatcaattaagatgaaatcaaagcaagttcagttaccctctgatgataagacaatgaaagatggaaaatctcacattaaagaaacccagcaggggaaaaaggatcttagcagaattatgaaagaagtgtag

SEQ ID NO: 2602 - DNA, 453 bp, Glycine max
  Peptide Sequence Number=SeqID_94287
atgcatacacgaatttcagctcatagaagaaacttatccaaacatggccctaataatagaagcaaaagagtgcatactgaagcgaaggctgaagcaaaagccgagctatcagtagcagcacatcttgtgcaatcacagggtacccagaacaggtcacttcccgtatcaagcgccaccatgaacttcactcccggtggagtttccgtcggagaaggcgaggccgtcgtcgatttgggagagcttgcggccgcggaggaggcggtcgcggtcggcgagttcggcgtagtactcgacggtgcccttctccggcggggcggggattccggaggcggtggagtgggaccacttcctgacaggctccgagtggcggtggtgcatcgtgaaggcactcccaagaagaaactcagcatcgaagtggggaagaagcatggatcacggagtggtggagcctag

SEQ ID NO: 2603 - DNA, 3189 bp, Glycine max
  Peptide Sequence Number=SeqID_94288
atgtgtcccatgcgtgcagttttcgtcatggtcagaaagagaagaactgaactaccaagtgggggtgaaagctctgaggctcaacacccttctgaaaggagtgcaccaccgccccaacaacaagctgctgctgctgccccaggaggggctggaccccaaggaggcagaggctggggtccccaaggaggaagaggagggggccgcagccgtgggatgccccaacagcaatatggtgcccctcctgattatcaaggtaggggaaggggagggccttctcagcaaggaggccgtggaggatatggcagtggccgaagtggtggtggtggtggtggtatgggcagtggccgtggcgttggtccttcatatggtggcccatcgaggccaccggcacccgagctgcaccaagcaacctcagttcagtcatatcaaactggggtgagttctcagcctgcatcatctgaggccagttcatccctgccgccagagcctattgatttggaacagtcaatggggcagatggtgcttcattctgaacctgctcctactcctcctcctgcaagtaaatcatcaatgaggtttccccttcgacctggaaagggtagctatggcaccaagtgtgttgttaaggctaatcatttctttgctgagttacccaacaaagatctgcatcaatatgatgttacaattactccagaagtgatatcaagaggggtgaaccgtgctgttatggagcagttggtgagactgtaccgggaatctcacttgggtaagagactccctgcttatgatggacgcaagagcctctatactgctggaccacttccttttatgtcaaaggagttcagaattgttctcgttgatgatgatgaaggagctggaggccagaggagggacagggagttcaaggttgtgataaaattggctgcacgtgcagaccttcaccatttgggactctttttacaaggaaggcaaactgatgctcctcaagaggctttgcaggtccttgacattgttctgcgcgaactccctactacaaggtattgtcctgttggaagatcattttattcacctgatttgggcagaagacagcctttaggtgagggattggaaagctggcgtggtttctaccagagtattcggcctacacagatggggctatcactgaacattgatatgtcttccactgcatttattgagccattgccagtaattgatttcgtaactcaactgctgaacagagatgtatccgcccggccactttctgatgctgatcgtgtgaagatcaagaaagctctccggggtatcaaagttgaagtgacacatcgtggaaacatgagaagaaaatatcgtatctctggtctgacttcacaggcaaccagagaattgacattcccggtagatgaaaggggaaccatgaaatctgttgtggagtacttctatgagacatatgggtttgtcattcaacatactcagtggccttgtctgcaagttggcaatgcacagagaccaaactatttgccaatggaggtttgcaagatagtggagggtcaaaggtactcgaaaaggcttaatgagaggcaaatcactaatttgctgagagttacatgccagcgtcctggtgagagggagcgtgatatcatgcagacagtacaccacaacgcataccacgaagatccttatgctaaagaatttggaatcaagattagcgagaaacttgctcaagttgaagctcgcatccttcctgctccatggctcaaatatcacgatacgggcagagaaaaggattgtcttcctcaagttgggcaatggaatatgatgaataagaaaatggttaatggggggacagttaacaactggttctgcataaacttttcaaggaatgttcaagatagtgttgcccgtggtttttgctatgaacttgctcagatgtgttatatatctggaatggcatttacacctgagccagtagtccccccagtcagtgctcgccctgatcaagtggaaaaggttcttaaaactcggtatcatgatgccaagaacaaactgcaaggaagagagcttgatttgctcatcgttatcttgcccgataataatggatctctttatggtgatctcaaacggatatgtgagactgacctaggacttgtttcacaatgttgcttaactaagcatgtcttcaaaatgagcaagcagtaccttgcaaatgttgctttgaaaattaatgtcaaagttggagggagaaacactgtactggttgatgcgctctcacgacgcattcccttggtcagtgacagacctacaattatttttggagctgatgtgactcatccacatcctggagaggattcaagcccatcaattgcagcagttgtggcttcgcaagactatcctgaaattacaaagtatgctggtttagtttgtgcccaagttcataggcaggaactcattcaggatcttttcaaacaatggcaagatccagtcagaggaacagtgactggtggaatgatcaaggaacttcttatatcttttaggagagctacaggacaaaagccacaacgcatcatattttatagggatggtgtgagtgagggacagttttatcaggttctactgtttgagcttgatgctattcgaaaggcatgtgcatccctggaacccaattatcagcctcctgtgacttttgtggtggttcaaaagcgtcaccacacaaggctctttgctagcaaccatcatgataagagttctgttgacaagagtggcaacatattgcctggcactgttgttgactccaaaatctgccatcccaccgaatttgacttttatctctgcagccatgctggaatacagggtacaagccgtcctgctcactaccatgtgttgtgggatgaaaacaattttactgctgatgccttgcaaacactcaccaacaatctttgctacacatatgctcggtgcacccggtctgtttcaatcgtgcctcctgcatactatgctcaccttgctgcattccgcgcaaggttttacatggaaccagagacgtcggatagtggctctatgacaagtggtgctgttgcaggccgtgggatgggcggtgtagggcgtagcacgcgtgtacctggtgccaatgctgctgtgagaccattgcctgcactcaaggagaacgtcaagagagttatgttttattgttaa

SEQ ID NO: 2604 - DNA, 1644 bp, Glycine max
  Peptide Sequence Number=SeqID_94289
atggagatgcaggggacttatgaagcatggctacatgatttggtaattgggtacttgttaaaagaacaatggattcatgacatggatatgactctaattaatgaccaaatagaaagcacaagatcaaccatatttggctcagctagtaacatccattccaatggtgaaaagcaatccgaaaatgttgctcatataccttctgttggaaacaaccaaactcccaaggttgctttacttcacaaattaaaatattctttcccttttcatggagaaatatggctgaaaaactacctttatgttgcacttttatttttgattcctgaaacttctttcaattcccaccaggtgaggaaaccatataccattactaaacaaagggagaagtggactgaggaagagcatcaaaagttccttgaagctttgaaattgtatggtcgtggctggcgccaaattgaagagcatataggtaccaaaaatgctgttcagattcgaagccatgctcaaaagtttttctctaaggttgtgagggaatctgagggcagcgctgagagttctatacaaccaattaacatacctcctcctcggcctaagaggaaacccctgcatccatatccccgtaaatcagttaactctttcaaaggacactgcataccaaatgaaacagaaatatctccatctacaaacctgttagttgcagagaaagacaccccatctccaacctcggtgctatctacggttggttcggaagcatttgggtctcaattttcagagcagactaacagatgcctttcaccaaactcttgcaccactgatattcactcagtcagcttatcacctgctgaaaaggaaaatgattgcatgacatccaaagcatccgaggaggaagagaaagcatcaccagcttcacttcctttatccactgtttctaacccaaacatgtgcatgaagcctgagtttagttccaaggacactttcatagaagatgctgccaatatgccacaaaccactagtattaagctttttggaagaacggtctctatggtaggtaatcagaagtcactgaacatagatgatgatgatggtaagccaataactgtgaagtctgatgaagtagatgatgttgagaatgagaagcttggccaatcaggagaatccaagcaagtagatacacaattatcacttggtgtggttagtggtaactggattataacacctgatgctgatggagctaatacaaccagcatagagcccccaaaggagaacctatgcttcagtgaatgtgcacctgatgcatcttttccgcagtggagtttgtaccaaggccttccacctttctacctgaggccatgcaatcaggtcctaaatcccttgcctcttaggccctctttgaaagtaagaacaagagaggaggagagttgttgcactggttccaacactgaatcagtttgtgacatggaaaaccaaggcaagaactcagatgctgttgattctaagtgtcaaaaatatcacaaggaaggagctgcaccccagaagcgtgcaagggggtttgtaccatataaaagatgtttatctgaaagagatggaaattctttaattgttgatatggaagagagggaggggcaacgagctcgtgtgtgctcatag

SEQ ID NO: 2605 - DNA, 210 bp, Glycine max
  Peptide Sequence Number=SeqID_94290
atgaagaaagagagaaaaacaaaagctccgccacgtgccgccgcgaaacggcggtgcaccggtgactccaaaaccggctcctcatttaaggctcaactggggcacacccctccctggtgtgatcatcatcgtcttctgtattcagcagcatcccttgagatttgccataactcactctctcaccctcccaaatcatgccgctatctttga

SEQ ID NO: 2606 - DNA, 882 bp, Glycine max
  Peptide Sequence Number=SeqID_94291
atggctccttctttagttcgattatatgaacaaatgcccgaacctaaatatgttattgctatgggagcatgtacaattacaggggggatgtttagtaccgattcttatagtactgttcggggcgtggataaactaatcccagtggatgtctatttgccgggctgtccacctaaaccggaggctattatagatgctataacaaaacttcgtaagaaaatatctcgagaaatatatgaaaatcaaatgagttctcaacgagagaatagatgttttacaaccaaccacaagtttcatattggatacagtactcatactggcaattatggtcaagaattattctatcaactgccatctacttcagagataccatctgacacatttttttttaaagagaagcaaaaaaatgcaaggtcgtttgtcttcttggctagtcaaacatggactgagtgcgatagatcattgggtttcgattaccaaggaatcgagactttacaaataaagcccgaggattggcattccattgctgtcattttatatgtatatggttacaattatctacgttcccaatgtgcctatgatgtagcaccaggaggactattagctagtgtatatcaccttacgagactagagtatggtatagatcaacccgaagaggtctgcataaaaatatttgtcgcaagaaaaaatcccagaattccttccattttctgggtttggaaaagtgcggattttcaagaaaaggaatcttatgatatgttgggaatctcttatgataatcatccgcgtctgagacgtattttaatgcccgaaagttggataggatggcctttgcgtaaagattatatcgccccaaatttttatgaaatacaagatgctcactaa

SEQ ID NO: 2607 - DNA, 463 bp, Glycine max
  Peptide Sequence Number=SeqID_94292
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcggctcctcgtgcgctctctgttcctgcctttcggttaccggtgtcattccgctgttatggccgcgtttgtctcattccacgcctgacactcagttccgg

SEQ ID NO: 2608 - DNA, 162 bp, Glycine max
  Peptide Sequence Number=SeqID_94293
atgtattctataattggtgcctatgttataccaatcttagttccgaaatttcaattgaaaattactgtgaaaacaagtgccaaagctagagggaattggaaggaggattggtgccatcccttgaagaatttgagtcaagaagaaaggggccaaccaccttaa

SEQ ID NO: 2609 - DNA, 600 bp, Glycine max
  Peptide Sequence Number=SeqID_94294
gactacgacgaggcttctccgcgtgcgtgcaagtggattgctacgaagaagaccgtgaagagcattcgcacgctgtcgtacagggagcacctggaccgactccggattccggatgtctgttggatcccttatggggagcatcgggagttccgggacttccacgtcagatcatgctattctggtctcttgcgctgggggcctattgttgtttattaccgaccggagagggtcttgcggcagtttggctacacgcagaccattcctgctcctcctatcgattcatgggtctcgtatgatgatatacacgataggtggatgcactacgaggatcatatcataccagcaggtgaggccccgcagacgaatatccctcgcgtgccggagccaggagcatcgtcgacatttgcggaggagcccagacatgcagtggaagtttgtgatgacattgctaagaggttggagtgccatctgagtctaggggtggtcacgcctggctcatcgacacatgaggtgatcgaagaatgcctcagattggccaggagtgtgacacaggaccatctagtatacgttaggtgtagacgcaggcggcgcactgattag

SEQ ID NO: 2610 - DNA, 399 bp, Glycine max
  Peptide Sequence Number=SeqID_94295
atgggcaccatcaagtacttgaccatggatgaattaaagcgcctaagcatccccttagaaatgcttagattctttaaccactctattttcccccaccagggacatccgacaagggacatccaacaaggtcaatgcaccccccacgaacatacaaaacatccaacgtatgaaacatgggcaccatcaagtacaatgaccatggatgaattaaagtgcctaagcatcccctcagaaatgcttaaattctttaaccactctatttcccccaacagggacatccgacaaggtcaatgcaccccccatgaacatacacaacatgcacatgtcaatgcatttccaacatcatcaacattccatttctatattattctcaatataaacattatctcatctcaatga

SEQ ID NO: 2611 - DNA, 156 bp, Glycine max
  Peptide Sequence Number=SeqID_94296
atgaaggactccttgaagcaaagttggtacattgatagcggttgctccaaacacatggtaggagatgcatcaaagtttattcatatttctcccaaaaatagtggacatgtgtcctatggagacaacaacaaagggggagaaatagaaaaaagataa

SEQ ID NO: 2612 - DNA, 204 bp, Glycine max
  Peptide Sequence Number=SeqID_94297
atgaccattgaatttctcgagatcttacgtggttcaatttcaggctactccatatgtgatgtgcttaaatcggatatccgagtgaaaggcgaaaggcccaagtggagaagggcgaaggcccaagtggagaaggataaagcccccgagtggagatggatgaaggcccaagtggagaaggatgaaggcccaagtggagaaggatga

SEQ ID NO: 2613 - DNA, 339 bp, Glycine max
  Peptide Sequence Number=SeqID_94298
atgacgcgtggtggtaactcggggtcgttgaatcacaacatcggttttatgaccgtctttgaagggtggtttttccacatcggttgtatagctacaaccggtgtagaatgcgtaggtttctacagcggttctaaggctgaaaacggtgttgaatgggtaggtttctacatcggttatcaatcaaccgatgtagaaaatgaaaggtttttacatcatttatcgtcaaaccgatgtagtatgaggagattttctacatcgtttatcactaaaactgatgtagaatggatacgaatggaaaggtttctacatcggtcttcaatcaaccgatgtagaatttga

SEQ ID NO: 2614 - DNA, 288 bp, Glycine max
  misc_feature (214)..(214): n is a, c, g, or t
  Peptide Sequence Number=SeqID_94299
atggacgaatcatccaggaagcgcaagggttcatctaccttcgctatgacaactagaacacctcgtcccggagccaccggagcatccctagcaccaattccaccttccttgtcatcctctacactattttcatctgatgaacaacgtatccgctgcattaatgaatcggccaacgcgcggggagaggcggtttgcgtattgggcgctcttccgnttcctcgctcactgactcgctgcgctcggtcgttcggctgcggcgagcggtatcagctcactcaaaggcggtaa

SEQ ID NO: 2615 - DNA, 336 bp, Glycine max
  Peptide Sequence Number=SeqID_94300
atgaaatcagtcaccaaaactgcagagggaaagccacctcagcatgggcctcagtggattgaagcaaagagtcatgttcaaacaggaaattacgagtgtggatactatgttatgcaatggatatggtgcatcgtaagtggtggattgaaggatgactggattcacggtggtgctgacaaggactacaaggaggtacccccacctcctttgtttaaacttgcagggggacacatcaaccaagctgtgaccttcaacagatcttattacaaggttcaaattataggacaattgtgcacgtactataacctgaacagccatccacaaggcttgggttaa

SEQ ID NO: 2616 - DNA, 512 bp, Glycine max
  Peptide Sequence Number=SeqID_94301
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccaggcatgtatcgtgtgcttaatatacctgaagatgaagctgttctcttgaattctagggagaaggcaccttacctgatctgtgtagaggaggcatccagttctcagaaactttctcaagggggaatccctttggcaaatggagatgctctcatgcaaaaacggctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactga

SEQ ID NO: 2617 - DNA, 1138 bp, Glycine max
  Peptide Sequence Number=SeqID_94302
atgacggcgcgggatttgtcgcggcgaagtcaaaagcgaccgtggtgccactgcgtatcgaaggcgcgagagcggagccacttcagccgcctgaaagggctggtgaagcagcgtctgttcccaaaaattaccctgcatattctgccgccaacgtcgttaccgatgcccgatgcaccgcgtgcccgcgatcgccgtaaaattgccggagaaatgctgcaccagattatgatggaagcgcgaatggccgttcgtccgcgcgaagaggctaccctgtttgtgggccgcattcttgaaaaatacagtaagaagggtgaaaagattggcctgatgctgcctaacgcgggcatcagcgcagcggtgatttttggtgcggtgtcccgcggccgtattccggcaatgatgaactacacggcgggtgtaaaagggctgaccagtgccatcactgcggcccaaatcaacaccgtttttacctctcgccagttcctggataaaggcaagctgtggcatctgccggagcaactgactcaggttcgctgggtcttcctggaagatctgaaggcggacgtgacgacgggcgacaagctgtggattttcgctcacctgctgatgccccatctggcacaggttaaacagcagccggaagatgacgcgattatcctctttacctccggttcggaaggcaacccgaaaggcgtcgtccacagccacaagagtattctcgcgaacgttgaacagatcaaaagcattgctgactttaccgccagtgaccgttttatgtctgcgctgccgctgttccactcctttggtctgacggtgggcctgtttacgccgctgctgaccggcgcagaagtgttcctctatcccagcccgctgcattaccgcattgtgccggagctggtgtatgaccgtaactgcaccgtcctgtttgggacctcaaccttcctgggtaactatgcgcgtttcgctaatccatatgatttctatcgtgtgcgttatgtggtggcgggggcggaaaaactgcaggagagcacgcgtcagatctggcaggacaagtttggcctgcgcattcttgaaggctatggcgttacggagtgcgcacccgtcgtctccatcaacgtgccgatggcggcgaagccgg

SEQ ID NO: 2618 - DNA, 304 bp, Glycine max
  Peptide Sequence Number=SeqID_94303
atggggacaaatcaaaacggaaaaagattctatcaagtcaagattaagggcctagatgtcaccagcctaaaggagttgggatggttgatgggacccctccaaaggcaagccttccgcaaagtgtacggaaagattttagatttgaccacagcagagatatttacgaaagccgttgtatgcctcgcccaatactatgaccagccgttgagatgcttcacgtttggggacttccaaatagtaccgactgttgaagaatttgaggaatatcaagacatctttgagtggtcataccaagacatgccag

SEQ ID NO: 2619 - DNA, 1116 bp, Glycine max
  Peptide Sequence Number=SeqID_94304
atgccttcgcttaaaaagaagttctatcaagtcaaggttaagagcctaaggatcaccagtctaaaagagttagggcagttgatgggtcagctccagtggcaagcttttcgcaaagcttacggtaaaatctgggacctcgccatggtagaagtctctacagaggccattgcttccctcgcccagtattatgatcagccattgaggtgtttcacctttggggacttccagctatcacctatggtagaagaatttgaagagatcctaggatgtcctctagggggaaggagaccatacctcttctcagggttctatccctcattagctagaatttataagatagtccaaatctcggcgcaggaattagaccacagaaagcaagtcgaaaatggggtggttggaataccgagaaaatatttggaggaaaaagcaagaatcttggcaggtaaaggcgaatgggccccgttcatagacattctcgcactgttgatcttcggaggagtcctctttctgaatgtggatgggttggtggacctagcagcgatcgacgcttttctcgtctatcatgaccacaaggaaagcccggttgtcgctatgctagccaacctatatgacaccttcgaccgaagctctttatgtttggttggtttcgcacctttttcgtcaagaattaaggcatgcttgcccgctagaagtcactgttcatgcacagataaaggaggtgcaaattgggaccaactcttagcaaacaaagaaggagcgtctatcaactggttccctcgacggaaagaaggaagaatcagagttcttatttcgtgcggaggatttccgaatgttcccttgatggggacgaggggttgcatcagttataatctcgttcttgctataaggcaacttggctaccctatgagagggccaccactagaggaagagatcgcgcctgtcatttcacgaggtttcaataagaccaacgtggagacacttcagaaggtccgcaaggcatgggaggtggtgcgaaagaaggacaaggaacttaggggcagtaacaatgggctcatcggtggctaccgtaagtggttgagagcccacatgcaaggttggattggctcccaagtttga

SEQ ID NO: 2620 - DNA, 327 bp, Glycine max
  Peptide Sequence Number=SeqID_94305
atgtacatctgtttgatgttgtctcctggactactaaaccccgatgtctcatgcatgttcagcctaatcctaatcaagcatcatcgacagatgtctcttgttggactaaacttaaccagaagcgcattaagacataacataacaaaattagcgccagtcttcttgctaagcctaagggttaaaggcgatgcgctaagcgagttcacactcgctcaacgcctctgtacaactaatccttcttctagattcttctgtgtgcttagccgaaggatggtgcgcttagcggatgactcgcctagcgcgtggcctggctcagcgagttcataa

SEQ ID NO: 2621 - DNA, 123 bp, Glycine max
  Peptide Sequence Number=SeqID_94306
atgcatattgttgtggtaaaacacgggcaggatcatcttgagctaccttctggggtacatagggacggatgcaagtggggatggggtcacgaccgaccgatcgttgccccttctctgtgctaa

SEQ ID NO: 2622 - DNA, 312 bp, Glycine max
  Peptide Sequence Number=SeqID_94307
atggctcaaaggaaaacccattctcctatgtttcaggatgtgaaagaaattggagtgtgtttgagcaagcttgagcacaagaggttgcatgatttggtgtttgtcaaatacaaccaacaattgaagcaaagatataatgcaagagatgaaattgatccaatttctcttaatgatattgatgtgtgcaatgaacggatcgtgggagagatggatcaagatgatgataatgatgctggaaatgatttggtatttgaagatgatgatgctctaaattgggcaactgtgtatcaggcttcgggggttggagtgtag

SEQ ID NO: 2623 - DNA, 278 bp, Glycine max
  Peptide Sequence Number=SeqID_94308
ggccaaggacaaggtagaggaaagtatgcgataatagctaaaacccaaaggaataggggagcaatgggggataagtgggaagggctatcaaaggaattaattcaaggtaggctcatttggctagaggcttataagaacaaaatgcctaaatcatctcccaacatgcatgtgaagcaagaagtatcaacaagagtcaagccaaggctattgtgcaagcaatcaatggggcaaaacacaccgaataaaatagatgatgatggctcaaattctcaccaagg

SEQ ID NO: 2624 - DNA, 294 bp, Glycine max
  Peptide Sequence Number=SeqID_94309
atgatcatgaggggtcaagacaactatagtagccaagaggaggctacttcttctccttcgtcaagtggaagtgagggtgaagccaagggtgatgagcatattgaagaggcttacccctatgaagatggtgatcttctaatggtgagaaggatccttgggagtcaatcttgtgccctaacccaaacccaaagagagaacatctttcatacaagatgcaagcacaaggttggtatccaagttgagtctcactcttatttcccacccaaagccttacaagcttcaatggctcaatga

SEQ ID NO: 2625 - DNA, 449 bp, Glycine max
  Peptide Sequence Number=SeqID_94310
aagtgtctgtgaagccattgcatccctcgctcatattacgactagccgctaaggtgcttcacgatcttgggatgcccactaggaggaaggaagtcgtatttgttttctgggttataccccttcatggcaagagtagcgaaggtggtcaagatctcgatgcaagaattggaccgagggagtggacttcattcattgatgttttagcacttttggtgttaggggtcgtcctctttccagatatggatgcgctagtggatctagcggcgatcgatgcttttcttgcttatcaccacaccaaggaaaacccgtctgtcccctacaaggtcaccgcatgtgcaccgggaaagggaaagcaaattaggagcagctcttggctggaagagagcatcatgcctttcattgcacaaggtttcagtgatcccaatgcaagaatgcttcaaagagtctga

SEQ ID NO: 2626 - DNA, 426 bp, Glycine max
  Peptide Sequence Number=SeqID_94311
atggagaaaagatgcgcggagtcgccaccaacgtttatttgtggaaaacgtcggaaaaaccgaaggaaaccggtcataaagaatattccaagttcgggagttgtatttacgtttgaggaagaggaaaaccttcatggatttgcttatgcaaacatctcagaagtgttacggaagcacctcggcttggattttcttcacggaaacaatttttttcacccaaaacagttgaaatacatcagcagggggatctgggaccctcagaacagcccccttcagcctatttataggaaaaaaggggaggaggttgccgcccagctcgcccaggcgagctgggttgcttcctccagaagcaatccagcttcgaaaatactctggaagcccaatttcaaaatttcaaaattgctatttgcatccccccatttttga

SEQ ID NO: 2627 - DNA, 312 bp, Glycine max
  Peptide Sequence Number=SeqID_94312
atgtcaggtggtggtgaacatcaattggatagcgcacaaagattcttgttggatgctcccaatgctcaaatgcaaagactattgagagagaacaacgaggagttgagaggaggaaatggtggtggtccaaggccaaaccgaattgaagaagtcaagctcaacattcctccctttaaaggcaaaagtgatcagaaggcatatttggagtgggaactcaagatagagcatatcttctcatgtaacacctatgaggaggcccaaaaattgaagctagcagccgcaaaattcttgaattatgctcatgtgtggtag

SEQ ID NO: 2628 - DNA, 114 bp, Glycine max
  Peptide Sequence Number=SeqID_94313
atgaacaagaaaatggactggataaggagagagaaagtggcgagtttatggagggctgaatggaagggatttggttcaaagtttgaatgtgttggatggagaatgatggtttag

SEQ ID NO: 2629 - DNA, 204 bp, Glycine max
  Peptide Sequence Number=SeqID_94314
atggagttaaaccacacttttcaatcccaagaggtgcctctcaatgatggggaggactattgggatggttacttcaagatccgaagagggaaaaacgaatgtgggattgaagaggatgtaactgctggttggccttccaccaaaaacctcgtcatagaggttttttttacgagcattaaaccttactatgttgtggttgtttaa

SEQ ID NO: 2630 - DNA, 261 bp, Glycine max
  Peptide Sequence Number=SeqID_94315
atgggtgccaagtacctcgaagtggtcaaacgaggttcgcatcccaacaacggatggtccccggacaaaattagggcgcaaaatgaccataatttgtctctgcgtgtcttcgggcacgatcgagcttgggtggcaaggcgcagaatgaccataatttgtctctgcgtgccaccggacacgatcgcctctggatggcgaaaaggtgtggggaatgaccataatatgtctccgcccacctctcgactcactgtccctgaatga

SEQ ID NO: 2631 - DNA, 360 bp, Glycine max
  Peptide Sequence Number=SeqID_94316
atgatggcacatctaaaccccccatacttagccttttgcactcctgggcaaaatgaaataaagaaaaaaatccaaggatatcaaagagagacaaaccaaaacattcacatatttctcaatgaacatcaaggaatgaaagcttgtagtgagcttcaaaacaaggaaagggaaacaaggctcaaaagggctatcaaaggaattaatttaaggaagcatcaacaagaatcaagccaaggctattgtgcaagcaatcaatggggcaaaacacaccaaatgattatgatgatggatggctcaaattctcacaaaggtaaactcatcactttcaaattgagctttcaaaactatcatgacatgtaa

SEQ ID NO: 2632 - DNA, 315 bp, Glycine max
  Peptide Sequence Number=SeqID_94317
atggtaaagcatttgcacaagattaaatggcctaactctctaaaaaaacagtccccagtggagtcgccaactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgagatctacgaactttttagtgaaaggttcgggagttgtatttacgcacggggaagggtgtttccctttgctcctacgtattcctcaatttgggatgagaaaatcagacctacgtag

SEQ ID NO: 2633 - DNA, 555 bp, Glycine max
  Peptide Sequence Number=SeqID_94318
atgattctcatgtcccaatctagccagagtaatgtggtggaacaatttctgcagaatgctcaagtgggttgttactgtttaactgttggaacagttgacgaaatcattattgatgctccatggagttatgacagttgtcctaactgtaaaacgacatttgatccatcaaaaggtggctccgcttgtcgttcttgccataccagtgtggtcgatacagtaccacggttagccatgatcattttttgtactgattatttatttacacgctttgctgttttagcaaatttccctgaaatttctatggatgtcaaggatgcaacatgtatcaagctgtttggtaaaactgttggagaatgtcgagatgagttgatagcggctggggatgatattaaggtatttccaacgtgtgttgatgaaatcctgttgaaaacttgggctgtcagatttaagtttcgttcacaattacgccaatcatctgtgttggatgtgagtgaagaactccatcatattcaatcattgataaccacccttgggttgaaggtaataactaaataa

SEQ ID NO: 2634 - DNA, 465 bp, Glycine max
  Peptide Sequence Number=SeqID_94319
atggccaccgctgaagccttggaacgagaaaccaagaaggcccgaaaggaagaacacgaatcatcacgggtcaaaggcatgatcttgaaggacgagctaaaggcttaccttaggtcgaaaagaaatttgtcccaacagttaagcgagactgaagggaatatgtgggccgtcatcgatgagtgcaaagagaagctaaatcttgcggcgactcacgagcaaaggctagaggatgagtacgccaagatatcagctgaaagcgaagcaagggagagggtaattgattcatggcaccaagaggcaacaatgtggacggaccgatttgctcttactttgaacaggagtcaagaacttccccgattgctagccaatgccaaagcaatggcggacacctactccgcccccaagaagatcacggacttctcagctatgtcaacatatgatagacttaatggaccatatgattag

SEQ ID NO: 2635 - DNA, 268 bp, Glycine max
  Peptide Sequence Number=SeqID_94320
catgcgacagggacaggcagatatcctcatagctaggttccctgaccctaactatggtgttaaaacgggttcctcttggtgtgggttttcaatggagaacaatgatggtttgtggtggctaatggtggatgtgggtgataccaaatttcgagaagatccaacggttaatgaaggctgggcagcgtttttaccgaggcagctacatgtagctttctctagaagcttcctcgtggcttctttgagaagctttctcaagaggcttctttga

SEQ ID NO: 2636 - DNA, 294 bp, Glycine max
  Peptide Sequence Number=SeqID_94321
atgaggacaacaaaagatgatgacaaaagtgatgaacacaaagctcaaagatcaaagaacaactcaagtgaatcaaagaacatctcaagtgaatcaagaacaagtcaagagttcaagaatcaagaagaattcaagactcaagaagaaagcctagaatcaagaatcaagattcaagattcaagattcaagatctcaagaatcaagattcaagattcaagatctcaagaatcaagattcaagattcaagatctcaagaatcaagatcaagattcaagactcaagattcaagaatga

SEQ ID NO: 2637 - DNA, 228 bp, Glycine max
  Peptide Sequence Number=SeqID_94322
attgattcatgtttgctgaaatcaatcccttacactaagaatgctttaagaaatggtttcctcaatcctgtgccaattgccaatagctttgagctcctcataattagatttggtgttgttcactgtagctcctttgatcaaaaatctggtccagttcctgtatccactgatgaggtttccttagtggggcaggcacttcacaccttccttgcttggacgacacatctg

SEQ ID NO: 2638 - DNA, 270 bp, Glycine max
  Peptide Sequence Number=SeqID_94323
atggaaccgattgcatccctttcccagtattatgaccagcccctaaggtgcttcacattcgaggacttccagctagtgccgactgtgaaagagtttgaagaaatcctgggatgcccactaggaggaaggaagccatatcttttctctgggttctatccctccacgacaagagttgccaaggtagtgaaaatctcagcacaggagttgaaccaggtaggcccgtctatccgctacaaggtcaccgctcgtgcgtcgaaaaaggaaaggtga

SEQ ID NO: 2639 - DNA, 339 bp, Glycine max
  Peptide Sequence Number=SeqID_94324
atggaggccaagaaagagcaaatggccacaatgatggaggccatgatgagcatgaagaagataatggaagccaatgcggttgcagttgccgctaccagcgttgttgctaaggaaatgatttggggagtacaggcggccccttatgatgtgcaaattcaaaacgagcacgccttcctgccatatggcttgcctcccaactatacaccacccaatgtggcgtacactcccgatgaggatgtcaataactccgctcccatactcattgagagccaacaacctcatcatgcacatgtctctcaacccatgggggagacacatgaaatttcccaccacatctag

SEQ ID NO: 2640 - DNA, 213 bp, Glycine max
  Peptide Sequence Number=SeqID_94325
atggatggacatagactatgctataagaaaagaccaatcgcctgcaatcacttatggaacgtaattttcattaagaccaaaatcttgcttaaggccattgatgaccagttcatcacttcagataaggctttagcaagcaccctgatcacgaagttctcctctcttcgactcactagtgtgaaaggtgtgcgtgagtacataatgcaaatgtga

SEQ ID NO: 2641 - DNA, 261 bp, Glycine max
  Peptide Sequence Number=SeqID_94326
atgaggcaaacaaaattccatattacaacaaataattgtgaagatgatgttgagacaaagacggatatggaaactctaacacaggaagaacttaaagcattgatgtctctgttgaagtccactgcattgaaccgtgttgataaggtgcagacagtacatacagtaaataatgtagcttttgtgcttcggttagcacttggcagaaataaagtagtgtggattgtgattctggagcctcagatgatatctgttgctccttga

SEQ ID NO: 2642 - DNA, 279 bp, Glycine max
  Peptide Sequence Number=SeqID_94327
atgacggagaaagagatgatcacaataatagtagacatattaccagtgttttactatgaaaaaatggtggcgtacgcaccttcaagctttgcggatttggtcttcgccggcgaaaggatcaaagtggccataacccctgccagggttcctcaacctccatttttccaagaatacgactcgaacgcaacatgtgcacatcatggaggagtctctggacattccaatgagcactgtatgaccttgaagcgtaaggtgcaaagtgtaattgatgcaggctag

SEQ ID NO: 2643 - DNA, 138 bp, Glycine max
  Peptide Sequence Number=SeqID_94328
atgaagaaacaacaatggaagagaagatgtagcggaagacaaaggagaagaggtgagaggaggccccatccactagggaataagccatggaagaaggagcttcaccaccaagatggcccttggataagaagcttgtag

SEQ ID NO: 2644 - DNA, 138 bp, Glycine max
  Peptide Sequence Number=SeqID_94329
atggaggatgaagaggacgaagatgtgggacttcccctggagttggagaagatagtcacccatgaggaccaagaaatggggcctcatcaagaagagacgaaaatagtggacttaggaaccagcaaagggaaaaaggaa

SEQ ID NO: 2645 - DNA, 375 bp, Glycine max
  Peptide Sequence Number=SeqID_94330
atgggaacaaatcaaattggaaaaagattctatcaagtcaagattaagggcctagatgtcaccagccttaaggagttggggcggttgatgggacctctccaaatgcaagccttccgcaaggtgtacggaaagattttagatttgaccatagcagagatatccatggaagccgttgtatcactcacccaatactatgaccggcctttgagatgcttcacgtttggagacttccaattagtaccgactgttgaaaagtttgaggagattctaggatgtcctcttgggggaagaaaaccgtatcttttctccgggtttcttccctccttgagcaagattgcagttgtggtcaaggattcggcaagagagttggatcgt

SEQ ID NO: 2646 - DNA, 228 bp, Glycine max
  Peptide Sequence Number=SeqID_94331
atgaatgttgaagaacggtcgagaatcttcacgggaggagcttgccacccagctcgcccaggcgagcaaggtggcttcctccagaagcaacagccttctggaggaaggatctggaaggcccaattttcgaagaagttacagaaattcacgaattgcacaaaaacacctcttttcgatttccgccacattacggaatttcacagatcgcgcaagcctgcttccttttga

SEQ ID NO: 2647 - DNA, 345 bp, Glycine max
  Peptide Sequence Number=SeqID_94332
atggagggaagtgagtcagaatgcagtgaagcaaaggctagttcttggacaagaaaggtgaaactttccagctttaatagaagcatagaagggggaactaatttaaaggaaaccaaaagtgatgaagcaaaattagcaagagaaataaagattgaaaaggttatggaggaagaagttgatccatcgataaagagggagaagcacaaggaaaatagagtgacgaatgtgggctgcgaagacgagtttcttgataacccaataacaggtttgatcaaaaaggaagttgaagctggtgatacaactgagcctcattcttttcaagtttccataaaaagattgttatga

SEQ ID NO: 2648 - DNA, 90 bp, Glycine max
  Peptide Sequence Number=SeqID_94333
atggataaaagcttgaaggtaggagaagatgagtggagggagggagagagaggggaacaaaattttaagagagagaagaggcagaatgag

SEQ ID NO: 2649 - DNA, 306 bp, Glycine max
  Peptide Sequence Number=SeqID_94334
atgataaaccaaatgttcataacggatagtaggaaaatagtaactgtcgcaacctacccttcggcgggagggcgacgcgtgacttgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgcgatgaggaaatcagacctacgcagttctttcttatcaagtga

SEQ ID NO: 2650 - DNA, 135 bp, Glycine max
  Peptide Sequence Number=SeqID_94335
atggaaaaggttgaaggtctgcgtattttgaagataagggtttgggagtcattcacgcacggggaagaggagagagtcgttaaggtgttggaccttgaaacgatcgtctcaagtttgaaaggcgagaatcgttaa

SEQ ID NO: 2651 - DNA, 222 bp, Glycine max
  Peptide Sequence Number=SeqID_94336
atgtatcttattgatttcaggattgtcatcatcaaaaagggggagattgtggaagcaatgtcttccaagattattttgatgatgccaaagaatcaagagttaagcaagttccaaagaatcaggagtcaaaaagcttcaagaatcaagtttcaaagattcaagttcaagaataatgaagtttcaagattcaatcaagtttcaagaatcaagattcaagaataa

SEQ ID NO: 2652 - DNA, 558 bp, Glycine max
  Peptide Sequence Number=SeqID_94337
gcccttcgtgacctcagtcagactgggaggtacgcctggggagtggctactctggtgcatatgtacaaccaactgaacgatgcctctattagcagcaatcgacaacttggtagtttcatcacattgttgcagtgttggatttacgagcactttccctcagtcgcggagtccactgctgatcaggactacgacgaggattccccacgtgcgtgtaggtggattgcgacgaagaagaccgtgaagagcatacgtacgccggtgtacaatgagcgcctggaccaactctggattctgaatgtctgttggatcccaccattcctgctcagcctgtcgattaatgggtgtcatatgatgatatacacaacaggtggatgcactactcggatcatatcgttccaacaggtgaggtgtgcgttgtgccaggtcagtgtgccagtgactacatggactgccccgattcgtcccttaagccccacgacggatatccttcacgtgccagagccaggagcaccgtcgacatctgcgaggcccgttgtggaggagcctagacatgcagtg

SEQ ID NO: 2653 - DNA, 176 bp, Glycine max
  Peptide Sequence Number=SeqID_94338
atgaaactggccaaatacaggctaaaggcccaagtggagaaggacgaaggctcaagtggagaaggacaaagcccccgagtagagaaggatgatgtgaacctgggtaggagcggatcgcttgatacaggttatagagtttggatgacgccacttccgatgaaggaagataagtcagg

SEQ ID NO: 2654 - DNA, 211 bp, Glycine max
  Peptide Sequence Number=SeqID_94339
atggcatcttcgtcgtcatgttcatcaaatattaaaattaagtctgacccgatcgatggtggtgacgtattatggatgcaagctaagcatgtttcagcacatgtttggaatggggaagaagataagaaattacacatcagacgagttgtccccacgtatcaaggggaagaagaaataccagaggaaattattcctctacttcggcaatctg

SEQ ID NO: 2655 - DNA, 258 bp, Glycine max
  Peptide Sequence Number=SeqID_94340
atggtttggcagtctccaaatcaaaaatcaatcttttccaaactcgaattcgattccttggtcacaatatttatcaaggtacaatcattccaatcgaaaggagaatttgtcccccacttaaacaatattgtcaagccattgcatgataggctaaagaaaaatccgcctccttggtctgacctccatacccaaacagttaaagagggagatccagtacaaaaggaaaagaggttccattggctctaccagagccaataa

SEQ ID NO: 2656 - DNA, 351 bp, Glycine max
  Peptide Sequence Number=SeqID_94341
atgttggtggcgactccgcgcgtattcttttcttggaacacgcacctgcgagtcacgcgtcgccctcccgccgaagggaaagaacgcgctttacgactccattaccgaatgcgtgctagagctagagtaatgagtgaagaagaagacaaggtgcaagagcagataaaggccgacatagaggccttgaaagagaaaatggccacaatgatggaggccatgatgagcatgaagaagataatggaggtcaatgcggtggcagttgccgctactagtgtcgttgctaaggtggacctggctcccctatttggacttaaccaaataaatcatcccatctcggatatgatagggtag

SEQ ID NO: 2657 - DNA, 168 bp, Glycine max
  Peptide Sequence Number=SeqID_94342
atggagagctacatcctctgttggttcttccttgtaggccttggatcttcttcatcaatggattcctttgcttcttggaagatgaatggcagcggaatggagaaggaagagagagaggagatgccacttcaaggagaatatgagtctagaagaagctcaccaccatag

SEQ ID NO: 2658 - DNA, 165 bp, Glycine max
  Peptide Sequence Number=SeqID_94343
atggttgaaactagccaaataaacactaaaagaggtgtgaaagataagctcttaaggtggttggcccctcttctggactcaaattcttcaagggatggcaccaatcctccttccaattccctatatggcaacccacaaacaaggaaacaaagagacaagcaataa

SEQ ID NO: 2659 - DNA, 231 bp, Glycine max
  Peptide Sequence Number=SeqID_94344
atgactgtaagaccctttaaggacaatgggttaatgcgtgacaagtattatgatgaaatccactgtgggaaatctgacgagttgaattactttgaggagggagaggccctgacagactctttagagtctaggccttgggggtacatacacctggaacagatggttagctggatgactatagagaaccttatactagaggacgatgtaatactatgctctgataggatgtga

SEQ ID NO: 2660 - DNA, 420 bp, Glycine max
  Peptide Sequence Number=SeqID_94345
atggagtgtggtcatggaatgtattacacgccaacaacattttctgaatatccttcacagatgtatcagtatccttttgcaggtcatcatactgatatatctgagacctcacattcgttcggtagtgttgcggaaacacaacctcatttttcatggcccactatgactccttcacagcagcacgatgcccccatggcaacacctaacacctcatttgctccgcaatggaatgtacccggagcaatacctgatatgggcgacttattaggtgttgatttgcgtcaggagttttctgcagagggtgagcaagcagaagcggggagacaacgcggcgacagaagaaattttaatcgtcaagcacgaagatgggatcaaccatgtggcacatcttcacgacatcacggacaccataatgactga

SEQ ID NO: 2661 - DNA, 570 bp, Glycine max
  Peptide Sequence Number=SeqID_94346
atgtcacatcttagaactcactcccataggagagaaaaggaaagaaatcctcaagaggctaacattaacctcctatacttccatgggaaggacaatgtagaggctaacttagattgggaaataaaggtagagcaacaacttaaaaggaagtctacttcaaaatcttatggctctcactcttatccaatgaaagaccaaggtcaaggcatcttagtggtgacaccttctaagcccaaagatgataaagggaagacaatagaaaagcaaccccttaaggctagtatgcaagagaagactagctccatgaagtgctttaaatgtcttggaagagcacacattacttctcaatgccccaccaagaaaaccatgattatgaggggccaagacatttatagtagtcaagatgaggctactacttcaccttcctctagtgaaagtgaagaagcaaaatgggaagaatctagtgaagagatttacccccaagaagaaggacaacctttaatggttaaggaggagtgtaaagagggaaatccggtttgccggaaagtgcatcggatcgtcaagtattaa

SEQ ID NO: 2662 - DNA, 156 bp, Glycine max
  Peptide Sequence Number=SeqID_94347
atggctcaacctacacctcttgagaggactctaagggaaatggctgcacctgatttcacttatgaaagcttgtgcattcaataccctgatgaggatgtcccatatgttcttaaaactagtcgatccacttgttgcccaagtttcatggtcttgcag

SEQ ID NO: 2663 - DNA, 174 bp, Glycine max
  Peptide Sequence Number=SeqID_94348
atgtggtatcatatcatagggacaccagtcagggtcacagtgttttacgagaatgctccaccatatgggatcaacataggcttaaaagagcactcaaaccgggtgatccccaaggcttacactccgaagagtccatcaaggcctctcccaaggccaacccagaaaatattttag

SEQ ID NO: 2664 - DNA, 387 bp, Glycine max
  Peptide Sequence Number=SeqID_94349
atggaacacgcatcccgcgtgactcgcgttgccctcccgccgaagggtaggttccgacaacagccttccagtgttttgaggtgtaatggtggcccgagtgatgttggggaatggttacgagcccgcaaagacaacggcggcagaaccagcctgataagcgccagaggaaacggtgggaagtttgggttaggctataaacccacacaagcggacataaggaaaagcgttgcgggaagaaagagcgggggtcaaggctcgcaattgggacaagaagtcgaaggaggcccgtcctgccacatcagtaggagctttataagcgcgggtctaggacacgaaggccaagtcattgcgatatgcaaagattattcgccgagtgggttggatttg

SEQ ID NO: 2665 - DNA, 252 bp, Glycine max
  Peptide Sequence Number=SeqID_94350
atggctggatggaatgatcatgcgatagctaatgcccttcaagccttagctcaggctatagggaatccaaacaggggagaagctggtggagctgttgagtaccaggggttggaccgcttccaacgaaacaaccctccttctttcaatggaggatacaaccctgatgtggaagatgcagagtattggtgggagaatacataccaatgcctagaggctaaatgtcaagatgtgacctgggatgtcttcaagagg

SEQ ID NO: 2666 - DNA, 240 bp, Glycine max
  Peptide Sequence Number=SeqID_94351
gaaagctgcaacaagatggtaattgtcactataaagtatacaagaaagatatgctcaagtggtctcctgacaaatctggccttgaaaaggcttttgttaatacagttgaccgtgttggttctacatctaccatcccaccaactggtaaaacgaccactgctacaatactacaaatttcaggggctctttcacgtgaaaagaaggaactacaaattcgtaagcaagatgtgaactgcgttg

SEQ ID NO: 2667 - DNA, 844 bp, Glycine max
  Peptide Sequence Number=SeqID_94352
ttggaactctacgtgccgatcaacgtctcatttcgccaaaagttggcccagggcttcccggtatcaacagggacacaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatacttgtcaagttaacgtcggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccagagatacttacagggaa

SEQ ID NO: 2668 - DNA, 768 bp, Glycine max
  Peptide Sequence Number=SeqID_94353
atggaaggaaggaaaagaaggagtccttttctcatgtgggaagatacccaaacattccgctggttaggaacgaggggttgtattaactacaatcccgcgctcgctataagacaactagggtaccccatgaggggagcaccgacggaagaaagcatgtctcctttccttgtgagggatctcggcgcacaaaattccaagactatacaaagaatccataaggcatgggaaaccccgttaaggaaagatcaagagcttagaggcattcgtaatggcatcattggtgggtaccacgaatggctgaaagttcgcatacgaggtttagattggctcgccaagttaaaagtcgtcagcgaagagaattttgaagcaccggaagaggacgaagaagtccaagctctcaaaagcgagttaggaaaggcaaaactcgccaaggaaaagttcaagttggctgctacacacgttcggaaggagtgcgccgggttacgggaagagaatgcaattaccgcaaaagcccttgaacaagagaccaagagggctcgcaaggaagagtatggccggcacaaatttcgcggagctctatggggtagcaataatgaactcaagttgcgaagggaagaaagggaccagtcgcgagcacatagcatggttctgaaagaggagttgattgcttgttcaaggtccaaaagaagcttgtctcagcgtctatgcgagacagaaaccaacatgttagctatcatcgccaagtaccaagaagacgcttgggtctag

SEQ ID NO: 2669 - DNA, 387 bp, Glycine max
  Peptide Sequence Number=SeqID_94354
atgacactaaatgatcatactgacgtagtcacatcccttatctgttgggatcaatatctgttgtcaagttcatctgaccgcacaattaaggtctgggcttgcattgaagcaggatctttggaagtgatatatacacacaccgaagaaaataaagatgtggcattgattgagttatgtcctggtggcctcttcttcactggagatgagagtggtttgctgatggtgtggaaatggttggagtctgttttcaaattctttctatcattatcaaagaaagatgtggcattgattgagttaggtcctggtggcctcttcttcactggagatgagagtggtttgctgatggtgtggaaatggttggaggtacccaaggtggcatcctcttga

SEQ ID NO: 2670 - DNA, 267 bp, Glycine max
  Peptide Sequence Number=SeqID_94355
atgcatgctcaaggtattgtgccaaaaatacacatgtccatattcaagcaagggaatgggggcaatgtggcatgccccattatttcagaacacaacctaggcttaaggccatcccttacaacccctcaattcaacaaaaacaagcaacaattcaaggataaatccctcacgtttttgagcaaatacatgcaacttagagcaccaaaatacatcaatggaaagctagagagcccaagaatgaggtacttacttgttggagatgaataa

SEQ ID NO: 2671 - DNA, 57 bp, Glycine max
  Peptide Sequence Number=SeqID_94356
ccttgggattcgcgcaaggcattctgttagactattattcagagcttagggtttatg

SEQ ID NO: 2672 - DNA, 699 bp, Glycine max
  Peptide Sequence Number=SeqID_94357
atggcttctatcacggaggccatgctaaagcttcagaaaactatagaggataatgccatggcgaccgcctccaatacagctagggaagcggaaccggtgctacagccagcaataaacttgggccgagatagaaacacgacggtgttcggtcggaggtatagtcatcacgcttacccttatggcttgcctctggacttcacttcccgtaccgcttcggacgatttgagccaagcccctaccttcgaggggcaactccctccttatgccgactatccgctgcaagaaaacgatgaagaagatgcccatctaggccctctactgcccctcaaggatccggccccccatgaattgccccaaccaaacatagtccgccatgtcccgtctccacccgcacccgttaaagaatctgttccctttgcaaaagataagggaaagattgatttacttgaagagaggccgagggcggtagaaggcctcgcaactacccgttctcgaatttggcggatctctgtctgggacgacatgtctaaaaggtcatcttcggatgtattgccgaaagatgggggcatattctacggacgaaaagctgttggtgcatttctttcaagacagcttagccggagcagcaatggcatggtataccaatctggaagcttctcagatccggtcatggaaagacttggcaactacttttattag

SEQ ID NO: 2673 - DNA, 174 bp, Glycine max
  Peptide Sequence Number=SeqID_94358
atggccgaagaatttgtgaatgactttgttcatcaaaacggcatcgctgtcataacacacaatccccccaaagcgattccggctccatgtaccgcaacacattcacctcaggcgatttcggctccatgcccacaagttgtgaagacgagtttttaccacacacattcacctcag

SEQ ID NO: 2674 - DNA, 802 bp, Glycine max
  Peptide Sequence Number=SeqID_94359
atggagttgtggtttctcggccaaggtcaccacaaccacttggagaaaagtgttgatgctgtcccaaatgataaaagacctgagtgggaaaagctggattatcaactctgtgttgttttatggcaatcagttgagccaaatgttttagagatccatagatcattcaaaacatgtcgttctttttgtgaaaaggcccaagatatctttgccaatgacatccaaagtctgtttgatgcgactatgaaggttacgaatctcaagcaaatcagccatgacatgattgcacatatgggaaaagctagggctattgttgaagagctgaagaggtttcttgtggttgattcattagaggaaatcaagttccttcaatggactctctcatcaccagacttcttcgtgcctcatgtattgaaggatgaaaatcttgttgatgttgtggaagcctcagccatggttgcatctcatgggagagggggaggccataacaataaaggaggtggtagtggaagagaaaaagtagcactagtgtctaagttagagaaaccagagtccaaattctctgatgaggagtatcaagagtatttgaagctcaagtccgagaaatccagcaatcaagcatcatcttcatcggtaccatgtttctcaacagcttgcgtttctcagtccattgcttggatacttgactcaggtgcctctgatcatatctctggtaacaagtcatccttttcatccatttctttctcaaaaattcctcaccttgttactgtagctaatggctccaaagttatgtctcaaggaagtg

SEQ ID NO: 2675 - DNA, 201 bp, Glycine max
  Peptide Sequence Number=SeqID_94360
atgttaggacacaagtattgcatactgggcaggttgtcatctgaagttggatggagctactatgataccatcagggatgaaaagtattggccattgatgcccgcattgccttcatatgagtatggaagggagcatcctggtcctcgatatagcagtttaattcatggtcaaaatcttagagatgttgtcataacaggttag

SEQ ID NO: 2676 - DNA, 174 bp, Glycine max
  Peptide Sequence Number=SeqID_94361
atggcaaaagctaaaatcattaaaacaagccaaaatcttcataatcatttaatcaaacaccttgtagtacaaagtggtaacgttgaagatgcaattgaaaaattgaatgacttaaatccagagatactggatacaactccccaattattttccatcttcaacaacaacgattga

SEQ ID NO: 2677 - DNA, 147 bp, Glycine max
  Peptide Sequence Number=SeqID_94362
atgaaaaagaaaggtggggtgtattggaagtctccaagagacccccaaacctctatttgtaaaccgtgtagactaagtgaagagctagctgggacctccaaagggttgtccaagctttcacataagaaaccatctagcttgctttaa

SEQ ID NO: 2678 - DNA, 279 bp, Glycine max
  Peptide Sequence Number=SeqID_94363
atggaaatttatgtgagtgatcgactaggaaaaaatgatgacaaaggtgatgacaaaaagctcaaagatcaatcaaagaataactcaagagaatcaaagatcaatcaaagaacaactcaagtaaatcaaagagcaatcaagaacaattcaagagttcaaaataagaatcaagaagaattcaagactcaagaagaaagtctagagacaagaatcaagattcaaggttcaagatctcaagaatcaaggatgaagagaagactcaatcaagataagtattaa

SEQ ID NO: 2679 - DNA, 471 bp, Glycine max
  Peptide Sequence Number=SeqID_94364
atgccgttcaagtataaggtgcaacacctaataaatgtcgactggctatcattccaagaggagggccccaaagttaaaaccaatccactagccagtcatggaggggctagcgtaaacgccatcgaagaggatgggccatcaggggcaaagagattagaagatgtggctacatcaagacagttcatctaccagtcgttgcaagcagcatgcatggtctctcgtggcggagacgaaagggacaaatgtttgtttcatctcagggaatcacacgacatggaaacctatcctgcggtggaagagttaattcaacgactcatggacagggggcagctcgaagtgtccaaaggagatagggaagaaccacagatttgcatgcagtcggaagaaaagaaggttcccccaacccccaaagccctagtaatatgtttcgctaggaaaggcaccggctccaggcccattgtcataccctaa

SEQ ID NO: 2680 - DNA, 468 bp, Glycine max
  Peptide Sequence Number=SeqID_94365
acttgtcctaaaaagaaggaacaatgtgcagactttgtcatagaaatcatagttaggaccagaggattaggtcgtgccttaggtcacgttactggcagaggtgtgggcagaggagatcgtgatgattctgatgatgctctacagcgtcgacggcctaccgcatccacacggaagcagcgagtacctgtgactgcgacgcacgatgagccagtggtccctgcaccagatgtagaggctgacgtatttctggatgacccgatggcaccaactgatgtagacactagggtagacattcttgcagacacaggcgtgcaggctgctgaggatgagcatgagggatttccgggtggtccgagcgacccatccgtgctgacccagtatgaggatcacgttgcttgcagcgtatggacgggagaggagcgtcctgagttgaagttatcctctcacgggaggaagtccatagtatag

SEQ ID NO: 2681 - DNA, 768 bp, Glycine max
  Peptide Sequence Number=SeqID_94366
atgacagatcttgtgagcgcggaagatgacggcgcagaagacgacattagtcaatgcgtgctatcaggcttttcatcttacagacagcaaaaagtttatacggataaccactcgggtatttacgcccgtcagcgtgactcaaaagtcagtatgacagatcttgtgagcgcggaagatgaccaacaaaaagtttatacggataaccactcaggtatttccgcccgtcagcgtgactcaaaagtcagtatgacagatcttgtgagcgcggaagattacaagacgacgttagtctcctgtgctatgaggctattcggcttacagcaaccaaaagtttatacggataaccactcgggtatttccgcccgtcagcgtgactcaaaagtcactatgacaaatcttgtgagcgcgaaagatgacggcggagaagacgacattagtcaatgcgtgctatcaggcttttcatcttacagactgaaaaaagtttatacggataaccactcgggtatttccgaccgtcagcgtgaatcaaaagtcgcagaagacgaagttagtctctacgtgctatcaggcttttcgtcttacagacagcaaaaagtttatacggataaccacacgggtatttccgcccgtcagcgtgactcaaaagtcagtatgacagatcttgtgagcgcggaagatgacgcttttcatcttacagacagcaaaaagtttgtacggataaccactcgggcttgtcgtgcgcgattgacgaagggcgcagaagacgac

SEQ ID NO: 2682 - DNA, 522 bp, Glycine max
  Peptide Sequence Number=SeqID_94367
atggagaccatgaaggatcagatgacctccatgatggaggccatgttaagtatgaaaggaatgatggagaacaatgcggccgtagttaccactaccagcgccgtcgtcgaggcggatccgacccatccatctgccataaaccaagtgaaccagcctatcctagacatggtgggtcaaggaggagatttggggcatacaccctttgctcagcctgtggcggaagcctgcgaagagcctcgagatcaagctctgggtgactttgaaccataccctatgttcgccactaagggaccggcgtgtagtggtatgcctcagcccaacactgtgggggctcctcaacaccggccgctacaagctctgcatttctcaatagggagactgcctccagcagtggaaggaagggagaaattggatctcattgaggagaggctaagggccatcgaagggattggtgattacccattcgccgacatggaagagttgtgtttagtgcctaacgttgtcatcccctcgaagttctag

SEQ ID NO: 2683 - DNA, 203 bp, Glycine max
  Peptide Sequence Number=SeqID_94368
gtgcttggtacccatcattaggcgaatttgtgaaattccgggaacgacaagtcatggtcacccgcgactctcgttgcaccctcattaggcgatttgtgaaatctgggaaaagtcatggtcacccgcgactctcgttaactgagaggagcgaaattagtgagtaccctaacatttcgccggaagtcaaaaaggggattgcttga

SEQ ID NO: 2684 - DNA, 184 bp, Glycine max
  Peptide Sequence Number=SeqID_94369
atggctaacactgtggccagacaagaggaagagcgtgtagagattgaaacgtatcaaggaagcatttttcaagttacctccatccatcatcagatgaccactgaagaggaaatgtctaaaatctctagtactccagaatactcctgctcggctactgctgactatgttagaggaatagagaaag

SEQ ID NO: 2685 - DNA, 270 bp, Glycine max
  Peptide Sequence Number=SeqID_94370
atgcgaggtaactcttcagcagggaatttagctccattagatttggagatagaagctacttgcaggagaaacaacgtagagagaaggagaaaagctttgcaagaaaggacagcacaaccaagtttgggagaagctcaatcatctgaatcatctttagcatttccaaacttaagggaatccaaagtaggtgcgtctgaagcacatatcatggttgaagatcaaccacggagggtgactcatgaggactattcaagctctatcgtgccataa

SEQ ID NO: 2686 - DNA, 277 bp, Glycine max
  Peptide Sequence Number=SeqID_94371
gttgtaccatctgtggtgaggctcatgaaacaggccaatgtattcccattgaagaaaacactcaagaagctcattatatgggaaatcaacagcgacaagggtatactcaaggaggattttcaggcttccaacagggtccttataatcagcaaggacagtggagctgtgatgataaggagtaaaaggtttgtggaggatgaggatgaggagagtgttgtgcataagaagaaagctgctgaaaagaaaggtactgatgacaagaaaaatgatgtgagag

SEQ ID NO: 2687 - DNA, 651 bp, Glycine max
  Peptide Sequence Number=SeqID_94372
atgacgtgcgtttttggagagttgagcacctttacgccgcgctgtaaaggttgtgtatcgaccccctcaaaacacgaagtcgacgccgctgaaatcccaatcatggacggcagcgccagtccgttcgtgttcttgctgctggatgccggcatcgaagaactgaactcggcgaataaattcctgcgtctgaaagagaccgtgcgtgttgaagatggcgacaaatgggccgagctgtccccgcataacgggttccgcctggacttcaccatcgacttcaaccacccggctatcgacgccagctctcaacgctatcgtcttgatttctcggctgagtcgttctcccgcggcctggccctgggcggcagcttcgactgcgccatcgtggtggatgactaccgcgtgctgaacgaagatggcctgcgtttcgaagatgaattcgtgcgtcacaaaatgctggacgccatcggcgacctgttcatgtgtggtcataacgtgattggcgcattctctgcgtttaaatccggccatgcgctgaacaacaagctgctgcaggcggtactggctaagcaggaagcctgggaatgggcaaccttcgaagacgaagctgaactgccactggccttcaaagcgccaaatttagtgctggcctaa

SEQ ID NO: 2688 - DNA, 345 bp, Glycine max
  Peptide Sequence Number=SeqID_94373
atggaaggaagactaagaaatttggctggcttagtggctgccacaggattaagtcctttgatcgcatgtttgttggacactggtgatcggagacttatgttagtatttgaaaagtggtggcataaggaaactagtagtttccatcttcctgtaggagaggtgactatcaccctcgacgatgtggcatcgttgctacatttttcgattataggggccttccgcaacttcgattctcttcatattgacgaagccatcttactattagttgaattacttgaagttagtttagaagaagcaagagctgaaacagtacaatgccatggggaatttgttaggctatcctag

SEQ ID NO: 2689 - DNA, 114 bp, Glycine max
  Peptide Sequence Number=SeqID_94374
atgaagaaaaaaaagaagaaaatcagaagaagtccagcccagcaaggcgctaagcgcaaggcatgcccaacgtgcaagaagtctttagtccactcaggagagggtaaagcctaa

SEQ ID NO: 2690 - DNA, 526 bp, Glycine max
  Peptide Sequence Number=SeqID_94375
atggcgaatgggacgccgccctgtagcggcgcattaagcgcggcgggtgtggtggttacgcgcagcgtgaccgctacacttgccagcgctgatgtccggcggtgcttttgccgttacgcaccaccccgagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacg

SEQ ID NO: 2691 - DNA, 628 bp, Glycine max
  Peptide Sequence Number=SeqID_94376
tgacagtggcactcgagctttctcaatggctgcactttcggataaacttgctttctgtttggtgtctgcctgtctggtgacagttgcacccaagcttttccaatggtgcataccttacagatataaagaagataatgatggcaatgtgagcaatgaattggaggtgcttgtggttagttcacaaaagggtcaagcattaatgttcccaaagggagggtgggaactcgatgaatctgtagaagaagcagcttccagggagtccctcgaagaagcaggagttacaggaatagttcagcatgaattgggccaatggagcttcattagtaaaagacttggaacatactatgaagggcacatgtttcctttgcttgtcaaagaacaacttgacttgtggcctgagaaagatctaaggagaagaatatgggggtggcgcatgagtcgaggaggaggaagtgaccttcttgcgggtgtttggccgaggtcaaggaagcgcagtggggtcgaggaattagagatgtgcaatggagtgagggtaagggaaggagacgcacggcagagtgagggtttgaaagggaagactttgaagtctaaagtctcaactctcaactcaaatattcaatctgtttaa

SEQ ID NO: 2692 - DNA, 794 bp, Glycine max
  Peptide Sequence Number=SeqID_94377
tggttgtagcagattatttctcaacatacgggaatgaagttttgcaaacaaatcttcgatctcttgagcggtctgttgatcaattgcttactaaggagatgtttatactttttcagtcatatgtctctaggactattaagctgagagtcgttgattgcaaagagatggccacgttctcagtttacacgattgtgaagtactatagtggaagtgtttggcgtgtgtcctatttcccatccacgttgccaagttgtttggttctgaataggtggtcaaaatctgccacagaaaatatcaaagataaatatgccgattctgcaatttattgggattcccaattgatggctaggtatgtcactctggttcaagtttctagagaagtttgcgaagctgcatactatgatgaagacgagtatgaaaaaatattgcatttcctatcaaatgaggttagaaggctaaagtcaaacaaaaatagtgaaccatctattgatgacaatgatgagcagcagggtcataattatgatgatattttataccctgttgttgttcaaactaaaggatgcggacaagttggaatagatgaatccggaaaacgaaggagaatccaaaagtatgggcaatgtggtggaagtggccacaataagcgttcttgcaccaatcgtcctcgaaatgcaaatgattatccacttgaaactaacttctggaagcatcatgcaattatagtagatgttgatgcaacgttgatagcacatgagttgaatgacgaaggcaaaaaggcatgggacattgtttga

SEQ ID NO: 2693 - DNA, 192 bp, Glycine max
  Peptide Sequence Number=SeqID_94378
atggtcatattgcttcctacagggagcaatagaacacagagcaagaaccacagaaagaagaaaaccaaaggccaaggagggaaattaacaagcctcattgcctcagagatttcgtgtagaaggttgagctggcagcagttggtgcagaggctgagctggcagcagagtggtggtcctccaggagctttttaa

SEQ ID NO: 2694 - DNA, 360 bp, Glycine max
  Peptide Sequence Number=SeqID_94379
atggctccaaagaagcttctctctaagagggcaacgaaggatgctgcgggagaaggatccacgatcaagagttggtcttttctcaaggagagacaggtccagttgagagatggagaatacattaagttccaagaggaagttgccaggatgcaatggactcaactcacagggcccatggctaaatatgacccgaaaatagtcatggaattctatgtcaatgcatggcccccagaggaaagggtcagggataagcgcttatgggtgcaaggccaatggatccccatagatgaagatgccattaatcagttcttcgggcatccgttggtcctgaaagagaggctacgttgcgaattcagttag

SEQ ID NO: 2695 - DNA, 258 bp, Glycine max
  Peptide Sequence Number=SeqID_94380
atgggatctagtcaggtgccttcgcttaaaaataggttctatcaagtcaaggtcaggagcctaggagtcaccagtctgaaagagttagggcagttgatgggtcagctccagcgacaagcttttcgtaaagcttatggtaaaatctgggacctagccatggcagaggtctccaccgaggccattgcctccctcgcccaatattatgaccattatcacccacggtggaagagtttgaagagatcctgggatgccctctag

SEQ ID NO: 2696 - DNA, 465 bp, Glycine max
  Peptide Sequence Number=SeqID_94381
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctaattcaaaagatgtcagggtgttacggtgaaaacctggcctatttcactacatggtttattgagaaaatgtttttcgtctcagcctatctctgggtgaatttcaccattttttga

SEQ ID NO: 2697 - DNA, 456 bp, Glycine max
  Peptide Sequence Number=SeqID_94382
atgtctcggaacttcgcaaatttcctaacgatgggtgccaaataccttgaagtggtcaaaccagggtcgcatcccaacaacggatggtccccggacaaaattagggtaacaatgtcgaatcataagagtactgagtcagcattaaagaaccttgaagtacagatgggacaactggccaagcagatagctgacaagtcatcaaacagctttggaacaaatacagaaaataatcctaaggaggaatgcagggctgtgatgaccaggagtaaaaggtttgtggaagctgaggatgaagaaaatgtggtagacaaggaacaactgagtgaaaagacaggtgctgaggttaagaaaaatgatgtgaagggtaaagagaatcaagaaaaaaggaagaaaataatggtccaaaataaagagatcgaggaccaagaaaaagaaaaagaaggagaaaaagaatag

SEQ ID NO: 2698 - DNA, 191 bp, Glycine max
  Peptide Sequence Number=SeqID_94383
aggaccttgaagaggacccaaaggagttacctcctgaacctgctatggatgcccctgacttaccagaggatgatgaggaaccgctccctgatgttgattcttcagaggatattatgccagcatctgaggcagactctacagaggagagtggccttggagggacaacgagtagtgacgactcttcatcatag

SEQ ID NO: 2699 - DNA, 783 bp, Glycine max
  Peptide Sequence Number=SeqID_94384
atggtttacaccaaccaagcagatatgaccgaaaggcttcatgccggttcattggcatttgaatgccgcatcatgcactacttgattgtgtgcatcctactccctagatcttccaaccttgcacaggtttctgaggaagatttgagaatcatgtgggttttcttaaccggtcatcaaatcgattgggcccatcttccctttgtcaaagtcaagagatccttctctatcggtgcaaatgtagtctcttccttcggataccacaaagagagggatggctcttgggtgaagaaggatgctctggtacaggctgatgaagaccattctccatcaccacattctcagagagatgactcttcatctcttatgcacaacattcttgacagactggatggactccacacctttgtcggagagcgctttgacttgctggatagccgtattgttgccatggatgcacaatttgcagggatggatacacatatcaccaagcttgaggaggatgattgtcatcgtcaaaaaggtggagattgtggaagcaatgacttccaagattattttgatgatgccaaagaatcaagagttaagcaagttccaaagaatcaagagtcaaaaagcttcaagaatcaagtttcaaagaatcaagattcaagaacaatcaagtttcaagattcaagattcaagaacaatcaagtttcaagattcaagattcaagaacaatcaagatcaagattgaagactcaagattcaagaaacaagagaagactcaatcaagataagtactaa

SEQ ID NO: 2700 - DNA, 93 bp, Glycine max
  Peptide Sequence Number=SeqID_94385
atgggtgccaagcacctcacgaggaccaaagaatggtcgcacgtcatcgagcaaaggtccccggacgaaattagggacaacattcctaaatga

SEQ ID NO: 2701 - DNA, 315 bp, Glycine max
  Peptide Sequence Number=SeqID_94386
atggaatcaaaaacgcggagaaaaggtgacctaaggctggaaaaccaaggaatcccacacaacaataataatttcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcgtggggaagggtgtttccctttgctcctacgtattcctcaatttgggatgagaaaatcagacctacgtag

SEQ ID NO: 2702 - DNA, 180 bp, Glycine max
  Peptide Sequence Number=SeqID_94387
atgaagaaacaatggagcagaaggagaagaggtgagaggaggtgccatccattagagaataagccatggaaagagaagcttcaccaccaagagagtgtcttggataaaaagcatagggaggaagcttcaatggaggaagagaatgagagagagaaagagatagagtggcatggaaattga

SEQ ID NO: 2703 - DNA, 312 bp, Glycine max
  Peptide Sequence Number=SeqID_94388
atgaggggcaccgtgcatgagcctcaagtgaacataggggccgatcaaaaaggactacacgtcctcgccaacagagggctgcacgccctcaccttaagaggactgtgtgtcctcactttcagaggactgcatatcctcaccttcagagggctacacgccctcgccatcagaggactgcatgtcctcaccttcagagggttacacgcccttgccatcagaggactgcatgtcctcaccttcgtagggctacacgccctcacctttagaggactacacgtcctcgccacagagggctgcacgccctcaccttga

SEQ ID NO: 2704 - DNA, 270 bp, Glycine max
  Peptide Sequence Number=SeqID_94389
atgggcaaggccactctgtcagtccccagacccgctccaactatagaacaaattaagcaagacaactctggtgatccaacgaccaatgttattaccaattggaaaatcaaagatggtgagttaatccaattggaattatctcccacaacacaataccaactgccaaaggtcaaagatcgtaaagataaacctgtcatggccactccattcaagacaacagatgttaacgaagaagtaacttccaaagacatcaaaagcctaatggaatag

SEQ ID NO: 2705 - DNA, 579 bp, Glycine max
  Peptide Sequence Number=SeqID_94390
atggtcatccgcgcacctttcgccacccagagacgatcgagttcgatggcacgcagagacaaattatggttattctacacctttcatcatccagaggcggcgagcccgatgacaggcggagacaaattacgttcattcgcgcacctttcgccatccagagacaatcgagtccggtggcacgcagagacaaattatggacattctgcaccttttgtaatgcggaggcggagagcccgacaacatgctgagaaaaattatgttcatccgtgcacctttcaccattctgagacgattgagtccggtggcacggagagccaaattatggtcattctgcaccttttgtcatccagaggcggcgagcccgatgacatggggagacaaattatggtaatccacacaacttttcgccatccagagacgattgagtctgatggaacgctgagaaaaattattgtcattctgcaccttttgtcatccagaggcggcgagcccgatgacatgcggaggcaaattatggtcattctgcaccttttgtcatccagaggcggcgagcccgatgacgtggggagacaaaatatg

SEQ ID NO: 2706 - DNA, 420 bp, Glycine max
  Peptide Sequence Number=SeqID_94391
atggagaggtggatagtgagtcatttaagagttcttatagttcctctagtgaagcagaggatgatggttttcttccaagaagatggacaaccattaatggttaaagagaagtgtaaggaggtaagtgtctcctccaagaggttagctaagaaggaaactcattttacaataaagacaaacattaaagaaactttccctcttagacaacctccacattttctcttttgcaaaaagacacttgttagcactgccacacctcttgggcttgaggttattcctcaagtaaaggagttgttggatgagggtttggttcgtgtcgagggaaggagcctagagtatgaagaacctcgggatttgaggtcaaatcctttccaaggtggaggggatgatgcaatcctaccccccaagggtattggatag

SEQ ID NO: 2707 - DNA, 426 bp, Glycine max
  Peptide Sequence Number=SeqID_94392
atgccgatctcccctggtagaaatatcagttgggatcgtgcccacaagacacacaatggacccggagaagtccaacagggccctcgggtttccagctctagctacgggcctctgtcagtcctacagggtgcccgtttcccccaacaagggatcgcacccgcaagacacctagtgggcccgaagaagtccaacagggtcctagggtttccagctctgattacgggcctctgtcagttctacggagtgctcatcgcccccagcaagttcatcaggccccctattaaccgggctttcgtcgagaagtactgcgcccccaggaaggcgcagggcgagacaccacagcagcctagggatggccggcagcgggcaacaaacgcactgccaccacctctagagttcacctcagcttatccacaaaaaggttag

SEQ ID NO: 2708 - DNA, 237 bp, Glycine max
  Peptide Sequence Number=SeqID_94393
atgcatgagaacgaatggcacggagcgcgtttgctcttttgcccctatttgggaacctataggacaatatctagggcgaaggcgaggctcacgggtgtgctttccaaaggaggaaagatgcgcggagtcgccaccaacgaaggtattagcacctctcacgtcgacaaaagcggtgctcttgctcctacgtaccctccatcaaagaggaaatcagacctacgtagttctttcttaagg

SEQ ID NO: 2709 - DNA, 254 bp, Glycine max
  Peptide Sequence Number=SeqID_94394
atggctcaacctccaccttgtgagaggactcttagggagatggttgcacctgatttcacttatgaaagcttgtgtgcattcaatatcctgatgaggggagtggcaaaagattggttgtactaccttgctcccagatccatctccagctgggatgaccttaagagagtgttcttggagaaattcttccctgcatctaggaccactaccatcagaaaagacatttcaagcatcaagcaacttagtggagagagctt

SEQ ID NO: 2710 - DNA, 605 bp, Glycine max
  Peptide Sequence Number=SeqID_94395
atgtcttctaggaaaagaaagagtgtcggttcaaggcacaccactcaatatgatacaagaagattccactcttttgaggcttggactagatacactgataatgtcctgggaagacatatattagctgagaggaaagtggaaatatatcatatagagctggatgaatttaaggctgaattggagaggcgtaacttccataagcgcctcacaaatttagctgacagtagcattgacctagcattgaaggagttctacaccaacctctacagtcctgagggaccttcaccaaaacaagtcaaaatacagggccacttgataaggattgatgcagacaacctcaatgtctttttagaaacccgtgtggtgcttgctgagggtgaatctttacccgcttactcaagatattgtaggatgcctactgacatcagggaaattgaggttgctctgtgcatacccggccgagggtttattttaaatgctgaaggtcaccctaggaagatcctcagaaaagatctaaccactcttgctcaggtctggagtgttctctcatactccaacctggctctgacttcccacacctcggatttgactgtggatagagctag

SEQ ID NO: 2711 - DNA, 194 bp, Glycine max
  Peptide Sequence Number=SeqID_94396
atgcttactacctcaaaagattggaaagccatttccaatgactcctctgcggcttccacgggacaacttccactgagtggatccatggacgtcccaaaagacagctgtcgcaacctacccttcggcgggagggcgacgcgtgactcgcgggatgcgtgttccacgaaaggaatacgcgcggagtcgccaccaac

SEQ ID NO: 2712 - DNA, 540 bp, Glycine max
  Peptide Sequence Number=SeqID_94397
atgggaccaaaacccggtcgtccctacgttgataccttgaaggggggtcagtttcctaatctaaaagaactgcgtgtgcagcatgcaggcatgcctgtcagagcctttttcgccttcgatccggtgcgccgtgcgattgtactttgcgcaggaaataaggctggctggataatggggacctacaagcaattactggcaaaacaatcacctgaaagtcagcagcgcatcgctgaaaaggtggaaaagttgcgtcaggaaatagccctgagccaattgcgtgaagagctaaacctttcgcaaactgaactggcgcgcaccatcggtgtatcacaaccaacgctggcaaagatggaaaatccggaaaacgatccgcgcctgtccacgctaaaacgctacgtcgccgcgctgggaggggaacttcgtattgatgttaaactgccaaacggcaaacattttgcttttcagctcgaccgcttctggcgtaagcaccggcagtccctgctgttgtcgcagtgcctcactggcggtgtcggcgttctg

SEQ ID NO: 2713 - DNA, 774 bp, Glycine max
  Peptide Sequence Number=SeqID_94398
atgaagaacttcatgactattatgaaggaaggcatagggcacatcctagacctcactcccattggagagaaaaggaaagaaagccttaagaggctaacattaacctcctatacttccatgggaaggacaatgaagtctacttcaaaatcttatggctctcattcttatccaaagaaagaccaaggtcaaggaatcttaggggtgagaccttctaagcccaaagatgataaggggaagacaatagaaaagcaaccccttaaggctagtatgcaagagaagactagctccatgaagtgctttaaatgtcttggaagaggacacattacttctcaatgccccaccaagaaaaccatgattatgaggggccaagacatttatagtagccaagatgaggctactacttcaccttcctctagtaaaagtgaagaagcaaaaggggaagaatctagtgaagagatctacccccaagaagaaggacaacctttaatggttaaggaggagtgtaaggaggtaagtgtctcctccaagaggttagctaagaaggaaagacattttgaaataaagacaaatattaaagaaatttcccttcttagacaacctccacattttctcctttgtaaaaagacacttgttagcattgccacatctcttaggcttgagtttattcctcaagtaaaggagttgttggatgagggtttggttcgcaagagattaaatccttgtgctttgttggtgcccaaaataggaataatcaacatgaaaatacagaaaaag

SEQ ID NO: 2714 - DNA, 450 bp, Glycine max
  Peptide Sequence Number=SeqID_94399
atgtacccttccttgttctatttgaacctagtggatgtaccctccactagaactgatccacaagagatataccctctcttttctcagtcaaactcaagtagatgtaccctctacttggaaaaggaagaatcaaaagaattctcagactatgtcgttttgaattctttgacaacggagaagggagacacaaaagaattcaggcgattagtcctttgttcttttggaaaagggagaagagagacacaaaaagaattcaggcggttagtccttggcgaattctttttggcaaagggagaagggaatgaaaagatgaatagcacaagttttcaaggtttagaaaaccagaaaacttcagaaagcttttggtacaaagaagaagaagaagaagttcaaagagatacaagacttgtaaaggattgtaagaataagtgttcaagattgaatgaatga

SEQ ID NO: 2715 - DNA, 186 bp, Glycine max
  Peptide Sequence Number=SeqID_94400
atgcccttcggcctatgcaacgcccctgggttttataggcgctttatcaaggattttagcaaagtggctcttccactatccaatctgctacaaaaggaggtggagtttgactttgatgaccagtgcaaagaggcttttgatgcctcaagcgtgagggactaccacccctatcattcaggcacctga

SEQ ID NO: 2716 - DNA, 459 bp, Glycine max
  Peptide Sequence Number=SeqID_94401
atgggtaccaatttacagcttgtgattcaaaagctgaatggtaaaaattatgttgaatgggctcaatccgtgaaattggcccttgatggcaagggaaagttgggctacctgataggagacacctctcaaccaggagagctggaccagtgctatgaggatgattgggaaaatcccaatgatgcaaccaggttgaagaagagagaagagaatgatagagtttacatgtttttagtaggcttaaatcaagaactggatgaggagaaaaaaagaagcgaccttggtgtgatcattgtagaagaccatgacacactaaggaaacctgctggaaactccatggaaaaccacccaactcaaaaaagaaaccaactggagagagttgggctttccaaacctcaaatgctgaaaatgtggagcagaaaggcaactccgagtcatctctgttcactaaggaacaactag

SEQ ID NO: 2717 - DNA, 339 bp, Glycine max
  Peptide Sequence Number=SeqID_94402
atgtctcctccacctctaggaatctcacaatcactcaaaaactcacaaatcttcctaaaagatcaaaacttggcttctttgctctgttctttgcctctgtgtatttcacacttcaagctcttatggctattcagcactctctccagccccccttacattctccacaagtcaggcttaaaaaaagggctcactgacctcgacgtcgcgcttagtgcgaaactgatccacaagagatgtaccctctcttgttctcagtcaaacccaagtagatgtaccctttacttgtaccacaaaggttgtaccctccaatgtgttaagacaaagatcttaggcggttaa

SEQ ID NO: 2718 - DNA, 918 bp, Glycine max
  Peptide Sequence Number=SeqID_94403
atgaagtcttgcaaccttgatgcccaaaacattctgacatatttggctttcttggcagtggctcaatcaagaatgcttggctttcttctttgtgcaggcttctctgagtatgtttatcactttggaaggagtctttctacaactatcaacttcttccctcattctcatttgatgtctttgtttgggcaatgctttgtggtgttccctgtggctgagtggatgaagctcttactgattcagccttgtagagaggttaaaggacagattagagaaggaaacagaacagagataagcatgccagaaaatggccggaacagagacggggaatctcgccagaaagagctggggtttgttggagatgatggctgccaaaattgtgcaaaagcagctgcgatgtgcactactccagctgtgacagtgaagtatgatgttagaggggtcaaagaagtggcagactcgtgttcacagatcaaagcattacttggtgattatgatgccatccatgttcgtcgtggggataaaataaagacccggaaagatagatttggtgtagcgaggagcttgcaccctcaccttgatagagacactcggccagagtttatgctttgtaggatagcaaagtgggtcccacctggaagaaccttgtttattgcttcaaatgaaaggactccagggtttttttcaccactttctgccaggtatagattggcatattcatcgaactatagccatatcttggatccgttaattgagaacaattatcaattattcatgatcgagaggcttataatgatgggtggtaaaacgttcattaggacattcaaggaggatgagacagatcttagcctcactgatgaccccaaaaagaacactaagctttggcagatacctgtttacaatgtggatgaaacttgttga

SEQ ID NO: 2719 - DNA, 87 bp, Glycine max
  Peptide Sequence Number=SeqID_94404
atggagtctacacccctctgggtactaggaagcccaaggacaaagtccatactaatatctacccaggatgcatatggaatgggtaag

SEQ ID NO: 2720 - DNA, 135 bp, Glycine max
  Peptide Sequence Number=SeqID_94405
atgaagatacacaaaactaatcgaatgatgaatgaagaacaccgaacgaagaacgatgaaatgaggaggtttgggacttcggtagctcgcccaagcgagctgttgcttcatcctgaggtaaccttactcgcctag

SEQ ID NO: 2721 - DNA, 642 bp, Glycine max
  Peptide Sequence Number=SeqID_94406
gttgcaggatgtacaatttgtggtggagcttatgaatctggatgttgtatccctaatgaaaaacaagtcacacatgaagtcaattatatggggaaccagtccagaaaccattttaatgcaggtggatttttcggattccagcatggacaacaatacaaccaacaacagggacaatggaggaaccatcctgggaatcaattcaatagagaccagggatcatccataaggctgcaaccacaagggtctagtctctatgatcgaaccatgaagctggaagagactctagctcaatttatgcaggtttctatgtctaaccaaaagagcacagagtctgccataaagaatctggaggtccaagtgggacagctcgcaaaacagttggcagataggccgtcaagaagctttagtgctaacactaaggaaaatccaaaggaagaatgtaaagctatcatgacaaggagtagaatgacaacccatgtggatgaaagaaaagttgagaagaagatggaggaacataaacaacaactggctgatgaactggcactggaaccggttgatgatttagttgaacttgaagaaattgttgaggaagcagaaggtgatgaagaaggagagatatcaaagactatcaagagagaataa

SEQ ID NO: 2722 - DNA, 432 bp, Glycine max
  Peptide Sequence Number=SeqID_94407
atggcacagaccaagcgtgagaaggccatcaaggccgccgtcgttccgggcaaggcatacgccttcgaggacgcgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtga

SEQ ID NO: 2723 - DNA, 430 bp, Glycine max
  Peptide Sequence Number=SeqID_94408
atggcatctagcataggtgggaatggaagagggataggaggctgctgcaagtttagaatgaagctcgacaggttcaggtgcaggtgctgctactggtggaggcacttgaatttggttgccatacctcaagccatctgcccatctgatttgtcagactctgaatggaggttcttgtctcttgctgaaattgcatattctggatggtcatttgcctcactaactcttctaaggaaggttgaggagaagcctcagttgcttgttatctttgttgtgactgctgctgctgttgctgcattggaggaggaacatatggcttgcttggaccaacaacattctcgaaaggagggacaggctgttgttgttgtggaggacttgtccatctcagatttggatgattcctccaacctggattgtatatgttgcttgaaag

SEQ ID NO: 2724 - DNA, 126 bp, Glycine max
  Peptide Sequence Number=SeqID_94409
atggtcgtgaggattaagcttgtttgtaggccaaagaagagaaggtgcaaaaacttgctgttgaactcgcttagcgaggtagattggctaagtgagcctcaaccgcttagcgaggcagccagctag

SEQ ID NO: 2725 - DNA, 213 bp, Glycine max
  Peptide Sequence Number=SeqID_94410
atgattgttaaggagactgagctttgtagaagcaagcttcatgatgatgaaccaagcaattttgatgatgccaaaaggccaagcctaggatcttcttcatcaatggattcctttgcgtcctggaagatgaatggccgcatagtgcagaaagaagacagagaggagacgccacttcaaggagaagatgagtctagaagaagctcaccaccatag

SEQ ID NO: 2726 - DNA, 1044 bp, Glycine max
  Peptide Sequence Number=SeqID_94411
atgagcgaaccgcttcgtttgacgcaatacagccacggcgctggctgcggctgtaaaatttcacctcaggtgcttgagaccattctgcacagcgaactggctgcctttcacgatccgcgactgctggtcggcaatgaaacccgtgacgatgctgcagtgtacgatcttggcaacggcacggcggtggtcagcaccactgacttctttatgcccatcgttgacgatccgcacacctttggccgtatcgcggccaccaacgccatcagtgatatttacgccatgggcggcaaaccgatcatggcaatcgctattctcggctggccggttaatgtgctggatgcgaaggtggcacagcaggtgattgaaggcggtcgcgcggcctgccaggcggctggcatcgcgctggcggggggccactcaatcgatgcgccggagccgatttttggccttgccgttaccggcatcgttgacgtggcgcgcgtgaaaaagaacagcgccgcgcaggcgggctgcgagttgttcctcaccaaaccgctcggcatcggaattctgactaccgcagagaaaaaagggctgctgcgtgcggagcatcagacgctggcggcgcaggtgatgtgccagctcaatagcgcaggggcggaatttgctaaactgcccggcgtcagcgccatgaccgatgtcaccggctttggtctgctggggcatctgagtgaaatctgtctgggctccggcctgcgcgcacatgtgcaggccgcacaggtaccgcgtctgcccggcgtggaccagtacattgcggccggcgcggtgccgggcggcaccagccgcaacttcgccagctacggcgagcacatttctgccatggatgaggccacgcgcgcactgctgtgcgatccgcaaacttccggcgggctgctggtggcggtgcagcctgacgctattgcggcgtttcacgcgtgcgccgtgcaggctggcgtcgaggccacggcgatcggctcgctgctgccggccgaccgcgcccatccactgattactgtagtcacctga

SEQ ID NO: 2727 - DNA, 252 bp, Glycine max
  Peptide Sequence Number=SeqID_94412
atgcgaaacttatcagaatgcgagaatcgatctttgagatctttccagatttcaaaagttgaatctatccacatcaccgattgtttgatagcaggactcatggaacgagtgagccatgacatcaccatgcgattgcaacgccgccaagcttcatgcattgggtgtgtcggtggaggacaaggaagtgtgccagaaagaaaatgctctttgttcttggattcaagcgccacaactatatcacgttcccattga

SEQ ID NO: 2728 - DNA, 483 bp, Glycine max
  Peptide Sequence Number=SeqID_94413
atgggtgatcaagaggagacacaggaacagatgaaagccgacatgtcggctctgaaagaacaaatggcttccatgatggaggccatgttaggaatgaggcagctcatggagaaaaacgtggccgccgctgtcagttcgactgccgaagcagacccaactctcttggctaccgcgcgccatcctccctcaaacacagtaggacggggaaggtacacgctggggcacgacggcaaccctcatctgggatacaaccgaacggcttacccttatggattgccacctaattactcaccacccgtcatgcaagacgatgcgggccatatttcttctcccgtccttgaaggggagcctcctcaacagcccgacgaggtccacgaaaaccctcaagactatgcccgaagggatgtcgagttctatctcccgatccccgaagggccggcacccaacacgttgcctcagcccaacctcacgacacaaccaata

SEQ ID NO: 2729 - DNA, 734 bp, Glycine max
  Peptide Sequence Number=SeqID_94414
atgggtgaagtagaggagatacaagagaagaggaaggccgacatggaggccattaaagagaaaatggccacaatgatggaggccatgatgagcgtgaagaagataatggaagccaatgcggttgcaattgccgctaccagcgttgttgctaaggtgaacctgatgtccccatccggcatcaaccaaatgaatcatccaacctcagatatggtagcaaagatttgggaagtacgggaagcccccataatgtacaaattcaaaacgagcacgccttcccgccatatggcttgcctctcaactatacgccacccaaagtggcgtacactcccaataagaatgtcaataactccactcctatacccattgagagccaacaaccccaaactgatcatgcacatgtctcttaaatcgtgggggggacacatgattccccaccacaatctagccgacttcgagccttgcctcggatatgccacggaagggcaagcagttggtggtatacccctacaaaaccctttggaaggccctcagtatcacccacaactacacctcttgcattccacgacaagtaaaaaccctcatgctatggcagaaatgggaaagttggatcatctagaggaaaggctcagggccattgaaggaggtgaagattatgcctttgctaacctaaaagagttgttcctagaacccaatatcatcacccctcccaagttcaaggtgctggaccttgacaa

SEQ ID NO: 2730 - DNA, 165 bp, Glycine max
  Peptide Sequence Number=SeqID_94415
gtcatgggttgtaccatatgtggttgtactcatgaatccgatctttgcattccttttgaagagcaaacacaagaggttagctacatggggaatcaacaaaggcagggatacaatcaaggtggattctcaggtttcccgcagggtccttacaaccaacaaggatag

SEQ ID NO: 2731 - DNA, 311 bp, Glycine max
  Peptide Sequence Number=SeqID_94416
accctaatttcgtctggggactatcattcactgatgttttgattctcgatagccgaattgcggtgttcgacactaaccccagctcgcctaggctagcatctgccttgcctaggccatggaattacctcctaggtaagcaaccagctctcctgggcgagctcattacttcagtgctaaggttcagctcgcctggcgtgagcttaaaccgccccaaggggttagaagggtcagcactaaagggaattgagagaattgagagaaaagaagaaagagaaaaagaagaagaagaaagaagaggaaacgaagcttag

SEQ ID NO: 2732 - DNA, 138 bp, Glycine max
  Peptide Sequence Number=SeqID_94417
atgaaggtcagtgttgaggaggttaaagatgcagatgctcccattcctgtacccactgaagagtttaagttagtggggcagacacttaacaccttccttgcttggccgacacatctcgtcaagcatttatcagaacgg

SEQ ID NO: 2733 - DNA, 465 bp, Glycine max
  Peptide Sequence Number=SeqID_94418
atggtctctggtaatcgattaccaagggggtgtaatcaattaccaggcttgaaaacgaggtttcatgtcctgaagctgtgtaattcgagtttggcctctgatcgtgacggtgcgattcgatttcggggcacgattcgatttacagctacttcattggtgcatccagatgaacccgcgcgcacgcttcagcgtattgtggagtggatactacccacgcctacaccataccgtctagtggagccagtccaagtgattgaggtaacgtcatccgaggaagaccctgaggaggatcccgaggagctacctcctgagcctgctgtggatgctcttgattttctagagggtgatgaggacccactccctgaggtggattctcccgaggatgtcatgttggcatttgaggcagactctacggaggatagtggccctggagagatggcgatcagtggaggctcttcatcatag

SEQ ID NO: 2734 - DNA, 504 bp, Glycine max
  Peptide Sequence Number=SeqID_94419
atgtcagagaatttgtggaagcaatcaaagaagctaaggactagggtgtcattactaaacctgaagaactttggaatcaaacatggaattgaattacacattgatgatgagcaactcaaaaatttaacattactggaaattgaaaaacttctgcatccaaaccaaaaattactcagagactatcctgcaatgccatatcctaagggtggaaatcctgcatcatgtctagagaatagtttgatattgtttgaacttaattacaacaatgatgaggctagattagaattcgaaaatctttttctatcgatgacaggaaaaacatacatatggagaacattagcaagttcactgagggcaaaaaatcaaattgtgattatggttgcttctagcggcatagcttctttgttattgccaagaggcaggactgctcatttcaaatttaagataatgattttcgacaaattctgccagtcattccaagaggaagtcgttcagacattataa

SEQ ID NO: 2735 - DNA, 181 bp, Glycine max
  Peptide Sequence Number=SeqID_94420
tattttcgggccagatgtcctggacatcgtatccgacatcgtggatcctgcagcttcaatgcttttagcaactccagatgtcctggacattgtatccgacatcgtgaatcctgcagcttcaattcttcatttgacatttcatcttgccttgtgcattgtgcagcccgatcttattctttga

SEQ ID NO: 2736 - DNA, 204 bp, Glycine max
  Peptide Sequence Number=SeqID_94421
atgcatattttgttatcttatgacaggggcagaatcgtcttaggcaatggtcgaatgccaggccagatcgataggcaaagactaatcaagggacggacgcaagtagaggctaggatcacgatcgatagatcgtcatcccgtgcccagcactggaccagcgggaagcgcagctgggggacagccaagtatcctttaaactcctaa

SEQ ID NO: 2737 - DNA, 522 bp, Glycine max
  Peptide Sequence Number=SeqID_94422
atgctgtgcccggaagatcgcaaagccgaaggcatcatcccggtgcactcggtgcgcgaaaacatcaatatcagcgcgcgccgccacaacctgagtgccggctgtctgatcaagccgggctgggaagcgaaaaacgcggaccaccacattcgctcgctgaacatcaaaacgccgggcgcgcatcagctgatcatgaatctgtccggtggcaaccagcagaaggcaattctgggccgctggctgtcggaggagatgaacgtgatcctgctcgacgaaccgacgcgcggcattgatgttggtgccaaacatgaaatctataacctgatttatcagctggcgaacaaagggatcgcggtgctgtttgcctccagcgatctgcccgaagtgatgggactggccgaccgcatcgtagtgatgcgcgaaggtgagattgccggtgaactgccccacgacgccgccacggagcagctgacgctgagcctggccatgccgaaaaccactcaagcggccgccgtggcctga

SEQ ID NO: 2738 - DNA, 588 bp, Glycine max
  Peptide Sequence Number=SeqID_94423
atggatgggaggaatgaatgcgggtgtttctgtttgcgggtcctgttgacccttgccaccggcggagtgggctttgcggcttcgtgcgaacagaatttcaaatccgatggcgttccgctggtaacatccgtgagctatcgctcgacacagagctttaccggcgtgaagtcttcggccgccttgcagcgtctggcgcaagccattgccgctgaagggttttcgggtatcaaggtgaacaagcaactcgcttctatcgaggcttttcaggaaacgacacggatcgggccggatccagaccttgcgcgtcactgcccgggcgcagggcaagagcacgcgtgtcgatgcggtcttcaccattcaggcgggacaggcgaccagcaagtccgtcgtgcgcgaaggactttgccgcatcattacttctgctgcaaattgagtttgtcgtcccaaggtccgaacgatgtgttccaagcgcaaaacccaccgttaaccggtgacgccgccaaactcggattatcgctggagaaagagaatggtagcggaggagggattcgaacccccgacacaaggattatgattcctctgctctaa

SEQ ID NO: 2739 - DNA, 199 bp, Glycine max
  Peptide Sequence Number=SeqID_94424
acctagtacttttgcttacctttggctttggacttggtcgcctgctggtcggccacaggtcgtaggcaaagttctagcctttgtagataagatgaggggctctagagatggcggtggtgcttctattgcccgttgccggccatccccagctgttgtggtgtcatgccctgtgcctgcctggaggcgcaatacttattga

SEQ ID NO: 2740 - DNA, 159 bp, Glycine max
  Peptide Sequence Number=SeqID_94425
atgtcttattctttagaaaaaaacctgctcgaatacaaaagttgtgctttttctatcgaaggccatgccaacctcggaagtgcacctatgggtggtgatcagagttcaagtctactggacacctatgggttggtgatactgcaatggaggatcaaatga

SEQ ID NO: 2741 - DNA, 306 bp, Glycine max
  Peptide Sequence Number=SeqID_94426
accagttcagggcagaggttgcatggcccggagattggcccgaggcccaagcaggagaggcaccccccagcagctcccggcgatggagaagaagcccacgaggatgaggagatggccgatttgcttgacttcttgggagggagtgggagatacgtgactggggagatcccccagattcatggtgaatgctgtgaagattttcccagacgcccaaaatggactcggatgaatgcacaaattgataaaagaacatattttggaaacgttgggttgactaaaatagaggaaatgaatcctgagccctag

SEQ ID NO: 2742 - DNA, 633 bp, Glycine max
  Peptide Sequence Number=SeqID_94427
atgaattcctcctccatttatattcttgtctttgtccagctttggttgttgagcttaccatgcagagagagtgtgtgcatcccaagtgagcgtgagacacttttgaagtttaagaataatctcatagatccttccaataggctttggtcttggaatcataataataccaactgttgccactggtatggagtcctctgccacaaccttacttcccatcttcttcagcttcacctcagctcttcagattatgctttctacgatgaggaagcttatcggagatggagctttggtggagagataagtccttgtttggctgatttaaagcatttgaattacttggacttgagcggcaattatttccttggagaaggtatgtcaattccttctttccttgggacaatgacttccttgactcacctcgacctctctcatagtggattctatgggatgattcctcctcagattgggaatctctcaaatttggtgtatcttgacctgagatctgttgccaacggaacagtaccctctcagatcgggaatctctctaagcttcgatatcttgacttgacctacaatcatttacttggagaaggtatggcaattccttctttcctttgtgcaatgcttgactag

SEQ ID NO: 2743 - DNA, 408 bp, Glycine max
  Peptide Sequence Number=SeqID_94428
atgttaactgatagtgataggatatcagcagcagataacagggataaggaaccagaagcaagcatcagaaagacagaaacattgaagggagtagcagtaattaacaaaccagaggtgcaaaaagaagaaaagactaagagaaaggtagtttggagcaacagacaagacctcatgaaatgcaatgtttctgaaaatcaagattggaatgctcgtttatttgcccaggattggtttcgagaatcacaagaggggttcagcaaatcagacttgccaagtcaatgcacttatagatataaggtgtacattgaaggttctgcttggtcagtcagtcaaaaatacattctgtcatgtgactctaccactctacgtgtacgactacatgtttcatctcctgaattcatatgctaa

SEQ ID NO: 2744 - DNA, 460 bp, Glycine max
  Peptide Sequence Number=SeqID_94429
gataatggaagccaatgcggttgcagttgccgctaccagcgctgttgctaaggtgaacccgacgcccccatctggcctcaaccaaatgaatcatccaacctcagatatggtaggcaaatatttgggaagtacgggcagtccccatgatgtgcaaattcaaaacaagtacgccttctcgccatatggcttgcctcccaactatacaccaccaaatgtagcatacactcccaatgaggatacatatgaaataccccaccacaatctagccgactttgagccttgccttggatatgccattgaagggcaagtagttggtggtatacccctgcaaaacactttggagggccctcaatttcgcccccaatcacaacccttgcattccacagcgggtaaaatccctcctgttatggaagaaattggaaaagttggatcatttagaggaaaggctcatggccattga

SEQ ID NO: 2745 - DNA, 471 bp, Glycine max
  Peptide Sequence Number=SeqID_94430
atgaatttattgcctagcgctgttcatgtgtcctccaccatcgagtctggagccccgcgaatttattgcctagcgctgttcgccaattctccattctccacttttatccagagccccatgaatttattgcctagcgctgttcatgcatcctccacccacgagtctggagccccgcgaatttattgcctagcgctgttcgccaattctccattctccacttttattctgagacccatgaattcattgcctagcgttgttcatgtgtcctccaccaacgagtctagagccccgcgaatttattgcctagcgctgttcgccaattctccattctccacttttatccggagccccatgaatttattgcctaccgctgttcatgcatcctccacccacgagtctggagccccgcgaatttattgcctagcgttgttcgccaattctccattctccacttttttcggagccccatga

SEQ ID NO: 2746 - DNA, 286 bp, Glycine max
  Peptide Sequence Number=SeqID_94431
ttgatttagttgtcatagatatagaggaggatgctaacattcctatcattcttggtcgcccattcatgtctactacaagctgcgtggacaaagatccacctagccaaaatgtctgtctgaaagtgcatgtgatggaggaaaagagacctgagaagaaggtccttgaagaaaagactcagaaattttttgcaattgtctatccgctaagcacagaccttgcgctaagtgctcagtcttcacgtgctaagctgagcttgctcgcgctaagcatagagacccctgattg

SEQ ID NO: 2747 - DNA, 429 bp, Glycine max
  Peptide Sequence Number=SeqID_94432
atgcatctcagggacttgcactgcctcacgagcctctggttggtccctcaggtgggtgtggaggaggttacagatgcagatgctccagttcctgtacccactgatgaggtttctttagtgaggcaggaaattcacaccttccttgctttgccgacacatctggtcaagtctttatcacaacaggcagctgtgtctccggcaaaaccacctcaaaagcccaatctggaggttgatgatccgctttatctgatgacattgaccatcccagagcttttcttgaggccttaccaggttatatgggatgtcaccgtgttcggggtctttaatccagacttccctctctacataaagcacgaagacctctccgaaatcgcacatggtggtcaatgtctcagcatacagtgttacagttgtggattctgcatctga

SEQ ID NO: 2748 - DNA, 545 bp, Glycine max
  Peptide Sequence Number=SeqID_94433
atggggacaaatcaaaacggcaaaaggttttatcaagtcaaggttaaaagtctagatgtcactagcctcaaggaattgggacgattgatgggacctctccaaaggcaagccttccgcaaagtgtacgggaagattctagatttgaccgcagcggaggtatttacggaagctgtcgtatccctcgcccaatactatgaccagccgttgaggtgtttcacgtttggggacttccaaatggtaccaactattgaagagtttgaggaaatattaggatgccctcttggggggagaaaaccgtatcttttctccggctttcttccttccttgagcaagattgcagctatggcaagggatatggcaagccaagagaagtggggcccgtttgcggatatattagctttgttgatttttggggttgtcctctttccgaacgttgacggtttggtagacttagccgccattgatgctttcctcgcatatcaccatagcaaggaaagtccagtggtggctatcttggcagatttgtttgacacctttgaccggag

SEQ ID NO: 2749 - DNA, 645 bp, Glycine max
  Peptide Sequence Number=SeqID_94434
atggatattgctgtctctgagcatcaaattgccaaggaaatcactgccaaacaagtccagcattggccaaagaaagggaagctttctgcaggaaagctgagtgtgaagtatgcaattctgcataggattggtgctgcaaactgggtacccactaatcatacatccactgttgccacagaatcttttgctgtcaaattacccattgccttccctactgtattgtgtggcattatgttgagtcaacaccccaatattttaaactacactgactctgtgatgaagagagaatctcctctatccctgcattacaaattgtttgaggggacacatgtcccagacattgtctcgacatcagggaaagctgcttcaggtgctgtgtccaaggatgctctgattgctgaactcaaggacacatgcaaggtgctggaagcaaccatcaaagccaccacagagaagaagatggagctagaacggctgatcaaaaggctctcagaaagtggcattgatgatggtgaagcagctgaggaagaagaagcagctgagcaagaagaagaagaagctgaggaagaagaagaagaagccgatgaggaagatgcagcagaggatacagaatccgatgatgatgattctgaagccaccccatga

SEQ ID NO: 2750 - DNA, 75 bp, Glycine max
  Peptide Sequence Number=SeqID_94435
atgggtgccaagtacctcgaagcggtcaagcaaaggttgcacgccaccaaacaatggtcctcagacgaaattagg

SEQ ID NO: 2751 - DNA, 585 bp, Glycine max
  Peptide Sequence Number=SeqID_94436
ggcgtagaagacgacgttagtctttgcgtgttatcaggcttttcgtcttacagacagccaaaagtttatacggataaccactcgggtatttccgcccgtcagcgtgactcaaaagtcagtatgacagatcttgtgagcgcggaagatgacggcacagaagacgacgttagtctctgcgtgctattagcctatttcgtcttacagacagcaaaagtttatacggataaccactcaggtatttccgcccgtcagcgtgactcaatagagagtatgacagatcttgtgggcgcagaagatgacgtatatctccgcgtgtcaacgggcttttcgtcttacagacagcaaaaagtttatacggataaccactcgggtatttccgcccgtctgcgtcactcaaaagtcagtatgacagatcttgtgagcgcggaagatgacggcacagaagacgacgttagtctctgcgtgctattagccttttcgtcttacagacagcaaaatgtttatacggataaccactcaggtatttctgcccgtcagcgtgactcacaagttagtatgacagatcttgtaagcgcggaagatgac

SEQ ID NO: 2752 - DNA, 288 bp, Glycine max
  Peptide Sequence Number=SeqID_94437
atggagaagatggatgtgcacataataacaagggggacccctaaggcttgcctaggcgagccgaaacttaaccctgaagcaatgagtttgcccaggcaagctgatttcttcaccatgaagctatttggtggcccaggcgagctagaggctaacctgggcgagctagggtccaggaaaaccaaggaaaaaacccttttaccccccctttttttggtatttttcgcattcttgatcaaaacgctgaatgatcatttgttttcacattgtaactggcgttcaacaccataa

SEQ ID NO: 2753 - DNA, 821 bp, Glycine max
  Peptide Sequence Number=SeqID_94438
cttaggcactaggaacctaaccttcaccacttgtggtgcttatggtatcttggcctatatctctatctggtccaacctccctcataggaaaactgattctgatgagttccatgttccgggattccctcaaaactaccgtttccacaaaacacaactgcataggtttcttcaagcggctgatggcaccgatgactggtcaagattcctcgttccacagattcaactttctatgaagtctgatgggtggatttgcaatacgattgaaaagatagagcctttggggttaaagcttctcaggaactatcttcaacttcccgtttgggccgtggggcctctccttccacctgcttcactcatgggttcaaaacatcgttcaggaaaggaaactggcatggctcttgatgcatgcatggagtggctggattcaaaggatgagaattctgttctctatatttcatttgggtcactgcacactatcagtgcatctcaaatgatggctttggctgagggtttggaagagagtggcaaatcgtttatttgggttataaggccacctgttggttttgacatcaatggagagttcagtgcagaatggttgccaaaagggtttgaagagagcatgagagacaccaaacgtggccttttggtgcacaaatggggaccccagttggagattctgtcacacacttctacaggagcttttctaagccattgtggatggaactctgtgttggagagtctcagctatggggtgcctatgattgggtggccaattgttgcagatcaaccttataatgtgaagatgttggtggaggaaatgg

SEQ ID NO: 2754 - DNA, 420 bp, Glycine max
  Peptide Sequence Number=SeqID_94439
atgttggtggcgactccgcgcgtattcctttcgtggaacacgcatcccgcgagtctcgcgtcgccctcccgccgaagggcacctcaacagcatgagctagagcccgaaaatgatcactcatctgaagccatcatccctggagctattgatttttcaaaaagaagattagagacgagatccaataaggctgatcatcttggaccagtgccagtatcagttgatgtaccatttccagggttggatccatcttcacctcagcatgcagcagattcttccactcctgtcttaaagatacttgagggccagaccataccagtcctagctctggacatttctcatccagctactccagtattgcatctgacagataaagaggatgttcagacacaggatatccaggaccagtcacaagaattttga

SEQ ID NO: 2755 - DNA, 534 bp, Glycine max
  Peptide Sequence Number=SeqID_94440
atggagggaagtgggttagaaagcagtgaagcaaaggctagttcttggacaagaaacctggaacttcccacctttgatggaagcatagaaggggaaactgattcaaagggtaacaattttgagtgtgacgatgacccattgcagttcttgaaatcagaaaacagaagtaaagaagtttcagaagaagttgatccttcgatgaagagggagaaacacaaggaaaacaaagtgaagaatgtgggctgcgaagaccattttcttgataacccaataccaaagatgatcaagaaggaagttgaagctggtgatgcagtcaagcctcattcttttcaagattcagattttcataaaaagattgttatgatgaaacagaattcattgttggacccaaattcgatcatgaaggtggacagaacatcaatgatgttggaatcttggaatgtcaacttgctggatgtgcctttagcattaaactttgttgcatctatggctgacagctcagcagtggagctaaagggagaaggaatgtactga

SEQ ID NO: 2756 - DNA, 369 bp, Glycine max
  misc_feature (14)..(14): n is a, c, g, or t
  Peptide Sequence Number=SeqID_94441
atgattataagggnccaagaaatttatagtagccaagatgaggctactacttcaccttcctctagtgaaagtgacgaagcaaaaggggaagaatctagtgaagaaatctatccccaagaagaaggacaacctttaatggttaaggacgagtgtaaggaggtaagtgtctcctccacgaggcaccaaatccctaaaataggtggtatgatgaatgttttgagtggtgcaaccctcttttgtataatcactcgtgcacccaacatcttcatgatttgcgtactgtcataccctaatttcgtccgggaacctttgctcgatgacgtgcgaccattctttggtcctcgtgaggtgcttggcacccatcattag

SEQ ID NO: 2757 - DNA, 224 bp, Glycine max
  Peptide Sequence Number=SeqID_94442
aatgtcctataggtagcctagttattccgaagaaatacaatctcctaccgttgtattgtggaagcaatgtcttccagggttattttgatgatgccaaagaatcaagagtcaagaaaaatccaaagattcaagaatcaagtttcaagaatcaagattcaagaataatcaagatcaagattcaagactcaagattcaagaatcaagataagactcaatcaagataa

SEQ ID NO: 2758 - DNA, 498 bp, Glycine max
  Peptide Sequence Number=SeqID_94443
atggcgcctaccaggcaccctctggacccagataagtccaacagggccctgggatttcccgccttgatcacgggactctgccagtcgttcggcgtccccgtcacgcctagcaaggtaattcggccgcccatcacccgagcttttatcgagaagtactgcacgcggagacaggtccagggtgatgtaccacaggccgcggacacgccgccacctcatcaggctagcccagtcggattgtttgatatagagcagtatttgcggcatttggttcgccagcaggcggccaaccaccgggcacatggctttactcctttcccgtgccctaccccggaccagtttagggcagaggtcacgtggcctggggattggcctgaggcccaggcagcagaggcaccagcaggggccccagcagaggctcccgatgaggcggatgaggcccgcgaggatgaagagatgacagatttacttgatttcttaggagggagtggagccgcatga

SEQ ID NO: 2759 - DNA, 300 bp, Glycine max
  Peptide Sequence Number=SeqID_94444
atggataatgaagagggcgtgcaggaacagatgaaggccgatctatcggccttaaaagatcaaatggcttccaactcggaggataaagccaccgcaaccgcctctagtacagttagggaagcggagccagtgttgcagcccgcctcgaatccgggcctagacaaaaacacgggcgtgttcggtcgaaggtatagtccgcaagcttatccttatggcctgcctccggacttcaccccccgtgccaccccagaagagttaagccaagcccctacttttgaggggcaactcccaccatattga

SEQ ID NO: 2760 - DNA, 1160 bp, Glycine max
  Peptide Sequence Number=SeqID_94445
tcaaggcttagctcaagaccccactactcgtcgtatttggtttggtattgctaccgcacatgacttcgaaagtcatgatgatattactgaggaacgtctttatcagaatatttttgcttctcatttcgggcaattagcaataatttttctgtggacttccgggaatctgtttcatgtagcttggcaagggaattttgaagcatgggtacaggatcctttacatgtaagacctatagctcatgcaatttgggatcctcattttggtcaaccggctgtagaagcttttactcgaggaggtgctctaggcccagttaatatagcctattctggtcagtggaatctttatgctcaaaaccccgattccaatagtcatatatttggtacccctcaaggagcaggaactgctattctaacacttctcgggggatttcatccgcaaactcaaagtttatggctgaccgatattgcacaccatcatttagctattgcatttctttttctagttgctggccatatgtatagaaccaacttcgggattggtcacagtataaaagatcttttagaagcacatactcctccggggggtagattggggcgtggacataagggtctttatgacacaatcaataattcaattcattttcaattaggtcttgctctagcctctttaggggttattacttccttggtagctcaacacatgtactctttacccgcttatgcatttatagcgcaagactttactactcaagctgcattatatactcatcatcaatatatagcgggcttcattatgacaggggcttttgctcatggagctatattttttattagagattataatccagaacagaatgaagataatgtcttagcaagaatgttagaccataaagaagctatcatatcccacttaagttgggctagcctctttctggggttccatactctgggactttatgtccataatgatgtcatgcttgcttttggtactccggagaaacaaatcttgattgaacctatatttgcccaatggatacaatctgctcatggtaaaacttcctatgggttcgatatacttttatcttcaacgaacagtccggcgttcaatgcaggacgaagcatatggttgcctggttggttaaacgctgttactgagaata

SEQ ID NO: 2761 - DNA, 141 bp, Glycine max
  Peptide Sequence Number=SeqID_94446
ggaggtggttgccgcccacctcgccgaggtgagcagggttgcttccaccaaaaggcaccgccttctgttggaaccctcaggaaagcccaaggagcaaacaaggttcaagggctgactgcaagtactcccggacgaaattag

SEQ ID NO: 2762 - DNA, 229 bp, Glycine max
  Peptide Sequence Number=SeqID_94447
atggttcggagaaggagatcaaccttctatccaagaactatgaaagcgatgagaacatctctcaagaagattaagcaaaaagcaaaagagtctctcaaatggtggaaccatcaaagaagcgcaaaggttcttcgagtagaagccaatgacattctgaggttcaagatattccaattccttcctccatttcctcctcctcattgttctcattggaagaacaatgtatatg

SEQ ID NO: 2763 - DNA, 1227 bp, Glycine max
  Peptide Sequence Number=SeqID_94448
atggagcgcttcgccgaagatgcctcgctgctggccaaggtgcgcgactacctgtggaaaaacgcccatctggtgtccaaagtggtcgagggcaaggaagaagaaggcgccaagttccgcgactatttcgatcaccacgaaccgatttcccaggtgccttcgcaccgcgcgctggcgatgttccgcggccgcaacgaaggtgtgctgcagctggcgctgaacgccgatccgcagtttgaggaagcgccgcgcgaaagccaggcggagctgatcatcatcaatcacctcaacctgcgcctgaacaacgccccggccgacgcctggcgcaaggcggtggtcaactggacctggcgcatcaaggtgttgctgcacctggaaaccgagctgatgggcacggtgcgcgagcgcgcggaagatgaagcgatcaacgttttcgcccgcaacatgcacgatctgctgatggccgcgccggccggcatgcgcgccaccatgggcctcgatccgggcctgcgcaccggggtgaaagtcgccgtggtcgacgcgactggcaagctggtcgccaccgacaccgtctacccgcacaccgggcaagcggccaaagccgccgccatcgtcgcggcgctgtgcatcaaacataacgtggagctggtggccatcggcaacggcaccgcttcgcgtgaaaccgagcgtttctatctcgacctgcaaaagcaattcggcgaggtccgggcgcagaaagtgatcgtcagcgaagcgggcgcgtcggtgtattccgcgtcagaactggcggcgcaggagttcccggatctcgacgtgtcgctgcgcggtgcggtgtccatcgcccgtcgtctgcaggatccgctggcggagctggtgaaaatcgacccgaaatccatcggcgtcggccagtatcagcacgacgtcagccagagccagctggcgaagaagctggactcggtggtggaagactgcgtgaacgccgtcggcgtcgatctgaacaccgcgtcggtgccgttgctgacccgcgtggccggcctgacgcgcatgatggcgcagaacatcgtcaactggcgcgacgagaacggccgcttcagcaaccgtgaacagctgctgaaagtcagccgcctggggccgaaggccttcgaacagtgcgccggcttcctgcgcatcaaccacggcgacaacccgctggatgcttccaccgttcacccggaagcctacccggtg

SEQ ID NO: 2764 - DNA, 1573 bp, Glycine max
  misc_feature (1571)..(1571): n is a, c, g, or t
  Peptide Sequence Number=SeqID_94449
atgttcaagcctagcaatgtgttccctgcgacctctgcagcggcagcacagatgactgacgacaatgcccgccgtcgcctggtgctggatgatggcagcagcgtgcaaaaccccaacccgattccatttattggtgaagacaatactttgcgtgctggtgacgtggtagaaaacctgactggcgtgattgactacggtttaatcacggcgtctaaccctggtccgcgtgattacaaactgcaccccacggaggcggtgcagttcacgcgtgaaaatcagcgcacggccgcgccggccagtgtgcaaggcaatctcaaaattgccagctttaacgtacttaactacttcaccacctttaccaatggcgcaacagccggtggtcaaaccggacagggctgcagcctgggtagcagcgtttcagcctctaactgccgcggtgccaataacctggtggagtttaaccgtcagcgtagcaaaattatccgcgccttgacggcgatgaatgcggatgtggtcggtttgatggagatccagaacaatggcgcaacagcagcgcaaaacctagtcgatggcctgaatgcagcattaggcacccatacctatgcggtgattgctgacccggtgacaggcaccggtacggatgcgatcaaggtggccatgatctacaaaccagccaagctgacaccggccgctgccgctttgtcagataacgacagtatcaataatcgcccaaccttggcgcaaacgtttgtcgctgctaatggcgagaagttctctgtcctggttaaccacttcaagtccaagagctgttctgattcggctggggccaatcaggatcagggcgacgggcaaggttgctataaccctcagcgtattgcccaggctaaccgcttattgcagttcatcaataccgttcaaacgcagtcaggtgacagcgatgtcgtggtgatcggtgacctgaatgcctatggtaaagaggatcctatcctggcattgacagccggtggattgcaagatcaggtggcccgtttcaacggtgataccgattactcgtatgtgttcgatggcgaatccggttacatcgaccatgccctggccagcaacagtatggctgcacaaattacgggtaccctgcactggcatatcaatgcggatgaaccctttgtgattgattacaacaccgagttcaagccgcaagacctttacaccgacagtccttaccgttcttctgaccacgatcctgtcattgttggcgttcaactggtgaaggccatcaccggcagcagccagcgcgacacgctggtgggtaccgcaggagatgatgttatcaccggtggtgtaggtgcagacaccatcactggtggggcaggacgtgacacctttgtctatcaaagtatgcgcgatgcgactgacaccatcactgactttacaccaggtgaagatcaattggacatcgctgaattgctgcaaagcatcggttataccagcagccagccatttgccgatggcgtagcccgctgggtcaatgtggcaggtggcgtgcagttgccaattgacaccgatggcaccgntg

SEQ ID NO: 2765 - DNA, 522 bp, Glycine max
  Peptide Sequence Number=SeqID_94450
atggatcttattgaaaatatggctacaagtgacattgatattctcagagatagagcccacataccaaaaaagaaaagtcttatggaacttacatcgcaagatgcgttgttgcagggtgtgccatctgtggtggagctcacaattctggctgctgtatccctaatgaagaaccagctcatgaagtcaattatatggggaaccaggcaagacaaaatttcaatgccacaacaacaagggcttagtctctatgatcgaacaacgaagctagaagaaactttggctcaatttatgcaattggcggataggccatcaagcaactttagtgctaacactgagaagaatccaaaggaaaaatgtaaagctataatgacaaggagcagaatggcaattcaggctgatgaaggtagagctgaagagaaggtggggggatataaacaacagttgacagctgagccggcactggaaccagtttctgattttgttgaacttaaggaagttgtggaagatgaagatgaccaatag

SEQ ID NO: 2766 - DNA, 1158 bp, Glycine max
  Peptide Sequence Number=SeqID_94451
atggaggctagtaagtatttgactactcttgaggcttttggtagtggacccaatatgtcgatttcccacatggcgaagggccaaggggagctcagacagcatttgattaagggtgttgtcaaccctcttttgaatagctcaccatcagggatgactatctatggtgggagtttggagcgtctcttggatgatggtcttgagctgcctaaccttcttggtgctagccagcttggagagcatgttttcttgagtattgctttcactaaggatgtaatacattttgaaacattcaaaatttttgatgagagacttcacaatgtgatagtacttgagcaacattgtttccttggtctggcatgtgttggtaacctgcctttggacaagttgcaagtctatgtagcatcgaagcttcttagctctgacttttctgcctggttgtttgaggctctaaagttgagcttgagggcatgcactagagtgacattgttagggccttcgaggatgatccctgcctcacttccttttacattggatgcaccgtcgacgctttctctaaacttgcttgatggggtagttcgtcttgactaccacttgatgactctaaaagtagggcctaagtcgtcaggccgaggcgcatgtcgtatttgcggagttcctagaagacttctttcaagtccgccacatgttgggattagtgtagttggtgtacattcatcatttgccatcgacctttttgaccatgacgacattggcgagctaggtagaaaacctgacttctctaatgaacacatcggtgatgcaccaatgcttgtgactagtgaggtccctactgagccacgtgcattgcctgggtttagattcaagttgcagctggacaagctctttgatgggtttcgagcctctattggaggtgtcatctcacggatctatgtcaaattcactgcccaggatggcttggtagacaatcagggctcagatttgagacccttcctccacggtcatgactcaagtgacttcagccattgtgtgtatgtctcgttaagcgaggcaccagcgcgctcaacaaggtacaagaatttggcagagaatctgccttgcaagcacacgctcagcgcgttgtcactcgctaagcgagtcatccgtcatcttccaggctaa

SEQ ID NO: 2767 - DNA, 291 bp, Glycine max
  Peptide Sequence Number=SeqID_94452
atgccgatgcgaggacgcaacaacaccatcgtcaacacccatagaagacgaacgaagcacgcgattggaaggttaggaagaagaccaacgaaggtcacaaagaagacgcagaataagacgcacaaaaagacgcagccaagctttttcaagaggaagaagaaggattcgaagaaggatgtgaaggtcaccaatgaaggtcacgaagaagtagcaatggcgaggaagaagaggaatggcgaggaagaggaagaagcaacaaaaatcgtgaagaagaagaaatggcggaaatga

SEQ ID NO: 2768 - DNA, 413 bp, Glycine max
  Peptide Sequence Number=SeqID_94453
atggcagaatcatcaaagaaaagaaagggcgtttcgacctcatctgcggccaccgaaactcgaagtcatggagcctctagagcgcagacagcaccaattcctccttccatttcatcttccatgttgttttcttcaaaagaacaacgtatctggtacacttcctttttctcctctcattctatactagaccctaagtttcttgacttgaagttctttgatgatgaaatgtttgactgttttcaagcatttcagaactccgggttaatcgaattcatgtctatgaaacttcctttctatcctgaattagttagagctttttattcaaatttagaaattcaggagggtactctagtttctgagggcatcattgatgaggactggaagtttgatttctccggtcatgatgcctgcag

SEQ ID NO: 2769 - DNA, 498 bp, Glycine max
  Peptide Sequence Number=SeqID_94454
atgtatcctgtacaattaattgaaggtaggcataagacagatatcaaggaaagtagcttaaaccacagtctcatggctactgtttcactcaagcataagtgtttaagctatccatcaataacaactagcaagagatggaaaacaggggaatcagagagagcaacagcttctccagatagggaatcagagagatcagtagcttctccaactggggaatcagggggagcagcagcttctccgaatggggaatcagagatgataataattggtggaaatgggggaactgcttcaagcttaggagaaagtggattcgccactagggattatggatcagtggcactggttcaacccgtgcagctctgtagcatagggactaaggtttgggagctctggacatccgatcatattgttgctgacaggggagctagagtggatgatgaatggttgtcacctgctgaggccctggttttccttttccttgatgccatctgtaaataa

SEQ ID NO: 2770 - DNA, 1002 bp, Glycine max
  Peptide Sequence Number=SeqID_94455
atggtgtgggcctttgagattctatgccctttcttcaacatccgacctagtgtgtcgatcttcttccaaatgaaattgtctggaaaaattggatgggtctccttaaacaacatatctaagaagttgtttgagtttgattcaagcatctttcatcgttttaaggaccgtttctttaaggttctggctactggtgtcatggctgatgcctcgctagacgtgcgggccattctttctctttctttggtgagcaattcgctcgctgctttgggtggtattatgcgtgactttgcctggaggtcacttgtgaaacaagtcggatctgcaagtcaacctgctggtgaggctggccctgttgttgtcatggttgaggttacccccaatgctccttcctctgttttggcaaaaaggaagagtgatgatgttgttgggccgtctggtcacaagaagttgatggccccaatgagcctccgtgccctaaggcaagttgctcctgctactactactactactcctgctccttcaccttctcccgttgttactgttcaggaggttacttctgttgttgttgaagttactatgcgagccactcaaactgactctgttatggcgccatcatccactgtcgcaacacctttgctaagtgtcgatgtggcaactactagtgctcctacggctatgcaaaaggtggcaaccttggaggtggaggtcaccaaatggagggctattgctcgtactctttggcgagtagagtgccctaaggtggccaatgccattgttgcttttattgaggttgtaaggtcgaactgccaactatcttctaaatttggtggtctattggccaaattgttgtgcacccgtgctgattttgatctgctcgctaagccaatctgccggcttagcaagccattcgctgagcgcatcactcttgcgtctgagcgcaaggaagaatctagaagaagaatgagttggacacatgcgctaagcgagggctcatcccgctaa

SEQ ID NO: 2771 - DNA, 505 bp, Glycine max
  Peptide Sequence Number=SeqID_94456
gggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcgggccatgaaccccagatttcaaccaaccacgaggcgggtgctcgcgggaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacg

SEQ ID NO: 2772 - DNA, 873 bp, Glycine max
  Peptide Sequence Number=SeqID_94457
atgaaagaaaaagcagcgttatactccaaactaaaagaacaaaatctagttcctctgtggcttgtcgagcaagatgtattaccgctacggcctaatccggctgcaatcccctggctttggaaatgggatcaactttatgaactggcagcaacttccggaaagctcgtaaatcttgaagaaggaggggaccgacgtgctttaggattaagcaatccagggcttaatggaaaaccttatgccactgaaactttatggatggcattacaatggttaaatggtaaagagatcgctcctccacaccgccatatttcacaggcctcaagattcattatccgaagcgagggttcttatagtacagttgaaggaaatagaatctttttggaaagaggagattatgtacttaatccccccatgctgtggcacgaccatggctctaccaatgataaacatgcgatctggttagacgctttagacattccgcttaccaactatctcaatgccaatttttttgaatcctaccatttggatcaacaggaaataaccaaaaaaatgaatgcgtctgtactgaagcatggcaatggtaattaccgtcctttatgggaaccttctaataatgaatatcctccggtatcagtttttaaatggaaagacaccctaaaagcacttaatgatcttaaagaagcagatgaagcgagtccttatgatgatgttgccctggaatacgtcaattcattcaatggaaaggcagtcatgaaaacctttggtgcatcaatacaaatgatccgtcctaaagtacataccaaagcccatcgtcatgtttccagcaatgtatactatgtttttgaagggaatggctattcagtgatagatggg

SEQ ID NO: 2773 - DNA, 363 bp, Glycine max
  Peptide Sequence Number=SeqID_94458
atgaatgacttagtttatgtcatgtacaacttgaagctcaaaagtagacaaacaagaaaaacggttgctcttccatttgaagatatggaatttgatgatgagtggataacagaagaaggagatgatatatttgatgaagacaatctccaagttgagcaagagcaacctttaggggaaagtggtagcggaagtaatattgacttggttggaggaagtttaactgatccaactttggatgcatttgatattgacaatttagtattgaatgacaatgtggaagatcatttctcaactgaggaagagcttgaagatgatgatggtgatattggagatgattttattagaggattgatgaacatttga

SEQ ID NO: 2774 - DNA, 498 bp, Glycine max
  Peptide Sequence Number=SeqID_94459
gccacgtggtgaagattgatgtagacaacctcaacacctttttggagacatctgtggtactagctgagggtgaaaccttacccgcatattccaaatactgcgggttgcccgctgatattagagaaattaaggttgccttatgtatcccaagtcgggggtttgttttgaatgctgaaggccaacctgggaagattctcaggaaagatttaacaactcttgctcaggctgatctttggcctagtctctcagatggacatgaatgtgggagctctcatctctgggttgcttctgacagcctggtcttcgaacgcctgagcccgatcattaacttggcctatatcaggaaaaactgttggaaccctgatgatctggaagttactatcagaggggccaagagagcgaggacaaggccagttgaagccctttccacatctatagctcctcctccagcacgtaccctagcagctccttctacctcaactcctgcagattttcagc

SEQ ID NO: 2775 - DNA, 546 bp, Glycine max
  Peptide Sequence Number=SeqID_94460
atggccacaatgatggaggccatgatgagcatgaagaagataatggaagccaatgcggttgcagttgccgctaccagcgctgttgctaaggtgaacccgatgccctcatctaacctcaaccaaatgaatcatccatcctcagatatggtaggcaaagatttgggaagtacggacggccccatgatgtgcaaattcaaaacgagcacgacttcccgccatatggcttgcctcccaactatacaccacccaatgtggcgtacactcccaatgaggatgtcaataactccgctcccatactcattgagagctgacaacctcatcatatatgccactgaagggcaagtagttggtggtatacccctgcaaaacactttggaggggcctcaatttcgcccccaaccacaacccttctatggaaaaatggtgggttacacaccttcaagctttgaaaatttggtcttcgccgatgaaaggatcaaagtgggtccggaaaaaggcaaatctgatcatcctgctttgatgattgccaaaaactggggcaaatga

SEQ ID NO: 2776 - DNA, 520 bp, Glycine max
  Peptide Sequence Number=SeqID_94461
gtcgactctagaggatccccatgccaccggcggcgcgttcagggtggtctatgtggcaaagttcagcgaagcgatctacgtcttgcacagctttcagaagaagacggagaaaaccagccgccacgatattcagataatcaaagcgcgttatgacgcggtaataatgagcggagtaaaggtcatgaccaaaccgattgataccggttcacgccacgttacgcccgcaggcggcaatgtgtttgcggatctgggattttccgccgacgaggctcggcaattgcaagcgcagtccaatgcggaaattgcgcagcttatcgcactgaaaaaacagctgatgggtgagattagcgcgtggattgaggaagaaggttatcgccaggaggaggcggcgcgttatctgcacacttcccggccgcgcgtgtccgacgtggtgaatcagaaaaccgagaagttcacgctggacgcgttggtcaacatgatggcgaatatcggcaagtcggtaaaactgatcgtcgagtga

SEQ ID NO: 2777 - DNA, 387 bp, Glycine max
  Peptide Sequence Number=SeqID_94462
atggtggaagaatttgaagagatcctaggatgccctctagggggaaggaaaccatacctcttctcagggttctatccctctttagctagaatttctaagatagtccaaatcttggcgcaggaattagaccacagaaagcaagtcgaaaatggggtggttggaataccgagaaaatgtttggaggcaaaagcaagaatcttggtaggtaaaggcaaatgggccccgttcatagacatcctcgcacttttgatcttcggaggagtcctctttccaaatgtggatgggttggtgggcctggcagcgatcgatgcttttctcgcctatcatgaccgcaaggaaagcccggttgtcgttatactagccgatctatatgacacctttgactga

SEQ ID NO: 2778 - DNA, 474 bp, Glycine max
  Peptide Sequence Number=SeqID_94463
atggacaaaggcatgacactagctgatgctcctagatctagcatggcattctcaaatttactgttcccaataaggcaaggtgggaatggaagagggataggaggctgcgactctgaatggaggcttttgtctcttgttgaaattgtatattctggatggtcatttgcctcattaactcttctaaggaaggttgaggaggagcctcagttgcttgttgtctttgttgtgattgctactgttgttgttgttgtattggaggaggaacatatggcttgcttggaccagcaacattctgaaaaggagggacagactattgttgttgtggaggacttgtccatctcagatttggaagattcctccaacctggattgtatctattacttgaaaggtcataattattttgctgttgttggttttgctactgaggaggtctattataaatgtttgcaacataagcttcaggttgcttattga

SEQ ID NO: 2779 - DNA, 498 bp, Glycine max
  Peptide Sequence Number=SeqID_94464
atgggtttcaggctgaaagagggctttctggcgaaaaggaggaaagcattggtttatgcccacccggctgaaaggaggctttctggccggactcgcagacaacttccaatgccttccaggcagaatgaaaaagctatggaagcttgtggtacggacttcacgcgggatgtttccgagctagattgcaaaaccgaaagccggggggagggggtcttagcgagacctcgtcctctttctctttcgatagacttcctaaaggatgatctagctgtggatgatgtcccagctcgagagcctctggctactctcgatacctcttactccagaatagtcacgcttcccagtctctcagcgagttcgaaggcgattgaggagttttttaatcaatatccgctattctgcatctggtctttccgtaagcctgcccatcgagcggaaagaagagctggctttgttgttccttcccgcgattggaatgccaaccctagtagaaagtga

SEQ ID NO: 2780 - DNA, 292 bp, Glycine max
  Peptide Sequence Number=SeqID_94465
gtacaatcccggatggaggaatcatcccaaccttagatggtcgaatccttcacaacagcggcagcaacaacaacagccatattttcaaaatgttgctggcccaagcagaccatacgttcctccaccaatcccgcagcaacaactacaacaacagccccagaaacaacaaacagttgaggcccctccgcaaccttcccttgaagaacttgtgaggcaaatgactatgcaaaacatgcagtttcaacaagaaactagagcctccattcagagcttaactaatcagatgggataa

SEQ ID NO: 2781 - DNA, 339 bp, Glycine max
  Peptide Sequence Number=SeqID_94466
atgggtaaagcggaggaggtacaagagacgatgaaggccgacatggaggccatgaaagagcaaatggccgcaatgatggaggccatgatgagcatgaagaagataatggaagccaatgcggttgcagttgtcgctaccaacgctgttgctaaggtgaacccgacgtccccatccggcatcaaccaaatgaatcatccaacctcagatatggtaggaaaacatttgggaagtacgagcgacccccatgatgtgcaaattcaagatgagcacgccttcccgccatatggcttgcctctcaactatacgccacccaatgtggcatacactctcaatgagaat

SEQ ID NO: 2782 - DNA, 585 bp, Glycine max
  Peptide Sequence Number=SeqID_94467
gattctgaccttaatgtgtggaagccagttgaacatagtagtgatgcaaagcttgcaggtgaatccgatccattgggagagttgatgaagatattgttttatgtgtaccagaatccagtggaagtgccatgggaggcgaaccaatttggacttcctgagattggggcaaaattttacatcacacatgcagatctagcggaaataatatcaggtgacaagtgtttaaacatagcgatactacaattgtggaccatatttatgaatgagtgcggtagaagcaaagctgatcagtcactatatggtttgttggagcctcaatctatacaaaatgctaaggaaagacggcaacaatgccaacaatacattgaaacatgggtcaaggaatcacaaaggcagttgtatttaggagcttacttgaatcatgcaatgaagacaataaccagttcttttgaaggcatgtctaatcaaggtgcacctcggtgggttgaacccaagactaatgtgcaaagcggagggtttgagtgcggatattatgtcatgcactggatgtggtgcatcgtgactgccggtttgaaggatgactga

SEQ ID NO: 2783 - DNA, 429 bp, Glycine max
  Peptide Sequence Number=SeqID_94468
atgagtattcttgcttctttcatctatctatttttctactctgctttacttgcactctctctctactctcacccacaggttttaccaccgcaaccagcgcgtacaatcgctggtcataaccatttttcgtcacaccggcattgctcagtttgtgcagtttccaactctgaacacgtgctccaccagagagactctgaatttgggtccaacaccgcattgaaagtcatcgttgtgactcacaatgcccagtgcggcatcaatctccagtggcatgtccatggtggcaaggtgggaggaatgggatatgtacgggaacgtgagatacagagaagagagaaaggatatacgggaaccgagaacgtgatcactaaggagagagaaataggatacatgaattatggaggagagaaaattgagattttattttaa

SEQ ID NO: 2784 - DNA, 286 bp, Glycine max
  Peptide Sequence Number=SeqID_94469
tgccccatgtgtacagttaagaaggtgatatggaccttccagcttcccgtgacaaaagacgagaccagcatacaacgcatgcgtgacgacatgatgcagatgcacaaaagcgcaacagggggatgtatcatccccttcgaaaaacatattgcggcaatagggactaccagtaacaatatgttatcaaagagaaaaactctagatgagggttcactgttatcaagcaagtcagagacccagcatgaccacagattcacctccactccttatgttcccatggaccccg

SEQ ID NO: 2785 - DNA, 198 bp, Glycine max
  Peptide Sequence Number=SeqID_94470
atgctccatcattgcggccatttgctctttcatggcctccatgtcggcctccctctactcttgtacctcctcctctttacccattactctagctccagcacaggaaagaatgcaatgagcaatgcaaccaatgaaaagcatggatgtgaaactggaagtaacaaggacatcaacagtcctaaatgtgtttggcagtaa

SEQ ID NO: 2786 - DNA, 241 bp, Glycine max
  Peptide Sequence Number=SeqID_94471
atgttccaagaaaggaatacgcgcggagtcgccaccaacgtttatttgaggaaaaatgtcggaaaaaccggagaagacatggtctacgaactttatgtgaaaggttcgggagttgtatttacgcacggggaaggaaaaggaaggagaagcttgccacccagcttgcctaggcgagctaggttgcttcctctagaagcaaccgccttctggaggaacatcctggaaggcccaagtgggccag

SEQ ID NO: 2787 - DNA, 294 bp, Glycine max
  Peptide Sequence Number=SeqID_94472
atgcaatgcgggctgacgatggagggattcaacatccggcagcggacccgtctgagcgcgcgtaaaccccatagccacccctggctaacgccagtggtggccgcgccgcaaaagcaaaagccggggcccccttcggctccccggcaagccgggtcgtcgagccctatgtcgctaagcggcaaagccgccaagcgccaccgaacccctgcgggtttcggccgcgagcggtttcgggctgatgtccaggggcaacggctgcagacggctgtgccgtcgcgttcactggccacataa

SEQ ID NO: 2788 - DNA, 381 bp, Glycine max
  Peptide Sequence Number=SeqID_94473
atgcctggcattctctcaaggctgaatgcaaccatttactgtcgcattcgggaagcaataacaaggcaacaaggagtgccgacatccttgtacagaagttcagctttgcctctttgttcgctcacttcaagtcacacacttcacacaaaatcaatgattactgcctcacattccaatgctatgctgggagatgtttatgcttatggcttaatctcaggtcgtggtagtgtgcgagacttcacaaagcctgctgtaggttgcttgaggggtagtgtgaatctaaggagactacaaccattgtatggaggatccgggattcgagtttgctgcatggatcatggctcaagaatttctcagcctcttcttctgcttgctacttag

SEQ ID NO: 2789 - DNA, 111 bp, Glycine max
  Peptide Sequence Number=SeqID_94474
gcgaggctcacgggtgcgctttccaaaggaggaaagatgcgcggagtcgccaccaacgaaggtattagcacctctcacgttcgtctcaaaggacaacagcctattttttag

SEQ ID NO: 2790 - DNA, 370 bp, Glycine max
  Peptide Sequence Number=SeqID_94475
atggctgtacagctacagtaccctatgaagagattttccactttttgtagagtagggttaccgcgctctctatctagaatcggccatgttagaagtcttaaggaaccaaagacttccttgagtggtaaatctcaggaggtggacgcaggattggcttcggtctgtccacaggtactggagtacagcaatggatccctgggtaaccatccaccaactattggatgcccccgtgttaagaggtgtattctcttaaagccggaagtgacgcagaacagctacaccgctagcaggaggggatattctttaaccaagaccggcattttagtggaagggcgtgctcctcaactcctatacccggaagtgggaacta

SEQ ID NO: 2791 - DNA, 426 bp, Glycine max
  Peptide Sequence Number=SeqID_94476
atgatgcaatcctaccccgcaagggcattggatagaagactccaagaagattgggccagagatgcaagagaaggccctagggttcttatgagccttagggatgttctctacctaacaatgttcatgtgttctatgttgtctcctgaactactaaaccccgatgtctcgtgcatgtttagtctaatcccaatcaagcgtcatcctcagatgtctcttgttggactaaacttaaccagaaccgcattaagacacaacataacaaaaactagcctaagggttaaaggcggtgtgcttagcgagttcacactcgctcagtgcctctgtacagctcatccttcttccagattcttctacacgcttagccgaaggataatgcgcttagcggatggctcacccagcgcgtggcgtggctcagcgagttcataa

SEQ ID NO: 2792 - DNA, 1455 bp, Glycine max
  Peptide Sequence Number=SeqID_94477
atggcaacaacaacagtttccaacttgccaattgctatgtcaagacccaagattccttcatcacaaaggattgcaaatgtatgtcctgcaattcttggaggtagatctaaggttggttcatgttataaactggcaagtgtttgtcatgttgcatcagcacaacctttccatcagggcttggcaatgacatcaggtgctgcaaaatatggcaaaatcctaacaaaggcaatgtccgagtctagttcaaacaaggaagttgcaggattgccaattgatttgaaaggtaaaagggctttcattgctggtgtggctgatgacaatggatatggctgggcaatagcaaaatctctcgcagcagcaggagctgaaattcttgtcggcacatgggtacctgctttaaatatatttgagtccagtttacgacgtggaaaatttgacgagtcacgcaaattacaagatggttcgttaatggagattgctaaagtgtatcctttggatgcagtatatgacaatcctgaagatgtcccggaagatgtgaaagctaacaaacgctatgctggagccacaaattggactgtacaggttgagggaataaaagtcgcagatatggctaggcacatccccacaccggaaatggcagtgagaacacacgacgtcgacctgaagagcacagtttccagaacacaaaccaaaccagaatatccaaacgcaaacaagaatgcatgccgagaggggcacggttgttgcggaaaatactcaaacggtgcctcggtggaggggtcgcgacatgaaggacgaggtttccgacgacgacaagtggtgcagatcttccctcctcgcattcgtggctaccccaaatcctcccttcagagtccaccgcgtcggaagtcacttgcagatctggaagttgctgaatctgtcaagaaagattttggcactatcgacatacttgtgcactcgcttgctaatggaccagaggtcagcaaaccattgtctgagacatctcggaaaggatatcttgctgccctgtctgcatcaaatggatctgcaatttctcttacatacattgcttcagaaaggatcattcctggatatggtggtggtatgagttctgcaaaagctgctttagaaagtgatacaagagtgcttgcttttgaagctggtagaaagaaaagaatcagagtcaatactatatctgcaggtccattgggaagccgtgcagcgaaagcgattggtttcattgacatgatgattgactattcatttaccaatgcaccactgcagaaagaactacatgctgaggaggtaggcaacactgctgctttcttgtcatcacccttggcatcagctattacaggcgctgtcatatatgttgacaatggtctaaacgctatgggtgttggagttgacagtccaatatttaaagaacttgacattccaaaagagcatcattga

SEQ ID NO: 2793 - DNA, 252 bp, Glycine max
  Peptide Sequence Number=SeqID_94478
atgaacgtcgtcagcttcttcttctccgatgacattaggcgacatttgtgtggacaaaggactaacatagtggaatggagaaggaagagagagaggagacaccacttcaaggagaagatgagtctagaagaagctcaccaccataggtggccatggataagagcatggaggaagaaggagatgaatgaagggagaggaagagaagagcacgaaattttgtgctctaaaagagctttgaaatcagaagtttaa

SEQ ID NO: 2794 - DNA, 948 bp, Glycine max
  Peptide Sequence Number=SeqID_94479
atgcacaagtacactgttgtcgccgtcaccgttggcgtcgctcggtcgtctgcgtcctctctctcgtgtgtcgtgtgcgtcaccgttgccgtcgcgctggagactgctgctggtcttgccgctgaagactgttgtgctgttttgttcgtggcttcgttcttgcgctccgagtttccttttgcaagagaaactcgagtagggttgggtgttaggccaccgattaagcaagtgtatgaaggaaggacacatggcaagtataagaggaagccagagcagcaaccagaactgggattaggtagccaactaagagatggactgcctagaattactcattcgagagtaatcacggtggttgacgtgaagctattcatggtttcaactcgaggaaacatggatgcgcgtgtggaatttctggaacgaggttttgaaggcataatcaacatgcgtgaggacgtcgcaacaccaatcatggaagcagcaatcgcgaccatgcagaacgggaaaatcgcgatcgagagaggaagaagatcgaatccagacagccatggtcgcaatggaaggaaaggcactaacctagtaccaatgccttcaatgaaccaaagcccctacgagttactactcaatttgaaacacgaaggaacagtagaagaatatcacgagaagttcgaattgtatgcaggtccgttgagaggaacagaacctgagtatttgaaaggcatatttctgaatggagtgaaagaggtggtgagggcagagctgaagttgcatccaataaacaccctccctgaactgatggactatgcgcaaaggataaaaaacttcgtaccccattgcccagaggctcttcgctatgcgaagccttacccttgcatatgcaaagaggctgtttccggattcgaacccatgaccaacaagtcaccaaggcacaactttaccgctgatagatga

SEQ ID NO: 2795 - DNA, 1023 bp, Glycine max
  Peptide Sequence Number=SeqID_94480
atggttgaaccatcaaagaagcgcaaagaagaacagcatacacggtacacaaacctcttctcctctcattctatcattgatcctaagttcatagatatggatttcttttctgatgagagtttcaaatgcactcaagcatttcaaaactcaaatctcattccctttatgtctctgaaattgcatgtgtattctgaattggtaaaagctttttattcgaaccttgaaattcaagaaagtaccttgatttcagaattttatgggataaagatggtcattgaccaatccctcttctatgatttgacccaattatctagtgacggtgtaccatttgaaggtacattggacgatgattggaagtttgatttttctatgcatgatgcctgccggttgatttgtagcaaccaagcagatatgaccagaaggcttcttgccggttcattggctcttgaaagtcgtatccttcactatcttattgttcgtatcttactcccaagatcttcaaaccttgctcaggtttctgaagaagatcttatagttatgtgggcttttcatatcggccgacaaattgattgggcacatttaatccggtatcgcatgcataaggcattgcgattaaatgctcctttaccatatccacatttagtcactcttttcctccaacatttcaacatccctcttgattctgaaccttatgttccaatcaagatatctttctttattggtgctattgtggttacgtcctttggttaccacaaagagcatgatggctcttgggtaaaaaagggtactcaaccaaatgatgatgaaggacaattaccggttgaaggagactcttctctccttcaaagtattttggacaggttcgatggactccaaacatatgttggtgaaaggtttgatgctttggaagaacaagtggacatgcaattcgatgcaatggactcaaggatcacaaaggttgaagaagatgtcaccatcattcgagactgcctcgatttacctccacagccaccattagtttag

SEQ ID NO: 2796 - DNA, 219 bp, Glycine max
  Peptide Sequence Number=SeqID_94481
atgacgcctgttgtaacctacccttcggcgggagggcgatgcggggctcacgggtgcgtcttcccagggaggaaaatgtgtaaagtcgccaacaacgtttatttgaggaaaatgttggaaaaactggaaaaggtaggctttgtggctgatttaggggtggcctttgtggatgattgggggttcttggctgatagggtggtgggtaatgagaactgctga

SEQ ID NO: 2797 - DNA, 237 bp, Glycine max
  Peptide Sequence Number=SeqID_94482
atgagatatgtcattgcatcacgatataacataatccttgtatcgttatcccgacaacaaagcatgacattttttcctcttagaagtcaaccaccacccaattcttctgtgcaccgcatgatatgtgtcagtcacgtgtttggaaatcattttgttcaggtttatttgaaagaccgttgtcctttaccgcctctagcgttattgtggtcaaccaattgctattctcaggcaaagtaa

SEQ ID NO: 2798 - DNA, 327 bp, Glycine max
  Peptide Sequence Number=SeqID_94483
atgactaagaaaagtccttttgattcaatttgtgtgtttataactgtagggcatgagatgaattgcaaaggtcacaagaagctaaagtcttgtagtgctaaaaggagcagtcgtgctaagcggaacctgtgggctcagctcgcatctatcactaagcgcaactacagcatgcttagcgtgatgagaaaatctggaagagcacaagaatcgaggccatgcgcaaagcaagacattcgtctcttaccaggctcaacgcacgactggcaccaagcccaaatccacttactcgtgctaagcgcgatggtggcgctaagcgtgatatcgtga

SEQ ID NO: 2799 - DNA, 282 bp, Glycine max
  Peptide Sequence Number=SeqID_94484
atgaagatggtagctaaaattggaggaaggaaggtgggtgaaggcaatggtaaaaaaaagtacggttgtggttgtgaggtagaaaagggaaggtggaagaagaaaataaactctcactatggagagaaaagaatccatctaaaatgggaagaaaattctccaatcgagggaatagccttccaagggggagcactctgccggtcccgtttcttccatcgccatgtttatgaggttaactttatagttcacacaatacttgacatgttgggcttgaagcaatga

SEQ ID NO: 2800 - DNA, 399 bp, Glycine max
  Peptide Sequence Number=SeqID_94485
atgtgcatagtccaagacgatgtatcccaagaagtcaacgatatgaccaatccagaccatcaagggttccatcaaggaggacctccaggacacaatctgggggggaatttctctcaaggccaaggttggagatcccaccatgggaataacttcaacataaatcaaggagtttcatctaatcggcctcccaatcaagggcctgatttatatgacaaaaccactaagctagaagacactttgcatcagtttatgtatgtttctctgtcaaatcacaagagcattgagtttgctatcaagaatttagagccgaatggagatggagggaaggagattggagacaccacttcaaggagaagatgggtcaagaacaagctcaccaccataggaagccatggataa

SEQ ID NO: 2801 - DNA, 237 bp, Glycine max
  Peptide Sequence Number=SeqID_94486
atggagaattgcactaagcaatcactacgcatggctccaaactcgtgggtggaggacgctgtcgcaacctacccttcggcgggagggcgacgcgagactcgcgggatgcgtttccacgaaagaatacgcttgagaatggagaattgcactaagcaatcactacgcatggctccaaactctgtgggtggaggacacatgaacgaaaacgcaattcatggggctccgaaaaaagattga

SEQ ID NO: 2802 - DNA, 741 bp, Glycine max
  Peptide Sequence Number=SeqID_94487
cgcctcaccaatttagctgacaatagcattgacctagcattggtgaaggagttctacaccaacctctacagtcctaaagggccttcaccaaaacaagtcagaatacggggccacttgataaggatagatgcagacagcctcaatgtctttttagaaacacctgtggtgcttgctgatggtcaccctgggaagatccacagaaaagatctaaccactcttgctcaggtctggagtgttctctcatactccaacctggctccaacttcccgcaccttggatttgactatggatagagctagaagaccaagggcaaggccaactgaggctccttctacatcagcagctcctcatccagcttctacatcagcagctccttctaccctacctcctacagattttcaacactccatcccgatggtagagcaatttaatgaatgggtatcctggccagggactcaacctcctcttcatagggaagatgaagatctcgccgctcaggtaccccatcagtcagaggatgagtcatcagagtcttccactcctgagcccttgaacaggaagaggagggtagttgtaacccaagaagttgcagccacctctgaaaagtctcctgaagccactccagagcctccgacaccagtggcagataccacttctccacagcaggaagcagacccttccacgcctgaggatcaaaccacctcagtccagtctccgaacgcctctcctttagctactcct

SEQ ID NO: 2803 - DNA, 408 bp, Glycine max
  Peptide Sequence Number=SeqID_94488
atgaaaaatcatgaaattcattttggtacgagatactcaatagaaaaatttcaagggagactagagttacaaccttactatcaaaatgaagcagaaagaggttccaatattgataaactattgatgcaattcatggaaacaactaaatcaactcaacaagcactccaaagtgtagaaatccaggttggtcagctagtagaagcagtaactcaatttatgtccagacgagaaaaatcctttgtagaggctgaagctcaagagaaaagccctgtaaaagagcatgagtcaagagaaaaagatgaggagaaagatgaggaacaagcacaacaacaatgggaaaagtactcaaaagtagaaaccaacaagaaaatattctccaaagcaataccttcctcatcaactaattga

SEQ ID NO: 2804 - DNA, 324 bp, Glycine max
  Peptide Sequence Number=SeqID_94489
atggctccgaagaaactctccacgaagaggtctagaagagacgccgcagcggaagggtccagtgccacccccgagtttgatagtcatcgtttccggagcgccgagctccaacagcgcttcgaggccatcaaaggatggtcgttccacagagagaggtgtgtccagctcagggaggataagtatacgaactttcaggaggagatagctcatagacattggacgtcgctggtgactcccatggctaagtttgaccctgagatagtcctagagttctatgctaatgcttggcccacagaggagggagtgcgagacatgcgttcatgg

SEQ ID NO: 2805 - DNA, 303 bp, Glycine max
  Peptide Sequence Number=SeqID_94490
atggctccgagaaagctttccaataagatatctaggagggacgccgcggccgaaggaactagcgccgctcctgagtttgacagccatcgtttcaggagcgcagaccaccagcagcgtttcgaggccatcaaaggatggtcgttccaccgagagagacgcgtccagctcatggacgatgagtacaccgactttcaggaagagatagctcgccggcgttggacgtcgctggtcacccccatggctaagtttgacccagagatagtcctggaattttatgccaatgcttggcccatggaggagggc

SEQ ID NO: 2806 - DNA, 375 bp, Glycine max
  Peptide Sequence Number=SeqID_94491
atgggtgatcaagaggagacacaggaacagatgaaagccgacatgtcggctttgaaagaacagatggcttccatgatggaggccatgttaggaatgaggcagctcatggagaaaaacgtggccaccgctaccgctgtcagttcggctgccgaagcagacccaactctcttggcaaccgcgcgccatcctccctcaaacatagtaggacggggaaggaacacgctggggcatgacggcaaccgtcatctgggatacaaccgagcggcttacccttatggattgccgcccaactactcaccactcgtcctgcaagatgatgcgggccatattgcttctcccgtccttgaaagagagcctcctcaacagcccgacgag

SEQ ID NO: 2807 - DNA, 426 bp, Glycine max
  Peptide Sequence Number=SeqID_94492
atgtcgcgggggtcaggagaccttggggacgtcagcgggcgagctcctggcagtcaacagataaaaggaacaaagaccacaaagcaagaaggcttgtgtggtggctggccagctgtgaatcttgagcttaaaaacgagaccaggaagctaagagggcttctggtaatcgattaccaaggggcctctggtaatcgattaccaggctgtgtaatcgattacacagagggacatgccactgcctctggtaatcgattaccaaggctgtgtaatcgattaccagagatgaaaagccttaagataccccttttacttgcatgtagtggttacgagacgcattgtgttgcggcgcagttagattttcgtgaaagagtctacccctttcttttctttcccgtagatcgtgatggtggcgcagctaatccatga

SEQ ID NO: 2808 - DNA, 572 bp, Glycine max
  Peptide Sequence Number=SeqID_94493
ctgacccagcaaatcagggaccagctagaggagtccatcacataaaaagtgacgcggcagctcatggcatccttcagccagatgcagtccaagattcagttccagatgcaatcttagggacttgcactgcctcccgagcctctggttggtccctccagtcctcgagaaacgatcctgagacgggtgactcagataggtgcggcttttacatcgaagaagatcctgcccgcctggttaccttggggagagtttatgagggatccactattgttcataacactcctttgttgcctagccaagtaaatgtgggtgtggaggaggttacagatgcagatgctccagttcctgtacccactgatgaagtttccttagtggggcatgcacttcacaccttccttgcttggccgacacatctggtcaagtctttatcacaacaggttacatgggatgccaccgtgttcggggtctttaatccagatttcccgctctacataaagcacgaagacctctccaaaatcgcacacggtggtcaatgtctcaacatatcagtgttacagttgtggattctataa

SEQ ID NO: 2809 - DNA, 375 bp, Glycine max
  Peptide Sequence Number=SeqID_94494
atgggtgaagtagaggaggtgcaaaagcagatgaaggccgacatggaggccatgaaagagcaaatggccacaatgatggaggccatgatgagcatgaagaagataatggaagccaatgtggttgcagttgtcgctaccaacgctgttgctaaggtgaacccgatgcccccatctggcctcaagcaaatgaatcatccaacctcaaatatggtaggcaaagatttgggaagtacgggcggtccccattatgcgcaaattcaaaacaagcacgccttcccgctatatggcttgcctcccaactatacaccacccaatgtggcatacactcccagtgaggatgtcaataactccgctcccatactcattgagagctga

SEQ ID NO: 2810 - DNA, 1260 bp, Glycine max
  Peptide Sequence Number=SeqID_94495
atggttacctcagagccctacactgtggcaatgaaaggcaccatgcataaacctcaagtgaacctaggggcagatcaaaaatttcctacttttaatgtccaatcttgtgaatttgggatgaccggccctctcgatgagtcaatctcttgctgcacgccctcgacttcagaggactacacgtcctcaacttcagacgactacacaggactaaacgtcctcgccttcagagggctacatgccctcgccattagaggactacacgtcctcaccatcagaggactacacgtcctcaccttcagagggctacacgccctcgccattagaggactacacatcctcgccttcagagggctgcaagtcctcgccttcagagggctacatgccctcgcctttagaggattgcacgtcctcaccttcagaggggtacatgccctcgccttcagagggctacacgcccttgcctttagagggctgcatgccctcgccttcagaggtctgcacgccctcacctttaaagggctctgtacccttacttttagagggctacatgtcttcgccttcagagggctacacgccctcgcctacagaggactacacatcctcacctacagaggactacacgtcctcgccttcagaggactacatgtcctcgccttcagaggactacacgtcctctccttcagagggctacacgctctcagcttcagaggactacacatcctcacctttagagggcaacaagccctcaccttcaaagggttgcatgccctcgcctttagagggctacacatcttcgtcttcagagggctacacgccctcaccttcagaggactacacgtcctcgccttgagagggctacacgtcctcgtcttcagagggctacacctcatcgccttcagagggcttcacgccctcgccttcagggggctgcaagtgctcgccttcagaaggctggacatcctcgccttcgtaggacaaaacgtcctcacctttagagggctgcatgccctcaccttcagagggctgcacgccctcaccttcagagggctccgtaccttcaccttcagaggggtacatgccctagcgttcagaggactacaggtcctcacattcagaggactacacgtcctcgcctttagaggactacatgtcctcgccttcagaggactacacgtcctcaccttcagagggctactcattctcgccttcaaaggactagatgtcctaacctttagagggctacacgccctcgccttctga

SEQ ID NO: 2811 - DNA, 312 bp, Glycine max
  Peptide Sequence Number=SeqID_94496
atgggaagaaacattttacctgagaggaaagtagagttgtatcacactaagctagataactttaaggctgagctggagaggcgtaatttccataaacgcctcaccaatttagccgatgagagcatagacctggctttggtgaaagagttctatgcaaatttatacagttctgaggatcgtccaccaaagcagtccagagtcagaggtcatttggtgaagattgatgctgacaatctcaaacgcattcctggagacacctgtgcctttcaagagggtagcagactcacattcacctttctaacatcatcataa

SEQ ID NO: 2812 - DNA, 312 bp, Glycine max
  Peptide Sequence Number=SeqID_94497
atggagtcaggtgacatgcgggggtaccttatggttatccccacctttcgtcaaccaggggcgaacaagctcgttgacgtgcagaaactaacatcgccttctgcaccttttgtcgtcctaacccgtgaagtcaggttttactctcgtcatctagaaacaatcaagcctggcgacgcacgagattcttctctgctaggcagggatgatcgagtgcaatggcgaatggaagtgtcgtggttgtccaactttgtcgctttcaagacactgaagtttgttggcgcttctgatgccttttctattctttctgaatga

SEQ ID NO: 2813 - DNA, 123 bp, Glycine max
  Peptide Sequence Number=SeqID_94498
atggcggtttgtggtggttactggtggctgtgggtgatggagaaagttcttgggacgttggaaatgagaattataagcaattgggcttggatccagaattgggctgaaccggcttggacttga

SEQ ID NO: 2814 - DNA, 234 bp, Glycine max
  Peptide Sequence Number=SeqID_94499
atggttgctcaggaagaccaagaaatgaagccacaccaagaagagacagaaattgtaaacttgagtgttggcaaggaaaggaaagaggtaaaagttggtatgggcatgaccacaccgctgttccccggtaaaacaaaagctaagaaggatcaagcccgagatgtccttaaagatctaaggagaggtaaaaaagcagttcgatgctggctttttggcagtggcttgataccctga

SEQ ID NO: 2815 - DNA, 209 bp, Glycine max
  Peptide Sequence Number=SeqID_94500
atggacgaagatcaatgggcatattacagtgtgatgtccgaagaagttgatatggattttcaagatgaagaagattgtggtgtgaatgaagcacatgttgattgttcagatgcttttaatacttctcaggtctttgcaacccgagaagatgttttgaagtgggctcgaacggttgcccatgaaaatggtttcgttgcagtaattatgag

SEQ ID NO: 2816 - DNA, 345 bp, Glycine max
  Peptide Sequence Number=SeqID_94501
atgggctcaaaaatataccctaaggttcatgagaaccctagggccttctttagtagctctagcctaagcctcttggagtcttctatccaatacccttgggggagtgaagttgggcaggttcacttgcagatgaggaagatgctactggttgagtcatttgcctcacaagttcttcaagggaaggttgtggaggagcctcaactgtttgttgtttctgaggctgttgctattgttgttgttgttgttggattggtggaggaatgtatggtctgcttgggccagcagcattctgaaaataaggctgttgttgttgctgctgctgttgtgaaggattcgaccatctaa

SEQ ID NO: 2817 - DNA, 246 bp, Glycine max
  Peptide Sequence Number=SeqID_94502
atggctcaacctccacctcgtgagaggactctaagggaaatggctgcacctgatttcacttatgaaagattatgtgaagaccctcataaaacatctgaaagaattccatattgtctgctccaccatgaaacctccagatgtccaagaagatcacatctttctgaaggcctttcctcattcattagagggagtggcaaaggactggctttattaccttgctccaaggtccatcacgagcagggatga

SEQ ID NO: 2818 - DNA, 696 bp, Glycine max
  Peptide Sequence Number=SeqID_94503
atgaaggttacaaccctcaagcaaaccagccatgatatgatcgctcatgtaggtaaggcttgggctgtcgtagaagagctgagaaagttccttgtagttgattcattggaagaagtgaacatgaaacttgacaagttctacatggtcctcattctgaagagcttacattcagactttgatcatgtgcgtgatcaagtacttactggggaccaggttccatcaatggattccctcatcactagacttctccgcgtgcctcatttattgaaggatgagaatcctactgatggtgtggagacgtcagccatggttgtgtctcgaggtagaggaggcatccacaacagtagaggaagtcgcagtggaaggggtggacgttctcgttgtacctattgcaagaggatgggtcacacccaagagaattgttattcgttgcataggtttctcaacaaggttgcacaggtctctagatcagagaaagcagagtctagattctatgatgaggagtatcaggagtatttgaagcttaaatccgagaaacccagcaaccaagctcaatcctcatctgtaccatatttttcaatagcatgtatctctcaatccattgaaggtcctagtccttggatactcgaatcaggtgcctctgatcatatttctggtataacatgggatggggcgactgattcgagaagaacatga

SEQ ID NO: 2819 - DNA, 339 bp, Glycine max
  Peptide Sequence Number=SeqID_94504
atggagacccacattggggaaaaccgtactcgacccctcttaagcaatatgtgtggtaagcccgggcacaactcctcaaattatgttgataaaggcacaacttgtttcaactgtagacagaaggggcatattcagagagattgcccatatcccaagaaggagcagaatggtgagagcctgaatgaccaaactagactcctaaagaccacaggaagtgatgcaatcctccctaggaagggaccagtcactagagccatgagcaagaggctccaagaggattgggcaagagctgctgaagaaggccctagggttctcatgaaccttagggtagatttttaa

SEQ ID NO: 2820 - DNA, 276 bp, Glycine max
  Peptide Sequence Number=SeqID_94505
atgtcaggatttacacgcaattctcctcaaatttcagccagcccgcatcaattagaccttgcaccttacgcttcagagccctacaatgctcaatggaacgccccggggcttttccgtgacaagcacacattgcgttcgagtcgtattctcggagaaatggaggttgatgaaccttggctagggttatggctaccattgaattatcaagtggtcttcgtcattggaagtgcggtagacagactttgtggtcgatttagggatggcctttgtggataa

SEQ ID NO: 2821 - DNA, 261 bp, Glycine max
  Peptide Sequence Number=SeqID_94506
atgacaacaactaaaggcaatagaggaagaaatgagctagttcttaatgagagggactgggtttggctccatcttaggaaggatagattccctactaagaagaaatccaagctcagtcctagaggtggtgttgatactgaggaggaggaaccaacaaatttgaggtcaaatcctcttcaagggggaagagatgatgcaatcctccctaggaagggactaatcactagagcgatgagcaagagactaagaggattgggctag

SEQ ID NO: 2822 - DNA, 590 bp, Glycine max
  Peptide Sequence Number=SeqID_94507
atgggtgatcaagaggagacgcaggaacagatgaaagccgacatgtcggctctgaaagaacaaatggcctccatgatggaggccatgttaggtataaaacagctcatggagaagaacgcggccactgccgccgctgtcagttcggctgccgaagcagacccgactcccttggcaactacgcaccatcctccctcaaacatagtaggacggggatgggacacactggggcacgatggcagccctcacctgggatacaaccgaacggcttacccttatggactgccgcccaactattcaccacccatcttgcaagaagatgcgggccacattgcttctcccgtccatgaaaaagagcctcctcagcagcccgacgaagtccataaagaccctcaagattatgctcggagggatgtcgagttttatcccccgatccccgaagggccggcaccgggcacgttgcctcaacccaacctcgcagcatcgccaatagttttgtctatggaagggccgcccccggcaactgaagaaaggaggaagctcgatctcctggaggaaagattgagggctgtggaaggatttggggactatcc

SEQ ID NO: 2823 - DNA, 174 bp, Glycine max
  Peptide Sequence Number=SeqID_94508
atgtggagaccagtcagggtcatgctgatttgcgagaatgttccaaccatatgggatcaatatagactcaaaggatcactcaaaccaagtgtatttatccccaaggcctacactccgaagagtctgtcaaggcctctccctcctgattcaggtccaacccagaaaacattttaa

SEQ ID NO: 2824 - DNA, 357 bp, Glycine max
  Peptide Sequence Number=SeqID_94509
atgtgtagggaatttaaagagaggcttttagatttaggcgttgaggtcagcccagttttaccacctggcgatcaagaaagttcacaagtttcagggggaagccaactatcattaaaggatgcatttctttcgaaagctaaagtcaaaactatttccgagatcaatggcatttctgaggatgttgtttgtgttacggtgggcactattagcaaaatagtcatggataatcattcatggtatagagttgaagtaatggttacccaaaacaatgagagtagcaagtttttgctctgggaccatgaatgtgctgaattgaatgatcaaacagctgatgaagtgaatagggtcaagattgaa

SEQ ID NO: 2825 - DNA, 670 bp, Glycine max
  Peptide Sequence Number=SeqID_94510
atgtggagacacttcagaaggtccgcaaggcatgggaggtgttgcaaagacaaggaactcagaggtagtaacaatgggcccatcggtggctaccgtgagtggttgaaagcccacgtgcaaggtttggattggctcccaagtctgaaagccactaaaagggaggaaggtgaggcaccggaggaagacgaaggggtgcaggcccttaggacagaactcaagcaagctcaaacagtcaaagaaaggttcaaatctgcagctcttaagatccgaaaggagaatgtcgaactgagagatgtaaatatagctaccaccaaggctttggaacaagagaccaaaatggcccgtagggaagaacatagccggaacaagttccgaggggctctgtggggcaagaccaacatgttagccatcatcagcaagtaccaagaggaactaagtctagccacggcccacgagcatagggtggcggacgagtatgcccaagtgtacgcggaaaaggaaactagaggaagggtgatcgactcgttacaccaagaggcaaccatgtggatggaccgatttgctcttaccttgagcgggagtcaaaaacttccccgattgctaaccaaggccaaagcgatggcagacacctactccgctcccgaggagatccacggacttctcagctatt

SEQ ID NO: 2826 - DNA, 546 bp, Glycine max
  Peptide Sequence Number=SeqID_94511
atggcatcaagaaagaggtctagaaccgatgacatctcttcatcatctatcccagctcctcagtcagcagccataggaccagatgtccaacactcgcaaaccttagtccctatgctacaaagcttattcagaggacaacttattatcatgcccagcctgcgagagttggctcacaacaggccaatcatatctatggagcattttcttgagcaagtagcctggcctgaagctcaacttccattggtgagacccaatgaggctactcctcctgagcccgcaccggcacgggttgaaccaatgccagctgagccacgatctccagtggtgaatccacctccttctcctgagcttgaagtagttcccccatctccatctctgattatcatctctgatgcatcatcggatgaaactactgccctcctgattcaccaactggagaaacagctaatccccctgattccccagttggaggaattgccgatctttctaattcttcatctagagaagtttttactctccctgattcccccgtttagacactgttga

SEQ ID NO: 2827 - DNA, 330 bp, Glycine max
  Peptide Sequence Number=SeqID_94512
atgatcgaaagttttcaacaacaacaacaaatgtcagttctagaattgtacgtagaaaaggatgttgctggtggacgtaatgtatctcatcatgagtcggaactgtcaagaaatataagcaatttacatgatgatgatgatgatgatgattatcttgcatctaactcatacgttgaagagtctttcgatgaagatgatagtgatgatggaatatctgatacagacaatgaagtcactgacatcgttgaccagtctcacttgttcacccaaccagaacggtacatgtcttgtgaatacggaaacttagttgatacatctatctttttatga

SEQ ID NO: 2828 - DNA, 665 bp, Glycine max
  Peptide Sequence Number=SeqID_94513
gattgatgcaaacaacctcaatgtctttttagaaacacctgtggtgcttactgagggtgaatctttacccgcttactcaagatactgcaggatgcctactgacatcaaggaaattgaggttgctctgtgcatacccggccgagggtttattttaaatgctgaaggtcaccctgggatgatcctcagaaaagatctaaccactcttactcaggtctggagtgttctctcatactccaacctggctccgacttcccacaccttggatttgactgtggatagagctagaggagtcgcttccaacagtttagtctttgaacgtttgagcccggcgaggccagctggggttccttctacatcagcagctcctcatccagcttctacatcagcagctcctcctccagcacatatgacaacagctccttctaccctacctcctgtagattttcaacactccatcctgacggtagagcaatttaatgaatgggtagcctggccagggactcaacctcctcttcacagggaagacaaagatctcgccgctcaggtaccccatcagccggaggatgagtcatcagagtctttaactcctgagcccttaatcaggaaaatgaaggtagttgtaactcaggaagctgcagccacctctgaaaagtctcttgaagcca

SEQ ID NO: 2829 - DNA, 207 bp, Glycine max
  Peptide Sequence Number=SeqID_94514
atgggaaaggttttggtctacgaacttaatctgaaaggttcgggagttgtatttacgcacgaggaaggaaaaagggggaggaggttgctgcctagatcgtctaggcgagctgggttgcttcctccagaagcaatccagcttcgaaaaacaatctggaaggcccaattcaaaaatttcaaaattactatttgcatccccccattttga

SEQ ID NO: 2830 - DNA, 261 bp, Glycine max
  Peptide Sequence Number=SeqID_94515
atggaatcggaggaagacaagcaccatggtggtagtagagacgagtctagtggtgctagcagtgacaacttctgcacaacgaaacatggttcaccggataagaacacttgccaagaaatttgctggaaaacagaaatagttcactggaagaagggtaacgagttgaatgatacaccagaaactggaaaaagaatgatagaagaaaggcaacgagcaaaagggctcaccagggcaacgagtaaaatgctcgttggaaaatag

SEQ ID NO: 2831 - DNA, 978 bp, Glycine max
  Peptide Sequence Number=SeqID_94516
atggctaactcatctctgcttcccaaaccctattattaccataatttccattatcaacacctaagatgcttcaagatcaacctcccaaaatggactactagtactagagcttcctctgctgcccctggggtcgacctcaacactctcgaatttgccatttccaagaaagacagtgatgctgttaaagaggcacttaatcagcttagtgaagttggttgggccaagaaatggagttctcagccatatgtttcatgtcgtacgacatcactccgggagctgacaagtctaggcataaaaaactcagagaaccttgcaattcctagtgtcagaaacgatgcagcttttctttttaccgtggttggaacaacaggatttttggctgttcttgctgggcaacttcccggggattggggcttctttgtaccgtacttgattgggagtatctcattagtggttttggctgtgggtagcatatccccagggcttctccaagctgctattggcagcttttcaacactttttcctgattatcaagaaaggattgccaggcatgaagcagctcactttttgattgcttatctgctgggcctacccatttttgattattccctggatattgggaaagaacatgtcaatctcattgatgagaggcttgaaaaacttatctatagtggacagcttgatgccaaagagctagatagattggctgttgtgtcaatggctggactggcagcagaaggtttaacatatgacaaggtggttggtcaatctgctgatcttttcagtctccagagatttattaacagaaccaagccaccactcagcaaagatcagcaacaaaatctcacaagatgggccgttctgtttgctgcttctctcttgaaaaataacaaggtgactcatgaagccttaatggcagcgatgacaaagaaggcaagcgtactggaatgcattcgggcaatcgaaaatgcagcatag

SEQ ID NO: 2832 - DNA, 93 bp, Glycine max
  Peptide Sequence Number=SeqID_94517
atggcaaacaggaacaaaacgcccaaatatcgagatagatacaactacactgtcaaagacaatttgatggggcaccagggggttgcctcctga

SEQ ID NO: 2833 - DNA, 975 bp, Glycine max
  Peptide Sequence Number=SeqID_94518
atgggagctctaagagttatgttaatgatattagctgccatgtggggtgttgtgcgtgttgggaagacttctttagttaacctgattgtaaaaggttctccaattgctcgccctcctcaaacaattggttgttcagttgatgtgaagcatattacttatggaaattcaggcagctcttccagtagtcttaagggtgattctgagagagatttcttcgttgaactgtgggatgtctcaggacatgaacggtacaaagattgtcggtctctgttttattcgcagattaatggtgtaatttttgttcatgatctttcacaaagaagaacaaagactagcttgcagaagtgggcagctgagattgctgcaactgggacattttcagctcctttgggatctggtggtcctggtggccttcctgttccatatatttttattggtaataaagctgatattgctgcgaaagagggtacaagaggaagcagtgggaatcttgttgatgttgcacgccaatgggttgagaagcagggtttgcttccttccagtgaggagcttcctttgactgagagttttcctggtaatggtggccttattgctgctgccaaagaagcaaggcatgacaaggaggctgtggtgaaatttttccgcatgttgatcaggagaagatatttctcagatgaaatacaaataccttcaccagcatggtccattccttctgttcagagacaagctcagcgtatagatgaaaatttcacagaagatgatcaatcttatgatacaagtctaagcagtgatccttacaagtataacatgcttccgccacttccagcacaacgcaatctaacaccaccacccacactctatcctcaacagccagtttcggtgtcggaaaactatagtttccctagattttccttgtcaggctcctcagaaatcagtactgtggcgagaacaaagcgatcagatattaatgtctga

SEQ ID NO: 2834 - DNA, 201 bp, Glycine max
  Peptide Sequence Number=SeqID_94519
atggattttgaagacagggttaataaaaggccagatgattcaatcattgagtatgaagtttgtgatcctaagagcctactcttcatatttggcatgcaattagattacagtgatgctctgattgggggaggcttctctttcaagaatcctaacgcgacacagacttgtggatgtggtaaatcctttgctgccgaaatttag

SEQ ID NO: 2835 - DNA, 1455 bp, Glycine max
  Peptide Sequence Number=SeqID_94520
atgaaggcctcgggtggaggaaacaataatgagcaagaaatgagacctggactacaaggcggtgaaggagcagaggctgtatctggtattggtgtcaattggggtgcaatagcatctcatcctatggatcctcccattgtggtgaatttgctaaaggacaatggaattaaaaaggtaaagctttttgatgcagattcttggactgtgagtgctttttctggcacagacattgaagtcatggttggaattcccaatgatcaattgaaggaactatccaaagaccaagacaatgcagaagattgggtcaaacaaaatgtcagcaaacatgttcatgacggaggggtcaacatcagatatgtatctgttggaaatgagccattcttgaaaagttacaatgggtcatttgtaggaatcacatttccagcaatggaaaatgttcaaaaggctattgataaggctggtttaggagacaaaataaaggtgactacggctttaaatgctgatgtttacgagtctaattcaaacaagccctcagatggtaatttccgcaaggacatttatggtgtcatgaaacaaatagtgaagtttcttgatgaaaagaagtcaccgtttcttgttaacatatatccattccttagtctatatcaaaatgaagattttccagaggattatgcattctttgaaggtcatggtaaaagcactgatgacaaaaatgcacattacaccaacatgtttgatgctaacttagatacccttgtttggtcattaaaaaagattggtcatcctaatgtgtcaatatgcgtaggtgaaattggatggccaactgatggtgacaaaaatgcaaatgataaaaatgcaaacaggttctaccaagggttccttaagaaaatggcaagcaagaaagggactccacttcaccctggacccgtgaacacttatttattttctctttttgatgagaacatgaagagtgttgcacctggtgactttgagcgtcattggggtatttttcgttatgatgggaagcctaagttccctattgatttttctggcaaaggagaagataaaatgccaataggagcaaaaggggttcgttaccaagagcacaaatggtgtgtccttaaaaataatgccaacaagagtgcgttgggtggatctttaagttatgcttgtgcaggtggtgattgcacaagcttatgtcctggttgttcttgtggaaatttggatgcatctggtaatgcttcatatgctttcaatcaatactttcaaataaacgatcaaagtgttgaggcatgtgatttcgaggggttggccaccattgtatcaaaggacccatcaaaaggagattgttatttccctatagctatcatcagtagtggaaacattctcagagtaatgcaaaatgtggtaggcattttaattggattcacattgattttcacaacttttatgtaa

SEQ ID NO: 2836 - DNA, 375 bp, Glycine max
  Peptide Sequence Number=SeqID_94521
atgggtcccttttcactatccgttatggttaatgactctgccatttcattaccagatacttgtacgaaaagaaagcagaacttacttctgaaaaattcttttgcatcagttagcatgggagatgaaaagccatttgacttcctacgcattttatttgagggcgttattgcaggaggtacagctggagttgttgttgaaacagctttatacccaatcgacacaataaaaacacgtctgcaggcaggggggtgttggaaagttccatgtcgattgcctcaattgatgggtgtgatttatttacttattggtcgagttcatttaatgccaattgcttttaagatgaaatctaacaatgaggaaataggaaagctttaa

SEQ ID NO: 2837 - DNA, 306 bp, Glycine max
  Peptide Sequence Number=SeqID_94522
atggcggtggcggcaactacgatggtggtggacgaggcagtggtgacggggattgctacaactgtagtgaattgggacatctggctagggactgcagctaagggggcagtggcagatatggaatggcggtggcaaaaggtacgatggtggtggaggagaggcggtggcagatatggaacggcggtggcaaaagatacgatggtagtggaggaggaggcggtggcagcggaggaagttgctacagttgtggagagtctaggcatttggtcagagattgcccatcaagtgctcgcgaggctaggctga

SEQ ID NO: 2838 - DNA, 1410 bp, Glycine max
  Peptide Sequence Number=SeqID_94523
atggtgggttatggtagatcactagacaggaaagccgtgaaggcttctggaaagtgcaatctaaagacaggatccattggagtgagaaattctcccaaaagaacaaataagttggatagcaaagccagaggatgcagtcaagagttgactgataaagagaatcagtattttccatttaaggaacatatgagaaagtgcccagaactttccaacaagtgtacttttcttacagaaaagagaaaggctattgaacttcatcctggacaaatgctcacttctgcaaaaatcaagttacaactttttccaattaatgaagaaactcggataggacttgaaaaggatgggcataatccttatttggaactcacacttagaggtcgaaagaaaatatcttcaatattaaaacaccttggaaagaagtggggaagttcaagtatagccaatggggaccttatactttttccatataatgtaatggaaaatctatctgactgcagaaggtggacaattaatgacagtgacacaacagcctctgctgtttatgctgctgttggaactcctgcacttttccggttgaagtatggctggttctacatgcatgagcccgggtcttttggtataccttctacaccaactccctataagcttgttgtacccggaggagacaatgctaatttagaggagactttacgtggtgaacgggacgaggttgagataagcaaagaatacaaagaaaccgaagtgggcaatgcagcaagtgaaactgtggctcagaaagtagaaaacgctgctgttgatcctacggataatgagccaagaacaagaataagtagcagccttcaacagtcatcatctccatgggttgatagtctaagcaatataagcatagggggcctcctgtccgaagcatcattatttggtgggcttgatccaaaatcatttgctggcatacagccgtgtgatataacttctgattcattggatgcttttattgccgctgctcaaattaataattgcccagttccaagactacctgctgatgacttgcacacatctattttggatgctgaagagacatgtcatgcatttcctcttcaaaagttatcttccccaacggatgtgcaggcagcttgtagaaaggattattctgctgtctgcagtcagggtgttttttcaaacttgttaaagttgtcaaatatagataaggtcaatgatcaagatggagcttcacaaaatcctccatcggggaagactcagacagacttgctttcttcacgcccatatgatgatgatagaagtcttgggttaacaggcatcaattggaatgattctatgggaccttttgatcttggcatgcccgcacagaagcttattggtggagacggtcttactggcaaatttgttaaatag

SEQ ID NO: 2839 - DNA, 1314 bp, Glycine max
  Peptide Sequence Number=SeqID_94524
atggatcccatcatcctctccgacgaagaagacccttcaacgccgttcccgctccgtcccaagaaacgccgaaccgaaccggatccaaacccaaacccaaaccgcaccgtcttcgtcatcgacgatgacccaacccctcacaaatccgccacaccttctatcgttcccgagactccaatgtccgcgctattcgattccgacattgcaatcgtcaaatgcaccataccttccgatcccaccgctagggtttcccccaaaaaattctctgccccttcagggattagtcaaatgatatgtttggaatcggataatgagtcggaaaattgtggaatgggcacacgggacaaaaatgagccaagagattctagatggatttcaaattcaatggggtctggaagttctcctggtatatgcttggaatcagataacgagttagaaaattgtggaatggacaaaccggttgagaatgaaccaagagattcaagatggacttcaaattcaagggaatctggaagttctcctcatatatgtttggaatcagataatgagctagaaaattgtggaatgggtgaacgaggtgagaatgaactaagagaatcaagatggacttcaaattcaatggggtttggaagttctcctgagaggcatatttcgtggggaaatgctactcaaactgaaatgcctggggatgacctttcaaatccagcctcttcacaagtggaaaatatgaacatgcagcaagaggagaacgccaataatattaaaaaatccaaagtttctgcaaagaacacaaccaaggcagtgggaaaaacaaaaatgacaaaagaagaaagaagtcgcttgatggaggaaaagaaactacagaaagaacaagagaagttaaaaaaagctgctctgaaggctgaagctgcagaactgaaaaaaattgaaaaagaaaagcaaaagtgggaaaaagggaagtttgcaatgaaatctatagtggcagaaattgatgcaaaggtggttgaattaggttcaattggaggacatctgcttactaggtttgctgaaaaaggacttacataccatattacatcaaatccaatcacagggtcaattttgtggtctatgaaagttccagaacatatttcacagctttctactgaaagaattgagattccatatatcttgctcgtttatgaggctgacaaattttgtaaccttgtcatgaatgattctctttttgatcaactctctagcattcaaagtctttatccagcttatacagtttgttacctcaccaataggttattggcttatattaataaaaagtga

SEQ ID NO: 2840 - DNA, 1335 bp, Glycine max
  Peptide Sequence Number=SeqID_94525
atgaccttgaggtggcctgagaatctatatcaatcatatcatcggagatttagggttaagaaagaggcctcagaacctgaggctgacccagaaagggatcagagaactgtttttgcctaccagatgccgttaaaagcaacagagagagatgtgtatgagttcttttcaaaagctggcaaggtgagagatgtccgtctgatcatggataggaactcaagacgatctaaaggagttgggctaaatgaaactcagcttgagctgtctgcactagagtttttgtttccctacatctctttgctgtatgctttgtatattgaattttatgatgcgatgtcagtgccaatggctattgctctctctggccaacttcttcttgggcaacctgtaatggtgaaaccttctgaagctgaaaagaaccttgttcaatctaatgcttctggtggagcggccggtgtagctgggccctatggagctgtggacagaaaattgtatgtgggaaatcttcacttcaacatgactgagagtcagctgcgggagatttttgaaccatttggtccggttgaggttgtccaactgcctcttgatttggaaacaggacactgcaagggttttgggtttgttcaatttactcatctagaacatgccaaggctgctcagagtttaaatggaaaattggagattgctggcaggactatcaaggtttcatgtgtaacagatcatgttgcaagccaagatgcaactgcaaaatctgcagacttggatgacgatgaaggtggattgactttaaatgctcactcaagagcattgcttatgcagaggctggctggcgcagaccctgcaagcataggtttgcctgttgtgaatggctcagttcctgctcagcaggctatcagcttgcctattggtgcaccagttctaccaacgctagtcatgcctaatccagtggtagaacctgtaggaaaccccagcgagtgtttacttttaaagaatatgtttgatccgagcactgagacggaaccagattttgatatagacattaaagaggacgtagaggaagagtgttctaaatatggccgagtgaagcatatttttgttgacaaaaaaagtgcaggttttgtgtatttgcggtttgatacagtggaagcagcaagtgctgctcaacatgcaatgcacttgagatggtttgcacgcaggttaatttctgctgtcttcatgtccccagaggctccttgctatgcggaaggggaggagtcttacccttgcatatgcaaaaagactgattccagatttgaacccatgaccaaccagacaccaaggacagaaagagatccataa

SEQ ID NO: 2841 - DNA, 204 bp, Glycine max
  Peptide Sequence Number=SeqID_94526
atgagtttatggcttcaacagggaaaattccactcattccacccagttgcgaccatccttagttacctgaccaaggcccctctggttccaccgggtacaccagtggtgaatgcgttgtcaaagcagcgagctatgctggaaaacatcctgagggcttgtgttggattagctcctgagaacaacatgatcctagagtacaagtga

SEQ ID NO: 2842 - DNA, 1299 bp, Glycine max
  Peptide Sequence Number=SeqID_94527
atgggaggatgtgcaactaagccgaaggtctcccaggacgatcccgatggaaagcccaaggcaccccaaccagaaccagaacctgaacctgaacaccaacaacccaacaacaaagacaccctgcaaaccaaagtaccccaagtggaacaaggtgctgctcacaaagaccacaacaaccttaatgtcaacgaaattgttgacgacgaccaagcaaacaaaccacgctctctcagctccttgttcaagcagaatgaagataaaaggggttccacagaaaatgagaaaaacaaagttgaggagtctgtgaaagaagaagtgttagaggtcaagaaacctgcggaagatactaaaagcaatgagccaacagttaaacaagaatctctaaagccagaggagaagctgtccgaggagagtaaaaacaatgaatcatcaaaacaagaatacgagactttgaaggcagaaactcatgtcaatgaaccatctaaggaaacagtgaaacgagagtcagaagctgagaaaccttcagaggaaactcatatcagtgaaccagttaaggaaacagagaaactagagtcagagactgagaaaccttcagtggaaactcatatcagtgaagcagctaaggaaactgtgaaactagaatcaaaagctgagaaaccttcagaggaaactcatatcaatgaaccagacaagaaaacagtgatagttgagtcagaagctaagaaaccttctgaggaaactcatatcaatgaaccagttaaggaaacagtgatagtagaagctgagaaaccttctgaggaaactcatatcaatgaaccagctaaggaaataatgatagtagagtcagaagctgagaacccttcaaaggaaactcttgtcaatgaaccagctaaggaaacagtgaaactagagtcagatgctgagaagccttcagaggaaaacaatcaaagcagcgagtcactgaaagaagaatttgtagaggccatggaggcaccttcagaggaaacacaaagcattgaacccatcaaactcaaagaagagcctattgaaccatcagaagaaggtaagccaagtggggaatcagagaagaatgcttcagaaactaagactctcattgtagagagcataaactctgaggtggctcctgtgcctgaggagagagtaattgaagaaattccaactgctgccaagtcttttgagaaggtaacaaaggaagctgcatcaagcacagaagagaaaagccataatggggtggagaatgcacctaaggctgttgatgctggcgctgagattcactaa

SEQ ID NO: 2843 - DNA, 588 bp, Glycine max
  Peptide Sequence Number=SeqID_94528
atgacagttggagaagagatagagcagggctgtgaagcagaaaaatgtgaaggtagcatcaagatacccaatggagatgtagcagctctattgggaggaagagagttagcatgggaatgctcaaactcaaactcaaactcaaagaaccccatttgcactatgcaaattatgatgattgtggatgagaaagaaacccttgcatcccaaggcaagtacaaaagcatcccacaaacccactgcatactgacttatcccattgtgctgcatacttggcaagatggcacagggcatatccaaatctgtaacatgtaccagatagtattgcgaattcttaagccaccagaattgatctctttggctgtctggtttcttttgactgggttttactgctttgctccttttaatgagcttaagtattttttgttccaagttatttccttatcttctttctttggtgtatctgcggcaacaagtttgataccttgtgcgaaatattcaaaccctcaccacttggccaaccttagtgggttggttatttccatatctgactgcaaccattttgtagatatcaaagagttgctgacataa

SEQ ID NO: 2844 - DNA, 1257 bp, Glycine max
  Peptide Sequence Number=SeqID_94529
atggttagagacgatctatgcatcaccgttcccagcttcttccgctgccctatatccctcgacgtcatgaaatcccctgtgagcctctgcaccggcgttacctacgaccgttccagcatccaacgctggctcgacaacgggaacaacacctgtcccgccaccatgcaggttctccaaaccagagatttcgttcccaaccgaaccttacagaggctcatccagatctggtctgactcggtcaccctccgagtggactcgcccgagtcacctacctccacccagtccgaatcagtcctctccaaggaccaaatcctcgtcgccatctccgagttgcagactcactgcgcgaaccgcttcgactcgctcgccaaaatcgcgcgtttcgcgcaagattccgaggagaacctcgattttctcgttagaacggaatgcttcgtgccggcgctggttggcttcctcgacaatgtcaatgacggcgtcgaattcctcgaacaggtcgttacggcgttggatttggttgtcagcaaaatggaagattgcgagggcctgaaaaatttgatactgaagaggcagggcgggggagaaaaacagagcgtggattctctgcttctccttctgcaacaaggaagccatgtcataaaaatcgcatcggctagggttttgaaatccctcgccgtagacgcggaatcgaagctgttgttagcggaaaaggatggtttattatccgaattgctgaatctaatcacaccggagaaagatccggatctaatggagaactgtttgtcgtgcctggtttcattatcgacgccgagacggagcaagatgaagctggtgcgtctcggagcggtgaaggtgttctcgaaccttctttcgactccgagcctgagcgtgtcggtgacggagaaggttctgaagctggtggaaacggtgtcgtctacgaaggaagggaggtcggagatatgcgaggattcggcgtgcgtttcggcgatagtgaacaaggtgctgaaagtgtcgagcgtggcgacggaacacgccgttacgacgctttggagtgtgtgttatctgtttcgggatcagaaggcgcaagaggccgttacgaaggctaacggattgaccaagattctgcttctaatgcagagcaattgctcgccgcaagtgcgtcaaatgtcttcggatttgctcaagatatttcgggttaattctaagtcgtgcctttcttcttatgacaccaaaaccactcatattatgcccttttga

SEQ ID NO: 2845 - DNA, 774 bp, Glycine max
  Peptide Sequence Number=SeqID_94530
atggagttcctggacgaggacgcaaggccaaggttcgtgttccagtccggtgcagctgcgaggagcagcgagccaccgcacccgatccacaaacctaccaagccattcctcttcgccaccgtttccctctcctcactcttcctcactctctccctcttcttcctcgaagcggagcccttcaaatcgctcctcttctggctcgcactctctctcctcgttggccccttcgcccctccctccatcactggcggcgacgtccgcgtcggccgcggcgaggtcgtcaacttccccgatccggagcccgagcccgacgaggacgccacgcggtcggagaagagaaaagaatcttctggaatcgagaagcgtgcgacgggtggtggaggaggagaaggggtggagcgaggaggatgtggaggtgctgaagaagcagatggtgaagaatccgtggacagtgtgataaagaaagcgaaggaattgggggagaagagagtggatgattcggagtcgtatgcgttgtttttgaagaagaggaaagcgttggataagagggttgtggaggagaatgcggatgagggtgagaaagttgttgataatggttggagttctgctgaggatatcgcgttgctgaatgctttgaaagcgtttcctaaggaagtttccatgaggtgggaaaaggttgctgctgcggttcccgggagatccaaggctgcttgcatgaaaagattcgccgaattgaagaaagggtttcggactgcaaaagctgcagccgagtga

SEQ ID NO: 2846 - DNA, 2193 bp, Glycine max
  Peptide Sequence Number=SeqID_94531
atggatgtgttctttgactcagtggatagtttgtcaactcaagattctgttttagccaaagaagagtttggttctggaaggtgtggttatgacgaaatttgggtgaaggagcctgttagtgtgaaggagaggagggaacgttttctgcagggtttgggcttagctgattcttcttccaaggtttgttcacaagagaaaatgaacttagatgactcatccatcagcttgggattggagaggatcagggagtgcagtggggcaatctcaaatgcttgcattttgcatactgatcaagtagtatctgagaagttgattctctctggaggcaaagcagcttctaaagaaaaaatctctttggatgaattcaaagggtgtccccaagatgaagcagaagcaaacattcaaggaaaagagcatgagttctcttctacagctgaggagcacagacccagagaagctgtttcacaagaagaatttcaggattttgatatgagtaaaagaaagaggaaaaactggtggaagcgctttgtgaacatcaggaaaagtggtgaaggaaatgtaaggtccaaattgaatgcagggacaaataaaactcgaagaataaaggtgaggcagaataaaaagaggtggctggagttcagtggcctataccttggacaagaggttagagcacacaaaggcctagtctggaccatgaaatttagtccatgtggtcagtatttagcgagtggaggtgaagatggtgttgttcgcatatggtgtgttacatcactggataaatccagtatttgtttcaccccagaagacagtacttctaaaagcaaagtggaatgtgacaactcttctcctcggaagaaacactcaagccaacccttcattttccttccaaatagtgtttttcaaattgaggaatcaccactgcaagaattctttggtcattccaatgatgtcttggatttggcttggtctaattcagatattctcctttcatcttctatggacaagactgttcgcttgtggcaaattggttgtaatcaatgtctaaatgttttccatcacaatgactatgcagtgacatgcattcaattcaaccctgttgatgaaaactacttcattagtgggtccattgatggtaaggttcgaatatgggggatacgtgaagagcgagttattgactgggcagatatacgagatgccataagtgctataagttaccagcaagatgggaaaggatttgtagttggttctgttacaggcacttgttgtttttatgttgcttcaggaacatatttccagcttgaggctcagatagatgtccatggaaagaagaaagcgtccggcaacaagattactggcattcaggctgatgttaggcctgagcaattgtcttacaaattggaagatgtagcgactctatttttaatgcctaatgtctatcctacctttctacatcaaattgggagttataatgtttactgtgttgggaggggaggggaagctttcttcggaaagatgtctagttcattcacatcaagtggaaaacatataatctcagttggagaggactcccatgtatatatttggaactttgatgacatgggaaatgcttcttcaaaacagacgaaatccgaacgctcctgtgagtactttttctctaaaggtgttactgttgcaattcctaggtcaggcatgaaagcagataaaagggactctagtggtaattattcccaccattcttcagaaatgccaacccaacagctagaggttgcctctgaggctagagatcacaaacgtttttctcttggtaattggttcgccattgatggcacgtgtcgaggttctatgacttggcccgaggagaaacttcctagctgggatttacctataacagaagatgaatatggtcaccagcagttatgttacaaagataattgccatggcagaaatgtatcagaaacatggggactatcaattgtggcagctggttgtgatggaactatcaagacattccacaactttggattgcccgctttgcctggtaaaggtggaaatttacaacggtgtgttatggccttagaatccaatgtaagtggctcaaaatgtgggaagacggaatttgaagcctttgcctctgcttatatgatgatcattgctaaatccatgttgagtctcaaggctctcgaaatgttctag

SEQ ID NO: 2847 - DNA, 801 bp, Glycine max
  Peptide Sequence Number=SeqID_94532
atggagaccaacactagtgcattcacaaatgtgaacagcacttggaatcttgaaaagatggaaacaaatgaacaacaaaatgatgaacataatattattctccaagtccaagaccctatgggttctgggatttggcccagcaacaactaccacaaccttcttcaaatgcatcaaacacccaacacaacaaccttatccatcatagcaccaccaccctcctcatcagggttccttggagacatactgggtgttcacaacctagaagaagatgaagagccagaagaagagctaggtgccatgaaggagatgatgtacaagatcgctgctatgcaacccgtggacatcgaccccgccacgattcgaaaaccaaagagaagaaatgttcgcatcagtgatgaccctcagagtgtggctgcacgccacaggagagagaggatcagcgagaaaatccgcatcctccagagactcgttcccgggggaaccaaaatggacaccgcttcaatgcttgatgaagccattcgctatgttaagttcttgaagagacaaataaggttgcttcaatctattcctcaatcttcaaatccaccacaatgcattggtgttgctactacttctcatcatgctagtaccttgttgttagccccttcctgtgattggccttttgcaccaaatgttcttcccagttccaccgccgccaccgcctcaatggacatgtcggccggactgggattcgacgtcggccatgctcatgcttgtgatggctcctccagctttaaccatcatgaggtaatcagtgaataa

SEQ ID NO: 2848 - DNA, 1080 bp, Glycine max
  Peptide Sequence Number=SeqID_94533
atggacgttgttcgttcacaaagaggcagtagtagaaacacgagcccagaccgcgccaaaatatgcaggatgaataaaaaagtgaagccctttagaaaagttcaagtcgtttactatctctcccgaaacggccttttggagcacccccatttcatggagctcacccttttgtccaatcaacctctccgcttgaaagatgtcttcgatcgactcatggctcttcgtgggagtggcatgcctttgcaatattcatggtctagtaaaaggaactataagagcggttatgtgtggtacgacttgggtctgaaggatataatacatccagcagaaggaggcgaatatgttctcaaaggttctgaactcgtcgaaggatgctctgagagatttaatgtgagcaacaagcagcagggaattcatcagcaggcagaggcagaggcagaggcaaattacaattacaattacgattcaaggagtaaggctttgggtgtgtgcaacaagcagcagcagcagcagaaagagcgtgaagagttggaggaatacgaggagcaagagaaagagtacgaggagggagagaaaacaagctacacgagctccaccaccaccccacactctcgttgctcaagaggggtatcaacggaagaactggtttatgatgaagaagaaaacaagaacgcaacaaaggtaaatgctgaaggcacaaataagaataagaagaacaagggtgagaaagtgaagagaagggatggtgaagggtcggtgtcaagtcgttactcagcactgttgcagctgatagcgtgtgggggtgggagcacgggcgaagcagcaggggagtacttgaaggggccgcgtctcagcgatgtggggaccaaagagaataataaggctttgttttgggaggagatggagaatcccatcttgttggggaatttgcagacagaggagaaggaatactttagtggcagcttcctcgactcaatcaaacccaaccatggaggaggaggtgaagtccaaggtaatggaacaagacaagaagaagggaggaatgaaagacaaatgtatccctctcatgaaatccactag

SEQ ID NO: 2849 - DNA, 2574 bp, Glycine max
  Peptide Sequence Number=SeqID_94534
atggtgaggtttttagggttgactcttggttatgctgaagaaccccgggaaatagcatcgaggtcgaacctgaccagtgattctggtgaaaatgggtggctcattaggttctttgactcggcgttcttctgcgagtggattgctgttagctacttatacaagcatgatcatgccggggtgcgtgattatctctgtaatagaatgtatactcttcctttgcaaggtgttgagagttatttgttccagatatgttacatgatgatacacaagcctagtccatccttggataagtatgtgatagatgtgtgctcgaagtcacttaagattgctttgaaggtgcattggttcttgatggcagagcttgaggactctgatgacaataacgggattagtaggattcaggagaaatgtcggatcgctgccaccttgatgggtgagtggccacctctaataaggccccaaactgaacccccgagtccgggaggcaagagccaagttttgaataggttattgtcgtcgaaaaatcgcttgttgtcactaacatcctcaccaccttctcagaagtctttatcattttcaccttcctcaggaaacaatgtacaagaggacggcaaaccactttctcctgatgagaacaagatatttaagaagtttatgcctagcccgaaggttagagatgctttgctttttcgaaagtcagtggacaaagacgatgatggttcagaaaaggatggtttttttaagaggctcttgagagatagcaaaggtgatgatgagctgggccaaaaaattcgtgattcatttctgtttaggaagtcatctgtgaaagatgatgaagactctgaaaaagataatttctttaaaaggtttttaagggacagtagaggtgacgatgatgactcggaaaaggatggtttctttcgaaggctcttaagggacagtagaagcgaagatgaagacatagcttcaagttcagagggattatttaagaggttgtttcgtgatagcaagaatgattctgaggacagaacacatactaaaacaatagaagatgaagataaagagggatttttccgaaagtttttccgggagaaatctgaagataggaaggatgggagtcataggaatgatcacagagatgttgctaattttgaagagaaatatgccaaacctgccgaagaggatgaaaaagaaggtttttttcgtaaattatttaaggataaatttgaggacaagaaagatacaaatgataaaattgaagagggtactgccaatggtgaggaagaagagtcttctgagttttccttgttcaaaagactatttcgtgtgcaccctgaagatgctaaaagtagtctagtcaatgaaaacagcaataatggtggtttatttgaaagtagtccaggtacagagaattttttccgtaaattgttcagagaccgtgaccgttcaattgaagattcagagctattgggttcaaaaagacagaaagagaagcatcctggatccccaaagcagcaaagtgaaaagttgagcacaaagccaccattaccaattagtttgtcgcagttccggaaaggggcttaccatgattcaatggagtttgtgcagtcattatgtgatacatcatatgggttagtggatgtatttcccattgaagatcgcaaaagtgctcttcgtgaggcgcttgtagaaatcaatttacatgtagcagaggttcagaacactggaggagtttgttttccattgggaaagggcatgtattgtgtgcttaatatacctgaagatgaagctgttctcttgaattctagggagaaggcaccttacctgatctgtgtagaagttttgagatgtgaaatgccaagtaattccaaggaggcatccagttctcagaaactttctcaagggggaattcctttggcaaatggagatgcactcttgcaaaaaccacccccttgggcttatccattacggacagcacaagaggtgtaccgcaatagcaacgataggatgtccagttcaactgctcatgcaattgaccaggcaatgactcatgtgtctgaggcaaaaatcaaatttgttagtgtgaatttttctgtggaaatgcagttaaatgatcagccagaggagattgaagtggccgatctacatggtggcagtcagcgttctgcttcagttcatagagagtgtgtgtatgatgcagcagcagcagaacgtggcagtgatttggaatgggtacgggtagtgttgtcagctgatcctggggctagattggaagatattgaggatcaagcaccacctcggaggaaggaacatcgccgtgttccaagtaccgtggcaatagaggaagtaaaggctgcggcagctaaaggggaagcacctcttggactccctttgaaaggcgctggtcaagattcttccgatgcacaaccaagggttaatggacttaatcccaaagctagcgatgccttgtctggtgaactttgggaggcaaagaaggataggatatgcaaggcttccatatatggaaagttacatggttgggacttgcgatctgtaagtgcatgttttaagtga

SEQ ID NO: 2850 - DNA, 924 bp, Glycine max
  Peptide Sequence Number=SeqID_94535
atggccaaagctgttggagttcggttccaccctactggtgttgaattagttgtgtactttctgaagaggaaagtgatggcaaaaaaaatctgtgatggtttcattgctgaacttgacatatacaagtatgctccttggggtctcccagataagtcttgtctgagaactggagaattggaatggtacattttctgcccgctagagaagaaatatggcagtgggagcaagatgaagcttgctaccaaaattaggcttgaagataaggacctcgctgacaaagggattgctcaggattcctatgtagtctgcaaggtcttccaaaaggaaggtcttggtcccaggaagggggcacactgtgcgagaccatttaatgaggaagagtgggacgatgaggaaattggaataccttgtgctgctttgactgcaccagttcccatcttgcctatgacatctgatggttctgttccaaatgacaatctccctgctagtggatgtactgtgtcagcatccatatcatgtctatcaggatcactgccttctcctggtacagtaaatcctactggtccaaatgatcaagctgctaatgataatgatattttaccaatgcttgatatttttaatgacgacaaatggtttgaggaggtctataatcctggtcaggaaaacattgttgaaggtgcatcaccttcagatgatttttttgagggcttggaagactacttggctggtttctcctctggccagaatactgaattcaacacaaacggaatgcggctactacagggcttgaaagactactgggctgctctggctggtttctccgctggccagaatacaggtgatattgggaactctgataacttggacttcatagagttgaatgacctagataccccattgttctatccgatcacacaaccttga

SEQ ID NO: 2851 - DNA, 303 bp, Glycine max
  Peptide Sequence Number=SeqID_94536
atggcaccagtggcaatgagaataatagagaaagttatgtggctgaaaagtgctaaagaggcattggtaaaacaccctaatggtgttcaaactatggtgaatatggttttcagggtatctgatcaagaatgcagtgagagtgctgttgaagtgcttttaactgtttgtggtgaatttgagcgtgcaagagaagaagccattgagagtggagttttgactcggttgctcttgcttctgcagagtcagtgtagtaacccaacaaaatcaaaggcaagaatgctgcttaaattgctaagatcctag

SEQ ID NO: 2852 - DNA, 1185 bp, Glycine max
  Peptide Sequence Number=SeqID_94537
atgagcttctcaacatgcgcagagctgtcgcgttgtttcgccgcagcatcggcgaaacctaattccggtcagtcaaacggcacttccacaacaagcctcagttttctcactccaatcggtcgttacggcgccgtttcatcagtatcgaggtcgaataagaccaacagaatagtcgcggaagctactcaaggtcttacttacagggacgccggcgtggacatcgacgccggctccgaactcgtgcgcaggatagcgaagatggcgccagggattggaggcttcggtggtttattccctctcggtgactcgtacctcgttgctggtaccgatggcgtgggaacgaaggtgatgcttgccttcgaaactggaatccacgatactattgggattgacctggttgcgatgagtgtgaatgacattgttacttcgggggcgaagcctttgtttttccttgattactttgccactgggcaccttgacgtggacgttgctgaaaaggttataaaaggcattgttgatggttgtaagcaatctgattgtgttcttttaggaggagagttgattttatttgcttctcagactgcagagatgcctggtctctataaagaaggtgagtatgatcttagtggctgtgcagttggcattgtgaagaaagattctgtaatcaatgggtcaaacattgttgctggtgatgttattattggtcttccatctagtggagttcactctaatggtttctctcttgtaagaagagtgcttgctcaaagtggtctgtcactgaaagatcaacttcctggcagtgatgttacaattgcagaggcattgatggccccaactgttatctatgttaaacaggtacttgacttagttagtaagggaggggtgaaaggaattgcccacatcaccggtggtggtttcacagataacataccccgagtttttccagaaggccttggagctgtaatatacgacggttcatgggaagtgcctgcagtgtttaagtggcttcaggaggctgggaagatagaagactctgagatgagacggacttttaatatgggcatagggatgatcctggtagttagtccggaggcagctaatagaatactcgagaacagaggcgaaacagagaaattctatcgcattggtgaaattataagcggcaagggagtgacctttagctaa

SEQ ID NO: 2853 - DNA, 648 bp, Glycine max
  Peptide Sequence Number=SeqID_94538
atgaaagggagaaatagttatagctttagagggaggcatatttccttggctctggttactcttgttatttttaccacgttactgtggacatgggagagaaatccgataattgccatgactttaagatcagctcatgaatggtaccgcttaccttcagaatttcctgtggaagccccgactgaatcagtgggaactccaacactggaaaagggtgtggaaaaatccatatcccccatcagagaaaatggaacaaaacttcaacttgatactcagggggtggcagctgtagattctacacctgcagaatctctagaaactcaatactatcaaaatgtcacgccttcttccagacgtaaaggaacaccaacacttgaaaagggtgtggaaaaatccacaacccccatcacagaaaatggaacaaaacttcaacttgatactaaggatgtggcagctgtagattctatacctgcagaatctccagaaactcaatacaatcaaaatgtcatgtcttcttccagaagtaaagacaaagtgatggggcccctcatccaccctacagttagtaagcaattaagcatgctaatggattctggttcccctgctttcaaactgataagcactcaagcacttggggagccctccctttaa

SEQ ID NO: 2854 - DNA, 624 bp, Glycine max
  Peptide Sequence Number=SeqID_94539
atggaagatgagagccataataacactttgccaaatggattcaacacaggaagccccgaaagtcctttcttaaagacaagcaccaccaccacacaacacaacaaagaacaggaccgatttctccctatagccaacgtgggaagaatcatgaaaaaagtgattccccccaacggcaaaatctcaaaggacgcaaaagagacagttcaagaatgcgtttcggagttcattagtttcgtgaccggggaagcttctgacaaatgccaaagggaaaagagaaagaccatcaatggagacgatgtcatatgggccatcacaaccctaggctttgaggattacgtggaacccttgaaaacttacctccagaaatataaagagatagaaggagaaaaacttagcattccaaagcaaatgcgttctgaacaaaggctacaacaacaccataataattatcatgaccaaaataatcaaccattcaatggtgcatatgcctcatcaaatctcatttctcagcctccttatgtgcccactgatcagaagttttctctaaccttctccccaaactctattcagagtcagctacgacagcaagaccagattgattctgtggggcactggtacgaataa

SEQ ID NO: 2855 - DNA, 3083 bp, Glycine max
  Peptide Sequence Number=SeqID_94540
atggcactgttggagaagagcattgcgccctacggaccgaccctggcagcacgcgagcgccaaccagctgcttttgcattagggacggtggctgacccaaaggaccctcaccggtacagaccttgggatcttggaggacctcggcagactggaaacaccttgaggacaaggttcctagccctcgaagctaggttgttctcgttcccgtgcttgcgggctgctgagggtgtgttggaagggatagactcaatgctaaagccagaagaggctaatgttgcagaaaaattggcaatgcacatagcagatgttgcaggcaaagataagtttaaagacaagcaagatgtgtcatgcaaaatttccttcattatgtcattattggataatttgatcccagaagggcattgtgtgcttatattttctcagactcgcaagatgcttaatcttattgaggaatgcctagtatctgaaggttatgattttttacgaattgatggcacaacaaaagccagtgacagactaaagattgttaatgattttcaagaaggttttggagctcctatatttctcttgacatctcaggttggtggtttaggactaacacttacaagagcagatcgtgtgattgtagttgatccttcttggaacccaagtacggataatcaaagtgttgaccgggcatatcgaattggtcaaaagaaagatgttctggtatatagactgatgacatgcggaactgttgaagaaaagatctacaggaagcagggaggattattcaaaattgctactgaacataaagaacaaattcggtactttagccagcaggatctcagggggctttttagccttccaaaagaaggatttgatgtatctgttacccaaaggcaattgaatgaggagcacgatcgtcaacatacagttgatgactctttcaaagcacatataaagtttttgaaaagtcagggcatagctggagttagtcaccacagtttactcttttccaaggcagagccagttcgagctgatcatgaggatgatgaagttacaaggaatcatagggtgaaatatgttggaacttcgagatcatcttcaaatgagcatgttgcttatggcccggagtttgcatttaatcctaaggatgttgggttaagcaaaaaaggttcttctcctagcagtgctgtcgacttacctcttcattttatcttcgttcgtgctgtgccttctcgcacggaattctgcgttttcttttccaccacaaacgcgttttacaatcaagagaatttcgcacatcgtaacaacccaattcatttaagagatgtttgcaatctcagtctatgctgcaagagtctctatgctcttggatcctctgaaaaagtgtggttcactcagtgtgatatggtgggagtggtgccccagaaagaccttgttgagtggagggagggtgtctcatcttacaagtcactttgccgtttccttctgagtgttaaaccattgcttgggatatgggttaatcagaaccctgagcttggtaaccttgtctatgtcatgcctggttttgtttcggttgtaggctgccggataattcctcaggagcttggtccattggggattcaagatggtcctatccaatggtcatctgtgtttgaagttattggtgattttgatggttcggctacattttttctccatggaagggaagagggaatggactatgtttatcgtggctctgtcaagtatatagatgaatcttgcaacgtgctgttgcttgaggttcaacctagggaacaagataatggtagtaatttgttgcagagtaggagcttggatgactcgggtgggacgatatcaggaaaggtttgtaggtcaaacagtgagctttctaggtttcaaaagatgggtggaaatgatgaggcaatggctcccttcagcaagttatcttttagtgatagaagaaagttgcttgaggtcactatcggcctacttcgacaagaggtttctagtgtagcagccgggccattgtttcctaggttgagagatgattgtgacaactttcagaaagatttggtgctcttgaaggaaagaagagcaatcttttgtgaaatgaacaaccttggtagtggtcagattgacaatgaggaagtttctcaaggggcagttggtccaatgcaattagagctggatgacataagaaagagttgttactggtggaaggatatctctgatcttctgaacaaggaggatggtcacatacaatgcaccaagaaaaaatgtcttggtggatatctctggggtagctttaaacagattgttggaagatctagttcaattaatgagagtcatacaattttcaggaagcttactgcaagacgtgagataaagcatgcacggcttgaagactttcttagatcaagcgatgcaatagggctatcattaaaggcctcaactgtaaaattatcttcttatcgagcatggccgaatatgcctgatacttggtttgcactttacaagatgcctttgcgagttccctcagcggatcaaatttatgtgggtttgtggggaggaacttttggttggcctcctggaataccttctgaagacaagcctggaaaggctctattctttcttctgctctcttatgaggagtctcaggaacaaaagcttcttattgcaacaaaaatattggaaggcactcactatgtcttgcatcctaatggttcagcaatgtttatagtggatgtcaatcagccttcatctgatccctttccctgggacaccaataaagactccttctcagtggatatcacacattcttttacaggagagggtatttcaaatggttatgggttcagataccctggatcaaagcccggtaccctctttgtatttcaaaatggcatccttgcctttgtttggaaggacactagggctgtcttgactttgcagagacttgacctgcaagatattttgaagaaaggagaaagagtaccttctctgcctcccatcaacaatttttcatatttgaccaagtcctactcaaatgtatttacaggctttcctggtgcttccacttgcttgccttcaccaag

SEQ ID NO: 2856 - DNA, 1455 bp, Glycine max
  Peptide Sequence Number=SeqID_94541
atgcctgaaaacgcagccacaaccaaccttaaccaccttcaagtttttggcatcgaagatgatgtgccttcgcattcacagaataactccaaatgctatgatgatgatggccgtctcaaacgaactggaaatgtttggactgcaagctcgcacataataaccgcagtgataggatcaggggtgctgtcattagcttgggccatagctcagctaggttggattgctggtcctactgtcatgttcttattctctttggttaccttttatacttcatccttgttggctgattgttatcgtgccggtgaccccaattctggcaagagaaactacacttacatggacgcagttcgctccattcttggtggagccaatgttacgttgtgcggaatatttcagtacctgaatctattgggaattgtaataggatacacaattgccgcttctattagcatgatggcaattaaaaggtcaaactgtttccataaatctgggggcaaaaacccatgtcacatgtcaagcaacgtatacatgatcatttttggcgcaaccgaaattttcctttctcaaattcccgattttgatcaattatggtggctctcaacagttgctgcaataatgtctttcacctattccataattggtctctctcttggaattgccaaagttgcagaaacgggtaccttcaagggtggcctcactggaatcagcattggaccagtgtcagagacccaaaaaatctggaggacttcccaagctcttggtgatatagcctttgcctattcatatgctgtggttcttatagaaattcaggacacaataaaatctccaccgtctgaagcaaaaacaatgaagaaggccacattgataagtattgcagtgaccacaacattttacatgctctgtggctgcatggggtatgctgcttttggagatgctgcaccggggaatctgctaactggctttggcttctataacccatattggcttatagacattgcaaatgcagctatagttattcaccttgtgggagcataccaagtgttttcccaacccatctttgcctttgtggagaaagaggtaacacaaagatggccccacattgagagggagttcaagattccaattcctggtttctccccttacaaacttaaggtgtttagattagttttgaggacagtgtttgttgtcctaacaactgtcatatcaatgctgcttccattcttcaatgacattgttggagtgattggggcattgggattttggcccttaactgtttactttcctgtggagatgtatatttcacagaagaagatcccaaaatggagtaacagatggattagcctcaaaatatttagtgtggcctgcctcatagtatcagttgttgctgctgttggctcagtggcaggagtcttgcttgaccttaagaaatacaaaccattccactcacactattaa

SEQ ID NO: 2857 - DNA, 306 bp, Glycine max
  Peptide Sequence Number=SeqID_94542
atggcgcctctgcagccaggccaacgccactcccttccggaccttcgtaacggagcgcgtcggcgccgccgtctacgtcgccttctccggcgtccacatggccggcgagtccgacccgaattggagaagtttgattccgttggacagcatcggcggtgttcctctgttttcgtcgcggcggagcaaggaaggggaggagccggtcatggttcacgccggcatgctcaatctcttcttctcacttttcaattctttccagaaccaggtaaaggtaaaacattcaaaaggtacgagaatgaggcttag

SEQ ID NO: 2858 - DNA, 72 bp, Glycine max
  Peptide Sequence Number=SeqID_94543
ttgatataagactaaacaccgctcttgaggttgcaattaaggcagtcctcaaagaagttgcaactaaggcgg

SEQ ID NO: 2859 - DNA, 1164 bp, Glycine max
  Peptide Sequence Number=SeqID_94544
atgtgtgacagtttggcttgcattgttatccaggttttatgtttgtcggaagagttcaatcaaatgagtttaaccatgatagatctggggatttcctttctgaggttggtcacgagccctgatgcatccagtgcatctattttcggatggctgataactggatcatttggactaatggctgtgatatatgctgttctcaagtggcagcgaaggtcctcattaaattggattaaagctgcagcaagagaaaagaagaaagtttggaaaaagtttaaagttccgctatcggagcatttgtgggtggaagattttacttatagggaacagccatccacttgttgtttctgcttgacttccctttggccttctcaaaatttaggtacaacagcctcaccgcgtactcctctccatcgttgctctgtttgtggtgtcgcagctcatttcctttgttctcagtttgcagcaaaggattgcaaatgtgtggctcaggctggttttggccatattcgacatcactggtctgaaagatgggttgatgtggatgaaaatcatgagatgtctgccttctgtttttactgtgacgagccatgtggtgttccgtttgttaaagcttctcctacctgggattgccgctggtgtcagcgcctcatccatgtgaaatgtcataacaaattgactagagattctggtgacttttgtgatttgggtcctttgaggcgaattatcctttctcctctttgtgtcaaacaagttgacgaagataaacaaggaggacgactaagttctattataacctcttctgttaatggccagattagaaagcggcgtaatcgcaataaaagtttaggtggttacaatgctaatggtaagtcagatggttcctcgattactgatgcaacattattggagtatgtgttgaatggtctccactggaataagttcggtgatgagaagctttttgatcttgtgaataatggtagagtattaggaaatggtttaactgctacgcctaatcaaatcaagaaatacacactggttggtttgccacaagatgcaagcccacttttggtcttcatcaatgccaggagtggtgggcagcttgggccttctcttcataggagattgaatatgctactaaatcctgttcagggtatgttattttaa

SEQ ID NO: 2860 - DNA, 2745 bp, Glycine max
  Peptide Sequence Number=SeqID_94545
atgggtggtggtaacgaagcaaagacctctagcgatggtggtgaagattcccaaaatgattcgcctgtgaaaacatctgaggaggactctgatgcgtttcaaacttcaacattggaggaagaggcttacccagctttagatgcattggcctctcaacttagcacactcaatcttgaacgtgtaatacacatcaagagtcgtttggttgcattttccggtcgtgtgcaaaagggtggcttactgtgcgactttatgcaaacacttgttttggattgcattttgcaaacttgcaaactctcttctgagcaagtgttctccggtttcattgtcctaacttcttcaaccaccaaccttggaggagctcaacctctttctctgcgcttcctatccaagccagctcctccgtttctatctctgagcctcttcttcccctcccactctactaacaatggcattgcggtttcctcaactcagtgcaaacccagaatccggtgtgacaaagaagtaggtaatggtaatagtaatggggtagaagaagaagcaaaagatgaagagggtgagcgtgaggtgcagtgtgaggttcaagtggtttcttggagggaaaggagagttaaggccgaaatttctgtcaatgctgacattgaatccgtttggaacgctctcactgattatgagcatctcgctgatttcattccaaatcttgtgtggagtgggaaaattccttgcccatatcctggacggatatggttagagcaaagaggatttcaaaggtcaatgtattggcacatagaagctcgtgttgtgttggatcttcaagaattcatcaattctgcatgggatcgagaacttcacttttccatggttgatggagactttaagaagtttgagggcaaatggtctgtcaaatctggaacaagatcttcatcgactaatttatcttatgaagttaatgttataccaagattcaacttcccagctattttcttagaaaggattatcagatcagatctccctgtgaacctccgagccttggcatatagagttgagaggaatatttctggaaatcagaaactttccctgccagaaaatcacttggataaaacttctagtgatatttatgagtcatctgcccaaaagataaatagtgctttgtgtgaaaacagagaatatttagtcagctcaattcctggtaccttgcccatgccttccagtgaggtgaacatcaataattggggtgcatttggaaaaacttgcagacttgacaggccttgtgtggtggatgaaattcatctccgtagatttgatggacttttggaaaatggaggtgttcatcgctgcgtttttgcaaccataacagttaaggcttctgttcgtgatgtatggaatgtaatgtcttcatatgagactcttcctgagatagttccaaatttagcaatcagtaagattttatcacgagataacaataaagttcgcattctccaggaagggtgtaagggcctgctttatatggtgcttcatgctcgtgttgtgctagacttgtgtgaatatctagaacaggagatcagctttgaacaggttgaaggggattttgactcgttccatggaaaatggacttttgagcaactaggaaatcatcacacactgctaaaatactccgtggagtcaaaaatgcgcaaagacactttcctttctgaagctatcatggaagaggtcatatatgaagatctcccatcaaatttgtgtgcaataagagactatattgagaataggacagcatcaaatatgttcgaagcatgtaagcagaatacagatttggggcaacaaactgttccatctggctttgaagatgatgacagctattgttcagcagaagacttgtttgattgcaatgctcaaagctcatctcaacaacgaccaagagttccaggtttacaaagggatattgaagtactaaaatctgaactcctgaaattcattgcagaacatggacaagaaggatttatgccaatgaggaagcaacttcgtttgcacggaagagtggatattgagaaggctataaatcgcatgggtggattcagaaagattgcaactataatgaacctctctctggcttacaaacaccgcaaaccaaagggttactgggacaatcttgaaaatttgcattatgagcaacaaaccataggtttgcttactttcaagtctagcaaagaaagatggatgaaagttgtaacatcacaactgatggctgtaactttatcccactcccaatttgaagtttctcgccttctgtccctcaaggtgaggcggcaacgaagcagacaagacaaccttgccaaggataagaaagttgatgatgatgtagcatcacctgatgtagatagtgagatcaagacaccatctagacccactgtttctcaagatccacaaaattggcttaccgaactaaaacagttggacataaattgggttgaagatgccatcccaggattgagagggcgaagtgtaagcatagccaagatggttcccacagctgcggcaaaggagcttggttctttggcgcttggagttgaaaaagggtatccaagaaggccagtgaagttgttggatctgagtgaacctgctctcatccacagagaagaaggagatgatgcctctctttatggacttcgagtcaatcagagaacaagtgttgcggttgctggagttcaagttcagctcataaccacacgaactacagctgcataa

SEQ ID NO: 2861 - DNA, 870 bp, Glycine max
  Peptide Sequence Number=SeqID_94546
atggggggtctttgttcaaagtctgccaaaggtgacaaggtgtttgccaaatcagatggacattctgataaacataaatctgatggtaagaaccacaagtccaccagcatgcctagtaatttgactagtgcaggggaacatggagtggacaagaaaaaacaagaaggttctgctgctgctgcagggaatggttctgatgatttctatgatggaatcccacggtttactgattctttttcccacaagtctaggtcagtaaaatcaaggcatgctgtggcgaaggtctcagaggtgagtttacgcctgggcagagctggtattgacgttttggacactcttggaagcagtatgacaaatttaagtgctggtgggtttgtatctggagctgtgacaaaggggaatgaaattggtattttagcatttgaggttgcaaacactattgtcaagggttttagtcttatggaatctctttcgacaaaaagtattaagcatttaaaagaagaggtgcttccattagaggctgtgcaagatttagtatcaaaggatatggatgagcttctaaggattgttgctgcagacaaaagggatgagttgaaagtcttttctgatgaggtaattcgttttggaaatcgttcaaaggatcctcagtggcacaacttggaccgatactttgagaaagttagcagagaacttaattctcaaagacaaccaaaggaggaggcagaattactaatgcaacaattgatgacgttggttcagttaacagctgaattataccatgagttacatgctttggatagatttgcacaagattatcagcataagcgtgaagaggatgataattcaggtgcagctcaaagtggtaattga

SEQ ID NO: 2862 - DNA, 1116 bp, Glycine max
  Peptide Sequence Number=SeqID_94547
atgtgcatgaaggcacaatggattggttattgtataatgcactttcaaagaaaaagtcactctgacctagaagttttgactgttacattgtgcaatatttctataggtgatggcctttcaatcttgagggcagaacttaaaagtcaaaaaaagcaagttaaacatttgaaaaaaaagtcactctggtccagaagtttggaggagattatggagaagcttgtagagatagtccattttttgcatttggagataaacaatgcctttggcactgaagatgaccataaaccattaattcaaaccatcagcagtcgccaaaaattgggtcctgcaggccttgctttgcattatgctaatatagtgctccaaattgatactcttgttgccagatccagttctatgcctgcaaatacaagggatgcattgtatcagagcttgcctcctaatataaaatcagctttgcgttccaaattaccaagctttcatgtcgtaaagcagctcaccatatcaaatattaaagaagagatggagaaaacattgcattggctggttctgattgctacaaacacggccaaagcacatcatggttttggttgggtaggggagtgggcaagcactggttctgagctaaataagaagaccatgaaggctgatgtgatgcggattgaaacgcttcaccatgccgataaagctaaagtagaaaattatattcttgaacttctcatatggcttcaccgcttggccatcaaaagtaaagatggcattgataccggagaaacgaggtctaccttaaagtctcatgttggcactgccattcaaactacaagtcaacaatcaacaaaagccttactgccattgttaacaactgacgagcagaaaatgctgcaagatgttagtaataaaattcacataagaaggatcagtaaaagcttggactttgacagtttgaagacagataatgacagacttactaagagtagcagttattcttattcatcaacaagtagaagcaaggaattatcttttaatagaattttgtctaagcttcctgttattgattttggtattgacaaaaaaagagcattggatgtgattgacagattagatgtggccagataa

SEQ ID NO: 2863 - DNA, 1233 bp, Glycine max
  Peptide Sequence Number=SeqID_94548
atggcaccaagagtttcgagtttagaagcagcccagaaagccataaactcaattgggttgggttttgacataacacaagatatagcttttgacaactgtaagaagggttcaaggttgatatttgtcaatgagaagcagtgccgtaatctggagattcctggagggatgttggagcacttcaaccaggaaatgtgccttggaggacaaactgcatctggccatttctgtgcttcatttgggttatcttgtcgaaatataaaagatttggcttctatcaagtctcttgcatatgatgggtggttcatcaaacgctatgccgttgaattagaaaggtatcagggtgaactccttgatcatgtcaaagaagcagtgccatcatcatgggatcctgaggccttggcaagcatgggagggaaggatgtgctatatcttagacaaggggatacatcatatcttggtcctactagtattcagaaacttttgaaggacacagctaatatgaagttcaaggattctgcagacaatcattgcctggcttctgaagacttatgtaaccaaaaagaggtagatgtaggtaatagaccagtagttgggctaagattacaattggaagggagaacaagcaaccggttggccattcatctgcagcatctggcttctctacccaagtccttaccactttctgacaacgcaaatacgtacttgtcttgtgactcatatagctgcaacttgcataagaaagttaaatggaactccttttcatacgtttgtactgctccagttgagtcggatgatagtgtttccattgtgacaggagctcagttacaagttgaaaagaagtgtctccttttgaggctgcgtttctctaaagtaattggtgcaattctgcagaaggaacctgagtgggatcaatcctccagtcttggccagtttagcaacaagtctgggggtatcttagcatttatttccaaagagggacagaggggtcatccaaagccaggtgataaaaccattggttccaatacatattcgtctgcacgccctgcgccagtgcacacacctaagcttcaaagatttgttgacacaaccgaaatgatgagaggaccagaagatactcccggatattgggttgtgtccggggcaaggctttctgttgagcatggcaaaatatatctccttgttaagtattcattattatcctttgttatgcaaagtgaaagtgaagcttcatag

SEQ ID NO: 2864 - DNA, 2784 bp, Glycine max
  Peptide Sequence Number=SeqID_94549
atgggaggcacttctgcagatcttcaccaccatgaatcagatatagaactcactgatgctgaaaggactgacacgaagttaggggcttctgattcaaaagctggcaatgatgttggacttgacagtggcaccaaatcccaggctgaagctgaaggacaacactacgtggaggtgaccatggacattcatcgtgactctgtggcattacacagtgttaaaactgttgcagccggtgttgacatggtggaagaagaaggtgataaattgggtttgatgggcaagaggcttgagaagaaaacaacctttggtgcctctgtggttcagagtgctgccaatcgcatgaagcagctgaagcgtttggcatcattttcaaaaccagcgcccaaacactttgaaaggaccaagtctgcagtgggtcatgctctcacagggctcaagtttatcagcaagaccgatggtggcgcaggatggggtgaggtggagaagcagtttaacaagcttactgctaccactggtggctatcttcctcgtgctctctttgcccaatgcttagggttgaacaaggagtctgaggcttatgcagagaagctttttgatactcttgctaggcagagaggtattcaggggggttccattaacaagatccagttgaaggagttctgggatcatatttctgaccagagctttgatactaggctcaaaacattctttgacatggttgataaagatgccgatggcagaattaccgaggaagaaattaaagagattatctgccttagcgccactgccaacaaactgtcaaacatccagaaacaagcagaggaatatgcggctttgatcatggaagaattggaccctgctgacacaggatacatcatgatagacaacctggagacgctcttgttgcatgaaccagaggaaaccacaagaggagaaagtaaatacctgagccaaatgctaagtcaaaaacttaagtctacatttgccgacagtgcaattatgaggtggtgtagagatgccaagtacttcttgctggacaattggcaaagatcttgggtacttgcactttggattggtgtgatgttaggtctttttgcctataaatttgtgcaatataggagaaaagcagcctatgaggtgatgggccattgtgtatgcatggcaaaaggtgcagccgagacacttaaattgaacatggctcttatcttgttacctgtttgccgcaacaccatcacctggctgaggaataagaccaagttaggtgttgtagttcctttggatgacaacatcaacttccacaaggtgatagctgtggcaatagcagttgctgttgctgtacattccatctatcatcttacttgtgattttcctcgccttcttcatgcaagtgatgaaaagtacaagctgatgcaaccttttttcggagacagaccatcagattattggtattttgtcaaatcatgggaaggagtaacagggatcataatagttgtgctaatggcaatagcctttacgctggctaatcctaggttcaggagaggccgggccaaactacccaaacctttcaacaaattcacaggtttcaatgccttttggtattcgcatcacctcttcgtcattgtctatgccctgttggttgtacatggaatcaaactttacttaactaaggaatggtacaagaaaacgacctggatgtatctggctattcccatcaccatttatgcattggaaagactggttagagcattcagatcgagcattaagtccgtcagaatattgaaggtgactctttatcctggaaacgtgttatcacttaaaatgtcaaagccgcatgggtttagctacaaaagtggacaatacatgtttgtgaactgtgctgctgtgtctccatttgaatggcatccattttccataacttccgcccctgatgatgattaccttagcgttcacataaaaatacttggtgattggactcgaagtctgaaagccaaattcacacaggcgtgccagcaacccctcaatggacagagtggactcctaagagctgaatgcttgaaaggagataacagcccaaggctggcagcgaggattggagtcgatcacacttggatagcaacaaagccttttaattatgcgttgattgacaaaaagcagggttcctttccaaaggttctggtggatggtccatatggggcgccagcgcaagactacagggagtatgaggtggtgttgctagtggggcttggaattggggctaccccaatgataagtatactaaaggacatggtgaacaattttaaggccattgatgaggaggagggaataggtggtgctaaatcaccaacgaggttgagtgacttcaagacaagtagggcatacttctattgggtgactagagagcagggttcatttgactggttcaaaggggtcatgaacgaagtggccgaagaggaccgaaggaaagtgattgaactccacagctactgcaccagcgtctacgaagagggtgatgctcgctctgctcttattgctatgttgcagtccctaaaccatgcaaagaatggagtggacattgtctctggcacacgcgtcatgtctcactttgccaaacccaattggcgcagtgtctacaagcgcattgcgcttaatcatccagatgcccgagttggggtattttactgtgggccatcagccctcacccatgagcttcgtcagctagcattggatttctctcacaacacatccaccaagatgatgtggaacgagctaaggcgtccaccttga

SEQ ID NO: 2865 - DNA, 939 bp, Glycine max
  Peptide Sequence Number=SeqID_94550
atggcttcaacagccaccttggtcagttcttttaatactgcattggttttccattaccattaccacgcagctttttacatcagtagagtggatgctacacttgacaagaaacttgagcaaattggtactactgaggctcttgatctcaaaggaaagggtgcggtttctcaagcagtcttagcttaccaactttaccagaaaaagttctctggtacaagatgggaacgcttagagaagagaggccaagctcttcatgcattcatagaccatggtattctttcaagaactcttgatgcaaaagtatcagaggctcaagacatttacaatgcaattgagagaagttggggattgattggagttccgttggatcacaactggaacatgagatgctggattctttcacaaaaagctttgacaatgtgcttgaatgcatgcaaaagaaggctaagcttagggatttcatcagcttataaaccgttatttcaggcacctagctttcacatcgtcaatggcaatgcttgcctgagacgacccttgatgaacccttttgctctaaagtcatccttcttctctggttccctcaatctctatcttcatcccaatcaccaccatcttacttcagctccacccaggatttccatgcgcgtcgcttccaaacaggcctatatctgtcgcgattgcgggtatatttacaaagacagaactccctttgagaagttgcctgataactacttctgccctgtttgtggtgctccaaagcgaagatttagggcctatgcaccggctgtcactaaaaatgacaatgacacagctgttagaaaggcacgaaaagcagaactacagagagatgaagcaattgggaaggcatttcctattgcaattgtcgtgggaattgcagtgcttgcaggattatatttctatctgaacagccaatactag

SEQ ID NO: 2866 - DNA, 1032 bp, Glycine max
  Peptide Sequence Number=SeqID_94551
atgaaaaatcttttggttgaaagaagagagccttctctcaacaagaagctcacaactatattcttagtctgtgtccattttaaatccttccgtgtccctctcctttcctccacccaaaacgccaccgtttcgccctgcggctccctcgatcggccactgtccccgcgaccggcgcgtgagcaagcgccactgccaagtcctcttcgacgcttccctccgcaagctctacatcctcaacggcgttcttccgcacggccacggcgactccaccgccacgtgtcgcctcgtccacgagttcagaaaaagggcgatgatttcatttcatggcaatggcgacgacggcgacggcgttgcgcttcttcgagaagcctccaacggggttctagtgaacggcgtcgagattcaaaagggaaaggcggtgtagttttcgagtgtggtggtgaaattgatgggttaaaaacattcgcgggacactcgcagagtgggaaggggaataagagggtttttgctgtgacggctaatgatccgaggtatgagggtgttgttgggagagcaaggtttcttcaagataggtgcagagatatattgcttagtaacgatcccgtgtcgcgcattctgcgcgatgaatcgaagtgtgcccctggcaatgctgaagtgcaatcaaatttggaattgattggtgaaagtaaagtgaagaatttggatcccaaagcggttgctgacgaggttcctaatacggtgagagtgttagattctgtagggaaggataattgtaatcctccttctgttggtggtgattggtggcagggaacaattggtggtggcggctgcaattatccgccgcctggcaagaagttttatctgaatcgccttgaatttatggaccacaactcctcggttcttgacatattgcaaggtgccttcatctaccagttacaattgcatgccacaatactgagatgttgtagttcaaaacctgatgacggagtatttatgccttaccaggattatcctaacctagttgtcgtgtga

SEQ ID NO: 2867 - DNA, 234 bp, Glycine max
  Peptide Sequence Number=SeqID_94552
atggtggcgtctctggtgctctctagagctcctcctctggttgctctgttagggttcttgtgcgtcagaaaagaaaaagggacagaagagccttttcccatgggtgccaatattagactgagacctggaaaatctcgcactgctggcaatgaggagaatcgaagccaagggagcccttcaactttgtcaagtggagaagacgctaatgggatagactcttcaaaaaacacttaa

SEQ ID NO: 2868 - DNA, 1758 bp, Glycine max
  Peptide Sequence Number=SeqID_94553
atggcatccattgccttcctgtatgtattttttttacgtattttacttttgcttctctctctctctctctttttctatgatttgggacctgcagtgacacccactattgatcagaacaattgccatcttgaaaaggctttatcacattggtgtatatttcaccgaagcaaagcagagctggtagtgggaacatggaataaacaatttcacaattcagagaaggttcagcgagtcccccttctgtatcttgcaaatgatatcctgcaaaacagcaaacgtaaaggaaatgaatttgtgaccgagttttggaaggttcttcccacagcacttaaggatgttcttgagaaaggtgatgatcaagaaaaacgtgcagtatttagactggttgatatatgggaggaaaggagagtgtttggatctcaggctaagagccttaaaaatgtaatacttggagaagaagcacctccgcagttggaattcaacaaaaagcggtcccgttcagttagaattgtgaaaaaggattctcgttccattaaaacgaaattgtccattggaggtacagcagaaaaaatagtctcagcctttcatacggtgcttaatgaacattccaatgaagatgcagagatgagtaaatgcaaggcagctgttcatcgtgtgaggaagatggaaaaaaatgttgatattgcatgcactgttgtaaaggaccctaagcgaaaaactttgtccaaggaactagtggaggaagaaaatattttgaaagaatgcattgaaaatctcaaattagttgaagcaagtagaacatcacttgttactcgcttaaaagaagctttgcatgagcaggcaagtcattatgtccatgaatctgagctggagaatgttcgcactcagattcaggtagcacaagcacaagtagaagaggctagctacatgcggaagcgacttgatgatgaagattcttcatataaagcctcaacttcaacgacttcagttactgatgtgaatacaaaatcagaagcagcaactaagaagtcagctgcagcaattgcagctgaggttgcagataagctaacagcttctacgtcatcgcagttaatcatgacttctgttctctcaacatttgcagcggaagaggcaaaaagtgcttgtctaacttctgagaccatgtcaaaacctgagaagtcaatacctatatcagatccaaatgtttttatgacttcacaacagttaattgccacaccaaatcattcatatccttcggttttggtacctcaacccaccttgcagaatccagctgctgcatcacagggtcaatatcaaatgctttgtaattcatcctcccagcattatttgcaatcaacaggaggggtcatttcttcttatggttatggtagcatcgcaccattaccattggggccacccccaccccatatggtgggtccaatggttcctttgacacatcagacaatgcaaataactcagcagctgcctacacctataggtcagcatcaaccaataaaaatgacacaacaagccccagcacctcctaatttccgaccacttcaactgccaggaatggtgtactatgggtgtcgttcaacttcaacaaaacaacagtccttatgcctctcctgtggtgttactgggaagaaggttggcacttggaggctgtatgttgaccatagaagctccaccaagcatgccgtaagggccaggttagcatgtatgatagtgtttgactgtagaaggtccaacatttaa

SEQ ID NO: 2869 - DNA, 120 bp, Glycine max
  Peptide Sequence Number=SeqID_94554
atgatgcgtaggggacatgtagaacagcacctgtcagtcaggggagcagctattgctgcctatcacccggtggaggtgctcgtcgacgcaaatggctcgggtcatgccttgcgtcgttga

SEQ ID NO: 2870 - DNA, 207 bp, Glycine max
  Peptide Sequence Number=SeqID_94555
atggctatagcagaagtcttaaacggccaaatgttggaagaggatgaagatgttgttagtcttttggtgcaaagtaaagataacaatccaaaagaagatgctcatgattcttatcaactgtcataccctaattttgtccggggaccatccgttgttgggatgcgaccctcgtttgaccactttgaggtacttggcacccatcgttag

SEQ ID NO: 2871 - DNA, 735 bp, Glycine max
  Peptide Sequence Number=SeqID_94556
atgtatgtatgtgggaattttcatattatggttagaattagaggtttagggcgtgtcttaggagttataggtagagccctggagagagagagagagcataatcatcattcagatgatattccccagcggcgaaggcccacagcatccgcacgtaggcaacgggaagctgctgttgctgaggatgctcctcacgtggatgacgcaactgaagatggttttccaggtgggccgtgtgagccgtcaatgttgattgcctatggtgaccatgttgcagtcattgtatggaatggagaggaacgtcctaaattgaagctatcctcccatggaaggaaggttcaaaaatttgggaggcctgctactgaaattgaagggctggtcactgccacaagattaagtcctttaatcgcatgttcattggacactggcaatcagggacttatatcggcttttgtggagaggtggcataaggagacgagcagttttcatcttccaataggagaggtgaccatcaccctcgatgatgtgacatctcttcttcatcttcccatcataggtgaattccacatcttcgagactcttcatgtcgacgaagtggtcttgatgttggtcgagttacttgaagtctctggagatgaagctagagctgagatagtacaatgtcatgggcatacgtatgcctatcgtggctacgagagatttatcagagtaaatgtgaggtcgaacattggactgtaa

SEQ ID NO: 2872 - DNA, 76 bp, Glycine max
  Peptide Sequence Number=SeqID_94557
tcttagtgatagcaaaagaaagatttaaaagtgcggataaccacttgggtatctccgcatgtcacgtgactccaag

SEQ ID NO: 2873 - DNA, 613 bp, Glycine max
  Peptide Sequence Number=SeqID_94558
atgggtgatcaagaggagatacaggaacagatgaaagccgacatgtcggctctgaaagaacaaatggcttccatgatggaggtcatgttaggaatgaggcaactcatggagaagaacgtggccatcgctgccacagtcagttcggctgccgaagcagatccgactctcctagccaccgtgcaccatcctcccccaaatacgctaggacgaggaaggaacacactggggcacaacaacaacccccatttgggatacaaccgaccggcttacccttatggattgccgcctaattactctccaccagtcatgcaagatgatgcgggtcatatctcttctcccatccttgaaggggagcctcctcaacagcccgaagaggtccacgaagatcctcaagactatgcccgaagggatgtcgagttctatcccccgatccccgaggggccggcacccaacacattgcctcagcccaacctcatggcacaaccaatagttttgtccatggaaggaccgctcccggcaactcaagaaaggaggaaactcgatctccttgaggagagattgagggtcgtggaaggatttggtgactatccgttcgcagacatgacggatctct

SEQ ID NO: 2874 - DNA, 639 bp, Glycine max
  Peptide Sequence Number=SeqID_94559
atgagttatcaaaaagtgtttgtcagaggaaagtgtgttagattctcccctgctgtgatcaacaaatacctgggcagacctactgaaggagtgatagatattgatgtttctgagcatcaaattgccaaggaaaatcactgccaaacaagtccagcattggccaaagaaagggaagctttctgcagggaagctaagtgtgaagtatgcaatctgcataggattggagctgcaaactgggtacccaccaatcatacttccactgttgccacagaatcttttgctgtcaaattacccattgccttcccaactgtattgtgtggcattatgttgagtcaacatccaaatattttaaacaacattgactctgtgatgaagagagaatcggctctgtccctgcattataaactgtttgaggggacacatgtcccagacattgtctcgacatcagggaaagctgctgcttcaggtgctgtgtccaaggatgctttgattgctgaactcaaggacacatgcaaggtgctggaagcaaccatcaaagccaccacagagaagaaaatggagctggaacgcctgatcaaaaggctctcagacagtggcattgatgatggagaagcagctgaggaagaagaagaccgctga

SEQ ID NO: 2875 - DNA, 216 bp, Glycine max
  Peptide Sequence Number=SeqID_94560
atgcatttacggacacgagagcccgaaaaatcatctctcttacttgtgcatttgggggcgcagtgccccatgtgtgcagttaagaagacaatatggatcttccgacttcccacgacaaaagatgagacccacatacaacgcatgtgtgacggcatgatgcagatgcgcaaaagcgcaacagggggatgcacagagtatggcaatatctataaataa

SEQ ID NO: 2876 - DNA, 1320 bp, Glycine max
  Peptide Sequence Number=SeqID_94561
atgcaggaagaagaggaaagaccactcataagaaaaagaaagttaccttcgacttcgaccaagtccgctgaacaaacagggacaggcaattctcaggctcaaatgcctaagaagaaaaagaaagtgaagcaagtcgagcccgaaccttctgtgactgtcgagggtggcgagccagccaggaagaaaaagaaaaagaccaagtcttcaaaagaacaaggtgacaatcaacctgttgacgtccaaccaccttcgactgatgttgacggcactgaagcagaggctactccctctattgctgagatgggcaaccctgtcgagcaaccgaacttaccacaagaacaacctaccatcgaggtacaacaaaatgtttctgtagaagaaataccctcatgtgctcgaacatctcccgctcctgagacggatgcagtgaatgttgaggaacagggtgaaggtcaaggtattggatccagcagtccttatggatcgagtcagaaaagttcatctgaagaaaacttttccgatgaagaggccatacaagaggctgaagctggaggttcggacatttacccggcgtcttcaacatctaagctttccgctagcatagggatcgcagaagacacattcattaaaatgcaagacgaagacccagctgcagcccttcgactcctgctgaacaccagtcaagccaacacttcgagtgaaaagattcctggtgcttcgtcctcatctgatgctgacatcacctcttcagtacgccaagattgcctgcttttgaagttatcaatggaatacgcacgggcagacgtacttaaatccattgaagagaacccctctgctgcttttgggcacctgaactttttgaagaaattgcacaaccctcttacctctgatgaaattctaggcaaagtcatccaaatcgagtccattatcgatcaatttgcaagtactgtgcagaaaaaacgcgaaaatggcgccagactggatgcccagaaacaggcacatatccttctgctcgaaaaagcccaagctgctcaacatgaagtcgagcgtctcaacaaagaggcgaaagaaggatcttctgagatcaaagcctgtgatgataacatctcctcctgggaggccactattacggacttgctgtctcaggtcgatgatctaaggcaaaaaattgtgacagagcaggccaaacgcaaggaactccaggagaaggccgctaactcgattcagaaactgattgctgaaaaagggagggaaggcctgaaggcctttagcgcatctcaggctgtagcagatgaggccaagagttatggagagtgctga

SEQ ID NO: 2877 - DNA, 549 bp, Glycine max
  Peptide Sequence Number=SeqID_94562
atgtcttggaagaggagacataacttctcaatgcccccaccaagaaaaaccatgattttgaggggccaagacatttatagtagccaagatgaggctactacttcaccttcctctagtaaaagtgaagaagcaaaaggggaagaatctagtgaagagatctacccccaagaagaaggacaacctttaatggttaaggaggagtgtaaggagacacttgttagcattgcctcatctcttaggcttgagtttattcctcaagtaaaggagttgttggatgagggtttggttcacaagagattaaatccttgtgctttgttggtgcccaaaataggtattattaggcaccaaatccctaaaataggtggtgtgatgaatgctttgggtggtgcaacactcttttgtaaaatcactcgtgcacccaacatcttcatgatttgtgtacatagggactcattaggtaggaataatcaacatgaaaataccgaaaaaggggttcccatgaaccctaagagaataagggtcattcctgagtggcccgctccaccaagc

SEQ ID NO: 2878 - DNA, 273 bp, Glycine max
  Peptide Sequence Number=SeqID_94563
atgaagtataaaggcaaagggaacataagggagtacattatggagatgtccaatctcgcatcaaaattcaaaataagaaaatgtagaagactaggtgctgcagaagggacttctcaacaaaagaaacaaaagaaggatgagaaatttacctgttacttctgcaagaagttgggacacatgaagaaagagtgtcccaagtatgccgcatggcgtgtgaagaaagatacttggtgggtagattctggtgctactactcacataaatggaatttga

SEQ ID NO: 2879 - DNA, 357 bp, Glycine max
  Peptide Sequence Number=SeqID_94564
gcgacaatgaccttcatttacatttcgaagatgacgatgtcttcagtcattgcatgctttcaaaaggcgacaatgaccctcatttacatttcgaagacgacaatgtcttcaatcattgcatgctttcaaaaggcgacaatgaccctcatttatatttcaaagacgacaatgtcttcagtcattgcatgctttcaaaaggcaacaatgaccttcatttacatttcgaagaaaacaatgtcttcggtcattgcatgctttcaaaaggcggcaatgctgtcatttacgctttcaaagacgacaatgtcttcatctcaaagactccaatgtcttttgtccttgtgcttcataggactcgac

SEQ ID NO: 2880 - DNA, 459 bp, Glycine max
  Peptide Sequence Number=SeqID_94565
atggggacaaatcaaaacggaaaaagattctatcaagtcaagattaagggcctagatgtcaccagccataaggagttgggacggttgatgggacccctccaatggcaagccttccgcaaagtgtacggaaagattttagatttgaccacagcggaggtatttacggaagccgttgtatccctcgcccaatactatgatcagccgttgagatgcttcacgtttagggacttccaaatagtaccgactgttgaagaatttgaggagattttaggatgccctcttgggagaagaaaaccgtatcttttctccgggtttcctccctccttgagcaagattgcagctgtggttggagattcggcgagagagttagatcgtatgaagcaaactcgaaatggcgtagtgggcctaacgcggaaatacttggaaggcaaggccttgggatatggcgaatcaagagga

SEQ ID NO: 2881 - DNA, 665 bp, Glycine max
  Peptide Sequence Number=SeqID_94566
gatcatatccaacatcggtcagtaattctttcaaggcatctaaactcatgatcaatgacctggtgctggaaattcaagaatttagagagagtcttttagatttagggatcgaggttagatcaattttgacgcctattggacaagggagttcacaggtttcaggctcatctcaattatcatcaaaagatgtgtttctgtcaaagactaaagagtttgtttgtgttactgtcgccaagattacaaccatagtgatggacaactattcatggtgctatccggcttgtggtcaatgttataaaaaagatgacatgctaactgtgccgttgacatgtccgtgtgtcaaagagaatgatcaacctgtactgaggtatcgggttgaggtgatggttaatcacaagggtgaacaaaccaaatttttgatctgggatcgtgaatgtgcacagttaattggtcagtcagcggatgaagtcaacaggctcaaaatagatgttattgatggggatgttgatttaaatgcctctcctcaagcactagataggctattgggttgttttcttgcattcaaagtgaaggtgcaaccaaggttcaggaattctgttgttcttaaatattcagatgaatcagagttgatcaatgttgtgctagatatgattcccgatagtgag

SEQ ID NO: 2882 - DNA, 1047 bp, Glycine max
  Peptide Sequence Number=SeqID_94567
atgggacctctccaaaggcaagccttccgtaaagtgtacgggaagattctagatttggccgcagcggaggtatttacggaagctttcgtatccctcgcccaatactatgaccagccgttgaggtgtttcacgtttggggacttccaaatggtaccaactattgaagagtttgaggaaatattaggatgccctcttggggggagaaaaccgtatcttttctccagctttcttccttccttaagcaagattgcggctgtggttggtgattcagcaaaggagttggatcgcacgaagcaaacttggaaaggcgtagtgggcctgcctcggaaatacttggaaggtaaggcaagggatatggcgagccaagagaagtggggcccgtttgtagatattttagctttgctgatttttggggttgtcctctttccgaacgttgacggtttggtagacttagccgccattgatgctttcctcgcatatcaccatagcaaggaaagttcagtggtggctatcttggcagatttgtttgacacctttgaccggaggtgtgagaaaaacagtgcgcagattgtctgttgtttacccgctctctgtggactagggggtgtattaattataatcccgcactcgcccataagacagctagggtatcccatgaggggagcgccaaccgaagaaagtctcttgcctttccttgtgaggaatctaggcgcgcaaagtctcaaggcgatacaaagagtccacaaggcgtggagaagtccgttgaggaaagacaaggagcttaggggcatccgtaatggcgtcatcggaggttatcatggatggctaagaattcacacgcgagggctagattggctctccaagttgaaagttatcgatgatgagaacttcgaagctccggaggaagatgaagaagtccgagctctaaaattggagctagggaaggcaaggctcgccaaggagaagttcatcgaattcctgcagcccgggggatccactagttctagagcggccgccaccgcggtggagctccaattcgccctatag

SEQ ID NO: 2883 - DNA, 470 bp, Glycine max
  Peptide Sequence Number=SeqID_94568
atgttggtgcgtatgatccgtactcgtctctttgcagcgacacgggtggaatcttgccccagtatgcatagtagctacgtgatagcctccctctttggttttgctcgcacagttggtcgccctccattatcagggtgtggcccaggaactgataaaaggaaactactgggccccttaactgggagcgcaagtctcggtgagggggcgtgcatcccttcgaagttgaggacgtgttgccctttgaaggcgagggcgtgtagccctttgaaggcgagaacgtctagtcctctgaaggcgaggatgtctagtcctctgaaggcgaggaagtctagtcctctaaaggtgagggcgtgtagccctatgaaggtgagggcgcgcagccctctgatggcgaggacgtgtagtcctctgaaggtgaggacgtgcagtcctctgatggcgaggacgtgtattcctctgatggcgaggac

SEQ ID NO: 2884 - DNA, 1308 bp, Glycine max
  Peptide Sequence Number=SeqID_94569
atggcgggtgaattagtggaatttgaagagggtactataggcattgctttgaatttggaatccaaaaatgttggtgttgtattaatgggtgatggtttgatgatacaagagggaagttcagtaaaagcaacaggaagaattgctcagatacctgtaagtgaggcttatttgggtcgtgttataaatgccctggctaaaccaattgatggtcgaggagaaatttcagcttcggaatctcgattaatcgaatctcctgctcccggtattatttcgagacgttccgtatatgagcctctccaaacaggacttattgctattgattcgatgatccccataggacgtggccaacgagaattaattattggagacagacaaacgggtaaaacagcagtagccacagatactattctcaatcaacagggacaaaatgtaatatgtgtttatgtagctattggtcaaaaagcatcttctgtggctcaagtggtgaataccttacaagaaagaggagcaatggaatacactattgtagtagctgaaacagcggattctccagctacattacaatacctcgccccttatacaggagcagctctggctgaatattttatgtaccgtgaacgtcacactttaatcatttatgacgatctctccaaacaagcacaggcttatcgccaaatgtctcttctattacgaagaccacctggtcgcgaagcttatccaggggatgttttttatttacattcacgtcttttggaaagagccgctaaattaagttctcagttaggcgaaggaaatggccaaatattcttatctgccgatctattcaatgctggaatcagacccgctattaatgtaggtatttccgtttccagagttggatcggcggctcaaattaaagccatgaaacaagtagctggtaaattaaaattggaattagcacaattcgcagaattagaagcttttgcccaattcgcttctgatctcgataaagctactcaaaatcaattagcaagaggtcaacgattgcgcgagttgcttaaacaatcccaatcagctcctcttaccgtggaagaacagataataactatttatactggaacgaatggttatcttgattcattagaaattggacaggtaaggaaatttcttgttgagttacgtgcttacttaaacacgaataaacctcaattcaaagaaatcatatcttctaccaagacattcactggggaagcagaagtccttttgaaggaagctattcaagaacagatggaactctttttactacaggaacaggtagaaaaaaattga

SEQ ID NO: 2885 - DNA, 249 bp, Glycine max
  Peptide Sequence Number=SeqID_94570
atggacacacctttcttctcgtcctccatagactattcttcttcccttcaacaagttcttccagtcccatctcctggtcctacgagtaatcccaaccaaagtgttagtggagtcccatctcatccaccaagtttagctgaagttgctcctccacctttcattacatatcaacgcaggacacgacaagttagttctacagtgcttgagtcttcttctcgtgattctgatcctcctccaacagatccttaa

SEQ ID NO: 2886 - DNA, 318 bp, Glycine max
  Peptide Sequence Number=SeqID_94571
atgttggccatcatcagcaagttcaaagaagaattaaatttggccaccgcccacgagcacaaagtggcggacaaatacgcccgagtgtacgtggaaaaggaggctagaggaagggtgattgactcattacatcaagaagcaacaatgtggatggaccgatttgctcttactttgaacgggagtcaagaacttcctcaattactagcaaaggccaaagcaatggcggacgcgtactccgcccttgaggaaatccactggctcctcagctattgtcagtatatgatagacttgatgacccatataattaggaaccgttag

SEQ ID NO: 2887 - DNA, 291 bp, Glycine max
  Peptide Sequence Number=SeqID_94572
atgtggaagttcgggccgagagcgacacctaggcacccaaatttgttttgccccagatatcaagattgggttcccacgataaaagaccccaatgaaacacgacctcagaccttttttgaaccttggcctgtaaaaaagggaatcctcattctttcccccgaagcaaaggacagtgaaatctcctcaagggagagcgaatggaatgctaaaacccgatttcccaaagaaagggatggggaaggaaaagtgaagagaaagagaaggaagaaatggaaaggtgggatcctctag

SEQ ID NO: 2888 - DNA, 390 bp, Glycine max
  Peptide Sequence Number=SeqID_94573
atgtcttcagtaattgcatgccttcaaaaggcgacaatgaccttcgtttacatttcgaagacaaaaatgtcttcagtcattggatgccttcaaaggcaacaatgtcctcatctacatttcgaagacgacaatgtcttcagtcattacatgccttcaaaggcgacaatatcctcttctacatttcgaagacgacaaggtcttcagtcattgcatgccttcaaaaggactcgacgtcctttgtttgtacgctttaaaaaaaaagggagtgaaaatgaaaatgaaaatgaattaaacgagaaaagaaggaatttcaatatcttcatgccttcacaggttttactgcttggatttgcgctagtggccggtcgggtaaagattcagctcgaatga

SEQ ID NO: 2889 - DNA, 574 bp, Glycine max
  Peptide Sequence Number=SeqID_94574
atggacacaatgatggaggccatgatgagcatgaagaagataatggaagccaatgcggttgcagttgccgctaccagcgctgttgctaaggtgaacccgacgtccccatctggcatcaaccaaatgaatcatccaacctcagatatggtaggcaaagatttgggaagtacgagcggcccttattatgtgaaaattcaaaacaagcacgccttcccgccatatggcttgcctcccaactatacaccacccaatgtggcgtacactcctaaagaggaaacacatgaaattccccaccacaatctagcggactttgagccttgcctcggatatgccactgaagggcaagcagttggtggtatacccatgccaaacactttgaagggccctcagtttcgcccacaaccacaacccttgcattttgcggtgggaagatcccctcctgctatcgctcaaaagggaaagttggatcatatagagaaaaggctcaaggacattgaaggaggcgaagattatgcctttgctaacctcgaagaattgttcctagtacccgaacatggtcattcccaagttcaag

SEQ ID NO: 2890 - DNA, 564 bp, Glycine max
  Peptide Sequence Number=SeqID_94575
atgacattgctacttagcaacattctgcccagcgaccgcaatgccaatctccccctgcataagtatcagttggtctgtgtcgtcccgacatggggatcgcacccacaaagacacccagtggacccgaaaaagtcaaacagggccctggggtttacagctctggttacgggcctctatcagtcctacagggtgcccgtacccccccggcaaggtcacgtcatcatagggatcgcgcctgcaagacacccagtggacccgaagaagtccaacagggtcttggagttgtcaagctctaattacgggtctctggcattaggccccctactaatcgagctttcatcaagaagtactgcgtccccaggccaggcgcagggcgaaacaccacagcagcattgggatggtcggcagcgggaaacagacgcaccgccaccacctctagagttcacctctgctcatccacaaaaaaggttagagcgttgcctacgacacatggccgaccggcaggcgaccaagtccaaagccaaaggtaagcaaagtactaggtccatgaccgacaagtcataa

SEQ ID NO: 2891 - DNA, 1017 bp, Glycine max
  Peptide Sequence Number=SeqID_94576
atggcggcacaggcgggcgagtggtcggtcggcgtgctggcgatgcgcggcgatgcggcgaccgagcgtgactggcagccgctgatcgacaggctcaacggcagcgtcggcggagaacgcttccgcctgcggccgctcgatctggcgcagatgcgcgaagcggtcaatcggggcagcgtgcagttcgtggtcactaatccggcgcagtttgtgcagctgaacagccactatcatctgcgctggctggcgtcgttgcgcgccgccaacggcgatcgggcaacgggcaacatcatcggcagcgtgattctggtgcggcgcgacagcggcattacgacgccgcaggcgctgatgggaaaaacggtgggcgccatcgatccgcaggccttcggcggctatctgaccggctataaggcgctcagcgacgccggcatacggcccgagcgcgattttcacctgcgctttaccggtttccctgccgacgccctgctctatctgttgcgcgagcgcgccattcaggccgccatcgtcccgagccttgctgaccgcaccgccccagtctcccttcctgtggggcgcaccggcctcgaccagcgaggtggaagcgctgctgcgcgccgtctatcagcacccggaacagcggcggctatggctggatatcaagagctggctgatccagcatcagacggccgtcggcctgtcgctggcgctgctggcgctgttgatcgtcaaccatatctggatcgcgctgctggtgcgccgacgcgggcgacaactgctccacgccgacgagcaactgcggcggcaggaacgggcgctggaaaacgccaggcagctgaacgtgctgggggagatggcctccggcttcgcgcacgagctcaaccagccgctggcggccattcgccactatgcgcaggggtgcctgatccaactgcgcaacacggacgccgggcatccgctgctggggccgctggaaaatatcgaccggcaggcgcagcgcggcggcgagacgattcataa

SEQ ID NO: 2892 - DNA, 710 bp, Glycine max
  Peptide Sequence Number=SeqID_94577
aaaaaatagaaagaaaagaaaaaggaaaagagagggtagaaataaatcaagatgagaggcaacaaataagggaagaagaaagaaggaaaatactaaaagagttaagaaaagaaaaacatgcctcctatagtagtcatgactcttgcaagatcctaagtgaagaacttcatgattattatgaaggaaggcataggtcacatcttatacctcactaccataggagagaaaaggaaagaaatcctcaagaggctaacattaatctcccatacatccatgggaaggacaatgtagaggcttacttagattgggaaataagggtagagcaacaacttaaaaggaattcttcttcaaaatcttatggctctcactcttatccaaagaaagaccaaggtattgttaggcaccaaatccctaaaataggtgacatgatgaatgtgttgagtggtgcgaccctcttttgtaaaatcactcatgcacccaacatcttcatgattcgtgtacatagggaattattaggtagtgatcaaggggttcccacggaccctatgagaataaaggtcattcctcagtggcccactccaccaagcataagaaaaatttggggcttccatgacttaacaaacttttacaaaaggtgtcgagagaagaagcccatagtatcaagaacctctggatttgaggtcaaatcctttccaagggtgaggggatga

SEQ ID NO: 2893 - DNA, 480 bp, Glycine max
  Peptide Sequence Number=SeqID_94578
atgttgctgcgcatggtccgcactcgtctttttgtagcggcatgggggaaatcttgccccggtatgcatagtagatgcgtgatagcctccctctctggatgtgctcgcacagttggtcgccctccaatatcagggggcgaggatgtgcaatcctctgatggcgaggacatatggtcctctaaagccagcccatatcaattagaccttgcaccttacgcttcagagccctacaatgctcaacggaatgccccggggcttctccgtgacaagcacacgttgcgttcgagtcgtattctcggagaaatggaggttgatgaaccttggctagggctttctcgctgcaaaattcatttcttggttggtgttttggtttatgctaaagggatggcctttgtggataactgggcggtgggtaaggagaaggtttgttattggctgagtaatgacattgttgggttggtgggaaacttggctgtatag

SEQ ID NO: 2894 - DNA, 525 bp, Glycine max
  Peptide Sequence Number=SeqID_94579
atgaagggtacttttcatccagaactagtcaaggttttcaatagttgtgcacgggatgaccttgaaggtaacctcttatctattgttaatggagtagatatggtcattgatgctattgtgtggaaggaagtagctggtctggacatgggtggagtccacaagttcgatgaaatgcctgattggtacaacaagatgcaggtctataagggaatgcttcttgaccttgctttgaggaatcgcttaggagttggtatcaagatgagctgggtactattgattgaagacattatgttgaagagtcatcgcgtggtggagtatgaatttccttatgttgtgctttcctcaagattcattgagtacttcaatgttgatgtctctaataagattgtggactttaccaaagcctctagtgagattaccgaaaggcatctcaagaagcttgaaatgatgtttgtcgatcatgaatggataatggctagagagcctacagctggaaacattgatcagatggaagaagatgcagaa

SEQ ID NO: 2895 - DNA, 1398 bp, Glycine max
  Peptide Sequence Number=SeqID_94580
atgtggaccaacctagccaagcgagcttcctcaaccttaaggaacaccttccgcgtttcttctttatatccgagattctgtaagccccaaacaagtaaaacgataaacccatacccatttcaggctttccctaaagccggggtgagccggtccaagtttcttttttacgaaggcttttctagcgttgccgaggctattgagtccacggacaccgaagatgactacgacgaggttcagaaattgttgcagcaaatggcgaaggcagaacacaaagtggacaacagcagcagcagtagcagctacaagtacaagttgcttaagaggaggcagataaaatcggagacggaggcgtgggcagaagccgcaagggagtatgaggagctcttggaggacatgcgcgagcagaagcttgcgcccaatttgccttacatgaagtcactcttcttgggttggtttgagcccttaaggaatgcaattctcgctgatcaagagctttgcaaggatagcaagtgcaggatgagccatgctccttatttcaatgacttgcccgccgacatgatggctgttgtcaccatgcacaagttgatggccttgttgatgacaaatactaatggggttggcaccgctcgggtcattcaagccgcttgtcaaataggtgaagctgttgagaacgaggctaggatataccaatttatgaagagggagaaggagaacaaatcatctcatgttgtgccggtagaacaaagaggagaactgactgaagagaacggggaaatggataaaaagcagagcagacttcggaaaagagttgctgctttgatgaaaaaacagaagaagctacaagcaatgggaatagtccgaggacaagatgattggaaagcttggggacaagaagctcaagtaaaggttggatctcgattgatgcaactattaatagaaacagcctacattcaaccgcctgccaatctgattggagatggtccaccggatatacgacccgcatttaagcatacccttaaaacactttcatctgagtcacagaaggaaactaggagatatggtgtcattgaatgtgatcctctggtgcaaaatggccttgaaaagtctgcaaggcacatggtcatcccctatatgccaatgttggtgccacctataaactggacagggtatgacaaaggagcatacttgtttttgccatcgtatgttatgagagtacatggagcaaagcagcaacgtgaagcagttaagagggctcccaagagtcaacttgatcctgtttttgaggcccttaatacccttggcagtaccaaatggagggtaaacaaaagggtactctgtgtgatagatcaaatatgggctaatggaggacgcctggctgatttggtggatcgtgaaaat

SEQ ID NO: 2896 - DNA, 366 bp, Glycine max
  Peptide Sequence Number=SeqID_94581
atgtgttttcgtgaagaaaatccaagccgaggtgcttccgtaacgcttccgttagcgattatgtggaaattcttcatcgttcttcaccgttcttcgtcattcttcagtcttcaaccattttgcaagaactacgtaggtctgatttcctcatcgcaattgaggatacataggagcaaaagccctgcttttgtcgaccaccccaagagatcgttaatggtccaacgccttaacatttctctcctttcaaaaaccaagagatcgttaatggtccaacgccttaacgtttctctccttttaaaaaccaagagatcgttaatggtccaacaccttaacgtttctcttctttcaaaaccaagagatcgttaa

SEQ ID NO: 2897 - DNA, 207 bp, Glycine max
  Peptide Sequence Number=SeqID_94582
atgacatcagtctatggagtgacttacattggggccagggaccagataaagaggaggctaaaggagcgttgtgcaattgaggatgatgtagagctgtttgctgcttcctgctatgcagcaagaaccactctcaccgccttagaagagatgtttgaggctgcaaggagtattatgagttggctaggtgattgtgcgaagctaatgtga

SEQ ID NO: 2898 - DNA, 303 bp, Glycine max
  Peptide Sequence Number=SeqID_94583
atgcatgacaaatgtaataatgagatcgacatgagacacctgaagaaccatcctttcctagctaacaatgtgttaggcccacttaggccttccagattcttcctccagaaggcggttgcttctggaggaagcaacctggctcgcctaggcaagctgggtggcaagctcctcccctattttgctaaaaatagggggaggagtgaagaggaaaggggttcagccttcttggcacttcatattcacttgaaattgctgaagaaaattgtttccgtgaagaaaatccaagccgaagcgcttccgtaa

SEQ ID NO: 2899 - DNA, 153 bp, Glycine max
  Peptide Sequence Number=SeqID_94584
atggggccaaggacaagattgaacagtacaaaattgaagattaaagcaagaactaggcaaatatatatatacattaagcatggccaaaacaaaacattaagcatggccaaaaataaaacattaagcatggccaaaaatcatatcttccaatga

SEQ ID NO: 2900 - DNA, 114 bp, Glycine max
  Peptide Sequence Number=SeqID_94585
catgtgatcctttggcatcatcaaaacattcagcttgatcctttgtctacaagtatgatattagaggacaaattgaaggcttgtcaaaggtcgaagaagggcttgactgaatag

SEQ ID NO: 2901 - DNA, 422 bp, Glycine max
  Peptide Sequence Number=SeqID_94586
gcttttattgagaagtactgcacccagagacaggctcagggtgatgctccacaggccgcaggcgcaccaccaccacctcatcaggctggcccggctgggtcatttgacatggagcagtatttacagcatttggttcgccagcaggcggccaaccaccgggcacatgtacagacccatgattgtctgtaccagctgagcctcagcatgcaaagccagggcttcgcttctttttcatgccctactccagaccagttcatggcagaggtcgcatggcccggggattggcccgaggcccaagcaggagaggcacccccagaggctcccgacgatggagaggaggccacgaggatgaggagatggccgatttgcttgacttcttgggagggagtggagctacatgaccgggagatccccagattcat

SEQ ID NO: 2902 - DNA, 312 bp, Glycine max
  Peptide Sequence Number=SeqID_94587
gcttctacatcatcattgacactctccaccctctttgctttatgcttctgtgctgcattccctacttcctccttaaaagttgaaaggaaagatattgagctggtagaggaggaagagccacggattggtgttgattgttctagtgcaacctctaataaatctgatatatataaggaggaagcaaggaatgcagcacagaagcataaagcaaagagaccgagagtgtcaatgctgatgcagaagcctttggtgatcactgggaaagttcagattgctctatgcattctgaatctgaagcattataacatatga

SEQ ID NO: 2903 - DNA, 761 bp, Glycine max
  Peptide Sequence Number=SeqID_94588
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttagactctgcagacactaccttagttaatcatcacaacagcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 2904 - DNA, 726 bp, Glycine max
  Peptide Sequence Number=SeqID_94589
atgaccaaacaaacttcaggcctcactcatttcaacgcacagggccacgcccacatggtcgatatcggcgacaaagcccataccaaacgtgtcgccattgccgaaggtcgtatcgagatgcaagcagccaccttacaaaccatcctgcaaggcaacgccaaaaaaggcgacgtgctaggtatcgcccgcattgccgcgatccaggccagcaaaaaaaccagcgacctgattccgctctgccacccgcttagcctaagccgcgtcgatgtcagttttatggcagatgaaacgcaacacagcattacctgccgtgtgcaatgtgaaaccaccgggcagaccggagtagaaatggaagcgttaactgctgtgcaagttggcctgctgacgatttacgatatgtgtaaggcgattgatagagggatgaccatacaaggggtgagagtgttggagaaacatggtgggaagagtggggactgggcgagttcactttctgttgcttgccccacagaaagtaaccaaagaagagggcacccagccatcacggcctacggctaccttgcgttgctcaacaaagtaagcggtcacgaaactcgccctagcagcttgctcacccccgcaagctgccgcggagctcaaacagtcgctcccttattccttactttgtttccgctactcagcgtgatggaatgggatttgtctcgccaaacttacagcgtgaaagattga

SEQ ID NO: 2905 - DNA, 438 bp, Glycine max
  Peptide Sequence Number=SeqID_94590
atgacggaaaaaacgatgacaatgatagtagacacattaccagtattctactatgaaaagatggtggactacacaccttcaagctttgatgatatggtcttcaccgacgaaaggatcaaagtgagtctaaaaagagacaaatctgattatcatactttgataaatgccaaaaaaactagggcaagtgaagaggatgagaagaagggagaaacctatgttgtgactgccattcttatacaaccaagtttcccaccaacccaacaatgtcattactcagccaataacaaaccttctccttacccaccgcccagttatccacaaaggtcatccctaaaatcaaccacaaagcctacctaccgcacttccaatacaaacaccacatttagcgtaaaccaaaacaccaaccaagaaatgaattttgcagcgagaaagccttag

SEQ ID NO: 2906 - DNA, 444 bp, Glycine max
  Peptide Sequence Number=SeqID_94591
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgtcacccttgtacaccgtttccatgagcaaactgaaacgtttcatcgctctggagtgataccacgacgattccggagttctacactatttcgaagatggcggtacgtgaaactggctattcctaagggttatgagatatgtttcgctcaccatcctggtgattcacagttgttaactgcatag

SEQ ID NO: 2907 - DNA, 897 bp, Glycine max
  Peptide Sequence Number=SeqID_94592
acctataagacacaccctaaactaaagaccttgctcgaaggcgggcagcgtattagttacggcgcccgcgcgatttccgaaggtggcatacaagctttgcctgaaatggctttccctggtggtgccttgcttggatgcagcgcaggcctggtgaatgtgcctaaaatcaagggcacgcattacgccatgaagtctggcatgctggccgcagaatctgtgttcgaggctgtgcagcagggcgcacctgagttattgaccagttacccgcaaaaaatgcgtacctcctggatatggcaagatttaacggcagtacgcaatgtgaaaccctatttatcacgctggggcacctgggtaggtaccgtattgggcggcatcgaaatgtggttgtccggttggggtatcaccatgccctggacgctcaagcacaccaccgcagatcatgccacgttggcagaagctaaacaaagccgccagccaagttatgccaagccggatggtgtactgacatttgataaactcagttcggtcagcctgtgcaatattggccatgatgaccaacagccatgccatttgaaattgtctgtggctgatattcctgagcgggtgaatttgcctaaatatgccggccctgaacagcgttattgcccggcaggagtctatgagtttgttgagcaggcgggcaaggaagtgttgcagattaatgcgcaaaactgcattcactgcaagacttgcgatattaaggatccgacgcagaatattacttgggttccgcctgaagcgtgggcgtccagcgaaactcgccctagtggcttgcacactgcgcaagccaccgcggaactcaaacagccgctggccgaccccatccacgctgactacgctactcggcgcgtcagatag

SEQ ID NO: 2908 - DNA, 1128 bp, Glycine max
  Peptide Sequence Number=SeqID_94593
atgacaaagaaaattgttgaaacgtctcgagctgatgtgagacccaagaaacccactggggtgaagatccaagaatggaaacaagaagagaaggaagaagaggaaagacctcttgtaagaaagagaaaatcacctgagacttcgaccaaatctgctgtccaaacagaggcaggcgattcccaggctcaaatgcctaagaagaaaaagaaagtgaagcagatcgagcctgaaccttctgtgacggtcgagggtggtgagccaatcaggaagaaaaagaagaagacaaagtcttcaaaagaacaaggtgagaatcaacctgttgacgtccaaccaccttcgactgatgttggcggcgctgaaacagaaactactccctctattgctgagatgggcaaccttgtcgaacaaccggacttaccacaagaacaccctaccgtcgaggtacaacaaaatgtttctgtagaagaaataccctcatgtgctcgaacctctcctgctcctgagacagatgcagtgaatgttgaggaacagggtgaaggtcaaggtattggacccagcagtcctcagggatcgagtcagagaagttcatctgaagaacacttttccgatgaagaggccatacaagaggctgaagctggaggttcagacattttcccagcgtcttcgacatctaagctttccgctagcatagggatcgcagaggatacattcattcaaatgcaagacgaagaccctgctgcagcccttcgactcctgctgaacaccagtcaagccaacacctcaagtgaaaagaatcctggtgcttcgtcctcatctgatgctgatataacctctacagtacgccaagattgcctgcttttgaagttatcaatggaatacgcacgggcagacgtacttaaatccattgaagagaacccttctgctgcttttgggcacctgaactttttgaagaaattgcataacccccttacttctgatgagattctgggcaaagttatacaaatcgagtccattatcgatcaatttgcaaatactgtgcagaaaaaacgcgaaaatggcgccagactcgatgcccagaaacaggcacatatccttctgctccgagaaagcccgagcggctcaacgtga

SEQ ID NO: 2909 - DNA, 486 bp, Glycine max
  Peptide Sequence Number=SeqID_94594
atgaccgaccctctcgatgagtcgatctcttgctttctcataagggtgaacccttgggtactagtaccctcacctccaaaggactacatgtcctcgccttcagaggactacacgtcctcgacttcagagggccccacgccctcgccttcagaggactacacgtcctcgccttcagagggccgcatgccctcgccttcagagaactacacgtcctcgccttcagaggacttcacgtcctcacctttagaagactacacgtcttcacctttagaggactacacgtcctcgccttcaaagggtcatgtaccttcaacttcagaggactacacgtcctcgcctttagaggactacacgtcctcgccatcagaggacttcctgtcccccattttcaaagggcgacacgccctcacctttaaaggactgcacgtcctcgccatcataggactacactccctcgccttcaaaaggcggcacatccttttttag

SEQ ID NO: 2910 - DNA, 372 bp, Glycine max
  Peptide Sequence Number=SeqID_94595
atggcgcctaccaggcaccctttggacccggataagtttaacagggccttgggatttcccgctttgatcacaggactctgccagtcgttcggagtccccgtcgcacctagcaaggcggccaaccaccgggcgcatgcacagacccatgattgtctttaccagttgagcctcagcctgcagagccagggttttacttcttttccgtgccctactccggatcagttcagggtagaggtcgcatggcccggagattggcctgaggcccgggtaggagaggcaccagcagaggctcccgacgatgcggatgaggcccgcgaggacgaggagatgactgatttgcttgatttcttgggagggagcggagccacatga

SEQ ID NO: 2911 - DNA, 210 bp, Glycine max
  Peptide Sequence Number=SeqID_94596
atggcccgcaccaagaaaactgggcagatgacgtttgagatagcaaaggaaattgcttacaagattgagcaggcgtcacagggttcgtttgtcccccatggacgtcaggatctcctgactactgccattgggcgaccagaacaccctggccgtgtgcattctgctgaagccggtgtgaccataaagaaatactttggatcggctccatga

SEQ ID NO: 2912 - DNA, 489 bp, Glycine max
  Peptide Sequence Number=SeqID_94597
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctttcgctccaagctggactgtatgcacgaaccccccgttcagtccgaccgctgcgccttatccggtaactatcgtcttgagtccacccggaaagacatgcaaagcaccactgcagcagccactg

SEQ ID NO: 2913 - DNA, 385 bp, Glycine max
  Peptide Sequence Number=SeqID_94598
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcttctcggactgggcatgctcgaggcgctgcatcacatgatcgatctcgtggccgagaccggatcaagcttatcgataccgtcgacctcgagggggggcccg

SEQ ID NO: 2914 - DNA, 555 bp, Glycine max
  Peptide Sequence Number=SeqID_94599
atgccctctcccctcggcagggatttcttcttcagcgaagacgagatagttgttggcggtgatgttattgatgagctctccaaagccttctacggagatacctttactggaacattctcgttcagagtggggctcgtcttgtcattttggtccttcgccatctttgtgttccctttgatgcttgcgggttgtgtcggcaggtcagagggtgcgaacacgcgaccgctacgggtcacaccactcagccccgtgatattagttaccttggccaacaacgagctgatatcggtggctattccgtggcacgattcgactcaccgctatttcattgttcaagtgatagaggtgtcatcctctgcagaggatcctgaggagttacctcctgagcctgttgtggatgctcttgacttacctgaggatgatgaagacccactccttgatgttgattttccagaggatatcatgtcagtatctgaggcagactctacaaaggagagcggccctggagggacagcgaatagtggagactcttcatcaaagcagatggctccttag

SEQ ID NO: 2915 - DNA, 138 bp, Glycine max
  Peptide Sequence Number=SeqID_94600
atgcatctacgtgatcaaggtggccttgttcgtgctcgtgcgcttagcgcaattctgaaccgcttagcgcacattagtgaatttcggcttagcgcgtgcatttctccctcagcggatggactgaagaggtgcacctag

SEQ ID NO: 2916 - DNA, 486 bp, Glycine max
  Peptide Sequence Number=SeqID_94601
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaaagcaccactggcagcagccactggtaattgatttagaggagttagtcttgagtcatgcgccggttaaggctaaactgaaaggacagtttggtgactgcgctctccagccagttacctcggtcaaagagttg

SEQ ID NO: 2917 - DNA, 357 bp, Glycine max
  Peptide Sequence Number=SeqID_94602
atgcatgaacgaaattgcaattcatggggcaccgaaaaaaggggtagagaatggagaattgcactaagcaatcactacgcatggctccaaactcgtgggtgcaggatgcatgaacgaaaacgcaattcatggggctccgaaaaaaggggtagagaatggagaattgcaataagcaatcactacgcatggctccaaactcgtgggttgaagatgcatgaacaaaaatgcaattcatcgggctacaaaaagggtagagaatggagaattgcactaagcaatcacaacgcatggctccaaactcgtgggtggaggatgcatgaacgaaaatgcaattcatggggatccgaaaaaaagtag

SEQ ID NO: 2918 - DNA, 167 bp, Glycine max
  Peptide Sequence Number=SeqID_94603
ctctgaagtacctattgaagaaggctgaatcaaagcctagattgatcaggtggatgctttggctccaagagtttgatttggagttccttgattggagcagtgcacaaaacctcatagctgaacgcttgagtaggattgagcggacgtctgaggactcacccatttag

SEQ ID NO: 2919 - DNA, 163 bp, Glycine max
  Peptide Sequence Number=SeqID_94604
gcttagaagtctagatttcctcgaagaagctacaaaaagaaggattgaggaagttttctccaccgaatccttgagcaacgatggctcgtggtcgccaccgatggtcgtgggtggtggagaaggagatgttagggtatgggtgccgtttggagaggaggagagg

SEQ ID NO: 2920 - DNA, 318 bp, Glycine max
  Peptide Sequence Number=SeqID_94605
atgcatatcccatgctaccaaaggtattccccagcattgaagccaataaaacaaatcgccccatccatcttcttcgttcaacattcactccgctttctcttctgtgagaccaaggagcaaaaccatatcatcgccgatacttatcaaggtaatccttgtggcgtctacccagacttatcttccttcactggaagtggcgtctaccctgacttatcttccttcactggaagtggcgtcatccaaacattcgtagcctgtatcaaacgatccgctcctactcaggttcgcatcatttggtatcagagcttcggctcttga

SEQ ID NO: 2921 - DNA, 1047 bp, Glycine max
  Peptide Sequence Number=SeqID_94606
atggaaaaggatgtattgctagataagtatagaagaccagtaaataatgctgtgtgtactgaacaatggtcctctctcaccaagaaggttttggatgtccttccatatactcttactactagtcaacagcttgctgtttcagaaattatttgggatctacaaagaccagttccaatgaatcggcttcttcagggtgatgttggatgtggaaaaactgttgtagcttttcttgcatgcattgaagttattggctctggctatcaggctgctttcatggttcctaccgagttgcttgcgatccagcattatgagcatttgcttaaattgctcgaaaacttggatgaggtcgtgttcaagccaactgttgctttactcactggttcaaccccactaaaacaatcacggatgattcgtaagggtatccagaccggagaaatctcgatggtcataggaactcacagtttgatagcagacagtgtggaattcgcagccttacgtattactgtggtagacgagcagcatcgctttggtgtgattcaaagaggaaggtttaacagtaaggtgtggatggtggaggaagtagggggtgatggagattcgaatctgaggagaaccttaccgtccgacgcatggtcggatgaggtaacgtcggaggaaggaggcgacgatgttgacgctgacgatgacagcgataccactttctccttttcgccggagctgtccttgaagaagtcgatacttcgttcgaaccactggtcagaggacacaaccagtggttacggccgccaaaccacacaccagcccagaccgatgggtaacaacctttctgatgacacatgcagagagggaacagaggatagagtcaagagtatccagagcccgaatacagcaaacgttgactctggaagcagaagtgcagaaaaggcagaggcaaatggttgcttaaaagaggcaatcctgaacatggataaagctgcttctcgggagcacaaaggtgaccctgtaggaaataatttgaattgtggagataaagtttcagatgtctag

SEQ ID NO: 2922 - DNA, 222 bp, Glycine max
  Peptide Sequence Number=SeqID_94607
atggtgtttggaggactgaagacgaatgttaatgttcccaaatttgggagagcaaagaatggagagccacaaacagcaaaagggggaagaacagaggctagacaaccacaaaaggggaaaaagagacttgtgcctgagcaggatatcaggaacgaaggagcggatcgtttgatacaggctacgaaggttttgggtgacgccacttctgatgaaggaagataa

SEQ ID NO: 2923 - DNA, 240 bp, Glycine max
  Peptide Sequence Number=SeqID_94608
atggcagcggaatggagaagaagaagagttgagaggagacgccacttcaaggagaagatgagtcaagaagaagctcaccaccataggaagccatggataagagcttggagagataagtgggctcatacttatctcatgggcctgaaatctgccgtaaggctcatgagaaccctagggccttctcttgcatctctgtcccaatctacttggagtcttctatccaattcccttccagggtag

SEQ ID NO: 2924 - DNA, 1191 bp, Glycine max
  Peptide Sequence Number=SeqID_94609
atgaggtattgtagttttgtaccttcgaaaatgtgttaccggctcaagcataagttagcagagaagaaggttgcgcgaggtgtgggaagcggttccaagttgcggaataaggtagttgctcttatggattataaccttcctgacctaattgggaatggaagcggtgaaaagaaatctaaaatgagtccaaaagatgcattagatgatctggacatctccttgatatgtaagagatttccgtcaattactttgggttatgctcctcgagtggatttatatgatgggaccaggtcatgttctgagacaatgaactctttagcaacggaaaattttgaaaattctttttctgattctttagaggctagttgggtgcaaagtactctctctgaagaacggccttctctgtatgccagtcattctagtctcacatcttccacattaggagaagaagattcttgtccttctcctttgccgcctgatttgacgccttcaatatatgaagaaaaattggatcaaatcaccagggaagattctcaaatgaaagtgaggatggagtcacaatcaaattctacacccagtgagttatttcttgacaaatctgtaagttgcatacctggattaagtaagaggcactaccagcagttggataactatgggtttcacacgttacggaaattgctgctccactttccacgatcatatgccaatctgcagaatgcgcatgctaaaattgatgatgggcaatatttgatttttgttggaaaagtcttgtcttcaaggggagtcaaagctaatttttcattttcatttcttgaggtggttgtgggctgtcaagttgctgaaagtgaatctgctcctgagcatgtaactattgatgtgcaaaagacagtttatttgcatctgaagaaattttttcgtggctcacgttttacttttaaagctttccttaaaaaccttgcagaaaagtatcaagagggagacatagtatgtgttagtggtaaggtcaggactatgcgtgctaaagatcactatgagatgcgagaatataatattgatgtgcttgaagatggaaaagatttgtctttttttgctaaagagaggccatatcctatctacccttcaaaaggccgtttgaacccaatatttcttagggacactattgcaaggtttgtgcttcaaattcctgattga

SEQ ID NO: 2925 - DNA, 231 bp, Glycine max
  Peptide Sequence Number=SeqID_94610
atggatttagaaattgaagctacattaagaaggaacagggttgagaggagaaggaagcttctgcaagacagaacagggaatttattccaaggattacctaacgaagacccctatgcacatttggcaacgttcatcgaaatatgcaacactgttaagattgttggtgtgccagatgaagctataagacttagcctatttgttcacggccgacaagtgtaccagatcgcacaa

SEQ ID NO: 2926 - DNA, 333 bp, Glycine max
  Peptide Sequence Number=SeqID_94611
atgggttttcctttgccgacaatcatttaccttgccgaaaatttatctggttttagcattcgttatttgctctcccttgaggagattccgctgtcctttgcttcgggggaaaggatgaggattctttttataggccaaggttcaaagcagtctaaggttgggtctcaacggggtcttttatcgtgggagcccaatcttgatatctgggacaaaacaaattcgtgggtaaggtgtcggtctcggattgaacttccatattatttccgcaaggcacgcgcaacaatgatgatttggaaacaacgcgcaaaattagtcatggccacagccaggtga

SEQ ID NO: 2927 - DNA, 138 bp, Glycine max
  Peptide Sequence Number=SeqID_94612
atgttgatgatgctgaaaatgcattgtgatgttgttatgttgtgtatgtaccttgggggtgcagtgaccttgttggatatccctgtgaccttgttggatatccctggtgggggaaatagagtggttaaagagttttaa

SEQ ID NO: 2928 - DNA, 372 bp, Glycine max
  Peptide Sequence Number=SeqID_94613
atggcgaagcaagaagaaagggaggtgaagccacaccgagaagagacagaggttgtgaacttaggcattgcggagagagaaaagaggtcaaggtcggcacttgatatgcctggtttgagctcggatatcatgcagcataagctaccactaaatcctgagtactccccagtgtcataccctaatttcgtccgggaaccttgctcgatgacgtgcgaccattctttggtcctcgtgaggtgcttggcacccatcattaggcaatttgtgaaattccaggacatgccgaaaaaccaaaaaaatattgatgcacaatccgtaagtttccgtgacacaccggaaatcaaatggaagcatcgttgcataattaagtga

SEQ ID NO: 2929 - DNA, 464 bp, Glycine max
  Peptide Sequence Number=SeqID_94614
atggtgaaagttggaacctcttacgtgccgatcaacgtctcattttcgccaaaagttgcagtcgataggggggcccggtaccagcttttgttccctttagtgagggttaatttcgagcttggcgtaatcatggtcatagctgtcccttccttcgggaaacctgtcgtgccaactgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacaacggggcggaatttcctggaagatggcccaggaagatacttaacagggaa

SEQ ID NO: 2930 - DNA, 752 bp, Glycine max
  Peptide Sequence Number=SeqID_94615
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaagtggaagggattctacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 2931 - DNA, 393 bp, Glycine max
  Peptide Sequence Number=SeqID_94616
atgggtgaagcaaaggaggtgcaagagaagatgaaggccgacatggaggccatgaaagtgcaaatggccacaatgatggaggccatgatgagcatgaagaagataatggaagccaatacggttatagttgccgctactagcgttgtcgctaaggtgaacccgatgctccgatctggcctcaaccaaatgaatcatccaacctcaaatatggcacatatctctcaaaccatgggggagacacatgaaattccccaccacaatctagctgacttcgagccttgcctcggatatgtcgctgaagggcaagcagttggtggtataccccctgcaaaacactttggagggccgtcaatatcatccacaagcacaacttgcatgttccacagcggttaa

SEQ ID NO: 2932 - DNA, 459 bp, Glycine max
  Peptide Sequence Number=SeqID_94617
atgggcctgcgatatgaggtccacatgtgggggaataaggttgagacacagtatgcacaccctgttccaccacataaaagggtccaaagaggaaggcctaagaaaaatagaaggagatctgtagatgaggacaatgtcacaagacatagggtaaggaggaaattggttgactttacatgtggaaagtgtggccaaaccaatcataacatcagaagctgcaaaaatattggagttcatattaggccaaagaaatatgttgcaccaccaacttcaaatgaggatgaccacctactatctcaagatgagcaagctttgaataaggctgaagaagctgctgctcatgttcaacaagatccagtggagattaatttatctcagcctaatttgtcacaagatagtccctacaacataacaagagccaaacaaaggaaggttgctgataaagatgatgcagtataa

SEQ ID NO: 2933 - DNA, 282 bp, Glycine max
  Peptide Sequence Number=SeqID_94618
atgctgtttgaatgtttcttgatttcagaagttgtcatcatcaaaaagggggagattgtagaagcaaagcttcatgatgaatcaaagaacaattcaagacttcaagataagaatcgagaagaattcaagactcaagaagaaagtttagagtcaagaatcaagattcaaggctcaagatctcaagaatcaagatcaagatcaagattcaagactcaagattcaagaatcaagagaaggcttaatcaagataagtatgaaaagtttttctcaaaaatcgagtag

SEQ ID NO: 2934 - DNA, 209 bp, Glycine max
  Peptide Sequence Number=SeqID_94619
gtaatgaaacgacttccggaagaacagatcttccggaaaactctcggaacacgtcttccggaatgtttccggaagatgtacttgttccggaaacattccggaagagggttcttccggatgacctttcagtggttccggaagcactttccggaagagccttcttccggaattgttccggaagaagtacttcttccggaagtagtttttaa

SEQ ID NO: 2935 - DNA, 432 bp, Glycine max
  Peptide Sequence Number=SeqID_94620
atggttgcctttgttaggcagtatcagtacaattttgatatggttccggataggatgcaactacagaacatttgcaaaaagggggacggatctttcaaagaacacgcccaaaaggtggagggatctggcggcccaggtggtacccccaatgatggaaagggagacgatgatcgtgatggctacacaccttcaagttttacagatttggtcttcgccagcaaaaagatcgaagtgggtttgaaaagaggcaaatttaatcatcctgcttggacgaatgagaaaactggggcaaatgaagagggtgaggatgagggagaaacccatgcaaagactgccattcctgtacggcgaagtttcccaccaacccaacaatgtcattacccaatccttctccttacctactacccatttgtccacaaaggctatccctaa

SEQ ID NO: 2936 - DNA, 336 bp, Glycine max
  Peptide Sequence Number=SeqID_94621
gccaaatacagtctaaaggcccaagtggagaaggacaaaacccccgagtggagaaggatgaaggcccaagtggagaaggatgaaggcccagaggcagagacactatcaagactattaattttgaaccaatctcagacttatcaaggtaatccttatggcgtctgtccagacttatcttccttcaccggaagtggcgtctaccctgacttatcttccttcactggaagtggtgtctacccagacttatcttccttcaccggaagtggtgtctaccctgacttatctaccttcactggaagtggcgtcatccaaatcttcgtagcctgtatcaagtga

SEQ ID NO: 2937 - DNA, 285 bp, Glycine max
  Peptide Sequence Number=SeqID_94622
atgtcttccatgatggatgccatgctaggaatgagacaactaatggagaataacgcggccaccgtcaccgctgttagtttggctgccgaagcagacgcaacactcccagctaccacgcaccaccctatcccaaacgtgtcggacgaggtccacgaggatcatcgagagcatgctcagggagacatcgattcctactccacgttccccgccgagggaccgacacccaacgcggacatgactgaactttgcttagtgccggacgtcgtcatccctccaaaattcaag

SEQ ID NO: 2938 - DNA, 516 bp, Glycine max
  Peptide Sequence Number=SeqID_94623
atggagctatgtcaggacctagcggcaatcgatgccttccttgcttatcaccatagcaaggaaagtccactcgttgttgttttggccgatgcctatgacacatttgacagaagatgcgaaaagagcggtgcaaggatcatctgttgcacacttactctttatgtatggctggtctcacacctctttcttcatgaaagtagacctgtctgtcccctgcaaggtcaccgcacatgcactgagaaagggaaggccaattgggagcaactcctggctagtatagtggggacatctgttaattggttcccccgatggaaggaaggaagagttggggttctgtcctcatgtgagggattctcaaatgtcccattgatgggaacgaggggttgtatcaattataatcccatccttgccataagacaacttggttaccccatgagaggagcaccgttggaagaaagtaccacgcgcttcatcgcacggggtttcagagaccccaatgcaaggatatttcagagg

SEQ ID NO: 2939 - DNA, 243 bp, Glycine max
  Peptide Sequence Number=SeqID_94624
atgagcccaattttgtcagacctgaagagaccctacgtgagtggatgtgcggaaaaaggcacaggccatccagaagcaaaacacttcccccccccccacgtgttgtcttgtgggggttatgaatatttagaacaaaagctcatggcggaaaagacaaagaaaagattggaggaagatccccagtccggaagcactgagggcgtcattgaccctccatctcccatcaaacgccacgtgaagtga

SEQ ID NO: 2940 - DNA, 117 bp, Glycine max
  Peptide Sequence Number=SeqID_94625
atggccccctctctttacagcgacgttctctgcttgtccagcgccgggaagggacgacgatcgattagtcgtgaccctatcccccatttgcgtctattcctaagtaccttcaagtag

SEQ ID NO: 2941 - DNA, 300 bp, Glycine max
  Peptide Sequence Number=SeqID_94626
gatggtgatctagatttaaatgcctccccaaaagcacttgataaactactgggtcatctgctcgccttcaaagtcaaaatccagccgcagtataaaaattctactgttttgaagtgctccagtgacttagctttaattaatgatgttctggacatgtttcctgatgctgagacatgttcaaagattaaagctacaacaccgtttgattccaatgatcctgtccacgatgaatgtcaatccatttctataacagtagaccatgatccacttattggacttcccttgacaccaacaaaatga

SEQ ID NO: 2942 - DNA, 525 bp, Glycine max
  Peptide Sequence Number=SeqID_94627
atggttaaggaggagtgtaaggaggtaagtgtctcctccaagaggttagctaagaaggaaaaacattttgaaataaagacgaatattaaagaaatttcccctcttaaacaacctccacattttctcctttgtaaaaagacacttgtttgcattgccacacctcttaggcttgagtttattcctcaagtaaaggagttgttggatgagggtttggttcgcaagagcttaaatccttgtgctttgttggtgcccaaaataggtattattaggcaccaaatccctaaaataggtggtatgatgaatgctttgggtggtgcaacactcatttgtaaaatcacttgtgcacccaacatcttcatgatttgtgtacattgggactcattaggtaggaataatcaacatgaaaatacagaaaaaggtgttgaggaaaaaagcccagactttcaagaacctcaggatttgagttcaaatccttttcaagggggagggaatgatgcaatcttacctctcaagggcattggatag

SEQ ID NO: 2943 - DNA, 606 bp, Glycine max
  Peptide Sequence Number=SeqID_94628
atggaagggttagtggacctagcagtgattgacgctttcctcgcctttcagcatggcaaggaaagcccggtcgtcgccattttggccatgtatgacacgttcgaccggggatgtgaaaagagcggcgcaagaattgtttgttgtgcactggctctctatgtgtggctggtttcacacccttttctccaagaaggtaggcccgtctatccgctacaaggtcaccgctcgtgcgtcgaaaaaggaaaggcgaattgggaccaactcttggctaacatggaggggcgtctgggttgtattaattataatcccgtcctcgccataagacagcttggctaccccatgagaggagtgccatcagatgaaagcatcacgcctttcatcgcacggggtttcagtgaccacaacgcgagggtactccaaggagttcgcaaggcatgggatgcggctccggacacaaggattggattggctcccaaatctaaagactgtggagacgatgaggttaaagcttcggaagaaagtgatgaggtacaagccctaaaggcaaagcttgaaagagcccgggtagtcaaagagaagttcaagtccatagccatcaaagtctga

SEQ ID NO: 2944 - DNA, 285 bp, Glycine max
  Peptide Sequence Number=SeqID_94629
atggaacccagctccaaactagaaagtggaggacacatgaacagcctaagcaattcattcatgtggctccggaaaaggatgagaatggatgattgccttgagggtcctctcttaggcaatcatgaaacacagctccaaactgaaaagtggaggacacatgaatcacaatgcaattcattcatgtggctccggaaaaggatgagaatggagaattgccttgagggtcctctcttagggaatcatggaacacagctccaaactcgaaaatggaggacacatgaatga

SEQ ID NO: 2945 - DNA, 105 bp, Glycine max
  Peptide Sequence Number=SeqID_94630
ggtaggttgcgacgcggggctcgcgagtgcgtcttccaagaaaggaaaatgcacgaagtcgccacaaacgtttattcgaggaaaacgtcggaaaaacctgaaagg

SEQ ID NO: 2946 - DNA, 141 bp, Glycine max
  Peptide Sequence Number=SeqID_94631
atgtcggctggaaaatatcagtcgcggctttacaacgaccgatgtcggctaaaggcccaagtggagaaggacgaaggcccaagtggagaaggacgaaggcccaagtggagaaggacaaagcccccgagtggagaaggatga

SEQ ID NO: 2947 - DNA, 120 bp, Glycine max
  Peptide Sequence Number=SeqID_94632
atggtttcacctttgtgtcattgcgtcgcaccaccactgttgtgctcttgtgttggtgtcaatgttaaaggtgtgaaccctcactctcacttttgcctatgccatgtcgcgacgtcgaag

SEQ ID NO: 2948 - DNA, 1272 bp, Glycine max
  Peptide Sequence Number=SeqID_94633
atgaagaaggttataaccgttatttcggggtcttctagacaggacttaaagttttgtgatgaagaaaatttccaagagcagctgcaatttgccagaaaggagagccgtactattgatgctgcacttctggaggagcaagtccatcagatgcttcgtgagtggaaggctgagcttaacgagccatctcctgcttcctctttgcagcaaggtggcagtcttggttcattctctaccgatgtctataggctattgcagctctgtgaggaggaagatgatgccactagtccattagttgcacctaagcctgaacctaatgatcagattatgcaggctggggctaaggtgatagtccaagagcaatttggatatctcagtaatagtaatgaatttcttggtttaactataaatcagggtttttgtgaggaaggtcgtgttcctcacatatctagctatctgccaagtgtgtgccctcctccttctgctttcttaggcccaaaatgcgcactttgggactgtccaagaccagttcaaggcttggactggtgtcaagactattgcagtagctttcacgccgctctagctttaaacgaaggaccaccagggatgaccccagttctaagacctgggggaattggactcaaggataatttactttttgctgctcttagtgcaaaggcacaaggaaaagttgttggaatcccagaatgtgagggagcagcaaccgcaaaatctccatggaatgcacctgagctctttgatatatgtgttctagagggtgagactattagggagtggctattctttgataagcctagaagggcatttgagagtggaaacagaaagcagaggtcactgccggattatagcgggcgtggatggcacgagtctagaaagcaagtgatgaacgaatttggagggctgaagagatcctattacatggaccctcaacctttgaacctttttgagtggcacctttatgagtatgaaattagcaagtgcgatgtgtgcgccttataccggttggaactaaagctggtcgatgggaagaagagctccaaggcaaagatagtaacaggtgattcagttgctgatcttcagaagcacatgggaagcctctctgccaaaggtagtagaaccaagcttggcataggaggtggtgtttattcagcttctaacagagttgctctactaaatgcaccttatcaatacggcttaacttcaccatatgatgactatgttgttcacaacacattagactattatgtgacatga

SEQ ID NO: 2949 - DNA, 168 bp, Glycine max
  Peptide Sequence Number=SeqID_94634
atggacgaagaacagcgaaagtataatactatcatgtatgaagaagttgatatgaatgttgaaaatgagaaagatgctagcgtaaaaatagaacacattgattgctctaatgcctttaatacttctgagttgtttgctacccgtgataaagttttacattgggcttga

SEQ ID NO: 2950 - DNA, 288 bp, Glycine max
  Peptide Sequence Number=SeqID_94635
atgcccttgccagaagccgaacaagttttcggcgatgttgccggggaacttcgttttattagggaaaaattgaggctacattgtgaaggaacagggctgaaaggagaaggaaacttctacaagacagaacagttgaatccattcttgaggaggagactcatttctctgacttattatcacttgattcaccatcataaagggaatctgccactcaattacctgaagtcattaccatggcagaagagcatgaccagaggattacccttgaggattactcaagtagtttag

SEQ ID NO: 2951 - DNA, 279 bp, Glycine max
  Peptide Sequence Number=SeqID_94636
atgtacatcaagtatggcccaaaatacgtcatgaagcatagccaacaaaacaagttgtccaatgaaacaaaaaccccccacacttattcccaaaacaattccaaagctccaaaattccttaaggatatggacgcatcaacaagaatcaagccaaggctattgtgcaagcaatcaatggggcaaaacacaccaaatgattatgatgatggatggctcaattctcacaaaggtaaactcatcactttcaaattgagctttcaaaactatcatgacatgtag

SEQ ID NO: 2952 - DNA, 888 bp, Glycine max
  Peptide Sequence Number=SeqID_94637
atgtcctctcgggggaagaaaaccatatctttcctccgggtgtctcccctctttgagcagaattgcaactgtggtcaaggattccgcaagaggtttggaccgcataaaacagactcggaacggcatagcgggcctaccacagaagtacctagaagacaaagcgaggggtatggccaatcaaggagaatgggtcccgtttatggatgcctagcagcaatcgacgctttccttgcctaccaccatagcaaggaaagtccggtggtagctgtcttggcagatctatttgacacatttgaccgaaggtgcgaaaagagtagcgcacggatcatctgttgcttacccgccctctgtgtttggttggtttcacacttgttccaacaagacacaagacatccatgtccgctcctgagccatcgctcgtgtactgaaaagaggagaatagattgggaccagctcttggccgggataggaggtagaacaatcagttggttcccccgatggaaggaaggaaaagaaggagtccttttctcatgtggaagatacccaaacattccgctggtaggaacgaggggttgtattaactacaatcccgcgctcgctataagacaactagggtaccccatgaggggagcaccgacggaagaaagcatgtctcctttccttgtgagggatttcggcgcacaaaattccaagactatacaaagaatccataaggcatgggaaaccccgttaaggaaagatcaagagcttagaggcattcgtaatggcatcattggtgggtaccacgaatggctgaaagttcatatacgaggtttagattggctcgccaagttaaaagtcgtcagcgaagagagttttgaagcaccggaagaggacgaagaagtctaa

SEQ ID NO: 2953 - DNA, 399 bp, Glycine max
  Peptide Sequence Number=SeqID_94638
atgaggaaaggcaagagtgaggaaaacattgacaagaaaaaggatactactccaaatgaaggcaaggaagtaccttatcctttggtaccttcccggaaagagaaagaaagacatttgacaagatttcttgatatcttcaagaaactggaaattactttaccctttggagaagcacttcaacagatgccactctatgccaaatttttaaaaggattcgcgatgaacgcgctaagcgcgcttgctgcgcttagcctgttcatcgcaactattaaaatttttcagatttctgatgattgcgctaagtggacgcgttcatcttggctgttgaaccaaaacgatgcaaacgctaagcgcgcttgtgcactaagaatcaatggtatactaggatacccagtgtag

SEQ ID NO: 2954 - DNA, 453 bp, Glycine max
  Peptide Sequence Number=SeqID_94639
gaaatcactgccaaacaagtccagcattggccaaagaaagggaagctttctgcagggaagctgagtgtgaagtatgcaattctgcataggattggcgctgcaaactgggtacccaccaatcatacttccactgttgccacagggacacatgtcccagacattgtctcgacatcagggaaagctgctgcttcaggacacatgcaaggtgctggaagcaaccatcaaagccaccacagaaagaagatggagctagaacggatgatcacaaggctctcagaaagtggcattgatgatgaagaagcagctgaagaagaggaagaggcagctgaggaagacaaagaagcagctgaagaagaagaagaagctgctgaggaagaagaagaagctgctgaggaagaggaagatgcagcagaagagacagaatcagatgatgattctgaagccaccccatga

SEQ ID NO: 2955 - DNA, 417 bp, Glycine max
  Peptide Sequence Number=SeqID_94640
atgaccatgattacgccaagctcgaaattaaccctcactaaagggaacaaaaaaagcccgggggatccactagttctagagcggccgccaccgcggtggagctcccattcgccctatagtgagtcgtattacaattcactggccgtcgttttacaacgtcgtgactgggaaaaccctggcgttacccaacttaatcgccttgcagcacatccccctttcgccagctggcgtaatagcgaaaaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 2956 - DNA, 300 bp, Glycine max
  Peptide Sequence Number=SeqID_94641
atggcgccgaccaggcaccctttggacccggataagtccaacagggccctgggatttgccgcattgatcacaggactttacgcgccgccgcctcatcaggctggcccagctaggtcatttgattcggaacagtatttacggcatttggttcgccagcaggcggccaaccaccgggcgcacgtactgacccatgactgtctttaccagctgagcctcaacctgcagagccagggttttacttcttttccatgccctactccggatcagttcagggcagaggtcgcatggcccggagattga

SEQ ID NO: 2957 - DNA, 162 bp, Glycine max
  Peptide Sequence Number=SeqID_94642
atggcgaggacatgtagtcctctgagggcaaggacgtgtagtcctctaaagattgactgtccttttgaaagaggtgatagtccatgcaacctcattctatcttttgcaaatctttctgggaactccctcagagtgtatgttctgtttgatttagtcacttga

SEQ ID NO: 2958 - DNA, 234 bp, Glycine max
  Peptide Sequence Number=SeqID_94643
atgtgggccatcatcgataagtgcaaagagaagctaaatctagcggcgactaacgagcaaaggctagaggatgagtacaccaagatatcagcagaaatgggaaagaggaaaggcccagggccattgaaggaggtgctggactttgacaagtacaaggggactacttgcctcaagaaccatccaaagatgtattgtcggaagataagggcatacgcaaagatgaggaattgctga

SEQ ID NO: 2959 - DNA, 204 bp, Glycine max
  Peptide Sequence Number=SeqID_94644
atgcaagcacactcccgcgatattatcaaagataacaccggtctgagagtggatattggtctcgtgaggcgccagaccaaattccgcgaagatccaacggttccagcgggctgctcagtgtttttgccaaggcggagacacgtagcttcctcaaaaaggttccttaagagggttattcaagaacagtctccgtggcttctttga

SEQ ID NO: 2960 - DNA, 585 bp, Glycine max
  Peptide Sequence Number=SeqID_94645
gaatacaacaaaatgaaaccttgtaaggtttcctaccaaaacataaagcagaagatgaagttcggtaatcaagagttgctggtacttacaaatgagtttcactaccctggtagagaagctgttaatgataaattcaattgtctcattgataatatttggaatattccaaaaaatacaaataataatgagcaatttgtttgttcagtaaaaaagggtatcatctgtgctctatacaatttctgcattgcagatgaccaaggagttcctcttcttacaaaagcctctccttctggaaaaggctatacagcttttgtcctgttatcaggaccgcataaaggtgtttataccaatttcaaagacctttgccttgcaaaggagggtattcaaagcccaatctacaaaggtttctattcaagggaagaagcagaaaaagccctagaattaaataccacagatattaacaaaataaaaaggtctcttgaaccagaaaaccccaaccataatcataaatgttggccaaaccaagaccagccaaaagacctacaaagacacagtcagcccaaatgccccaggctcaacaaatga

SEQ ID NO: 2961 - DNA, 320 bp, Glycine max
  Peptide Sequence Number=SeqID_94646
taaatggcaatttgaatccaactgttgaagtcaacatatttggttattcagaggctgcagacgttgtatttacaagtggggtagatgtacttgcagtggggataaatgttacccaccaagttgtactaactgaatttatgcataaggctccagtgccgcctcagagtttgatagtcactgttttcggtgtgtcgagcaccagcagcgcttcgaggccatcaagggatggtctttccacagggagaggcgtgtccagctcagggaagacaactatcctgacttccagggagatatctctcgcagacattgggcacgactag

SEQ ID NO: 2962 - DNA, 342 bp, Glycine max
  Peptide Sequence Number=SeqID_94647
atggcgaagaggtttggaatgaccataatttgtctccgcatgtcattggggtcgccgcctctggatggcaaaatggtgtggaatgaccataatttgtctccgcatgtcatcgggctcgtcgcctctggattaaaaaaggatcagaatgaccataatttgtctctgcgtgccatcggacacgatcgtctccggatggcgaaaaggtgcggaatgaccataatttgtctccgcatgtcattaggctcgccgcctctggatgacaaaaggtgcagaataaccatagtttgtctttgcgtgccatcggacacgatcgtctccaaatggcgaagaggtttggaatga

SEQ ID NO: 2963 - DNA, 1188 bp, Glycine max
  Peptide Sequence Number=SeqID_94648
catctcgctgaccgcgaacaaggcgatcaccaccaccacgaaatcgatgccatcggccaggtgcacggagtcgaaggtatagcggtatacgcccgagttcgcatccacgccgatcaccgagatcgacaggccgatcatcgccgccagcacacccttgatgggctgcttgccgagcaggctggtgaggcagcagaaggcgaagatcatcagcacgaagtactcggccggcccgaacgccaatgcccatttcgccagcagcggcgccagcaggataatgcccaccaccgacacgatggcgccgaagaacgccgaccatgccgacaacgacagggccacgttggccaggccctggcgcgccagcggatagccgtccagcgtggtcatgatggcgctggcctcgcccggcacgttcagcaggatcgaggtgatgcggccgccgtattccgcgccgacgtacaccgccgccagcaggatcagcgcggtctcgggcggcaggttcatggcgaaggcaatcgggatcagcatcgccacgccgttgatcggccccaggcccggcagcacgccgaccatggtgccgaaaaacgaaccgatcgcggccaccaggatgttggtccacgacgaacgccacgccaaagccgatcgatagatgatcgaggattccgctcatatcaggttctccagcagcccgccgggcaggaccacgtccagcaccttgtcgaacagcacgtagaagaaagtgctcatgacgatgccgccaatcgcgcacttgacccagccgccgccgaacaggcggccgacgaagaccgtcatcaacgcggtggcgatgatgaaacccagccactggaacaggaacgcatacgcggcggcgaacaccaccatcaacgcgatgcggccgttggcgccggcggggttcggctcgaccgcgttgccgcccttgtaggccaggcgcagaccgcacaggccgatgatcagcgccagcagcaacgggaaggcgcgcgggcccaccggttcataggcgaacggcgcttcgatgccccaccccgcccaggtcatgaaggccgccagcgcaagcgccgcgatgcccaggattcgatcgttcatgatcagctttccgttggtagaaggaccgggcggcgcaagcccgccccggcctccggctgggagccggcggcgcaaggtgcgcgttaa

SEQ ID NO: 2964 - DNA, 180 bp, Glycine max
  Peptide Sequence Number=SeqID_94649
atggctcatggcggccaatctcttaccttctatgaggttgagctaatcaaaattggtggcattgttagtgataatcttcttgggcaacccgtatcggcagattatctcttgatgaacctaaccaccacgctctttgttacactggcgtctaaagccgcttcaacccatttggtgaagtag

SEQ ID NO: 2965 - DNA, 1083 bp, Glycine max
  Peptide Sequence Number=SeqID_94650
cagatcgtcatcgacacacaggccggctcgccgcccaatattgccattttgccgcagcctggccttctcgccgatctcgccgccaagggttttcttgtgccgctcggcgacgacacggccaaatgggtcgaggaaaattacggcgcgggtaaatcctgggtcgatctcggcagttataagggcaaggacggcaacaaggcctatttcgctttccccttcaaggccgacgtgaagtcgctcgtctggtatgtgcccgagaatttcgaggaagcgggatataaagttcccgagagcatggaagacctgctcaagctcaccgaccagatcgttgccgatggcggcacgccctggtgcattggtcttggctccggtggtgcgaccggctggcctgcaaccgactgggtggaagacctgatgctgcggacgcagccgctggatgtctaccagaagtggacgaccaacgaggtaaaattcaccgatccggccgtggttgccgcgatcaacgaattcggcaaattcgccaagaacgaaaaatatgtgagtggcggcgttgcggccgtagcctccaccgacttccgcgacagccccaagggcctcttcgacattccgccgaagtgctacctgcaccatcaggcatcgttcattccctccttcttccccgagggcaccaaggtcggaacggatgcggatttcttctacatgccgacctatgcctcaaagcctgacctcggcaagccggttctcggtgccggcacgctcgtcaccatcactaaggaagcgcccgctgccaaggcattcgtacaattcctgcagacgccgatcgcccatgaagtgtggatggcgcagtccagcttcctgacgccgtacaaagggtgtgaacgtcgaaacctatgccatgagcagatgaagcgtcagggtgaaatcctgaccacggcgacgaccttcggttttgacggttccgacctgatgcccggcaagatcggcgccggcgctttctggaccggcatgatcgatttcgtcggtggcaagtctgccgatcaggtcgccgccgatatccagaaggcctgggacggcctgaagtaa

SEQ ID NO: 2966 - DNA, 544 bp, Glycine max
  Peptide Sequence Number=SeqID_94651
gcatctcaccgaaacatgtatgcgagcggggaattctgatatctatggattcctcgagcctcagtccattcagaggtctgggcaatcacagtttgaatctgaaagttacataaagagttggatgcaaagttcacaacgcgatgtgtatcttagagcctacctaaatgggttccactgcagcggacattggcagatggtggtcatcctgcccaaggaacacttagttgtctggttttgttcattgcataacaggccagacaactaccttaaggggattattgatagtgctatcaagggtcttgatgatgctccacagcctaaatcaaaggctcctgctaggtggattgtcgtcaaggtacgtcatttacataaaacttacactagttgtttaattaatatctgtcggaacctacccttcggcgggagggcgacacgtgactcgcgggatgcgtgttccatgaaaggaatacgcgcagagtcgccaccaacgtttatttgggaaaacgtcggaaaaactggaaaagacgtgatctacgaactttaa

SEQ ID NO: 2967 - DNA, 357 bp, Glycine max
  Peptide Sequence Number=SeqID_94652
atgtcaggatttacacgcaattctcctcaaatttcagccagcccgcatcaattagaccttgcaccttacgcttcagagccctaccatgctcaatggaacgccccggggcttctccgtgacaagcacacgttgcgttcgagtcgtattctcggagaaatggaggttgatgaaccttggctaggatatgggatcaagtctggcataggacactggaattggggtgaattctacaggctttctcgctgcaaaattcacttcttggttgatgtttttggaattgcagtcacagcatgggtttctccctcatcctcaccctctttatttgccccagttttctcagtcgtcctagtaggatga

SEQ ID NO: 2968 - DNA, 376 bp, Glycine max
  Peptide Sequence Number=SeqID_94653
atggctccgaaaaagctttccacgaagaggtctaggagagacgtcgcggtggaagcgtccagtgtcgcccccaagtttgatagccaccgtttccggagcgccgagcaccaacagcgcttcgaggccatcaaaggatggttgttccatcgagagaggcgcgtccacctcagggaggatgagtatacagattttcaggaggagatagcttgcagacattggacgtcgctggtgactaccatggctaagtttgaccctaaagtagtcctggagttttatgctaatgcttggcccacagaggagggagtgcgagacatgtgttcatgggtgagggatcagtggattaaatttgacacagaagccctcagccagttcctag

SEQ ID NO: 2969 - DNA, 634 bp, Glycine max
  Peptide Sequence Number=SeqID_94654
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggattgcacctacgagacacctagtggacccgaagaaatccaacagggcactgggatttcctgctctgattacaggcctctgtcaattctatggagtgctgggccaggtgccacagtagccagcggaggaccagcagcaggcaactgcagatccattgtcaccaccacgatggtggccgacatctccagaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 2970 - DNA, 432 bp, Glycine max
  Peptide Sequence Number=SeqID_94655
atggctactctagctcagacatggagtgttctttccttctctaacctgattcctacctcccacacatctgatgtcactcttgacaaagccaaactcatttatggcatcattatgaagattgatatgaacctggggtacctcatctcccatcagatctccctcatagcacaacatgacacatctagactaggattccctaccttgagagtaacttttagaggacccaggaaggccaggggtaagagatctgaggccccttccacttcagcatcagaggcaccaacaccttcttcttctacagtaccttcctcttcatccactcagattccagttattcctccagtacctttacagaccccacttccagctcctctctctgcaggtccatcagattttatttttacaccacagatgctgcactccatgctctag

SEQ ID NO: 2971 - DNA, 255 bp, Glycine max
  Peptide Sequence Number=SeqID_94656
atgaaagcaaccattaggtccttccaagaatggactcgggaaggttccagattagtataccaggtgacggctgccccagaggtagtcttttcaccgcaaaatacaaggggtgtggttgtgggcgatactaaggaccccccaaagtgtttagcaggggtatgccaccaaatgcctacccctcagtggcatattcgaggcaaggctcagagtcggctagagtatggtctcggggtacttcatatgtctcccccatag

SEQ ID NO: 2972 - DNA, 228 bp, Glycine max
  Peptide Sequence Number=SeqID_94657
atggcggctaagcgagtcagtctcgctaagccaccatgcctctattgtttgaataagcttgggctaagcgagtcagtctcgctgagcccaaggcaatttagttgttctgaattttgttcatgcactgagcgagtcatgctcgctaagcgcaatttcttctattgtgtcgcgctaagcaagcctgtctcgctatgcgcaattagctctctattagagaataaggcttag

SEQ ID NO: 2973 - DNA, 342 bp, Glycine max
  Peptide Sequence Number=SeqID_94658
atggagtcaggtgacatgcggaggtaccgtatggtgacccgcacctttcgtcaaccaggggcaaaagagcctgttgacgcggaaagactaacatcgtcttctgcactttttggccatccagggacagcgagtcgggtggcaggtttttactctcatcgtctggagacattcaagcccgacgacacacgagattcttctctgctgggcggggacgataaagttcaatggcgtagggaagtgtcgtggttgtcccgctttatcgctttcgaagacactgaagtaatccgtgaagttccgcaacattctggaagtcgaaaggaagcattgttgcgtaatccgtaa

SEQ ID NO: 2974 - DNA, 111 bp, Glycine max
  Peptide Sequence Number=SeqID_94659
atgggggttgttctaaggagctcgaaggcccctggtgaggtttccgtaagcaaatccgtgaaggttttcctccgttattcatcattcttcgttttcttcagtcttcaacgg

SEQ ID NO: 2975 - DNA, 303 bp, Glycine max
  Peptide Sequence Number=SeqID_94660
atgcggcgacactcagtggttttccggtattgtcgcactttttatgaaggagaggatggtggcgttggagggggtgtacggtgcaggggagcggatcgggatgatgtcagattgggagtcacgagtgaggtcgacagagctaaagttgtctgtggcgcggccagtgatttgaaggagcatggagaggaattggaggaggacgtgataatgaaggatgtcgacaagggtattcaggaagaagtggttgccgacaatgaggtagatgatggggacgacgagaatggaaagggaggagtggtttga

SEQ ID NO: 2976 - DNA, 296 bp, Glycine max
  Peptide Sequence Number=SeqID_94661
atgggagatagcttagaggatatgattcatgatcttggacaagagttttttcagatcaagattaatttcaagcttcatgaaaagaagtcaagaagattcaagattcaagagaagtttgatttcaagattcaagagaagatgaattcaagattcaagagaagaaatcaagaagacttcacaagggaaggtacatctacttgggttgttgtaactgagaacaagagagggtacatctcttgtggatcagttcaagtggagggtacatccacttggttgttcaaagagaacaagggagg

SEQ ID NO: 2977 - DNA, 339 bp, Glycine max
  Peptide Sequence Number=SeqID_94662
ggtatatcctttgtggtacaagtagagggtacatctacttgggtctttgtgactgagaacaagagagggtacatctcttgtggatcagttcaagtggagggtacatccacttggttgttcaaagagaacaggggagggtacatcccttgcggacctttgcttgtaaaggatattacaaggttgaaaagaaatcttaaggactgcgggtcgcttggggactggatgtttgtcatcatcaaaaagggggagattgtagaagcaagcttcatgatgttgaatcaagttgattcaagtagttttgatgatgacaaagatgatgacaaaaagcccaaagaatga

SEQ ID NO: 2978 - DNA, 267 bp, Glycine max
  Peptide Sequence Number=SeqID_94663
atgaggtcctttaatggtgattttccaccatggagatgcagcggaagacaaaggagaagaggtgagaggaggcgccatccactagggaataagccatggaagaaggagcttcaccaccaagatgagccttggataagaagcttggaaggatgcttcaatggaggaaaagaaagagggagagaaagagagaggggggagcacgaaattgaaggaataaaagagggagagaagtggaactttgaagaattaatgaaacattgggcttaa

SEQ ID NO: 2979 - DNA, 232 bp, Glycine max
  Peptide Sequence Number=SeqID_94664
atgatgctagacatagttctcaatacaggcaatggtgcgcacaagatgcttagcaaccatgccaacttcagtgcagctcctttacgtgcattttcgggagggacttctcctagcctccatcgttcaaccaatgcagtgatcaatgcaagatcaattctacactgtttgattaggacaatatgttggaacccagtagatgataataatggtataatttatggttctggttcag

SEQ ID NO: 2980 - DNA, 269 bp, Glycine max
  Peptide Sequence Number=SeqID_94665
attcaagcttgtcggaaaccgacaacacaatagccgcgacacaatacgattacgcaacacataaggcacccgcgattgcgattttcacggaatccgcaacgcgatgccgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 2981 - DNA, 219 bp, Glycine max
  Peptide Sequence Number=SeqID_94666
atgcagggtgtgtcgcaacgtgcccttttgcgggcgagcgaaggcgaggctcacgggtgcgctttccaaaggaggaaagatgcgcggagtcgccaccaacttttatttgtggaaaacgtcgggaaaaccgaaggaaaccggaaggtattagcacctcttacgtttgtctcaaaggacaacaacctattttttagaattgtggaaattgtgttaccttaa

SEQ ID NO: 2982 - DNA, 483 bp, Glycine max
  Peptide Sequence Number=SeqID_94667
atcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgaactcaaatctgttaagtgcgactcccgggggcccggagacggtgtcccgcgggagtcgtcacgacacaacatttacatacaatgactctcggcaagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 2983 - DNA, 171 bp, Glycine max
  Peptide Sequence Number=SeqID_94668
atgctcctagcatgtggaggcaatgaaggtagccaagaaaacacatggtaccttgacattggtgtaagcaatcatatgtgtggaaaaagaagcacgttcatggatcttcatgaatcaaggcttaagtttgctatcaaaggagaggatggtgagaggactaccctctattaa

SEQ ID NO: 2984 - DNA, 180 bp, Glycine max
  Peptide Sequence Number=SeqID_94669
atgaagaaaaagtggaacaaaaagcaactacaggggaaatccaacaaagtgcaaacttgtattaaagagttggatggtgcaggagaaaattctgagggacatacttatgtattcttggaagacaatgattccaaaccagtgattattagcagctcgttgaagataacagaagaagattag

SEQ ID NO: 2985 - DNA, 234 bp, Glycine max
  Peptide Sequence Number=SeqID_94670
atgtgggcatgggaacgatgcatgactttggctccaaagaggacgtctctcgtcatagaaaataaaccactgggacacagctggctacgacgtggaaatcagcatattggcaatgatgatcttagacttttccgtcgaaaattggatctgatgaaacgacatgagtttgtctgggagccatacacaccaactatgatggcagcgttagggggtagggttgggttttatggttag

SEQ ID NO: 2986 - DNA, 522 bp, Glycine max
  Peptide Sequence Number=SeqID_94671
atgttatatttcaatggaagggtatatgaagataatgatggtgtaatatttgaaggcagtaaaaaagcgattcagattaaacgtggaattagtttcaatgctttgaaaataaaatttgagacaagatttttagtgtcagaaaaatatattgccttgcaaatttgcgatgacgaagacgttgaaacgatgctagaaagttttaaacaacaacaagaaatgtcagttctagaattgtacatagaaaaggatgtggcaggtggttcaatgtttcattatgcaaattcggttacatcatgtggaaattatttatctaatgatgacacacaaccgccaacaaatatgagcaatttacatcttgacgaagatgatgatgatgattatcttgtgtctaactcatacgttgaagagtctttagacgaagaagacagtgttgacggtatatttgatacagacaatgaagtcaccgaaatgatttcaccagtaagaattgttcacccaacagaaggtataatttcctcttaa

SEQ ID NO: 2987 - DNA, 851 bp, Glycine max
  Peptide Sequence Number=SeqID_94672
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataaatcgtgtctgagcaacgcgcgggtgaaattagcaagcgtaaaaggaaacgcaaaggagtttgtcttgagtgtttacggaaaccctactggatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 2988 - DNA, 627 bp, Glycine max
  Peptide Sequence Number=SeqID_94673
atggtatcaaaacgggtttttcaaaggaagcataaaaacatacaatggtggttccaaagtaagaaaagatgcaaagataagctgaatctaacaagaaacaagcgtagaatcatggttacctcaaagaagaccatgaaggtcagattgggcttcgttctctatcgaaaccgcgagacaagtttagaagattctgctccgattgaagggttcctctcggtgtggggtttcaacggagaacaacagcggtccgtggtggccaccggtggttgtgggtgttggagaagaagcttgggatgttggggaagggttttggaagaaagaaggagaaaggaatggctattttccaaggttacacgaaaaataagacttgaaacactcaagtgtttctgctctcgggaaaagaagagtttctcacacaccagaagacatatcacagatcacaatggtcaattcatggacatttgtcctatgaacctacagaccaaatttagaaaagatccaacagttaacgaatgcaggagggcgcttttaccgagatggcttcaggcatcttccttgagaagctttctcgtgaggcttctttgtgaagcttccttgagaggcttctttgagaagctaaagtcttaa

SEQ ID NO: 2989 - DNA, 827 bp, Glycine max
  Peptide Sequence Number=SeqID_94674
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatctcaccagaagttcgattcaagatgcaaaatgattcacaagatcctgtagatgttgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 2990 - DNA, 1085 bp, Glycine max
  Peptide Sequence Number=SeqID_94675
atggtgaaagttggaacctcttacgtgccgatcaacgtctcattttcgccaaaagttggcccagggcttcccggtatcaacagggacaccaggatttatttattctgcgaagtgatcttccgtcacaggtgctcccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatatcgaaacatttggaaatgtccgcgttcaaaacatacttgggcttagctcgaatagcgttgaatatggctttatcagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctctgttcctgcctttcggtttaccggtgtcattccgctgtatggccgcgtttgtctcattccacgcctgacactcagttccgg

SEQ ID NO: 2991 - DNA, 446 bp, Glycine max
  Peptide Sequence Number=SeqID_94676
cttgggaggattgatggggacccggtgttgagagaaacgaggatatgggctacgtgggagtacgtgagctcagttggaggtgggcaacaggggatggagaccttggggacgtcaggtggggtgccattgcccaaaaccaagcttgaccaatcccgacccaactcgggcatagtcagtcactgtgaatcttgtgtgatatatgagttatggcctctggtaatcgattaccaagggtgggtaatcgattaccaagggtgggtaatcgattaccaagggcttgaaaacgaggtcaggaagctaggagagcttctggtaatcgattaccaagggaggaatgggtcactggtaatcgattaccagatcgtgatggcggcgcagctaatccatgatcgagtagagatggagtgcctagaggaagcttgggagaccctcgaaggcaacacgag

SEQ ID NO: 2992 - DNA, 372 bp, Glycine max
  Peptide Sequence Number=SeqID_94677
atggccccgaggaagcttgcctcaaagaggtccaggaaggataaggcggccgaaggaactagttccgctcctgagtatgacagtcaccactttaggagcgccgtacaccagcagcgcttcgaggccatcaagggatgggacgacgagtatgcggatttccaagaggagataggttgccggcggtgggcatcactagttacccccatggccaagttcgatccagaaatagtcctcgaattttattccaatgcttggccaacaaaggagggtgtgcgcgacatgaggtcctgggtaaggggtcagtggatcccgtttgatgccgatgctatcggccagctcctgggatatccgttggtgctggaagagggctag

SEQ ID NO: 2993 - DNA, 231 bp, Glycine max
  Peptide Sequence Number=SeqID_94678
atggcagcggaatggagaaggaagagagagaggagacgccacttcaaggaaaagatgagtctagaagaagctcaccatcataggaggccatggataagagcttggaggaagaagaagatgaatgaagggagaggaagagaagagcatgaaattttatgctctaaaagagctctgaaatctgatcccataaattcaagatcaagtccaagattctccactaagtgtgcttag

SEQ ID NO: 2994 - DNA, 570 bp, Glycine max
  Peptide Sequence Number=SeqID_94679
atggcgaatcaagaggagtgggtcccatttgtggacgtattagcattactaatctttggtgttgtcctctttccaaacgtggacggtttggtggacctagtcgcgattgatgctttccttgcatatcaccatagcaaagagagcccggtggtagctatcttggcagacttatttgatacatttgaccgaagagtagattgggaccaacacttggctgggataggaggcaaaacaatcaactggtttcctcgatggaaggaaggaaaggagggagttctcttctcatgtggggactacccaaacatcccgggggcaccagcggaagagagcctctctcctttccttgtgagagatttcggcgcacaaagtttcaagattgtacaaagagtccacaaggcgttggaaagcccgttaagaaaagataaagaacttaggggcatccgtaatggcatcatcggtggttatcatgaatggctaaaagttcgtacacaagggttagattggctctccaagttgaaaattatcaacgaggagaacttcgacgctccggaagaggatgaagaagtctga

SEQ ID NO: 2995 - DNA, 875 bp, Glycine max
  Peptide Sequence Number=SeqID_94680
gcgacggccgtcgtccccgagggccggatctcaccgcgcgacgtcgggctctggaacgacgcacagcgcgatgctctggccccgatcgtcgaggcgatccacgaccgcggtgcgcacgccggcatccagctcgcgcacgccgggcggaaggcgtccacctggtggccgtgggcacccgagcggggctccgtgcccaccgccgacggcggatggacgacgaccgcaccatcggcggtcgccttcgacggcttcgatgaaccggtcgccctcgacctcgcggggatcgaccgcgtcgtcgaggcgttcgcctcctcgacacgacgggccgtcgatgccgggttcgacgtcgtggagatccacggggcgcacgggtatctcctccatcagttcctctcgcccctgtcgaacagacgcgacgacgagtacggcggctcgctggagaaccgagcgcgactactgctgcgtgtcgtggatgccgttcgcgagagcgcaggcgacgaggtaccggtgttcgtgcgcatctccgcgaccgaccacgcagacggcggcttcaccgccgacgaggctgccgtcgtcggcgcctgggcgacgcagcacggcgccgatctcatcgacgtctccagtggcggtctggtcgcccaccagcggatcagtgtgttcccgggctaccaggtcccgctcgccgagacggtgcgccagggtggccgcatcccggtgtcggccgtgggcctcatcacggcagccacccaggccgagcaggtcctcgtcgacggcgcagccgatgcgatcttcgccggccgcgagtggctccgcgatccgcatttcgctctccgggccgcgcatgagctgggcgctgacgtcgcgtgggcgccgca

SEQ ID NO: 2996 - DNA, 909 bp, Glycine max
  Peptide Sequence Number=SeqID_94681
atgtccgtacctcatttcaagtgctgccgccaaagcagacaggccgccagacagcacgccggagtcgccgaggatgaagaaactgccgacgctgacggccagcagcgtccagcccggcccccagttcgccgaccaccccatcagcagcgatcccaacgcgccggcggcgcccataaacatcagcaccgatgcacggttgaaatagtcggaaacggtgccgacaatcagcgtggcaaccatgccggccaggtggatcaccgccgcgacgatcaatccggcgctgagaggatccagagagaaaccgctcaacgcctcgctgaccaggctgggcgcccaggcccagttaccgagcagttcccagctgtgggcgatatacccgaccagcaacagcagggtcgcataggtgatagcatagctttcacgtttcgtctgcctccccagcgtacgcggctgcggctcccgataaccgaccagggccaacgaaccggccagcgcccccagcaacgcaccggcggcacacagggaaaacgccacgccggccccccagcacatggcgctccaaccggcgatgaaaaccgacagaaaataccccagcgaactggccgccagcatcatgccgatggcgtaaccgcgccgcgccgggccgttcatccccatcgccagcagcagcgccggcgtataggcgccgccctgcgtcaggccgacgaaggccatcaacaccagcgcgccggcataagaatgggcaaacacggcgaacagcatcagcgcagcggcgcccagccaggaaaacagcaggtaaacccggcgcgccccccatcgaatcacaccaccaggaaatccaccagcagcgccagtgcgttagtccaggctaaacaccgtttgcatcgtgccggcggaggcggcgtctag

SEQ ID NO: 2997 - DNA, 1263 bp, Glycine max
  Peptide Sequence Number=SeqID_94682
atgagtagagtcagagaagataaaaatttgatcgtggggctggatattggcacctccaaaattgtggcgattgcggcagaaattttgccggaaggcacattgaaggtgattggtgtcgggcaacacgcttcccgtggcttgaaaaaaggcgtggtggtcaacattgattccaccatgcaggccatccagcgcgcaattgaagaggtcgagctgatggcggactgcaagatcaacactgtgtattcaggcattgccggcagccacatcaaaagcctcaactcgcatggcatggtgaagatcaaggagagcgaagtctcacagatggacatagaccgcgtggtggaaacggctcgtgcgattgccttgccagccgaccaacagatcctgcatatcctgacccaggaatttattatcgacggccaggaagatgtacgcgagccactcggtatgagtggtatccgcctggaagtgcgcgtgcacatcgtcacaggtgcgattgcagcagcacagaacatcgtcaagtgcatcaagcgttgcggtctcgaagtgagtgacctcattttgcaacccttggcttcgagtgagtctgtgctcaccgatgatgaaaaagagctgggtgtctgtctggtagacatcggtggcggtacgactgacctggcggtgttcaagaatggtgccattcgccataccgctgtgatcccgattgcgggtgaccagattactaacgacatcgcggtagccttgcgtacaccaacgcagtcggctgaagaaattaaggttaaacatggttgcgccttacggcaattggccgacccgcgtgaagtggtggaagtgcctgctgtggatggccgcgagccacgtcagttgtcctgccaggccctgactgaggtgattgaagaccgcgtcgaggaaatttacgagtttgtgcagcaagagctgcgccgcagtggcatggagtccatgatcgcctccggcattgtgattaccggcggtgcggcgcagatgcgcggcatggttgagttgggtgaagagattttccacaccccggtccgcctgggtgtgcccaggggtgtggaagggttatccgaagtggtgggtaatccgcgttatgccaccggcataggcttgttgctgatggccaagcagcaggtagaaaaacaaatggtgggtaacttgcaatctgggtcagtaggcaggttgctggaacggatgaaaagctggtttacagggcgagtgtgcggggcaaaccaatcactcaaataa

SEQ ID NO: 2998 - DNA, 583 bp, Glycine max
  Peptide Sequence Number=SeqID_94683
atgactgcgcctgatgtctatgtactcgagctttccagtttccagctggagacgacctatagcctacaggcagacgcagccactatcctgaacctgtctgaagatcatatggaccggtacgatggcatggaggattatgcgcatgccaaagcccgtatttaccagcaggcccgcattgcagtggtgaatcgcgatgacgcgcctagtgctgcactcgctggccagttgccacaggtatcgtttggcgtgaatccttccccgaccatcaacgattacggtctgaatgatgcgggttggttatgcgcaggtaaccggcactatattgaagcagacagtttgcagattcgaggcaaacacaatatcgccaacgcactggcggcgattgccctgacccagtctattgggatagacaaagtctctatcctgcataccgtgcagtcctttagtgggttgccgcaccgcgtagagtgggtagcaaatattgatgacgttgacttctacgacgactctaaagggaccaatgtcggcgcgacttgcgcggccatcagtggcatgctcaaacagggggaaaccacaaaaagtg

SEQ ID NO: 2999 - DNA, 1111 bp, Glycine max
  Peptide Sequence Number=SeqID_94684
atggatctcgcgtcgctacgcgctcaacaaatcgaactggcttcatcagtgatccgtgaggatcggctggataaggatcctcctcagtacattggcggagccgacgttgggttcgagaagggcggtgaagtgacgcgagcggcgatggtggtcctgaaatacccttcgcttgagctggtggaatacaaggtggcgcgtatcgccaccaccatgccctacattcccggctttctctcctttcgcgaatatcccgcgctgctggccgcgtgggagcaactttcgcaaaaacccgacctgctgtttgtcgatggacacggtatctcacacccgcgccgtttaggcgttgccagccactttgggctgctggtggatatgccgaccattggcgtcgccaagaaacgtctctgcggggcgtttgaaccactttccgctgagccgggtgcgctggcgccgcttatccataagggcgagcagctggcgtggcgctgcatgaagggttaccgcttaccggagcagacgcgctgggcggacgcggtggcttcttcgcgtccggcttttgttcgttggcaggaaattcagccgatgattcagcacgtcacctttatggcttgcctgtgcgagcgcatgtatcccaactatgccgcgttctgtaagcagacgggctttggtgatggtcatatctaccgccgcattctggatttgatctgggaaacgctgacggtcaaagacgcaaaggtgaatttcgactcccaactggaaaagctggaagaggcgatcccggccgcggatgattttgatctgtacggtgtctatccggccattgatgcctgcgtggcattaagtgagctgatccactcccgtctgagtggcgaaaccctggagcatgctatcgaagtcagtaaggcatccattacgaccgttgcgatgctcgaaatgacccaggaaggccgtgaaatgaccgacgaagagctgcgagctaacccggcggttgagcaggaatgggatatccagtgggaaattttccgcctgctggcagagtgtgaagaacgtgacattgagctgatcaaagggctgcgtgcggacttacgtgagtcgggcgagagcaatattg

SEQ ID NO: 3000 - DNA, 195 bp, Glycine max
  Peptide Sequence Number=SeqID_94685
atgaagaaacaacaatggaagagaagcagaagacaaaggagaagaggtgagaggaggcgccatccactagggaataagccatggaagaaggagcttcaccaccaagatgagccttggataagaagcttggagaggatgcttcaatggaggaaaagaaagagggagagaaagagtggaagaaataagtcaagatga

SEQ ID NO: 3001 - DNA, 204 bp, Glycine max
  Peptide Sequence Number=SeqID_94686
atggtggtcccgtgttccgtatttgaagttttgttagtggctgttcttcctatttcgtcggaggcacagcaggaggaaggtccggaaagaccacttccggaagttactaaggcctattccggaagaagtgcttccggaagaccttcttccggaaagggtcttagtaacttccggaagaacttcttccggaatgtaaaaatataa

SEQ ID NO: 3002 - DNA, 1275 bp, Glycine max
  Peptide Sequence Number=SeqID_94687
atgggtgacgtagaggaagcgccagaacagatgaaagctagcatgtcggctctgaaagatcaaatggcctccatgatggaggccatgctaggtatgaagagattaatagagagtaatgcggccacagctaccgctgccagcaccgctgctgaagcagacccagtccttccatctacagcaaatctagcacatcaactcaccctggatatggtgggacaaggaagagacacgttggggaatagcagtagccctcttttggggtacaaccgaaggaaacctccccagcctgtagggggcgcccatgaagagcctcgggagcatgcccaaggggacgtcgactcatacccccctgttcccattgagggaccggcacccaatgccttgcctcagcctaatattgcgggagtctttcaaccccgtccgatgcaaccactactcttctctgtaggggggccgcctccaacagtggaaggaagagaaaagctcgatctcatcgaagaaagattgagagctgttgaagggttcggtgattacctctttgctgatatgacggacttgtgcttggtacctcgccctacccataatgccaatcctagcatgaaccctaacatgggaagaaatcctccggtaaagaaatcctccgcaattttccccaatctcaatgacatatggagacctattgccttcactgatcgccaaccaattggtagtgggcatttggttgaacaatgcatgaccctcaagcacaaggtccagagcttgattgaggcgggatggttgacgttccaagaagatgggccaaatatgaagacgaatccgctcgctaaccatgaagtaggtgtggttcctctcggtgggcacaacagggatccttgcttgatgcatccagaccaaggccgacatgagatcggcaacgaggacgagaaagagatacatgtctacatgcacaaggcggtcccgtggaggtacgctcctcagaagccgagcgagaggaaggagaaggccaccgacactgactcactttccaccaaagtgaccaatattaccatgctaagtggcgtgaccagtagcggctgcatctttgcagcgcctgacctaccggccaacgaagcaaaccccaccccagatgaggatgttccagtagggaggttcattgaaaaaggggaaggcctcggcagaaaggaggtatccttggaggaggccaacgagttcctccgtataatccaacagagtgaattcaagataatcgagcaactcaacaaaactctggctagg

SEQ ID NO: 3003 - DNA, 252 bp, Glycine max
  Peptide Sequence Number=SeqID_94688
atggagacatacccattcctagaccagaagcaaaatggacacacgaataagtacaacaagatctgtaaagatcatctaccaaagaaagattttgttgccctcaagtctagagaaactagttctataagagaagaaaagaagagttcatctaaagctcttaaagtgcagatggctaactctgatggtttagacaatagttctggagattccacagatgatgaagtggctctcatgtttagaaagttcaagtag

SEQ ID NO: 3004 - DNA, 495 bp, Glycine max
  Peptide Sequence Number=SeqID_94689
atgaaacaggccaatgtaacccaattgaagaaaacacttaagaaattcattatatgggaaatcaacagcagcaagggtatacttcaagaggattttcaggtttccagcaaggtccttatagtcaacaaggataatggaggtcacaccctagcaatcagttcaacaaagatcaaggtgggacaactggccaagcagataactgacaagttatccaacagttttgtggcaaatacagagaagaatcccaaggaggaatgcaaagctgtgatgacaagaagtaaaaggtttgtggagaatgaggaagagaagagtgttggactcaagaaaaaagttgttgaagagaaaggtattgatggaaggaaaaatgatgtgagaggtgaaaataatcaggaaaaagagaaacaaataatggtcaataaaaaagaattgaatgaccagaaaaagaaaagagtagaaaagaaaagaaataaaaaagttgaaaagatgaaaaaatga

SEQ ID NO: 3005 - DNA, 369 bp, Glycine max
  Peptide Sequence Number=SeqID_94690
atgcttcatagcattcatcaaggacatattattccattacagagtttacaggtggtggagcctccaggatttatcccctcagtcgaacagttcagagagatggtagcctggcctgggactcagccttctcttcatagggaagatgaaggtcccactgctaaggtaccaacgcatatggaggatgagtcctttgaggccaccattccagagccatttactgcaggggaggaggcaggtgacacacagatgacacaggtagctgctgccactcttgagagatctcttgaggccacttcagagcctcccgcatcagcagtggacctaccttcacctcagcatgcaacagacccttctactcctgtcctatag

SEQ ID NO: 3006 - DNA, 555 bp, Glycine max
  Peptide Sequence Number=SeqID_94691
atgagtgaaatttggaccaaggtaatttggacttggtatgggaaagctcgaggtgtagacagaaaaagtgggcacccaatcatgtccattcttaactgcttcaaggaaggaggtgttcccgaagttatctttcatcataatttgtcttgttgggcttggtggtggcctgtgcaaacccacaccgatcgtggtcgtggtggaggcggtggctctggtggtggtggtgggagtaacgatggtggatacaatgtgactgagcacgttaaggagaagatgggtaccacgatgggtgttgttgccgctctcgagaggtatggtagagtgatgtggtgctacaagcttccgtgtagtgtctccgctgctgtggcggaggcagcggcagatgcaatgaaagcaccaattgttatggatgctgaagttcctggagttctagagaaagctagcaataacaaaattgcgacaaatatcctaacagaaaaagcatattcccaacagaatcatccaagggcccaatccaacaatatcagctcagcaattctgctcctattctgttag

SEQ ID NO: 3007 - DNA, 747 bp, Glycine max
  Peptide Sequence Number=SeqID_94692
atggatatactagaatatgtgtgggaacaaacatggcaatggatgacagatgatattgtatttaatcttagaagacaaggtggagtttattttctctatggttatggtggcactaggaagacatttatctggaaaactttatcatctactatacgatctaatggaggaattgttttaacagtagcttcaagtgggattgcatcattattgcttcccggaggaagaacaacacattctaagtttgctataccagtccctgcaacacaaaattcaacatgcaatatgcatcaagggagtgacctggctgaattgctaaaaattaccaaactaataatttgggatgaagctccaatgtgtcataagttcatttttcaagcacttgataaaagcttaaaagacatcatgcacaatgatagaccttttggaggaaaggtcattgttttttgtggtgatttctctcaaatactaccagttgtaccaagaggtaatcgttttgatatcatccatgcaagtctaaatgcatcatacatatgggatcattgtcaaattcttaaattgacaaagaaattgcatttgcaaaccaatgttgtcgatagcagcaatcatgacctcaaacaattttttgattggctactagacataggcgatggcaaacttagagaacctaatgatggttatgttgaaatcagtattcctaatgagtttcttatcaagcactttaatgatcctacccaggcaattgtttag

SEQ ID NO: 3008 - DNA, 957 bp, Glycine max
  Peptide Sequence Number=SeqID_94693
atgtacgctttgttgctgcgcttccttcttcctccttcattgtttgttctcaccgtgcccccaccattgtctgcctccgttcgcaccctcccgctagtccccgccactgccgtcgcgttcaccatcgccattatggtcagaatcagaggattgagtcagactttaggcagggttataggaagagccttagggagagaagttagtggtgacgcggatgaagcccctcaggggcgaaggatgacaacatttgcacctaagaaacgggaagttgtacctattgttgaggatgttgagcatgtggatcatgccactaacaaggtccatgaacaacatgaagaggcagttgctaatgatgtagttgttgatgccctgggttgtgcaagcgaaccccatgatacatcaattttgatggactatgttcatcatgtgatcgtgacaatttggaatggagagtggattgtagcagctccaacatatagtttgcatctggtaggttgcatactatttgctaacaagagtgccacacacgtgcctgtgatattcttggatgcatttcatgacctcagccaaactggaagctatgcatggggagctattgcactggtcgatatgtatgagaatttgaatgatgtgtcaatgagaagcgctaggaaacttgtaggatatatcacgcttttacaatgttggatctacgagcattttcctattgttgcttcttctattgctgctgaagattatcatgagaggaaaccacatgcttgtcgttggaagtttgggaagtcattactagtgttgacgtatcacatatcagatgaggtccatctattttcatataccgaccgaagagggttgtgcgacagtttggtgggtcagatatgtgttgcacctggacaatgtgcagcagactacatggagtggttctatatgatatctcatcctttgatgagtccaacatag

SEQ ID NO: 3009 - DNA, 450 bp, Glycine max
  Peptide Sequence Number=SeqID_94694
atgcatgcaaacggtgggcttagcaggatgagtgcttgcttagtgcatgcgtccagctcatcattcttccagattcttccttgcactcagccgcaagagtgtgcttcttgtatgcgaggtaatcctttagtagggaatttagttccattagatttggaaataaaagctacttgcaggagaaacaacgcagagagaaggagaaaaaaaattttggaaaggacagcacagccaagtttggaggaaactcaatcatctaaatcgtcttcaacatttccagatttcagggaatccaaagtaggtgcgtctgaagcacatattgatgtaagctccattggagcttgtaggcctaggatcttcttcatcaatggattcctttacttcttggaagatgaatggcagcggaatggagaaggaagagagagaggagacgccacttcaaggagaagatga

SEQ ID NO: 3010 - DNA, 661 bp, Glycine max
  Peptide Sequence Number=SeqID_94695
acatctaaagaagcatgggatgggatatgttgatcatgaatgggttatagctggagagccaccagtagcagaaaacatcaataagatggaagatcaggtggaagaagaagcacaacaagagcttgctcaacaatggaacccttttgagtctcttatgaatcagaagttggatgttatccttcatctccatcaagagcaccaagtcgaagttcacatctccttagaaaacattacaactagacttgagaacatagaaactaggctatcccttagtaaccttctgaaaccacatgaggatgaagcggaaacatcccttagcaccgccatacctcttgagcttgaggttattcctcaagtaaaggagttgttggatgagggtttggttcgcaagagcttaaatccttgttctttgttggtgcctaaaataggtattattaggcaccaaatccctatgataggtggtattatgaatgtgttgaatggtgcaacactcttttgtaaaatcactcatgcacccaacaccttcatgatttgtgtacatagggactcattaggtgttgaggaaagaatccatgagtttcaagaacctctggatttgaggtcaaatccttttcaagggggaggaaatgatgcaatcctaccccccaagggcaatggatag

SEQ ID NO: 3011 - DNA, 192 bp, Glycine max
  Peptide Sequence Number=SeqID_94696
atgactctctatatcagcttagcctcagcttgtagagccaggtttagggcagaggtcgcatggcacggagattggcctgaggcccaggctgcagaggcacccgcagagactcccgacgagccagatggggcccgcgaggatgaggagatgtcagatttgctcggcttcttgggagggagtggagccacatga

SEQ ID NO: 3012 - DNA, 365 bp, Glycine max
  Peptide Sequence Number=SeqID_94697
tgggacctccaataaatctgagaattataaggaggaagcatagtaagaaaacacagaagcataaaccaaagagggtggagagtgtcaacgctgatgcagaagcctttggtgatgactggaaaaattctgattgctctatgcattgtgaagctgaagcagtagaacatacgaacaaaaagagatacaggccatcaaaatgtggcatttggacaatgggagattcagctaaagttgtgatcaaacaagacatgaagggaagaaggcataaatatgggtttaacaacaatgaacgtgagaaggcacagaagaaaagggtggtggatgatgaaactgccgacaaacatcagctggatgaagtcctatga

SEQ ID NO: 3013 - DNA, 282 bp, Glycine max
  Peptide Sequence Number=SeqID_94698
atgacaattgaagagtctatacatgtttcctttgatgagtctaatgccattcttccaaggaaggattttttagatgatatttcagattccttagaagatacacatattcatggaaatgaatctaaagaaaaagatgaaggaagcaatgaggattctcaagataatggagctagaagaaataatgaacttccaagagaatggaaagcctcaagagatcatcccctcgacaacattattggtgatatatcaaaagggaaaaacctgaaaattatcctgtcatag

SEQ ID NO: 3014 - DNA, 507 bp, Glycine max
  Peptide Sequence Number=SeqID_94699
atgacggaagggtgtggtgaagggttttgccttgcaaaccttcccggtgatgcttttagtctatggggaacttctttgaggcaaaaaacaatgatggctgatgccaagtctggcaagccgtggttgaaatttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctg

SEQ ID NO: 3015 - DNA, 333 bp, Glycine max
  Peptide Sequence Number=SeqID_94700
atggaggtgggcaacaggggatggtgggtttatgcgcgctttgtggatgtggaaaacttgttgtgcaccatcgcccgaccgccacctagtaccacatgtgatggggtgaaacttcctgcttttattgttgaccacagagtggtacctggagatatgtcacgggggtcaggagaccttggggacgtcaggcgagctcctggcagtcaacagataaaaggaacaaagaccacaaagcaaggaggcttgtggtggctggccaactgtgaattttgtgtgatatgtgattatggcctctggcttgaaaacgaagtcaggaaactaagggagcctctg

SEQ ID NO: 3016 - DNA, 1266 bp, Glycine max
  Peptide Sequence Number=SeqID_94701
caccgtgctggatttcggcctggcctcgcccaccagcgcactgttcgacctcgccaccgcgatcgagcgcaacgcggtggcgtggctggagctggagcgcggcatggaggcggtgcgcatcgatatcgcgctggccctgctcgacggctaccgccaggtactgccgctgtcggcggcacgcgtgcacctgctggccgacctgctgccgatggtccatttcgacttcgcactgtccgaagtggagtacttcgaaggtgtcaccggctcgaccgcgaatgccgacgtggcgtggcagcccttcatgctggggcacccggcgtggttccacagcgcgccgggacaggcactgctgcaggccctgcacgcggcagcctgaagggcgccggctcgcaaatccgtaccatttggagctttgagccgcagccacacccccgtcatgggccggtgcacctgcgcgccgtcgcttcgtctcccttgttgtccgaagacgaatcgaatgaaccgctgccttcgccccaccctgctctccctcgccctctgcgccgcgctgccgctgcacgccagcgaggccgaggccccaccgatgcggccgccatcggcgccgaacgctcaccgaccgaactggcagcggtgcgcgtgcaggccggcaaaccgaaggccgatacctcgcgcgtgaacgccttcggtggcggttcgtggaaggacacgccggcttcggtgaacgtgctcgagagcgactatctcgaccgccgccagctacgttcgctgtccgagctggccagcaatgatgcctcgctgggtgatgcctacgcgccggtgggctactaccagaacgtcgccatccgcggcttcgccctggacgccgccaccggctaccgcttcaatgggctgtccatcgccggcgagcaacgcctggcgctggagaacgtgcagtcggtggagatcctcaagggtgaagccggcctggcggcaggcgtgatggcgccgggcggaatcatcaactacatcggcaagcgcccggccgaagtgcgcaccgccacgctcggtaccgattcggaaggctcgcgctacgtcgccgtcgatgtcggccactggatcaccccgcgcttcggcctgcgcctgaatgccgcatgggattccagcaattcctacgtcgagcacgccgatggccgccgcaacttctactcgctggccgccgactggctgatcggcgaacgcggcaagctggaagtggatgccaactaccagaccagctcgcagcgctcg

SEQ ID NO: 3017 - DNA, 63 bp, Glycine max
  Peptide Sequence Number=SeqID_94702
atgggtcgtaggcaacgcactaaactttctgtggatgagctgagggctttggaggtggcggcg

SEQ ID NO: 3018 - DNA, 1953 bp, Glycine max
  Peptide Sequence Number=SeqID_94703
ctctacttcccggtgttcctgctgggggcggtgttcggcaagctgatcgagctgtccggcttctcccgttcgatcgtcgcggcggcgatccgcattctcggccggcgtcacgccattccggtgatcgtgctggtgtgcgcgctgctgacctacggcggggtgtcgctgttcgtggtggcgttcgcggtctatccgttcgccgccgagctgttccgccagagcggtatccccaagcggctgatcccggccaccgtggcgctcggcgctttctccttcaccatggacgccctgccgggcacgccgcagatccaaaacatcatcccgaccagcttcttcggcaccaatgcctgggccgcgccctggctggggctgatcggctcgctgttcatcatcgcggtcggtctgctgtatcttgaacgccagcggcgcaaggcgcagctgaagggagaagggtacggcaccgatctgctgaacgagccggaaaccccggacgacatcaacctgccgaacccgctgatcgccatcctgccgctgattttggtcggggtattcaaccttggcttcacccattggatcccgcaggggtacggccccagccacaagctgacgctgccggggctggccaagccaatcgccaccgacgtggcaaaaatcaccgccatctgggcggtggaagcggcgctggtgtcgggtattctgctggtgggggtgttcggttttcgcaatattcgtggccggttggcggaaggcagcaagacggcggtcggcggggcgattctggcggcaatgaacaccgcctccaaatacggcttcggcgcggtgatcgccgcgctgccgggttttttggtgctgtcgcaggcgctgtcggcaatccccaatccgctgctgaacaaagcgatcagcgtcaccctgctggccggcatcaccggatcggcctccggcggcatgagcatcgcgctggcggcgatggccgataatttcgtggccgccgcccacgccgcgcatatcccgctggaagtgctgcaccgcgtggcctcgatggccagcggcggcatggacaccttgccgcacaacggcgcggtgatcaccctactggcgatcaccggcctcagccaccggcaggcctatggcggcatcttcgccatcaccctgatcaagagcgccgcggtgctgagcgataccatgagtgtacaaggcaaaaccgcgctggtgaccggctcgaccagcggcatcggcctcgggatagcgtccgtgttggccgccgccggcgcgcgcgtgatcctcaacggcttctgcgacttggcgcatgcgcaagcgcaggtcgcgcagctgggcgccgcgccgggctatcacggcgccgatctcggcgatgcggcccacatagcggacatgatgcagtatgccgaaagcgagttcggcggcgtggacattctggtgaacaacgccggcattcagcacgtggcgccgctggatcagttcccggtggagaaatggaacgccatcctcgccatcaacctgtcggcggtgttccacacctgccgattggcgctgccggggatgcgcgagcgcaactgggggcgcatcatcaacgtggcgtcggtgcacgggctggtggcgtcgaaagacaagtcggcctatgtggcggccaagcacggcgtggtggggctgaccaagacgctggcgctggagaccgcgcgcacgcccgtcacctgcaacgccatttgccccggctgggtgctgacgccgctggtgcaacagcagatcgacaagcgcattgccgccggcaccgatccacagcgggcgcgcgatgagctgttggcggagaagcagccgtcgcaagagttcgtcacgccagagcagctcggcgagctggcgctgttcctgtgcagcgatgcggcggcgcaggtgcgcggcgccgcctggaacatggacggcggctggctggcgcagtag

SEQ ID NO: 3019 - DNA, 203 bp, Glycine max
  Peptide Sequence Number=SeqID_94704
atggttcaactgatttctgataccatctattgtttgcaggaatcgcacccacaaagacacctagtggacccggagaagtccaacagggccctggggtttccagctctgggtgcccgttccccccggcaaggtcacgtcatcatagggatcgcgcctgcaagacacccagtggacccaaagaagtccaacagggccttggagtt

SEQ ID NO: 3020 - DNA, 129 bp, Glycine max
  Peptide Sequence Number=SeqID_94705
atgcgagcattcgctaagcgcaacactcatgggctaagagcgaggaagactctaaaagaagatgagctatacaggttcactaagcgcaccgcttcagttaatccgctaagcgagaaaggcatgcgctaa

SEQ ID NO: 3021 - DNA, 186 bp, Glycine max
  Peptide Sequence Number=SeqID_94706
atggacgcaccgccatcacctctagagttcacctcagctcatccacaaaaaggtagaaagataccttggatatgcatgtatgtagcaaaatacttcacaagaatgtatgtatgtttaggtagcaaaatacctcatgggaaaaaagagagcgagcaagaaaagaataagaaggaagaaaaaaaatag

SEQ ID NO: 3022 - DNA, 174 bp, Glycine max
  Peptide Sequence Number=SeqID_94707
atgggtgccaagtacctcgaagtggtcaaacaaggatcgcatcccaacaacggatggtccccggacgaaaatagggcgcataatatatcgagatgctcgaaactaaacatggaagcacaaggcaaattcaaacagccacaacttttgactcggatgtccgatttagaccaataa

SEQ ID NO: 3023 - DNA, 714 bp, Glycine max
  Peptide Sequence Number=SeqID_94708
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcctcaccttcagagggctacatgtcctcatctttagaggactacacgttctcgcctttagagggctacacaccctcgccttcagaggactacacgtcctttccttcagagggctacacgccctcaccttcagaggactacatgtcctcgccttcaaagggctacacgtcctcgcctttggagggctgcacgtcctcgcttttatagggctctacatctgcacctttagagaactcaatcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 3024 - DNA, 648 bp, Glycine max
  Peptide Sequence Number=SeqID_94709
atggctccacctaaagaaattgtgatcgtcatttaccacaatggtcacattgcagacgacccagttcagggatcggtgtacacatgtgcgaacccaatatttatttacgtcagtcgttctattacgttaacacaattgattcagaaaattaacaatcgtctccctactcgagcaactgcaaaagttgctcaattgttattttgtggccctatttcatttcatcagggtcaaacacgttatatttcatcacaactactcgacaatgacgatctcggaggcgcgatggaaataattctccaaaatccacaattaaattctgccgaattctatgttgttactgaccttattcctcaaccacaaccatcatctccacaaccgtcatgtccacaactacaactacctcctccacaacaattaacatacaacaacctgaacctcaatgatccaatgtcttcatacaacaaccttgaaacacaagacacctcctttgaccaacaaaaccatccttcatccccctttaggtcaccctcacaacaaccacaaacacaaacatcaaaccgaaatgaatatctcatcgctaacgaagatcccattatacgatctcataaggaaaacatggatgattttagtgaggataaggatcaatag

SEQ ID NO: 3025 - DNA, 288 bp, Glycine max
  Peptide Sequence Number=SeqID_94710
atgtacaaagataattggacccaaccttggcccatgggctcagaaatctaccctaaggttcatgagaaccctaaggccttcttcagcagctctagcccaatcttcttggagcctcttgctcatggttctagtgattggtcccttcctagggaggattgcatcaggttccgtaacattacggaaggaaaacaagaagttcctccagaaggcggtgccttcgggaggaagcaacctagctcgcctgggcgagctgggtggcaagcttctccctcttttccctataaatag

SEQ ID NO: 3026 - DNA, 78 bp, Glycine max
  Peptide Sequence Number=SeqID_94711
atggagaaggaagagagagaggagatgccacttcaagtagaagatgagtctagaagctacactgaggagctacactaa

SEQ ID NO: 3027 - DNA, 834 bp, Glycine max
  Peptide Sequence Number=SeqID_94712
atggctacctcaccaaaagaaacttccgcttctggttcacccgctgtaccatcatctccgcaccaggaacaaccggaattcaacattcaacccatacaaataattcctggtcaagcttcagtccctgagaaactgattcccagaagacaacagggggtgaagattgctgaaaaccctagccctgcaacaagtcctagggaagtagacacggagatggacaagaaaatccgcggtattatgagtagcattctgaaggatgcttctgtgcctgatgctgagaaagatgttccaacatcttccaccccagatgtttctgtgcctgatgtcaataaagatgttccaacatcctccgctccaaatgctgaagccctcccttcacccagtgaagaggaatcaacagaagaagaggatcaagcctcagaggagacccctgcaccaagggcaccagaacctgctccaggtaacctcattgacttagaagaagtcgaatctgatgaagaacccattgccaacagatgtctcgacatcaaagaggaccaagacatcagggaaaaggtgcctgaaaatgtccctgatgcaccattggacaacatctcattccactccattggcaatgctgaaaggtggaaattcgtgtatcaacgcagacttgccttggaaagagaactgggaagagctgccttggattgcaaggagatcatggacctcatcacggctgctggactgctgaagactgtcaccaagttgggagattactatgaaagtctagtaagggaattcattgtcaacattccctctgacataacaaacagaaagagtgatgagtatcaaaag

SEQ ID NO: 3028 - DNA, 245 bp, Glycine max
  Peptide Sequence Number=SeqID_94713
ggatcacgcccgcaagacacccagtggacccggagaagttcaacagggtcttggggtttcgagctgtgattacgggcctttgtcagttctatgaagtgccagacgcccccaacaaggtcattaggctcccattaaccgggctttcatcaataagtactgcgcccccaggcaggcgcagggcgagacaccactgcagcctggggatggctgacagtgggcaacaggcacactgccaccacctctag

SEQ ID NO: 3029 - DNA, 285 bp, Glycine max
  Peptide Sequence Number=SeqID_94714
atggcttcttcacctgcctcccctcctcctcctcctcctccttctcctcctcctcctccttccgacgcatcggcttcaccaccagtggtccacgtggaccctactaccagcaaggtcgacggtccccgcaggaagaaattaagaacatatttgggaatagtggcacgcgataaggtggacgtcacgtacgagaactggaaggaggtccctactgctcagaagggctttatttgggaggatattcaggtggaatttgaaatcccagaggcttctgacagtaggtga

SEQ ID NO: 3030 - DNA, 162 bp, Glycine max
  Peptide Sequence Number=SeqID_94715
atggatgacgaagagttgtcttcgcctgtgaattacgacatcgtcaagtgtgttttgtcctttgcattttttattgtcttaaagaacgtacactctcgttcttgctcactcattccggagccatttggcactttcaacagcggtgtcataagcgttaagtaa

SEQ ID NO: 3031 - DNA, 753 bp, Glycine max
  Peptide Sequence Number=SeqID_94716
atggctaagtacggccctgagatagtcatggagttatatgcaaatgcctggcccaccgaagaaggagtcatggataagcgctcctgggtgcggggccaatggatcccttatgatgaagatgctatcaaccagttcctggggcatccattggtcctagaggaggggcagcattatgagtacaccgagagaagaagccaggtgcggatcatgcacactagcatgaccactttgacacagatctggatgacgtttctcctcagcaacatccttcccaacgaccataattctgatctcctgctgcctaaatgtcagttggtctatgctaacttgacccagatcagtgttcatgtagccgagcttatctcggatgccatttgccagtttttctatggggtgccaattacaccaacaaagctcatctggcctcccattaacaggtatttcattgagaagtactgcatgccaaggcaggcacaacagctcgggcaggaccagcagcagcagccggccatagacgcaccaccgccacctctaccgcagccaccatctctagagtccatctcaactcacatgcagaggatggagctctacatgcagcatttggcataccacctttacccatggcctactctcgagcaattcaggaccactgttgcatggcttggggataggcctaattttcaggcaggggcaagtcccatagaggccccaggagatgaagacggagctgaggaagacggtgacatagcagat

SEQ ID NO: 3032 - DNA, 495 bp, Glycine max
  Peptide Sequence Number=SeqID_94717
atgggaggagaggaagcgtttctcgcttacgaaagaacattcttccgtaagagaaaatgcctgaaaatgcttcgtacggaagaaggttcttccataagttgctatggaagaaccttcttccgtaagaacttatggaagaagatcatgtttagaacaagaggtttaggtcgtgccttagctagtgttagaggcagaggcatgggtcaggatgagcatcatgctgatgttccctggcagcgtaggcctaccgcttctgctcgtaggcaacagattcatgtcgaagttactgaggatgttcctcatatggacgaggatattcctgagaggactgcggacgtagatgttgcagacgtagaaggcatagctattgatggtgctgaggggtcacctgctgatcatgttaagggattccctggtgggccacgtgacccatcggtcctgactttgtttgccgtccatgaggcacatagcatctggagtggagaggtattttaa

SEQ ID NO: 3033 - DNA, 309 bp, Glycine max
  Peptide Sequence Number=SeqID_94718
atgttgggttacaagtgtgaggtgaagtcccacatcgggtctccttatgtggtgactcgtggtccacaggtgtacccctcaaatctccccaacaattggtatcagatccgatggttcaagttggtgaccgactcagacgagtatgcaaggcaagtaccgcaggtagccatggctatactcgtggatgataaagacttccgctttccgctcgagggggagactaccatgtggaagagactcacacttgagggggagatgtgttgggttacaagtgtgaggtctccttatgtggtgactcgtggtccatag

SEQ ID NO: 3034 - DNA, 537 bp, Glycine max
  Peptide Sequence Number=SeqID_94719
ggtttccgagacctgggtcaggctgggggctatgcttggggagctgcggcgctggtgcacatgtatgaccaactaaatgaagcttgccagacccctacacgacaaatggttgggtacttgactttattacagacgatccctccgccgcctattagtgcttcattgtcattagaggagatagacgataggtggatgcatttctcggaccatgtagcacctgcgggtgagatttgtgttgtccctggacagatatctcatatgttcgtcacaccgacccaggcaggtgatcagcccagacatccacctgccccacaagatgaggaatacgtcgagccacatatcccagaggttccagtggcatctgatctccctagacattcagtggatgcttgtgaaggttgtgaagcgatcgcagaaaggttggagcgtgtgctcaacctcaggatgatcactgaaggcacagagttacatgagatcatgcaggattgcctcaggattgctaggggtgacgcctcaaatggaagtcttagggcgtga

SEQ ID NO: 3035 - DNA, 339 bp, Glycine max
  Peptide Sequence Number=SeqID_94720
atggtcattgaccaatcccttttccataacttaacccaattgtccagtgatggtgtaccatttgaaggtacactgaatgacgattggaaatttgatttctctgcacatgatgcccgccagttggtttgcaccaaccatgcggatatgaccgaacgccttcttgccgcttgtcttgatttcaaggattgtcatcatcaaaaagggggagattgtagacaaaggatcaagctgaatgttttgatgatgccaaaggatcacatggatcacatgcttctcaaagctttattcaagacaaagaaattaaagatattcaagatggatgatcaagacagtctctag

SEQ ID NO: 3036 - DNA, 384 bp, Glycine max
  Peptide Sequence Number=SeqID_94721
atgtgcacgtgtgcaatttttggtagccagaatgctttgagtatgcatgtatgtaaatttagccaaggaaatgcatgtgatgtaggtagtacaccttggaagaggttgtacgccatttttgtcttaagagtagcattccttggtaaaactaactttccaaatgtttgccttcgcaggaaatggccccgaggaagcttgcctcaaagaggtccaggaaggataaggcggccgaaggaactagttccgctcctgagtatgacagtcaccgctttaggagcgcagtacactagcagcgcttcgaggccatcaagggatggtcgtttctccgagagcgacgcgtccagctcagagacgacgagtatactgatttccaggaggagatag

SEQ ID NO: 3037 - DNA, 165 bp, Glycine max
  Peptide Sequence Number=SeqID_94722
atggatttttacaaggttgaaagaaatctcaaggaccgcaggtcgcttggggactggaggaagggaccaatcactagagccatgagcaagaggctccaagaggattgggctagagctgctgaagaaggccctagggttctcatgaaccttagggtagatttttga

SEQ ID NO: 3038 - DNA, 435 bp, Glycine max
  Peptide Sequence Number=SeqID_94723
atgtataatatgatgagaatcatgaaactggccaaatacaggctaaaggcccaagtggagaaggacaaagcccccgagtggagaaggataaaggtccaagtggagaaggacgaagacccaagtggagaaggacaaagcccccaagtggagaaggatgaaggcccaagtaatccttgtggcgtctaccctgacttatcttccttcactggaagtggcgtctacccagacttatcttccttcaccggaagtggcgtctacccagacttattttccttcaccggaagtggcgtctaccctgacttatcttccttcaccggaagtggcgtcatccaaaaaatctacagcctgtatcaagtgatccgccccgtaaggttcacatcatctggtatcagggcttttctttgttacggttcaacaaacgttgcatttgtgtag

SEQ ID NO: 3039 - DNA, 241 bp, Glycine max
  Peptide Sequence Number=SeqID_94724
gcccacttgggccctccagaatattcctccagaaggctgttgcttctggaggaagcaacctggctcgcctgggcgagctgggcggcaaccacctcccctattttgctataaataggggaggaagtgaagaaggaagggccgaggcgcttccgaaacgtttccgtaacgttttccgtgaggattctcgcaaaggtttcaaccgtttcttcgacgttcttcatcgttcttcgatcttcaacgg

SEQ ID NO: 3040 - DNA, 458 bp, Glycine max
  Peptide Sequence Number=SeqID_94725
gtatgccgcctacctggcaccctctggacccagataagttcaacagggccctgggatttccagctttgatcacaggactctgccagtcgttcggagtccccgtcgcacctagtaaggtgattcggtcgcccatcacgcgagcttttattgagaagtattgcacgcagagacaggcacagggtggcgaccctcaagccccagatgcaccgcctccacctcctcaggctgacccagctgggtcatttgacacggagcggtatttacggcatttgcttagcctcagcctgcagagccagggttttgcttcttttccatgccctactccggatcagtttagggcagaggtcgcatggcccggagattggcctgaggcccaggctgcagaggcacccgctgagactctcggcgagccagatgaggcccgcgaggatgaggagatgtcagatttgctcggctag

SEQ ID NO: 3041 - DNA, 528 bp, Glycine max
  Peptide Sequence Number=SeqID_94726
atgagtcatcattcatctagtgttaatggtgagggtactagtcataaagaccctttatctagaatcttagatgagttgagttccctcaagttatggaaagaaaaacaagagagaaaagaaaaaggaaaaaaaagagtggaagaaaaaagtcaagatgaaagaaagaaaataagagaggaagaaagaagaaaaataatgaaagaaatgaaaagagaaaaacatgcctcgtatagtagtcataactcttgcaaaagcctaagtgaagaacttcgtgactattacgaaggaaggcataggtcacatcttagacctcactcccatagaagagaaaaaggacacattacttctcaatgcccctccacaaaaacgatgattatgaggggccaagacatttatagtagccaagatgaggctactacttcaccttcctctagtgaaagtgaaaaagcaaaaggggaagaatctagtgaagaaatctacccccatgaagaaggacaaccattagtggttaaagagaagtgtaaggag

SEQ ID NO: 3042 - DNA, 483 bp, Glycine max
  Peptide Sequence Number=SeqID_94727
acgatgagcccgatgacatgcgggggtaccgtatggttatccacaccttttgtcatcccgaggcggtgagcccgatgacatacggggagactaacgtcgtcttctacaccttttgtcatctcgaggcggcaagcccgatgacatgcggggaaacttacatcgtcttctgcaccttttgtcatctcgagacgacgagcccgatgacacgtaggggtgccgtatggttatccgcatctttcatcgaccaggggaaaacgagcccgttgacgtgcagagacttacatcatcttctgcactttttgttatcccgagatggcaagcccgatgacaagcggggcggagacacccaagtgattatccgtgcaaacggtttctgtcatcttgacccatgtagtcaggtttttactctcgtcatccggagacattcaatcccgacaatgcacgagattcttctctgctgggcaggggcgatcgagtgcgatg

SEQ ID NO: 3043 - DNA, 421 bp, Glycine max
  Peptide Sequence Number=SeqID_94728
tcaagctaagcgcgccttgtgtgctaagcctgagtgtctgtctgttgaggctgagctaagcgccagcatgctcgccagcttgctgcgtttagcgcttgagcaaaattttataaggttcgctaagatggcatctaagaataggaaagcaccctttacacctatccaagctagatttgatagatctaggttcacatccctagaggcttgggagagatatacagacattgtggtgcctcgcaagcttttaccagaaaggaatgtggtagtttattatatagagtttgatgagttcaaggaggaactcgagagacgccattgggatgagaagctggctgatttttctgacagcagcatagacatcgccattgtaaaggagttttatgagaacctctatgaccccgatgataaatcacctaagcag

SEQ ID NO: 3044 - DNA, 156 bp, Glycine max
  Peptide Sequence Number=SeqID_94729
atgagagcagcagcccccaagcctcccttgttgagtttttgcttcccttttcacgctttagttcactccccgcaagggatggccctaggcctacgttgcattttgaagcaatggggcatgccatattgcccccattctcttgctattcatgcctaa

SEQ ID NO: 3045 - DNA, 812 bp, Glycine max
  Peptide Sequence Number=SeqID_94730
gcgcgcctgttaatcgaaccggaaaccgccgcgctggcggcacgccacgccagccccgaagagctggccgctatccgcgaggcctttgagcaaaactgtcgcgataaccgtgccggttcaaccacccatcccggcgaccgcctgttccatatccgtatcgctcaggccagcggcaacccggcgtacgcgtttatcatcggccacctgctcggccaccgctacggcagtatgttccgcatgctgcagcgccattacaccccggacgatatgccgcatcgctcggaacaggagcatcgcgcgatccttgaagccattgaggcccacgacgtccgtgcggcaaagaaagcaatgaaaaatcatattgatcagatgaaaacgccgctgatcacccgtgaagggtatgaaaaactgaagcaagagatggattacttgtggcgtacagagcgcccggaagtcaccaagaaagtgacctgggcggcgagtcttggcgaccgcagtgaaaacgccgattatcagtacaataaaaagcgcctgcgcgaaattgaccgccgggtgcgttatctcaccaagtgtctggaaaatctcaaaatcgtcgattattccccgcagcaggaaggcaaagtgttcttcggcgcgtgggtggagatcgagaacgacgatggcgataccaagcgctttcgcattgtcggctacgatgaaatcttcggccgcaaagactatatctccatcgattcgccaatggcgcgcgctttactgaagaaagaggtgggcgacctggctatcgttaacactccggcgggcgaagccagctg

SEQ ID NO: 3046 - DNA, 495 bp, Glycine max
  Peptide Sequence Number=SeqID_94731
atgagttactctatgagactatcaattttcaattcattcaattcattgaaattgctatccattgctccaacaagatttgcctccactattgtaatgcttaagagattcaagcaattgaagaaaggactccaagagatggtcattagtgaccaatggtcttcttataaggaagatgatgttgcaaaggctaaatttatgaaagatactttgttggatgataaatggtgggataaggttgattatattctttctttcactagccctatctatgatgttcttagaagaacgaatacggaagcttcatctctccatctagtatatgagatgtgggattcaatgattgaaaaggtgaagaatgtcatatatcaatatgagagaaaggaggagagtgaaggatcaaccttttatgaggtagtgcactccatattaattgatcactggactaagagtagcactcctctccattgtttagctcattctttaaatcctaggtaa

SEQ ID NO: 3047 - DNA, 177 bp, Glycine max
  Peptide Sequence Number=SeqID_94732
atgctccagccatatgggatcagcataggcttaaaggagcactcaaacccggtgaccctcaaggcctacactccgaagagtccgtcagggcctctccctcctgattcagccagcgatagtagcatctctagcggttccctgagattcctccagttattcctccgactgatccgatag

SEQ ID NO: 3048 - DNA, 806 bp, Glycine max
  Peptide Sequence Number=SeqID_94733
atgctatcggccagctcctgggatatcctttagtgctggaagagggtcaggagtgcgagtatggccagaggaggaaccagtccgatgggttcgatgaggaggccatcgcccatttgctatgtatgctggggccggattttgcccggactattgccgggagacgggtgcggatcatgcgcaccaacatgaccaccctgactcagatctggatgactttgctgctcagcaacatccagcccagcgatcataattccgacctccccctgccgaagtgtcagctggtgtatgccatcctgacacggatgagcattcacgtggctcagttaatcgctgatgccatctatctatttgcaggtatgacgcctaccaggcaccctctggacccggataagtccaacagggccctgggatttcccgccttgatcacaggactctgccagtcgttcggagtccccgtcgcacctagcaaggtgattcggccgcccatcacccaagcttttgttgagaagtattgcacacagagacaggcccagggggatgctccgcaggccgcagatgcgccgccacctcatcaggctggcccagctggatcatttgatacggagtacctgcagagccagggttttacttcttttctgtgccctactccggaccagttcagggcagaggtcgcatggccaggagattggcctgaggcccgggcaggagaggcaccagcagaggctcccgacgaggcagatgaggcccgcgaggacgaggagatggccgatttacttgatttcttaggagggagtggagccacatga

SEQ ID NO: 3049 - DNA, 393 bp, Glycine max
  Peptide Sequence Number=SeqID_94734
atgatgatttgggaacaacgtgcaaaattcgtcatggctacaactaggtgggtactcaagcatccaatttatggcattgtgatactaaggcttgggatttacacaagtagacccaatgtttccaaattatgttctttcatcggttcaatgaatccatccattctcatctcggacaatgttcctaaaggaaaactctacgaggttccggaacaaacattatcgacaaataacaaaaaacaagataacatacaaatgataaatgatggaacatacgaatttggggatgccacggtcatgtggctccacatgccaccggactcttgggtcacggtaacaaaggtggggtggtcgacgaaagcagggcttttgctcctacgtatcctcaatttgtga

SEQ ID NO: 3050 - DNA, 507 bp, Glycine max
  Peptide Sequence Number=SeqID_94735
atgggctcgcagcgcaacagcgcaaaacgcaaagcgcgcctgagcgcgattgcggagctgacgccggcgcagttgcagcgcattcacgcaccggttgggctggatatcggcagcaaaaccccggcggagatcgcgctggcaatcatggcggatattcgtctgaatgatcacatcactcatcccacgaaaaacccggatgtaccaggacgccagcagacgggcaaacggctatgccaaattttcgcgccgcaaataatcaataagctatgctttatgtttcatgatgtgatcaacgcttgcgctttaccgcggcgataccgtatcaccacacagggtttcgctctcaggtttgccgcgtataaatcagcgacgttcgggaaaagcgttatgctgttattcgaaatccgcatggcggctgaacatgctctcgctggtttcaccgcactgatgcatgatttcaagcaccatggcgtcacaggtgatgaagcagagttgctcaaaggctga

SEQ ID NO: 3051 - DNA, 585 bp, Glycine max
  Peptide Sequence Number=SeqID_94736
gtctgccatggaagctcttgaggaaagatctttccactctggcccaaacctggagtgttctatcttattctaacttggccctgacatcccatacttctgatcttaatctggatagggccaggttagtctatgggcttgtaatgaagatgaacatgaacttaggatcacttattcctggtcagatttcactcattgctcagtccaactcttcgtggcttggatttccagccttgattattgccttgtgcaaggcccgaggagtcacctcagattctctcacttatgagtcacttggcccagccattaatttggcttatattaagaagaattactggaacctggatgacctttcagtcacttttccaaggacccaaaaatccagggctagaagatctgaggccccatctcctttagctgcccctgctccccctacttctgctccctctacttctactctcccttcaccaccagcagctccagttcttccagagcctacaccagggccagctcctgattatgcagagcttgcaggatgtggtctagcagcgggtagttatgagcctggaggagtttgttcagaaggtg

SEQ ID NO: 3052 - DNA, 335 bp, Glycine max
  Peptide Sequence Number=SeqID_94737
atgacattgctacttagcaacattctgcccagcgaccgcaacgccaatctccccctgcaaaaggatcgcacccacaagacacccagtggacccggaaaagtccaacagggccctggggtttctagctctggttacgggcctctatcagtcctacagggtgcccggatcgtgcctgcaagacacccagtggacccgaagaagtccaacaggttctacggagtacctgtcacctccaacaagggcatcaggccccctactaatcgagctttcatcaagaagtactgcgtctccaggcaggcgcagggcgaaacaccacatcagcattgggatggccg

SEQ ID NO: 3053 - DNA, 204 bp, Glycine max
  Peptide Sequence Number=SeqID_94738
atggcggcttcttatatggtgggcgataagctggaagatatgctggcagcgcaggcggcaggtgtgggaaccaaagtgctggtgcgcagtgaagaagcaccggctaactccgtgccagcagccgcggtaatacggagggtgcaagcgttaatcggaattactgggcgtaaagcgcacgcaggcggtctgttaagtcagatgtga

SEQ ID NO: 3054 - DNA, 204 bp, Glycine max
  Peptide Sequence Number=SeqID_94739
atggggtcgggcaaagtatgcccccatccttctagtggttcagggactctctctttcaagggaggcagcggggatttcgactttcccctgggggtaggggtgctcgaaagggaggttgatcatgaaattttcaataaaaaactgaaatgtattcttcctgtccctgggtcgatgcccgagcggttaatgggggacggactgtaa

SEQ ID NO: 3055 - DNA, 609 bp, Glycine max
  Peptide Sequence Number=SeqID_94740
atgcctaaatcatctcccaacatgcatgtgaagcaagaagtatcaacaagagtcaagccaaggctattgtgcaagcaatcaatggggcaaaacacaccaaataaaataaatgatgatggctcaaattctcaccaaggggaatggcagtccaaggaaaatgagatggaactccaacgactaaatcaaaatgaagaaaccgacaagaggaaacgaagcatagcactcaaagcctcctcctcaatacaagaagaagaagaagatgaagaatcagaagatgaagaaggcctttctctctttgtgaagtttcacaaatttgtcaagaaaagaagaattgagaggcgtcaaaatttcaaccatggaaaaagattccaagaagactctccaactcttagatgctacaagtgcaaccaacttggtcacatcaaagcaaattgcccctcaaacgagcaatggcctgagaggaatgagaagaaaagtcatgaagaaagaagatccaagaaggcgtatattgcatgggatgacaatgactcatcagatggtttggagaaggagattaaccttctatccaaggactatgagagcgatgagaacatctctcaagaagactaa

SEQ ID NO: 3056 - DNA, 657 bp, Glycine max
  Peptide Sequence Number=SeqID_94741
atggcagggagacgagtgcggatcatgcgcaccagcatgaccaccatcacgcagatttggatgacgttgctgctaagcaacactctccctagcgaccataactcggacctccccttgtcaaagtgtcagttggtttacaccatcctgactcaggtgagtgtccatgtcgcccaactaatctctgatgctatttaccagtttgtagggattatacctccgagacacccagtggacccggagaagtccaacagggccttgcggtttcctgctctgattacaggcctttgtcagttctatggagtggcggtcacccccaccaagctcatccgacctcctattaataaggccttcattgagaaatactgcatgcccaggcagatgtacaggtacatgcatcacgtgactagccagcatgcagctaatcacaaaggacaggtgcggctgaatgagacattctaccgttacaacatgcgccaccagagtcaggaccccaatcgtttcccttggcctacccctgagcagttcgaggccacagtggcctggcctggggacgagaccgattttgagatacgggctggacctacaggagctccgggggacgacggaggagctcaggaggatgacgacatggctgatgtgttggacttcttcacttga

SEQ ID NO: 3057 - DNA, 810 bp, Glycine max
  Peptide Sequence Number=SeqID_94742
atgaccactttagctaagacatggagcattttttccttctctaacttgattcctacctcccacacatctgatgtcacattagacagggccaagttaatctatggaataattatgaagatggacatgaatgtgggttacctcatctctcaccaaatctctattacaacacagcatgactcctctaggcttggatttccagccttaatcacagctttgtgtaaagctagaggagtcacatcagattctagatccctggagagcctcagccccaccattaacgtggcgtacattaagaagaactgttggaatctggatgatccaacagtgacattcagagggccaaggaaggccaggggcaagagatcagagtcccctactacttcagcagcaccttcttcatccactcctccagcaccttcttcttctactccatctactcagataccacttccagctccttcatcttttgaactcaaattttttgtttactccagagatgcttcattctatgctccagagcttacacagagggcagcccaagagcccgaggctgtagaggagaagatacaagtagatgaggatgagctcactcctcctgagccctttgaatttgtttctaactcagtgctagatcaggaggaagtaccttcaccagagcctattcaaaagccatctcctgcacctattcctgagtacaccatgctagctgaggatacccagccatctgcactagtattggagcatgagcaactcaacattcaggattcatcagtagctccagtactggatatgaatgaagatcagccatag

SEQ ID NO: 3058 - DNA, 189 bp, Glycine max
  Peptide Sequence Number=SeqID_94743
atgaaggagatccaaggcctacaagctccacatggagctatgtcaattttacttttgcaatcctccatgatgcaatcctatcccgcaagggcattggatagaaaactccaagtagattgggccagagatgcaagagaaggccctagggttcttatgagccttagggtagatttcgggcacatgggctaa

SEQ ID NO: 3059 - DNA, 474 bp, Glycine max
  Peptide Sequence Number=SeqID_94744
gttctagagagtacacagggagaggaaaagccatcgacctcgtacctccccctccctctccctctccctctccctctccatcccatcacaaagaaaacaacaattcacattattagcagatcagactccgacgacgacgacgaccgcagccacgaagaaggaaagcatggattcgagtttgtttgggaaatggagctccgctggtctgccactctcaattccctttccaacgacattgacactcccatccacgacgacgtcgatgttcccgaaatggaggagaaggagaaggtggtgaggcacatgtgggatgtgtacacaaatagtcactgcaggaggtcttcaaggatgcctatggatttgacgagcgatgtcgctgagctcagagacgctgccgtcaccgagatcgctgatgtagctctattagagcttgtaggccttggatcttcttcaatggagttctgtgcttcttga

SEQ ID NO: 3060 - DNA, 471 bp, Glycine max
  Peptide Sequence Number=SeqID_94745
atgaagataaaaacaaacaaaacaagaaatgaattgaaaatctcggattcgaacacttactggttgaagaaccaagaacggacaaagaacgaggaagaacggaggaaaatcttcatagatttgctcacggaaacgtctcagaagcgatacagaagcacttcgactagatttttcttcacggaaacgggaaaatggaggtgtttgccacccagaggcttcttgaagaagatttctaagcgcaccccaattactaagttcaccccccttttcgtactttacggaaaagttacggaagccttacgaaagtgttttggatttgattttcatctttttttctcttccatttcaccaatattaagtgaaatatgcttacccaaggttttcggaaattttatggaagccacggaagccccagaaaccagttttcatcaaaatgtggaggagcttgccgcccaattgcttcctctttaa

SEQ ID NO: 3061 - DNA, 297 bp, Glycine max
  Peptide Sequence Number=SeqID_94746
atgggggttgctgatgtgccccagtgtgattctttctcgtcctaccatgtttgggattggtgcgcggtagttgggagagttgggtctgcttcgacagccgaactaacagcggcggcggtggccgcgttattctccattagttgtctcattcctagcatggcatccatcatggaagccatttgctctttcaaagtcgacattcatcatcctagatttggatctggtgtgatagggatgtcatggggcactcttagttatggcgtttttcctaaaaaaacaaacgtgaggagtacgtaa

SEQ ID NO: 3062 - DNA, 327 bp, Glycine max
  Peptide Sequence Number=SeqID_94747
atggacccagagaagtccaacatggtcttagggtttccagctttgattacgggcctctgtcagttctacggagtgctcgtcgaccccagcaaggcaggcgcagggcgagacaccacaatagcctggggatggctggtagtgggcaacagacgcaccgccgccacctctagagcccctcagctcatctacaaaagctggagcgttgcctacaacccgtggccgaccagcaggcgaccaagtccaaatccaaaggtaagcaaaagtactaggtccgtgactgacaagtcatcacgcgtccagttcaagacgttaaagaagcgttactag

SEQ ID NO: 3063 - DNA, 156 bp, Glycine max
  Peptide Sequence Number=SeqID_94748
atggtcattcccaagttcaaggtgccggactttggcaagtacaaggggactactcgctccaagaaccatctaaagatgacaactgtcgcctggtatactaacttaggaaccttcttgagtccattcttggaaggacctaatggttgccttcattaa

SEQ ID NO: 3064 - DNA, 522 bp, Glycine max
  Peptide Sequence Number=SeqID_94749
atggttcctcaccaactcaatgagtggtgctacaagtgtccttgtcgcaacctacgcttcggcgggagggcgacgcgtgactcgtgggtgcgtgttccaagaaaggaatacgcgcggagtcgccaccaacgtttatttgaggaaaacatcagaaaaaccggaaaagacgtggcctacgaactttatgtgaaaggttccggagttgtatttatgcacggggaagggaaaagaaggagaagcttgccacccagctcgcctaggcaggctaggttgctacctctagaaggcaccgccttctggtggaacctcctggaaggcccaagtgggcctgatggtccccggatgaaattagggtatgacaccatgaaatctttccaaggcctcactcaaagattcatcgggaaattggtgaaaagaagaggtggcaactttgccttctacagtcttagactcagggaaatatttcttcagaaatttctccacaacttcatcccatgtcttaagactattacctatgaatga

SEQ ID NO: 3065 - DNA, 207 bp, Glycine max
  Peptide Sequence Number=SeqID_94750
atgaatttgacatccttgtctctctcatcctttctgtcgcaacgtgcccttcgcgggcgagcgagggcgaggctcacgggtgcgctttccaaaggaggaaaggtcgacaaaagcggggcttttgctcctacgtaccctcctttggagaggaaatcagacctacgtagttctcacttatgcgtgaatcaagtgattctttttacttga

SEQ ID NO: 3066 - DNA, 318 bp, Glycine max
  Peptide Sequence Number=SeqID_94751
atggcttttctggttatatgcaactcactattgctcctgaggatcaggaaaagaccacattcacctgccccttcggcacttttgcctataggaggatgcctttcggcctgtgcaatgcccctgaggtgtgtcgcaacctacccttcggcgggagggcgacgcgtgactcgcgggatccgtgttccacgaaaggaatacgcgcggagtcgccaccaacgtttatttgaggaaaatgtcggaaaaaccgaaaaagacgcgatctacgaatttttaagtgaaaggttcgggagttgtatttacgcacggggaaggtattag

SEQ ID NO: 3067 - DNA, 526 bp, Glycine max
  Peptide Sequence Number=SeqID_94752
atggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctg

SEQ ID NO: 3068 - DNA, 126 bp, Glycine max
  Peptide Sequence Number=SeqID_94753
atggtgcaaaaagggactctatcggacatccgagttaaaagttattgtcgtttgaatttgctaaatgattttgttatcaattacaagcgtctagatatattacgggacacaatcggacctgagtaa

SEQ ID NO: 3069 - DNA, 279 bp, Glycine max
  Peptide Sequence Number=SeqID_94754
atgaagcacttcactgacaccctcatcagtgccaacatagaaacagctatgaccatgattacgccaagctcgaaattaaccctcataaagggaacaaaagctggtaccgggccccccctcgaggtcgacggtatcgataagcttgagccccatgaatgttattgcctagcgctgttcatgtgtcctccaccttcgagtttaggagctatgtttcatgattgcctaagtgcggaccctcaaggcaatcctccattctccccctttttcggagccccatga

SEQ ID NO: 3070 - DNA, 210 bp, Glycine max
  Peptide Sequence Number=SeqID_94755
atgaagaaaatccaagctgaggcgctttcgcaatgcttccgagacgttttcgtgagcgattttgtgaagattttccaccgttcttcatcgttctttgtcgttcttcgttcttcaactgttctcgaagaactacgtaggtctgatttccttaccacaattgaggaatacgtaagagcaagggaaacacccttgtcgaccacagaaagataa

SEQ ID NO: 3071 - DNA, 885 bp, Glycine max
  Peptide Sequence Number=SeqID_94756
atggtcatcctggtcgatgacgaacaccgtgaaaacgaaggtgattttgttattgccgccgaattcgtcaccgcagagcacattaacttcatggccaaatatggccgcggcctgatctgcctgaccctgaccgagcaacgctgccgccagttggacttgccgcccatggtgcaaaaaaatggcacgcgcttaggcaccaatttcaccgtatcgatcgaagcggccgaaggcgtcactacgggcatttcagccgcggaccgtgccacgaccatacgcgcagcgattgccaaacaagccaatgcgggcagcattgtcagtcctggccatatcttcccattatccgccatgaatggtggcgtactggtacgtgccggacacaccgaagcaggttgtgacctggcgcaattagcaggctgtgagcctgccagtgtgatttgcgagattttaaaagatgatggtgaaatggcgcgcttgcccgacctgatgcaagtcgcggccgagcacgatatcaaaatcggcaccattgccgacctgatccattaccgtgccgcgcacgaaaccctgattgagcgcagcgccgagcgcaatattgaaaccgttttcggccccatgcgcctgattgcctaccgtgacaatatcgcgcaagaaactcatctggtgctgattaaaggcgatccgcaaaccagtgatgaagcactggtgcgtgtgcatgagccattgtccatgatagacctgctggatagcagccaccaggcacatagctggaacctgttgcatgccatgcgcaccatcagcaccgcgccttgcggggtgattgtgctgattaaccatgacgaagatggattagggctcacggaccgcattctgcgtgccgaccagaaaatg

SEQ ID NO: 3072 - DNA, 153 bp, Glycine max
  Peptide Sequence Number=SeqID_94757
atgactaaagcacgtcaaaagggggtacggaaagaaaaggaaggagatgcttgccacccagctcgcccaagcgagctaggttgcttcctccagaagcaaccgccttctggaggaacatcctggaaggcccaagtgggcctggttgctatttga

SEQ ID NO: 3073 - DNA, 339 bp, Glycine max
  Peptide Sequence Number=SeqID_94758
atggaggttgaggaaccttggatggggttatggctaccattgcattatcgagtagatatgggacaggtgggctttgtggctgatttaggggtggcctttgcggatgattgggcattcttgactggtaggggttttgtgacgtttcggaaggaattgtgcaaaatactcaaaagagggggaaaatggtcactttggggacatttttcagcccctgggcccactagaaagcttagagatgaagtaaccagctcgcctgggcgagctaggttgcttctagaggaagcaagcagctcgcctgggcgagctgtcatgcaacctcctcccctcactttcctataa

SEQ ID NO: 3074 - DNA, 426 bp, Glycine max
  Peptide Sequence Number=SeqID_94759
atgaaaaagattttacatcaactacttagtaagaatccccaactgaggattttagcctttcatggcaaggaagctccttttacactgaagaagaggaatcaagagagattgcttgcttacaaaggagtgaggatgtctcctccatctctaggaatctcacaatctctcaaaaactcactaatctccctaaaagatgaaaacttggccccttgctctgctttacactctttgaaattcacaatcttcaggcctctgatgactcctctggctctttctgttaattatgtgcaaatcaggcttaaaaagggcttcctgatctcgacgtcacgcttagcgccattctcgtgcttagcgcgaatgcctttccagattcccctttactcgccaagcgcgctggtgctgagctttgccgttgatgcgcactaa

SEQ ID NO: 3075 - DNA, 786 bp, Glycine max
  Peptide Sequence Number=SeqID_94760
tgcgtcgggtgatgctgcccaacttactgatttagtgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcatgttcaccacatcaagtttctcggacacgacaccattgaaatcaacaaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 3076 - DNA, 339 bp, Glycine max
  Peptide Sequence Number=SeqID_94761
atggcagtagatcagcataaggcattggtatcaggttcctcctcgggtttgtgtttgtgttgggattggtgtttccggtgggttgagactgtgcgggaaacaaattttgtgggggagaccattgtggttgagtgggcaatctttgttggacggacgccagattgggaagggttccaacgttggctgaataatttggctgatgcgaggaatattggtaggtgggttgtgaagggtttgttgggattttgggcatgtgggagccgaagttacgacatgggtgtctccctccgtcttcttggccccatccattctgaacctcctattgcttgtacttgttga

SEQ ID NO: 3077 - DNA, 183 bp, Glycine max
  Peptide Sequence Number=SeqID_94762
atggctgggacgccacaatatccatcgctaagtgcagctttaacgcgtttagtgcaaagaacaatttgccaggtgccttcagccaggctcagctcgacactggcgctaagcccaatttcacttactcgcgctaaacataagggtggcgctaagtgcagtgtcacgatttcagagcctatttaa

SEQ ID NO: 3078 - DNA, 384 bp, Glycine max
  Peptide Sequence Number=SeqID_94763
atgcacaagaaactctccccccctccccacggtaatcaacctgagtctcaagggagttccagaccgagtgacatgcccccgagtacaagtattcctcctaatgagaaactacaagatattcaacaagatgatgacaaaggtgatgacaaaaagctcaaagatcaatcaaagaacaacccaagtaatcaagttagaatcaagaacaattcaagagttcaagatagaatcaagagaagaattcaagactcaagaggaaagttaagagtcaagaatcaagattcaaggttcaagatctcaagaatcaagatcaagattcaagactcaagagaaggcttaatcaagataagtatgaaaagtttttctcaaaaattgagtagcacatga

SEQ ID NO: 3079 - DNA, 243 bp, Glycine max
  Peptide Sequence Number=SeqID_94764
atggaggagttgataaacaaaatacaactctctcccaaaataatgtcaacgtcgtcacgtcggttcggtggctcctcaccagaatcttactccttccaccctgctactgtcattctgctcccacgaacaagaaaaatcagcatgcaacagggacaggcagatatcctcatagctaggttccctgaccctaactatgttgtcaaaatggtaaattttataataaactcccctcacctattgtga

SEQ ID NO: 3080 - DNA, 513 bp, Glycine max
  Peptide Sequence Number=SeqID_94765
atgttggagtttgactcgaacgtgttttgtagatttaaggatcgcttcttcaaggtcaaggaaaccaacatcgttgttgaaaggttttcattgatgcttgatgggaaccgggaacctcgcttcctcttttactggcagtcagaccccacaagattcaaatcctttgatgtgtctggtgccccagaggtgaggacaaataaggacattttgaagagattatcgaccttgatggacgtgcaagccatcctgtccttacctttgacaaacaaccctcttactattttggatggtaaaatgggtgactttgaatggcaaccctttgtgaagcaggttagctctgctggtgatggtgtgcctcctctctccactatcattctaatgtcttcaggtagggaaagagggcaggctagagtcgatcttcatcgagcttttgaagatgacaaggataaagttgttgaggtcacaccagacgtgcttcctgatgcaatcctaccccccaagggcattggatag

SEQ ID NO: 3081 - DNA, 597 bp, Glycine max
  Peptide Sequence Number=SeqID_94766
atggcgatttgtagtggctactggtggctgtgggtgatggagaaagaacttggaatgttggaaatggttttggaagaaagaaggagaggaaaatggcatttttccaaggctacacgaaaagcaaaggctgaaacactcaagtgcttctgcttgcgggaaaggaagcgttcctcacatgtcagacgtcgtattgaagattgcaacgaattagggtacaactttaacaagagcccaaggcacaaaattccacagcacaccacagtgcctatttttggaaaagagctctggaggcagcaagaggagcagcttttgcagagatacctaggttttaacttgaatgaagcagaattgaaacttagtcttatggaagcaaagctttccaagtttattttgatgatgccaaagactcaagtcaagaatcaagagtcaaacaagtcaagaatcaagagtcaaacaagtttcaagaatcaaagtgttgttcaatcaacaatcaagattcaagtgaagattcaagagaagactcaagatatgcaagaacttcacgaaaagcatcaagataagtataaaaatattttttcaaaagaaaagattgaatag

SEQ ID NO: 3082 - DNA, 177 bp, Glycine max
  Peptide Sequence Number=SeqID_94767
atgacaacaattttggcagcgaatgtggtggcaattgatgatggtaatggtggtgacggtgacaatcatggtggtggcagcgatgacaacaaagtggtgatggtggtgataattatggtggtggctgcagcggtgggcagggtggtggtagcaataatcatgatggtgatgggttaa

SEQ ID NO: 3083 - DNA, 54 bp, Glycine max
  Peptide Sequence Number=SeqID_94768
atggcacacaaccaaggttggtggcataatacttctagagatagatttttgtag

SEQ ID NO: 3084 - DNA, 447 bp, Glycine max
  Peptide Sequence Number=SeqID_94769
atgacactcgcggtgagaatggcaaaagctttattgttttcttcagagaaagaagcgtgtgtcgtggcgcgacaaagaagatcgatgctcttgaaggtgtacctaatggaagaagaccaatcaaacaaacaacacaatgaggagagtgagagtgagaggtcgagaacgagggactctctgaaggagtctaagcttgaagcagcaaaggagaaagaagcaaacaagaagcttgaggaagagcttctaatgtttaaaaaacaggtcgtacagcaacatgagaagggatttttcaaggccattaagcaggtcgagttcttcactgagggtcttgacttaggtcctttttatccatttaaggatgtgaaggtcttgtcaatcaatctggtgatgttcacttttcactttgtggagcttcttacccaaggtcgtaaggacttacttgagtaa

SEQ ID NO: 3085 - DNA, 555 bp, Glycine max
  Peptide Sequence Number=SeqID_94770
ggtacatcctttgtggtacaagtagagggtacatctacttgggttgttgtaactgagaacaagagagggtacatctcttgtggattagttctagtggaggatacatccactaggttgttcaaagagaacaagggagggtacatcccttgtggatccttgcttgtaaaggattttacaaggttgaaaagaaatctcaaggaccgcaggtcgtttggggactggatgccacttgatccaacatgccctaggtttgtcgaccctctgaagattcgaccagggacttacttgagctttttaccaatggcgaaaggctcaccaagggcgaacattgggtttgatgagccttcgaagattcgaccaaagactggaactgccttgcttgataaggaccttggacaccatgaagttggtgatgacaatggagatgaccatggggtcatcctggttgatggagtcaaagcttttgaaatctttgttggtgaatgttatgggagggaggcttctggtgactattgttcgttgttgacgtcaatatctttgatggcgtggagatga

SEQ ID NO: 3086 - DNA, 699 bp, Glycine max
  Peptide Sequence Number=SeqID_94771
atgaggggagcaccgatggaagaaagcatgtctcctttccttgtgagggatttcggcgcgcgaaatttcaaggctatacaaagaatccataaggcatgggaaaccccgttaaggaaagatcaagaacttaggggcattcgtaatggcatcattggtggttaccatgaatggctgaaagttcatatacgaggtttagattggctcgccaagttaaaagtcgtcagcgaagagagttttgaagcaccggaagaggacaaagaagtccaagctctcaaaagcgatttaggaaaggcgaaacttgccaaggagaagttcaagttggccgctacacacatctggaaggagtgtgccggattacgggaagagaatgcaactaccgcaagagcccttgaacaagaggccaaaagggctcgcaaggaagagtatggccggaacaaatttcgcggagctctgtggggtagcaacaatgaactcaagctgcgaagggaagagagggacgaggcgcgagcacacagcatggggtggaaagaggagttagttgcctgttcgaggtccaaaaggagcttgtctcagcgtttatgcgagacggagaccaacatgctagctatcatcgccaagtaccaagaagaattaggtctagccacggcccacgagcatagggtcgcggacaagtgtgcccaaatatacgcggaaaaatag

SEQ ID NO: 3087 - DNA, 194 bp, Glycine max
  Peptide Sequence Number=SeqID_94772
atgttgacatctccggaaagggcgcagatgaccatactggcctctgctcatcaatcacacttggggtcactgaatgacgaggtgcagataactgcaaggtgtctccgcgggttaccagctcttgggtcatggcaacaaaaggtggaaccgttaaaaggaaactactggtcccttaaccgggagtgcaagtctcg

SEQ ID NO: 3088 - DNA, 900 bp, Glycine max
  Peptide Sequence Number=SeqID_94773
atggttgaatcagaaagatttaactacatcaggaacaatcaaaagaaactcagagttgacaagtattgtagcttacaaaattcactggatgttgggacaagccaaggtttaaataaagacaagagagtaattttgccttctacctttgttggcagcccccgctacatggatcggctatattttgatgttatggcgatatgcagccacgttggtttcccaaatctttttatcactttaacatgtaatccaaattggcctgaaatccatagattacttgcgccattgaatttgaaactagcagatagaccagacattatctcacgagttttcaagttgaaatatgaagaaatgctttcatacctaacaaagaatcaccaacgcggaaaaacagtggcatacagtaaatatccaacttcagatgaaattgacctgattatatcagtagagataccttcaaaggaagatgaccaagaactctatgcattggtgcaaaatcatatggttcatggcccatgtggaattatacgctctgaatctccatgtatgaaagaaggaaagtctagtagattttatcctaaaatgttccaacctcgcactcttttagatgcaaatggttatccagtatatcgtaggagaaatgatggtcgtacaatttcaaagaatggtgttatcattgataatagacacatcgtaccttataatccaaaattattgaaaaaataccaagcgcatgtcaatattgaatggtgtaatcaaagtacttcaatcaaatatttattcaagtacataaacaaagggtataacagagtcactgctgttatgctttatgatggcaatgatgaaatccaaaatgctaccaaccagaaagatgagattaaagaatatatagactgcaggtag

SEQ ID NO: 3089 - DNA, 336 bp, Glycine max
  Peptide Sequence Number=SeqID_94774
ggaccaccaggatttatttatttgcgaagtgatcttcccgtcacagctgtccctcctgttcagctactgacggggtggtgcgtaacgccaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctccaaggcgattaagttgggtaacgccagggttttcccagaattcgatacggctttttcgagtaatgtgaaatgtcgctatgttggcactagcttgggccatgatagttga

SEQ ID NO: 3090 - DNA, 102 bp, Glycine max
  Peptide Sequence Number=SeqID_94775
atggaagcacctccggttgaagatgctctaagctcagtacactttctatcctctgactttcttcaaacaagttcaatgggtcgatgcaacagaactccttaa

SEQ ID NO: 3091 - DNA, 345 bp, Glycine max
  Peptide Sequence Number=SeqID_94776
cggttccttgagattcctccagttattcctccaactgttccgatagaattcccaaacatcagagagacggagaagagattgaagcctccacttgtactgtcttcatccgattcctttttctccctccacagatattatctcgcaaattccaacggtgaaagtaccattctggatttctgtgggaaaagagaaagctacggtgcgaagggtatttctcttagctctgttatgattttgcaattcccaacggttttgcgggctacaggaaaaagaaaaggttttggagaagagaacagagaaaacgaaaatgagggacagaagaggcaccgtcagtgtgaaaactga

SEQ ID NO: 3092 - DNA, 564 bp, Glycine max
  Peptide Sequence Number=SeqID_94777
atggtattcttaggagaaagttcgtctcagacgattgtcaactcaaggttgacattcatttttccaaatggagccgtcattcacaacgagtgtggggtttattttcaaagttctactccagtgcccatgcgagaacaaaacctgtgcgatttttcaactcttaaaagcagaatacacaacacccttcagctaaacaacaatcaagttgtgaatgaaattcattatcggcgaccgctcaaagatacaagtaacaacattcacttccaatgtatgcaattgaaacatgacatggatgtgaacaccatgttaatgtgtaatgatcaattttcatgtgttggaccgattgagttgttatgcaccgttggtagaacaccggatgcaattttaaacttacttgaacgccccagcatccctactcatgatgcggttctgtattacaacggaaggtggaacatgccacgccaaaaaaactttgtgggttacacgttcacaagaataaatcccaaaaaatttgatattccaaaaggatgtaccatagatgaactgaaggatttgatcaagcaa

SEQ ID NO: 3093 - DNA, 342 bp, Glycine max
  Peptide Sequence Number=SeqID_94778
atggtggcccaagcccgggctgttgatatgctcgtggagacgtcatcatcgcgattgtggatggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaaccccatacctgtcgggacccgaaagatggtgaactatgcctgagcggggcgaagccagaggaaactctggtggaggcccgcagcgatactgacgtgcaaatcatagctggagcccgcgggcgagttctatcgggtaaagccaatgattag

SEQ ID NO: 3094 - DNA, 159 bp, Glycine max
  Peptide Sequence Number=SeqID_94779
atggtccatgacatctttgtcaaggtgaaactggaagtaacaaggacattaacagtcctaaacgtgtttggcagtagacgaagcagcgataaatgggtttatgatcccaacatggttggctcgtggtacctaacacatgcaattaagaatgtagtgtga

SEQ ID NO: 3095 - DNA, 141 bp, Glycine max
  Peptide Sequence Number=SeqID_94780
atgaatgttgaagaacagtcgagaatcttcaccaaactaggggaggagcttgccacccagctcgcccaggcgagcaaggttgcttcctccagaagcaacagccttctggaggaagaatctggagggcccaagtgggcatga

SEQ ID NO: 3096 - DNA, 117 bp, Glycine max
  Peptide Sequence Number=SeqID_94781
atggccctctacaggatactaagctaccttgtagcgacgttttccacttgtccagcgccgggaagggacgacgatctgtcggtcgtgaccctatcctctatttgcatccgtctctaa

SEQ ID NO: 3097 - DNA, 211 bp, Glycine max
  Peptide Sequence Number=SeqID_94782
atgagctcttcatatcgccctcagtccaatggccagactgagaatcttaataagaccattgagatgtatctaagcttgggcatgacaccatttcaagcagtttttggtagacctccaccagcggtgatgcactacgaggttgatcctaaggatcccgatccactcaaggctttattacaactacgtgatcaacttttgagcaagcttaaag

SEQ ID NO: 3098 - DNA, 566 bp, Glycine max
  Peptide Sequence Number=SeqID_94783
atgggagatttcatcagcagactctccttccccgaaaacaccgagactttttcaagtctcagaagttatccagaactacgtagggctgaattcctcattggaggatacgtaggagcaagagcctcgcttttgtcgaccacaccgccttttgttgttatgattcaagagctggtagccggcgggatgagcagagagaccaagtttggtcattctgcatccatgatacgcggagataccttacggttatccgcacccctttgccattcagacacagtcgtgtccgttggcacgcagagaccaaagaccaagtttggtcattctgcacacatgatacgcggagataccttacggttatccgcacccctttgccattcagacacagtcgtgtccgttggcacgcagagaccaaagaccaagtttggtcattctgcacacatgatacgcggagataccttacggttatccgcacccctttgccattcagacacagtcgtgtccgttgacaagcagagaccaaagaccaagtttggtcattctgcatacatgatacgcggagataccttacg

SEQ ID NO: 3099 - DNA, 54 bp, Glycine max
  Peptide Sequence Number=SeqID_94784
atggccgaccagcaggcgaccaagtccaaagccaaaggtagagagataccgtag

SEQ ID NO: 3100 - DNA, 321 bp, Glycine max
  Peptide Sequence Number=SeqID_94785
atgcacacacaaagtttcacaaattcacaattccttaaaataggcctaactcacaaaaaaagtccccggtggagtcgccaactgtcgcaacgtgcccttcgcgggcgagcgagggcgaggctcacgggtgcgcttcccaaaggaggaaagatgcgcggagtcgccaccaacgtttatttgtggaaacgtcgggaaaccgaaggaaccggtcaaaatgaaaattctaagttcgggagttatattacgcttgaggaaggtcgacaaaagcggggtttttgctcctacgtaccctcctttggagaggaaataagacctacgtag

SEQ ID NO: 3101 - DNA, 369 bp, Glycine max
  Peptide Sequence Number=SeqID_94786
tcattcggggttcgcatcacacctagtaaggtgattcgaccgccgatcacccggtccttcattgagaagtattgtacgcctagacaggcacagggtgatgcaccgcaggccgcagacgcaccgccaccacctcatcaggctgatccagctgggtcatttggcatggagcggtatttacagcacttggttcaccagcaggcggccaaccacagggggcagttcagggctgagattacaaggcccggagattggcctaaggcccaggcaggggaggtgcccgcagaggctcccggcgatggagaggaggcccgcatggatgaggagatgacagatttactcggtttcttaggagggagtggagctacatga

SEQ ID NO: 3102 - DNA, 595 bp, Glycine max
  Peptide Sequence Number=SeqID_94787
atggataatgaagagggagtgcaagaacagatgaaggccgacctatcggccttaaaagatcaaatggcttctatcacggaggccatgctaaaacttcataaaactatagaagataatgccacggtggccgcctccaatacagctagggaagcggaaccgatgctacagcccgcaataaacttgggccgagacagaaacacgacggtgttcggtcggaggtatagtcctcaagcttacccttatgcccctaccttcgaggggcaactccctccttatgctgactatcctctgcgagaagacgatgaagaagatgcccatctaggccctctacttcccctcaaggatccggccccccatgaattgccccaaccaaacatagtctgccatgtcccgtctccacccacacccgttaaagaatccgttccctttgcaaaagataagggaaagattgatttacttgaagagaggctgagggcggtagaaggcctcgacaactgcccattctcggatttagcggatctctgtctggtacctgacatcgtcatccctcccaagtttaaagtaccagatttcgatacataccaagggacgacat

SEQ ID NO: 3103 - DNA, 585 bp, Glycine max
  Peptide Sequence Number=SeqID_94788
gaagttggtgacctgatgacaggtgagccgacgaccgaagccccggtgaacggcggccgtaactataacggtccggaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggaccgggaaggacgcacctctggtgtgccagttatcgtgcccacggtaaacgctgggtag

SEQ ID NO: 3104 - DNA, 129 bp, Glycine max
  Peptide Sequence Number=SeqID_94789
atggatagaggcatgacactaactgatgctcctagatctagcatggcattctcaaatttattgttcccaataatgcaagggaaaactgccaggaagccacattataaacagaacctcgaagagagttga

SEQ ID NO: 3105 - DNA, 339 bp, Glycine max
  Peptide Sequence Number=SeqID_94790
atggttatgggggatttcattaacatactctccttccccggtggacgcattgtttttcactcaaaaaaagcatatgctgctctaatcagttggaatatttgtctctttgctaaagcatgtttacatttcgatggagaaaacaccgagactttttcaagtctcacaagttatccagaactacgtaggtctgagttcctcattggaggatacgtaggagcaagagcctcgcttttgtcgaccgcaccgctttttgttaccatgactcaaaagctggtagcccgcggaaacaccttacggtctatccgcacctcgtcattcagtgaccccaagtgtgattga

SEQ ID NO: 3106 - DNA, 192 bp, Glycine max
  Peptide Sequence Number=SeqID_94791
atggagaataggatcgcgacggaccaagcgccaccccttcccagcgctaaacaagcagagaatgtcgctgcaaggccagcccagtatcctttgcgttcgcagtttcttttactattgtttgttttaaataagctcaagttaggcaaaacgctaacccataagaggggggagacatggttaatgcacccttaa

SEQ ID NO: 3107 - DNA, 60 bp, Glycine max
  Peptide Sequence Number=SeqID_94792
ggagtgatggttggacggaatgatcgtgcgatagcggatgcccttcaagccttagcttag

SEQ ID NO: 3108 - DNA, 528 bp, Glycine max
  Peptide Sequence Number=SeqID_94793
atggatttagatatatgggatgctatagaaaatgacctttttgtccctaaaaatagtataagagatcaaataattgataaaactagagataggtggagtggtgatgataaaagaaggttaaggaaaaagggaaatcaaagaagaccaaatttcaaccctgagaagaatttcaagaaggatgcaaaatcctctccaattccaagatgctatgaattcgaactgcgttgttcgacaccagttatcgcacaagacgaaatatcgttcaatgttttgatcaagaatgctaaagataccaaaaggaggggcaaaagggcctttttattgagtttccgggatcttggttcgcctaagatagcctatggctcgcctgggcccctaagttacttcagcctgaaggaaccagctcgcctgggcgagcctacttcaggagggtcccctttgttgttttgtgcatattcatctccttcttctatcatcggtaatcaactacataggtctgaattcctcatcgcacctgaggatacgtaa

SEQ ID NO: 3109 - DNA, 538 bp, Glycine max
  misc_feature (58)..(58): n is a, c, g, or t
  Peptide Sequence Number=SeqID_94794
gatccctaagcaggtgagggtgagaggtcatttagtgaagtttgatgaggataccttnaacacattcttgaagacccctgtagtgctggaagagggggagaacttgtgtacttattccaaatttgcactcctgaggcctgatcctcagaagttggctactaagctttttatcccagggaggggattcaagcttaatgctgatgggcagcctttgaagattttgatgaagaacatgaccattctagctcagacatggagcgttctctccttttctaacctcattcctacctcccacacatctgatgtcaccttggacagagccaagttgatttatggtattattatgaagatggatatgaacttggggtacctcatctcccaccagatctctctgattgcacagcatgacacatccagacttggattgcctgccttgatcacaactctatgcaaggctagaaaagtccagtcagattctagatccctggagaacttgagccctgccattaacttggcatatattaagaagaactgttag

SEQ ID NO: 3110 - DNA, 1011 bp, Glycine max
  Peptide Sequence Number=SeqID_94795
atgaagtgcttagagataacttgtcggcttaggagcccagctgctaagggtgatgcgtcttacataagccccaaaagctctgagctagcttgtgggcgaaagaagttgtctaatgtaaagggagattatcgagtgccgaggcccttggaggaccaaaaggttattcctattggtagttcctcctccttgaagactcgccttggggtttttgatagcaaatcctcttcttttgagaggatggtggactcacgctgtgttggcaaaagttcttctcgctttcgtaggagggatgaggtgtttagacattgtagagacttgttgaaagagaggaatgatttggaaggcagggtagagcatactgctaaagagaaagaaggtcttgttgcgatagtggcggagtccactaaggagcctgagcttgaggcgacaaaggagaaggaagccaacaaagagcttgaagaggagttgttgacgttcaagaaggaggtcatggagcaacacgagaaaggattttacaaggtcatcaggcaggctgggttcttcaccaaatgtttttacttgggtctttttgacccatttatggacgtgaaggatggtgaactgcttaatgaagaagaagtggttgttgcaaaggaggacatcgatgaggagcaagatgatggggataggccgtctatcttgatgagatcttggcaaaataagaagcaagacgttgacaggaatgcttaccaagggcggaccttggggaggctcaccaagggcagaccttgggtttttcgagcctcttggagattcaatcaaggacgtgttcgtcctatattttggcgagactcaccaagggtggacctttggcttgatgagcctttgaagaagcgaccagggatgcacttgtctaggattttggccttaaatcttcttcatcaatggagtcatttcattcttaaagatcaatcgcagcagaatggagaaggagaaaaggtgattggagacgccacttcaaggagaagatga

SEQ ID NO: 3111 - DNA, 498 bp, Glycine max
  Peptide Sequence Number=SeqID_94796
atggcgactcggggcggccaccggtggtcatgggtggtggagaaggaggtgttaggtagggctcgcttagcgggccaaaactcacttagcgcaattccctctcgggttggaattgcgcttagcacgcccttgctcgctcagagggttgaaatagtgcttagcacacccttctcacttagcaagacaccagaaggtgttacttttaaaagctcaatggtcagactatggagaaatgtcttaggaagctccagacaaaatttgaagatgatccaacggttaactaatccaggatcgcaattttacaagaataggtttagactcatcttctccttgaagtggagtctccagtcacctttcctccttctctattccattgccattgatcttcaagaagtaatggactccattgatgaagaagatccaaggcctataagctctacatggagctacattaaaactctcaagatttttctcaagaaaatctcacagaaaccctaa

SEQ ID NO: 3112 - DNA, 528 bp, Glycine max
  Peptide Sequence Number=SeqID_94797
atgtcggcgagctatctcctcctgaaaatctgtgtactcatcatccctgagccggacgcgtctctctttgtggaacgaccatcctttgatggcctcgaagcgctgctagtgctcggcgctcctgaaacggtggctatcaaactcgggggcggcactggtcccttcaactacagcgtccttcctagatctcttcgcggaaagctttttcgaagccatttcctgcggggacaaacatttggaaagttaatttacaaggaaataccaatcattacgaacaagagccaaacaacacttatatggcatgaaaatcaagggaatgggggcaatgtggcatgccccattactccagaatacaacctaggcctaaggccatcccctacaacccctcaattcaacgaaaacaagcaacaatccaaggataaatccctcacgttttttagcaaatacatgcaacttagagcaccaaaatacaccaatggaaagctagagagcccaagaatgaggtacttacttgttggagatgaataa

SEQ ID NO: 3113 - DNA, 630 bp, Glycine max
  Peptide Sequence Number=SeqID_94798
atgggtgatcaagaggagacgcaggaacagatgaaagccgacatgtcggctctgaaagaacaaatggcctccatgatggaggccatgttaagtatgaaacagctcatagagaagaacgcggccaccgccgccgctgtcagttcggctgccgaagcagacccgactcacttggcaactacgcaccatcctccctcaaacatagtaggacggggaagggacacactggggcacgatggcagccctcacctgggatacaaccgagcggcttacccttatggattgccgcccaactattcaccacccgtcttgcaagaagatgcgggccacattgcttctcctgtccatgaaagagagcctcctcagcagcccgacgaagtccacaaggaccctcaagattatgctcgaagggatgtcgagttctatcccccgatccccgaagggccagcaccaggcacgttgcctcaacccaacatcgcagcatcgccaatagttttgtccatggaagggccgcccccagcaactgaagaaaggaggaagctcgatctccttgaggaaagattgagggctgtggaaggatttggggactatccgtttgcagacatgacggatctttgcttagtacccgatgtt

SEQ ID NO: 3114 - DNA, 273 bp, Glycine max
  Peptide Sequence Number=SeqID_94799
atgcagagttcacaacgcgatgtctatcttggagcctacctaaatgggccagacaactaccttaaggggattattaacagtgctatcaagggtcttgatgatgctccacagcctaaatcaaaggcttctgctaggtggattgtcgtcaagggaacttttaggaataattgggaagcgtattttaacgatcctagaccattggagccagagagattaaaagcattgcgaatccagtgggcacagttttatctccgagttagacatcaggcctag

SEQ ID NO: 3115 - DNA, 321 bp, Glycine max
  Peptide Sequence Number=SeqID_94800
atgatttctagattgagtcaagaacaattcaagaatcaagagaaatttgatttcaagattcaagaatcaagaaaagactcaatcaagataaagggtacatcctttgtggtacaagtagatggtatatctacttgggttgttgtgactgagaacaagagatggtacatctcttgtggatcagttctaggggagggtacatccactaggttgttcaaagagaacaagggagggtacatcccttgtggatctttgcttgtaaaggattttacaaggttgaaaagaaatctcaatgaccgtaggtcgcttggggaatggatgtag

SEQ ID NO: 3116 - DNA, 789 bp, Glycine max
  Peptide Sequence Number=SeqID_94801
atggcacgcagagaccaattatggtcattctgcgcccttttgtcatccagaggcgtcgggcccgatgacatgcggagacaaattatggtcattccgcacacctttttgccattcagacatagttgtgtccgatggcacgcagagacaaattatggtcattctgcgcccttttgtcatccagaggtggcgggcccgatgacatgcggagacaaattatggtcattccgcacaccttttgccattcagatacagtcgtgtccgatggcacgcagagacaaattatggtcattctgcgcccttttgtcatccggaggcggcgggcccgatgacatgcggagacaaattatggtcattttgcacaccccttttgccattcagacacagtcgtgtccgatggcacgcagagacaaattatggtcattctgcgcccttttgtcatccggaggcggcgggcccgatgacatgcggagacaaattatggtcattccgcacacccttttgccattcagacacagttgtgtccgatggcacgcagagacaaattatggtcattatgcgcccttttgtcatccagaggcagcggacccgatgacatgcggagacaaattatggtcattctgcacacctttttgccattcagacacatttgtgtccaatggcacgcagagacaaattatggtcattctgtgcccttcgtcaatcgcggccgacaagcccgttgacacgcggagatttacatcatcttccgtgctcacaagatctgtcaatcgcggccgacaagcccgttga

SEQ ID NO: 3117 - DNA, 297 bp, Glycine max
  Peptide Sequence Number=SeqID_94802
atggaccattcttcttccatccagaatgtacttccaattccctctctttgtcctctaggtacctcaaaccaaaatgtcagtgaagttccatcttctccaccacatccgactgaagttgctcctccaccacttcttacatatcaacgcaggacacagccagttggttctacagctcttgaacatagtggtactagggaacttgttcctcttcctcctgacaagaagactgtgggttgtagatgggtctacacagttaaagttgggtctaatggtgagattgatcggcttaaggcttga

SEQ ID NO: 3118 - DNA, 441 bp, Glycine max
  Peptide Sequence Number=SeqID_94803
atgtggcaaaaggaaaaagaatccatggaccgaccccatcgtctccaccccgtagggaactacgagatcaccccaaggacgccttcggcatccagggggtcgcggaccgaccatagaaccctgttcaaaaagcggaaacgcattagctatccgctctcaggttggacatttgatctatgctatgatttatcattcatggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctggtga

SEQ ID NO: 3119 - DNA, 891 bp, Glycine max
  Peptide Sequence Number=SeqID_94804
atgggcgttcagcatcacgaatttgcgcacccctcttttatgttccaactcggcgatgccgagccagcgctcgatggcctcatcgtatcgcagcgtcttcgtgcccggcacattcatgtgttcgatggaatatccgaccggctccgctggcaggaaggagacgggcagatgaccgggcaaggcggcggcaaggcgggcgacgatgccttcagcaatcagagtatcggtctcgaagggcaggtgggggccatgctgttcatgcgcgccgagcggcagcacggaaattgcgcctgttgcgtgaagatgaggtccgcgcgagcattcggtaaggatttccagcaacatatatcggttccgccacagggtaaaaggcactcgcgtatgagcaaggacaaatccgggaacaaggacaaaagcgccaagaaggataagggcggcaagaaggtcaaggacgccaaaaagagggatgaaaacttcaacccggaggagttggcgcaatcgataacccaagccgcccgctccatgcgtaccgcgctcagccacagcctcgccgaaagcgggctttatgccggacaggacggcgtcatcctggcgctggcgcaggaaggcagcctgacgccggggcaaatcgcccagaagctgggtgtcaaggcgccgaccatgacgcgcaccattggccgcatggaagcccagggtttcgtggaacgcagcggtgacgacggggacggccgtgtgacgctggtgaagctgaccgaagcgggcctgaaaagcgtcgagcacatcaacgtttccatcgccaattgtggcgcgaaagctgtcgaaggcctttcggccaaggatattcgcaacattgttaaactcttgaaagccatagacgccaatcttcaataa

SEQ ID NO: 3120 - DNA, 429 bp, Glycine max
  Peptide Sequence Number=SeqID_94805
atggggtgtacgggcccgtacttagcccatgggcccaaaatctaccctaagactcataagaaccctagggccttctcttgcatctctggcccaatctacttggagtcttctatccaatacccttgcggggtaggattgcatcacggtatctacagcacttggttcgccagcgcggccaaccaccgggggcaggtgcagatacatgagtgtctctaccagctcagcctcagtcagcagggccagggtttcgttccttttgcgtgccctactccagatcagtttagggctgaggtcgcatggctcggagattggcctgaggcccaggcaggggaggcgcctacaggatccccgggcgatgcagagaaggcccgtatggatgaggagatgacggatttgctcggtttcttgggagggagcggagccacatga

SEQ ID NO: 3121 - DNA, 366 bp, Glycine max
  Peptide Sequence Number=SeqID_94806
cgaccctctaagaagagcttattggagctaacatcacacgatgctttgttggcacagtacaagttgccatctaagccacttgagatcctaacggttgtaccatgtgtggtgaagctcatgacacaggccaatgcatccccactgaagaaagcactcaagaaattcatttcatggggaatcagcagaggcaagggtatacccaaggaggattttcaggcttttagcaaggtccttataatcagcaaggacaatggaggacacaccctggcaaccagttcaataaagaccagggtggatcctcaaacaggccaattcaacaagggcctaacatcttttaaaggacgactaagttggaagagaccttga

SEQ ID NO: 3122 - DNA, 297 bp, Glycine max
  Peptide Sequence Number=SeqID_94807
atgactaatttttggagcttcggagaccccaaccggctaaagccaattgtcacagtatgggaaatttgttctaccacaaatgcatgtataataatagtcgttctgatacccggagcaaaagttatggccgttttaagttttgctaaaaacaagttcccaaaatttttgtctctctctaatactgccacaccaagtgcttatgaggatcaagctgaatgttttgatgatgccaaagtttcacatgcgtctcaaagctttattcaagacaaagaaattaaagatattcaagatggatga

SEQ ID NO: 3123 - DNA, 956 bp, Glycine max
  Peptide Sequence Number=SeqID_94808
gaaaacgcggccactgcaagagcccttgaacaagaaaccaaaagtgcccgcaaggaggaatatggccgagagaaattccgaggagcattgtggggtagcaacaatgagctcaagctccgaagagaggagagagatcggtcacgggtgcatggcatgatcttaaaagaagagttagttgcttgcacgaggtccaaaaggagtttggctcaacacttggaagccacggagcaaagcatgctagctatcatagggcaatacaaggaagagttgaaccagtttgtggcccatgaacaaaagctagtggcggattttgcacaagtgtatgccgaaaaagaagcaagagggagggtgattgatgcattgcatcaagaagcgactatgtggatggataggttcgccttgatcttgaatggaagtcaagacctcccgcgtctattagccaaagcgaaagccatggccgaagaacagatgaaggccgatctattggctttaaaagatcaaatggcttccatctcagaggtcatgttaaaactccagaaaaccatagaggacaaagccacggcaaccgcctccagtacggctagggaagcggagccggtgctgcaacccattttaaatccgggccgagacagaaacacgaccgtgtttggtcgaaggtatagtctgcaagcttatccttatggcttgcctccggacttcactccccgtgccaccccggaagatttaagccaagcccctacttttgaggggcaactcccgccttatgacgactatcccgggcaagatgatgagaaaggagatacccatcttggccccctgctccacctcaaagatccgtccccacatgaactaccccaaccgaacatagtccgccatatcccggcctcacccacacccgtaaaagaatctgttcccttcgcggaagataatggaaagattgaggcgcttgaagaaag

SEQ ID NO: 3124 - DNA, 198 bp, Glycine max
  Peptide Sequence Number=SeqID_94809
atgatgaaagaagaaagaagaagattcctccttagcccctgtcgcaacctacccttcggtgggagggcgacacagggctcacgggtacgtcttccatgggaggaaaatgcgcagagtcgccaccaacgtttattcgaggaaaacatcagaaaaaccggaaagggtgtttccctcgctcctacgtatcctcaattgtga

SEQ ID NO: 3125 - DNA, 216 bp, Glycine max
  Peptide Sequence Number=SeqID_94810
atgagggtgtatgatcaagggcttcccatggaccctaagagaataaaggtcatttctgagtgggctactccaccaagtataagggaaatttgggacttcaatatcttaacaaacttttacaaaagctccattggagcttgtaggcctatgatcttcttcatcaatggattcctttgcttcttggaagatgaatggaagcgaaatggagaaggatga

SEQ ID NO: 3126 - DNA, 203 bp, Glycine max
  Peptide Sequence Number=SeqID_94811
atgccgcaagaaatcggcgcttttagcgtctcttcctccgtttgtttgcttcctcgtttcgttcaagccgttggcggcggcggacaagccgttttcgaatcagcgttacaaatccgggaagcgctccggttgcgcaaacagcaggctatcgtcgactgtctggctattcctcaggtcaacgacagcggtgaccgcgtggactg

SEQ ID NO: 3127 - DNA, 1179 bp, Glycine max
  Peptide Sequence Number=SeqID_94812
atggatatgtgtaacgtagtgcatgcgttaaagcccattctgctaatggtgctggtgcaggttgcaaatgcttgggtcaatgttctctacaagctcgcgcttaacgatggcatgaacttgagtatcattgttgcttaccgttatgtttttgcaactgctttcattgctccacttgctttcattgttgaaagtggagcattgcctcaaaacttaaacatggaagcgattgctttaacttcagtaacgtttacaacagccatatccaacctcattccagccatcacttttatcatatccctctccttcggattggagagattaaatttaagaagagcaggagggaaggcgaagataattggaacaataactggaattagtggggcaatgctactgacattcattaaaggcccagaagttaagatgctgtctttccatgtaaaccttttcaaccaccgaaacggccatgtcgtacatccacacgctacttctggccttatgaccatatttggtgctctcgcttctgtcgcaagcaacgtctcttatgccatgtggcttatcattcaggcaaagatgagtgaaagatacccgtgtccttattcgagcacagcgttgatgtccctaatgggggcagtgttatccatttcgtttgctttttgtgttgaaagggatttgagtcagtggaggttgggttggaatatcagactattgactgtggcttatgcgggtatagtggtttctggagtgatggtagccgtgatttcgtggtgtgtacgcacgagaggtccactgtttgtctccatttttagccctctaatgcttgtggttgtggcctttgctggatccactattttggacgagaaactataccttggaagcatcattggatcaatgttgattatttgcggattatacgtggttctttggggtaagagcaaagagatgaagaagaatcaatctggtcagtcagaaagcacccataaatctgacacaattgaaataatggtcaaacctcgtgtagaagataaaagcaacaataagagcaataccctcattaactctgtaaatgtgacgggggataataaagattcatggaaaaatggacgtgaaagcaatgtatcacatatacactgctgcaaggtgcaagaagaagtaacatctcagaatgtctcacgtacctaa

SEQ ID NO: 3128 - DNA, 246 bp, Glycine max
  Peptide Sequence Number=SeqID_94813
atgttgggaaatttttctgctttcatagaagaactttggggagttttcgagggtttaaagttggctgctgctagcatatcagatttctggagtttcatattgattcaaaatttgttgttagtagcatctctaaggagtttgaaggttgtgcggacttgtgacacaggatgtgagtcaaaataccttaacattaagagtgcaattatgatagcagaaggctttttaaaagcatgttcaggagattag

SEQ ID NO: 3129 - DNA, 567 bp, Glycine max
  Peptide Sequence Number=SeqID_94814
atgggtcaaagagttcttgctagaccactaaaccgttattgcaagagaattaaaatacatataagcagggatatctacagagaaatatctgatgtgcatccagagaagtgtccgatgcctgtccaactacttagagaagtgcatgtggtgtgtccaagccccaaaaaaaaaattggacaccgcaaaaacgtgtcagacacggtgtccgccgcatgtccaagctgtgtgggtgttggaaacgtgtccaacacgtggacatggcattcatcggaagtgtctgtgtttcctagtttggaagcagttgctaaatgcaattgtattattattattatcaatcattcagaagtcataaaagttgatattagctgggaagcattgatcaaactagtgcagtggttttattctgatgatctgcctaatcctccttctggatgcttgtgggataataaggatgatgaagaaaagctattcaatctacaaccatatgtggagctttgttggcttgttgagttctggattttggaaaatattcaggaagcctgctggaatgtgattgtcttgtcttga

SEQ ID NO: 3130 - DNA, 5628 bp, Glycine max
  Peptide Sequence Number=SeqID_94815
gatgttaaccttgagagcacaactctacaaggaaagcaagaccaacacaaactgttcccgttcaacctccactacactctcctccaaccaccaccacaaggaaagggcgaccatgactccctaaggctccaactcaatgttaccacccatgtcggtaaccgagtgcgcatggcctccgacgccattagtgtcactgtggataaagagtttgttcccctgaactttgtgcttcccaaggccaagactccctcgccggcggaggaaatttcaccaaaatccggtgaaacaagctcgttcgccggtgagagcgagttcttgtggattgttggcgcgcttctttctgcttgttcttggattggatccattgaacttttccctctgcggatggcttctccctctgaatcctccctcatctccaagcttcagtcctccgattcccctggcatccacgccctagtctccgattacctccgtcccctctcagatctcaagcctaccaaaaaacccaaccccgaccaaaccctaattcgctcactcgccaagcgtttcctctccttcctcaatgcctccttatccctcctcccaaaacgcctccccgaggtttccaagtccaacgactctgacgccgtcttcctcctcgaattgctccgcgtttacaggctctgcctcgattgtttggacgtcgtcgcttctcagttggcttccaagccattctccgtcgagttgcagcgtcttcgcctcattcactgcctcgagtcatgcggcttgctcgaggaagcccaatctgagggttttggggttttggagaagcttcgacccgccaagacgaagggtaagcttctccctgaaatagacaagggcagtggagacgataaagaattgtgctatttggtcgttgatattgttgtgagcctcgtgaggtgtgcagccgcgggcttggctaaagaggatggccatttcaggaaggtgcttcagttggtggaggaagtaaacccttggcttaggacaccatttctggatagagactttgtgaccttgttttggtgtacgacattaactgaatatgtgaaatctcccatcaaagatcaagtctacaagattaccctcaggatatgctcatcattgtttgcactgagggataataactccctgtatatcatggatatactggactccatacttcgcgagtgcaaggttgaggagggaaacacaggaaaagactttgttgaacttgtatattactgtgcaaataaatgtcaaactgcaaatgcaagtttttgtagtacatttgcagcatatttgaacaaaatagcagaacatttcaaacaggtttcgacacccattaattcaatactgaggctttatgctgctggattgctccttgttagttgtaatttgagatccagaactggagatgttgcatcctctggctatgcaaaatttgagtgtttgcttggaactttacttgaaaacgagaaaatactacagaattcacccccattgctgggttccttgcatatttgcatcaaaagtaattgtatgtcgtccagtgtagaagaccaatgttttgctggtcccccttgcatactatcaggtttcgatgccgaggcctctatgacttacctgtcagtttacttagaggcattgaaatttctatgccaaccacttgctaaatcaattaattcagaaaggaaacagttagttaccgaagtggatgatgcttctgctatgactatgatgtccactgtccaagatgcattccatatcctttgtcatcttattctttctagtgcaagctccatgcctaaaaacaatggagatggatttgacgaaaagagtaaaacagtgcttaatttagttgtagcagccttcaccctttccatcagaaccaatcttaaagtccagtatctggcatttttcccgtttatgtttaggtttgcttcttcactctcactgattgttgtatggtatggtaatgatatgcagatagtatgtagacgtgctacgcaggtggatgagacaattgattctcttaccttgtatagcctgctgtcatcttctacagaattgtcaaagaggaataatgccatgatcttggagcaggagcttactgcatatgaggaaatgggttttaaatacccagaattttgccagaaaatgcaaatgaaaataacagacattctcctgcaagatatatatatcactccagatagtcgttttcaaaaggcacaaactctagtgagaaagggaaaggcaattagggttaggggcataggtggtctcagggactgcattcagtgtctgtcagaagcaataactattttgaaggagatttctggtgagatatgtactgataataatcccattgatcatcaattgtgtgtgacatattgcttgcgtgcaatatgtacacaggaagctgaagctaattcaaagcaaatctttgaagatgtcaaggctgctttggatctatggttgaacatttctcatcttaatcactttgaagagggagattgttctgcattatctgacaatataatgattctactctataatgtagttgatttattacaattgaagggtttcatggaactgttcaatgatgcatctcgattggtgattaaaatgtttaaaaggaagaatgtcccaattgagaagtggttgcccctaatgtgggaaagtagaagtctaagtcatgccctttgtgtttcgcctggaaatcaatcatcattgatagggtttcagcagaatttttctttcttgtttgctagctctcataagaattcttgcagtcacgggagctcttttcaaacggacatcacaattgctgaagttcaaaaagcagcacttgatctgatttcaaatgttcctgtcccaagtcattctacatttcttgctgggtgtcttttttatgatttgtgcccaagacttgttgcaaatggacagttaatagaggctctttcatctgcaaaagaagctcatagattacatgccaaactcttccaaaggaagtttacacatagtgttcagcagcagaatgaagagcaaaatgtaatagctgattcctcaaagaatctaatggatggtattgaaaatattggattgaacttatcagttgccagggaagttttgctatttgattctatatcatgggacttggaagacaattatcttagtgcatggaaagttatgcaatgctatcttgagagcactcttcaggtaggaatcatccatgaaatggttggagatggagctgaggctgaaacctatttcaagtggggcaaagccatatcctgttcactaaacctccctttctttttaattgttttttcttcctctttaggaaaactttatgttaagaaaagactttgggatttagcagaaaaggaactacggagtgctgaacagattttaaaggaaagcaacacactgttttgttgctcaaagtgtaaattgaagctcgaagtcactctgtatgagtatcttggagatttgtgtcaaagtaaatttgacacttgtgatggggttatgtctgaggagactgcaaaaaattggtatacatcagctctggataaactaaatctttctgagtggaaaaatcctcttagctgtccagaagttggcagtgatggaactgcaacagacataaaatgtcctgctggtaagacttgtacttgctttataatgaatgaagcagcaaaggttttaccaaaggaaccaaacttagtggttgagaacacatcaaggttaactcgttctagatatcgatctttgcagaaccaagatacaagcattcacaggaagttagaagtccatgaaagtctggaggggaatcatgtttctgattcatctgatatgcttagtcagaatgggtcagtttttagcaacataggttgcccttttccttcaaggcttgtgcctgataccactgtagatcttgcagagtatgtgaagaggtttttggctggtcttccatcaacgactataatcagtataagtttgcttggacgtgattatactagtttactacaggaattgttgtcttatcctacatgtgttcaagcatggatgctggtgtcaagactgagctttaagaatgaacctgttgtaatgttactgccacttgattctattttacaagcttcaggtgagggtgatctgagtactggttcggacacttttcctaagtgtgaggaacatagtgaaaaatggcgttgcccatggggttttacagttgttgatgatgtggccccagcattcaaaacaattttagaagaaaactacttgtcaacaatatcccctcttgaagatacaacacaaaataggatgttatggtggaagcgaagaaagaaccttgatcactgtcttgataaattactgaggaatctcgaagagtcatgttttggttcatggaaatgcttgcttcttggagaatggttgaactgcaaaaattttgacttggtgcttaagaatcttgtgaatgatttaagatctaaatgcaaattggatgtaaacgagggccttcttaaaattattctcggaggctccaaatatgtttgtgatgggaaaacattggtttcacaactatgctcaaagaaagattgctacattgctaaagtaggctattgtaatgaagcgagaagggggatattaaattccgccgatggaattggagtgtcatctgaggttgcttttgaactgttaagtgaggcattaaatgtgctggaagtggatgactccatgtatagagagcctataattcttgtgttggattatgaggtgcagatgcttccttgggaaaacttgcccattctaaggaaccaggaggtttatcgcatgccttccgtgagctgtatttctgccgttcttcataaagacagcaaccataaggagcaagtgggaaggaatttagggccctttcctttgatagatccactggatgctttttatttattaaatccagatggggatcttggtggcactcagattgaatttgagaattattttagagatcaaaacctggagggaaaggctggtttgagacccaccatcaaagaattggcttcggcattggaaagtcacgaccttttcatatattttgggcatggaagtggagggcagtacattcccaggcatgagattcagaaactagacaaatgtgctgctacgcttctaatggggtgtagtagtggttcattgaccttacctggtcaatatgcgccgcaaggtattcccctgtcatatctgctggctggttctccagccattgtcggcaatctgtgggaagtgacagacaaggatatagatcgatttggtaaggcaatgcttgatgcatggttgaaagaaagatcagatatgccaacagaatgcttgcaatgcaatttattgtctgaagaatttgaggccatgaacttgaagggctgcaagggtagagcaaagaggaaggctccacggaagaaattattagagttggctgagagtgagtcacccaagaactgtggtcacagacgcaaaattggagctttcatgggtcaggcacgggaggtttgcactcttcctttcttgacaggagcatctccagtatgttatggtgttcctactggaatttggaggaaaacgaatgtttag

SEQ ID NO: 3131 - DNA, 162 bp, Glycine max
  Peptide Sequence Number=SeqID_94816
atgggggaaagctttgtgaggcaagaaagaagaaagggaaaaaggaaaggcaggaaggaagaaaggttggtggaagggtgggtgccaataatgagaggaaagggagaaaaaaatggcggcgcaaaacttcacactacttcaccaaaaactgttggtccataa

SEQ ID NO: 3132 - DNA, 1836 bp, Glycine max
  Peptide Sequence Number=SeqID_94817
atggctgatgatggtgctgatccatttccgaagttgacaagtgtgtatagagtgtctggttccaaaaacaataagctgagctggaatgtagccaattctcagcaaagtgttgactccagtgtaaacaactcaaggcagttacagagcatttctgatggcagtgcttcaagatcctggttttctcaaaattctagaccaaatgcatgggaagttccaagtgtgattcagaagctgaggctggggaagcggggtaatgacggattgactaacaacagtaacctacaggacaaaagtaattctccagatgctctggctttgacgggaagtggaattttgaatgacagcaagttgcctcctgagtcagcaatatctccaacatcagagacatgtttaaattcatctgttgatgttgttgatacaactacatccaaggatttaaaaaatgttgaatgcaaggatgagagaatcccagaaccccattgtgaagacaatggatctgatattgtttttgatagtgatgacgattgttttttagacaacattgacttggataccggggagagaagccatgaacagtgcaaaaagagcaagtggctcaggaatttctttgataaattaaatgcactcaccaatgaggagataagttcattagacaggcagtggcattgcccagcatgccaagggggttctggtgctattgattggtacaaagggttgcagccccttttggatcattccagaacaatacaaacaacgagggcaagactgcaccggatgtttgctgaaactttggaggaagagtgtttcaggagaagagctccattaacaacggttggcgaagtccacaatatatgggagggtcttgataagaaagtcaaggatcatgaaatagtttggcccccaatggttattatcatgaatacaagatatgagcaggacgaaagtaataagtggaatggaatggggaaccaagaactcgtcgattgcttcagtgactatgctgcattgaaggctcgacactcgtatggtccacaagggcaccgagggatgagtgctttaatttttgaggaaaccacggcaggttatctagaagctgtgcggctgcacaagcattttaaagagcaaggaagagatagggaagcttgggattgctgtcaaaatccatttctcccaggtgggaagcgccaactttatggttacttggcttctaaagaagatttggatattttcaacaaacactccggaggaaagacaaaactgaagtttgaaatgagatcatatcaagagatggttgagagaaagataaaacatattaatgatgatagtcggaagcttgactattataagagcatggtagccaaagaacaaatcaaatcacaagtcggtgcagactctttatgtaaatcaagtgagaagttaagcatgacaactgaaaaaaaccgtgttgaccaacaggacaaggagatggatgcactagaaaaaaatttccagagccaaatccaagacattcaacaagccatagctgcaaaggaggataagtttgtgaaattacagctgcaggcaatgcaagaaaaagtgaaagagtcctgcaaagaatcttctgagaaagaggacaaggtggaaaatatctctagtttcctgaagcctcaagacaaggagatgaagcaattcgaggcagagagagagaaaattaaaaaaattcatgaagagaaaaagttggctctgaagaagaagcagtggcaagagcaggttgaacttgagaaggagttagagaatgaactgacgcagctcatggacaagtacaattgcaaccaatctcaagaaaaaaactgttag

SEQ ID NO: 3133 - DNA, 1246 bp, Glycine max
  Peptide Sequence Number=SeqID_94818
tgttgagagagagagtgtggtagtgattccagatgctttggaaatgggaaaaaatgaacaacaacatgttcaggaagaagggcaggttgagacatccttcagactggaaaaaccggtttcacagcttattccatatattgaaacattagaacatgatatgcacgacgaaatagctctaccaaatacagaggtggctctcctgtccatgcaccaaagtattccacctaactgtactgacgtggtgtttggtgttctctctgatccaatgaattcttcaataaatccagtgtccttgagtgtgctgaagtcatctttaattgaactgtttctcaagcaaatcaacctgactttgacatcatcaatatttgggaatgcatcaatatttgagatcttgaagtttcctggagggttaactgtaataccagtacagtctgcttatatttggcagatgccagagattttgtttaattttactcttaacaattcaatatccgaggtattggaaaattttgatgacttcaaggatgaattgaagtttggattgcgtctaaactctgatgagaatgtgtatgtgcaaataacaaatgcaaatggctcatcgataactcctccagtagtagtgcaggcttcagtcatgccaggctttgggagcctcttacctcaaagattaaagcaattagctcaaacaataacaggttctgctggcaaaaatcttggccttgataactcagtttttggcagagttaaagaagtcagattatcttctttcttgaagaatacactacatgcttcctcaccttctcctgctcctgctccatctccacagttaattgatcactctgagccatcaacttcaccacatcgtgctagtccttacactccaatatcaccagcagctgctgaacaacctccttgtttcgattgtgaagtaccctcacctgcaccttctatggtgcctgcgcatcctccagatccctgtctatatagtggcttccttcatcatccaatcccttcgccaaaatcttattctaaaccatcctttccccctgattattcacctgctgctgcccctacctcaaattctgctagccacaccagtgaggaagcttctgatccgtctcgtgaagccgaggtgtcccatggatccaagcttcggcagggtgaagagacgtctaataaactgaattttgggaattgtcttgtctgtgatggaatgctccttaaacccaggcttgggttcttttga

SEQ ID NO: 3134 - DNA, 879 bp, Glycine max
  Peptide Sequence Number=SeqID_94819
atgtgggcctcaggccatgtgacaagcccagaaaggggtccacaactgttaatgttgcatagaataatattccctgactccgttgtcccctttgctgaacagaaactcgctcctttaactcacatttttagattgaacgataagtggtgtcaaagatgctttcaactcaatgggttgaactatcttcaactgtcaaccggtgatttgacttcctcatggtcaactagtttctctttctttaatgggggaggagatggaggccgccgctatggaaaggctgggatgtccaactccaagatgtctggaaaagatccatttaatggaaggaaatggacagaaattctccttgctgccaatgttttattttatattgcacaacttgcaacccaaggcaagctattattgtggggagcaaaggtaaattgttattccttgaactcagttggtcctactgtggagagcttcagtggccctcggagatttcttgcagtttactttatctctgcaattgcaagttctgctacgagttattggttctgcagaatgcctgctgtaggtgcatcaggagcaatttttggactagttggatcagttgccgtatttgtattaaggcacaaagaccttgtgggaggtggtaaaaaagatttacaacacatagcccaagtaattgccctcaatatggttattgggctattatccactgggattgacaactggggacatttaggagggttggttggtggagttgctgcatcatggtttattggaccggcatggaaacatgaatccacatcaagtgatggaagaagacttttcattgacactgcaccaatgtataaactcttcaagattaaaagagtacctaagcaatggaaatag

SEQ ID NO: 3135 - DNA, 282 bp, Glycine max
  Peptide Sequence Number=SeqID_94820
atggagggtggagaggtctttatgagaggaatgtccttcatcttcatctatatggtggagggacctaagaaaggggatcaactgttgggaatatcctttcctaggctgtttctcaactctaataaaaaaaatgatatggttgcaaacatgggagggtgggaagggttaacttggaggtggaaatttgagtggcatagggagtggtttgaaagggagatggagcaagttaattttggtggactagtgcagaatgaaattttagacagaggggagggagactaa

SEQ ID NO: 3136 - DNA, 1146 bp, Glycine max
  Peptide Sequence Number=SeqID_94821
atgggaagtgagggatatgaacaggtgatgggtgctgatagggtgttttttcattgctcgattgtgacatttgcttcttcatgtgataaaagatggagcacacaatggttattcttagcaatttctgaggtaactgtacatgtttttgtatttagtgtgctagatggtgggaagcatttatattctctaaagatagcttttttgttgctgaggttcattgcttatgatcatgtgtcatcatacaggcgaaaaagtcgttctatttcaccaagaggtcacagaagtccttctactactccaagacgtcgtagaagccgaactccatctgctaaacgatacagaagacatagaagtaggagttcctcgttgtctcctactcgtaaatcttccagtccaagtcttgggtcagtagagcacaaaagtgccactgaaaaactaaagaaagaagaagagaagaaaagtggcgtgtttggttcacttctgattccattggatgtcctaatgctttatgctttcttttttcaaccaatgaatatctcctttgagccttgcagggaagtaggagcttacatggttatggacttagtttttatagcacacccactcagaaaagattggcctgatcctctgaatcacctccaagggggtctagtcatcaggcgtcaactagaagcagagttgaaattaatagaagaagagactgcaaagagagttgaagaagcaatccgtaagagagttgaagaaagcttgaaatctgaggaggttcaggtggagattgaaaggcggttggaagagggacggaagagacttaatgatgaagttgcagctcaacttgaaaaagaaaaggaagctgctattattgaggctaaacagaaggaggagcaagcccgtaaagagaaagaagatcttgaaaggatgcttgaggagaaccggaggaaggttgaagaagctcagagaagggaagctttagagcagcaaagaagggaggaagaaagatataaagagctagaagagatgcaaagacagaaggaagaagccatgcgaaggaagaaacacgaggaggagcaagaacgtctaaaccaaataaagttgttgggtaaaaacaaatcccgaccaaaattgtcatttgctcttggatccaaatga

SEQ ID NO: 3137 - DNA, 1149 bp, Glycine max
  Peptide Sequence Number=SeqID_94822
atgagtaaggtgaaaggtgtattgaatggttggtggtgcgagatgggggtagaaaagttggtgtctgaaaaagggaggaaagttgatgggtcaagaacaaagtcgaatgtgaaaatattcactcgcgttgtgggtttggttcagtcgctggagttgagaaggaatgccattaaaaacaaacttcatgctcaagtcgttataatcggtcaacactggtccgagtgctttgagccactgaacgccaagcacaatgttagtgtcgcacaatggaagtacatggaggtccattgtgaaggtgtggccctgtacaagcagattcaaggatttcatgaggcattcttgcacgaaattatgtgtgctaccgccgtccaccaagagcatgacattccgatgagagatccaacccaccatgcgcgggttgggtggattttggctaagttgcgggttaagttggttttcgggttaggtcgggtcatcaacattggggtaaggcgtttgaggggaaggggtgggggcttgactggtgacgataaaaggggtagagtggaagtaggggtggggacgagaacgggtaatggtggaggaaaattggtggtcgaaggtgggcgagggcgagagcctggacctcccggtgaatctcgaggtcgagcccggagacgaagcagctcaggagaaatgagggtgcccgaaaggtttgacccatcgaatcttggtacatcaagcttcattcgaggagggttactgatggttgtgcttggtgtaggtgtggctgaggacgaagatggggctagtttggccattgcttcctctaggtgctccaagtttgatttagaacgcgtggattcagccatgagggtcaatgaaagcaccgacgttggtgatgaaacaatcctccattggttgagagattgcataaaaactgttgttgtttggaatgctctcaggtgtttggcaacgggtggtcatggaattatcttctctccattgcgtgctggttcatctggaagtgcacgttcttgtgacacaactaagccagctctccaattagtgctgcaaggcaatggggtcgctgatatccttgcaaaacatggtgcaatggactctacctccttggtcacttatccctcacctcccctggagatgctatag

SEQ ID NO: 3138 - DNA, 2247 bp, Glycine max
  Peptide Sequence Number=SeqID_94823
atgggaagaagaaacggtggtaggtcccttcaagaaaccctccgtcgccgacttgagtcatgcaaatccaaatactccaccgccgaagaattcgccaaccatctccgttcaacttatcccgattaccaccgaaccaagcaccaaaccctaattcgatttgttcaggaagctcttcattccaccgccaagcttaatcacactcccacacccaagcactgcgacggcgacgacgatgacgacgaagaaggagaggctcaaagcgcgtctcgaaagcggcggaagaaaatcgatgggagtgaagagagattgcagaggatggaagcgttacacgtccgaagcaaggtgcagagatcttcctcatcgtcctctgcttcggagagcgacgatgaagatgaagaagaaaccgtgtcgacttcggaggacgcaatttacggggagaaggtggagcctgagtttgatttgatgaagacaatgctgcgaaagtcgtatacgccgaagaaggttgccgcggaggaaaaaaacgttgaattggaggtggggaatagcagtaaggacactcttgtgaacgaggaaaggaaggaagtgaagggctcaagttcgggttcggtttcgaacaggaaggacggaccgaggtttaaggatttgggtgggatgaaggaggttttggaggaactgaagatggaagtgatcgtgcctttgttccacccccaattgccaagacagttgggagtgagaccaatggctggcattttgttgcatggaccacctggctgtgggaagactaaacttgctcatgccatagctcatgagactggtcttcctttctatcagatttcagctactgaggtggtttctggagtttcaggtgcatctgaagaaaatattagagagctttttgctaaagcgtacaggtctgcgcctgctattgtctttattgacgagattgatgcaattgcatctaaaagagagaatttgcagcgtgagatggagaaacgtattgtgacgcaattaatgacttgcatggatcaatcaaataggcttcttcaaccagcggatgatgtggagagttctggtgatgatcatcatcctggctatgttcttgtaattggagctactaataggcctgatgctgttgaccctgccctaagaaggcccggccggtttgatcgtgagattatcattggcaatcccgatgaatctgccagggaggagatcctttctgtgctcacttgcgatcttagacttgagggtttatttgatctacggaaaatagccagggctacatcaggattcgttggtgctgatttggcggctctggttgacaaggctggtaatcttgctatgaagagaataattgatgaaaggaaacgtgaattatctcaagatctcacgagtgagcatgctgaagactggtggagggaaccttggtcggttgaagaaataaacaagcttgccatcaaaatgtccgatttcgaggaagcagctaataaggtgcaaccttcattaagaagagaagggttctcttccattcctaatgtaaaatgggacgacgttggagggcttgatcttttaagaaaggagtttgaacgttacattgtaagacgtataaaatatcctgaagattatgaggagcttggggtggatctcgagacgggatttttgctttatggacctcctgggtgtggtaaaacactgattgccaaagctgttgccaatgaggcaggggctacttttattcatattaagggacctgaacttttaaataaatatgttggagaaagtgagcttgcagttcgtacaatgtttagccgtgcaaggacatgtgcgccttgcatacttttttttgatgagattgatgctttgacaaccaaacgtggtaaagaaggtggttgggttgttgaacgactattgaaccagttgcttgttgagttagatggcgctgaacaacgaaaaggtgtttttgtgattggtgctacaaataggcctgaggtgatggatcgtgctgtcctacggcccggaaggtttggtaaacttctttatgttccacttccaagcccagatgaacgagttttgatattgaaagctcttgcaaggaagaaggctgttgatgcctctgtggatttgagtgccatagcaaaaatggaagcttgtgaaaacctaagtggcgcagatcttgctgcattgctacagatgagtgttgaagaaagttatccattggcctataatgaagagctgtatcttgcttga

SEQ ID NO: 3139 - DNA, 759 bp, Glycine max
  Peptide Sequence Number=SeqID_94824
atggacgaaagctccaggctttgggatgcttgccatgtactcaagtctgccatttctggaatggaaaattattatttagctgcctctaacatagcttcttctttggatgcttaccattattttactccacaactttcacgtcaggtcattcgagcgataaatgtttgtcaaagggagattctaggattggaagaggaaaacaggagcttgatggaaacaaggattgaaccgttgtctcaatgtttgattcagaacatctcaatggaatccaagttaaacggattcagtggattccgaggtgttctctatgcaatgcggagtgttagttcactgcttctgatgattctgcttagcggacttgcgtattgttggtcctcctcttgctttcaccaagggtacgatgggcacatggtttttggatccactggcttcatggtttcaatggcaatactgcagcagaaagtggcagaggagatagaccagaatattgaaggggggcagccagggattctgctgtttgagtttcaaaaagcaaagaatgccatggaggaactaaaactggagttggagagaatagcaataagttgttatgaagaagggcatgctgatcatgagatccaagaaaaaattcacaacgtcaagagttgctttgggttgttgagatgtggggtcgagactataacggggcaacttgatgatttctttgatgaaatagtagaaggaaggaagaagcttttggacatgtgcagtcataggtag

SEQ ID NO: 3140 - DNA, 3624 bp, Glycine max
  Peptide Sequence Number=SeqID_94825
atgggaatatgttgtttggttgctactgaaatgagacaaggtgaagccaattcgacccagggtcccaaggtcaatttgttgcagcatgccaatgctcttgagaatttctcctcccaagccaaatttttgagctccacttttctgttttctgtcccacctaagaagccgccacaccacgcagaaccaaaccctgggactgccgggtttgtatttcgacgaagtgaaactattcaaggttcacacagagtacaagtcgagaaggctttaactgctcattcaagtctacaaaattctagtaggatctatgtccaactaggaaaaacacaggttactcctcagcttcatgaagataggagaacaacttccttccatggacgctatgagaatgacagccggatatgtcctgatgtcactgtaactccgattgttaacaatcatagttctcggggtttggatggtttggtgaacaatcatactaattacacaggccaaatcatcaagtcttctaactgcatggctgtagatattgacgatgatgatgatgccatacttgcgccattacttaagtgtatcctaactgtttacatccatgtagatgctgatttctctctttttgtttctgtcctgcttttgactgtctttaagaacattgatgttgaccaaattgttgaggaacaccagtcaacttgcactcccaaaccatcaatatccaagtttcctcctataacaccaactgcagataaagataattttgctagacagggggataatgttttgccaccagagttgtgtttagattgcatccatggttacaagttagggttttgccctgaagcagcaagtcatttgcaggaaatgaaggataatctaattgcaatctctaatgagctgcttgacaatggtgaaaacctcaattctacacagatagcaaagcttcgccatgataggtcacagctcaataagcaaattcagcagcttgaaaaatatattcattctggaaatcttaatgaggaaaggcaaaagtcacatttttctgcatccacggcaccacctacatcttttgtgtatgaaacacctcagcaaactgtcctctgtaatggatctaagagatatgatacccaggcttatatgggtaatgagacatatgggtcatcgttccagtctcttccatctttttctgtagataattgtaacatgccattaggttcggtggggagggaagcgttcatcccaaagattattgaagttaattacattgaaggttctggagacaaacgctggagcagctacgattttccttggacaaaagagttagaggttaataataaaaaagtatttggaaatcactcatttcgccccaatcaaagagagatcattaatgcctcaatgagtggatgtgatgtttttgttctgatgcccactggtggtggaaagagtctgacctatcagttaccagctcttattcgtcctggtataacattagtaatttctccccttgtgtcccttattcaagatcaaataatgcacctattgcaggcaaatataccagctgcttacttaagtgccaatatggaatgggctgaacagcaggagatcctccgagaacttaattctgattattgtaaatacaagttattatatgtgacacccgaaaaggttgccagaagtgataatcttctacgccacttggacaatttacattttcgtgaattgcttgcaaggatagtaattgatgaggctcactgtgtgagccaatgggggcatgattttagaccagattatcaggttggagctttgggacttggtatattgaagcagaaattcccaaatactcctgttttagctttaacagctacagcaacagctagtgtaaaagaagatgtagtgcaagcacttggtcttgttaactgcatcatttttcggcaaagttttaatcgcccaaacttatggtattctgttgtccccaagactaaaaagtgtttggaggacattgacaaattcattagggtgaatcattttgatgaatgtggcattatctattgtctttcacgtatggactgtgaaaaggttgctgaaaaattacaggaatgtgggcataaatgtgcattttatcatggtagcatggaccctgctcaacgtgcttctgttcaaaagcagtggagcaaagatgagatcaatataatttgtgctactgtggcatttggaatgggtattaacaaacctgatgtccgctttgtaatccatcattccctcccaaaatctattgaaggctatcatcaggttttgcttctgttggcttacatgtatgatatatattttcctttcaggaatgtggacgagctgatacgagttaagcatatgttaagccaaggagcaatagagcaaagttccatgacatctggatacaaccgttcaaatatgataaattcaggaaggatactagaaacaaacactgaaaaccttgtgcgaatggtcagttattgtgaaaatgatgttgattgtcggcgccttctgcagcttgctcattttggggagaagttcaattcttcaacttgtcagaaaacatgtgataattgcttaaagatcacaagtttcattgagaaggatgtcactgagattgcaaatcaattggttgaacttgttaagctaacaggacagaggttctcatcatctcatatattagaagtgtatcgtggttccttaagccaaatggtcaagaaacaccggcatgagactgtgagccttcatggtgctggaaagcatctagctaagggtgaggcttcccgcatattgcatcatcttgttgttgaggattttcttggggaggaagtaaagaaaagtgatttttatggatctgtatcatcaatattgaaggtaaatgagcccaaggtccgtaatctgtttgcaggccagagaattatattgagattcccatcctctgtaaaggcatcaaaaccagggaaatctgatgcaactccagctaagggttctctgacctctgaaaagctgaatgttatgcaaattgaccctccttcacctcaaactgaagtggatcatacaaatctacttcagattctttcagctaagttatacaatgccctgcggttgttgaggaaaagtcttgttacagaagctggagagggtgtcatgcctcaccacatatttggtaatgctacattgcttctgataagcaaaagagtgccgagaacaaaagaagaactccttgatatcaatggcattggcaaggctaaggtaagcaagtatggggatcagttactggaaaccattgaaaaaaccgtaaatgaacattacaagttggacaacatcggtagcggtagcaaaggaagtgcagactctaccaaaaagagacgagtaccaaatggaaattcagatacaaatgttgaggatgatgacgcccccaccaaaagtacaggtcgttcaaagaaaaggacggtaaagagacaaaataggaaaggtgtgatatatgattctccagaggaagattattttcaaggatgccctgatgaagacctagattttgacatcatagaaattgatgcattagatcaagtgacttgtaaaaatactgcaggaagagtactacctcaatggacagcatcttga

SEQ ID NO: 3141 - DNA, 2844 bp, Glycine max
  Peptide Sequence Number=SeqID_94826
atgggtgatctgattgagttgagtgagcgggtgcgtgtgtatgtaatgggttatagatctgcatgtttagttttgatccttttcctcatccttggaattggaactggaattgcttcgtctgagactccgaggcccaaaaatgtccaagcttcccttggcgctaagtggtccggtactcctctccttctagaagctggtgagttgttatctaaagaagaccctcgccttttctgggacttcatcgacatttggctcaatgctgctgccgacgatcaatctcattccgcaaaagcttgcgtcatcgaaattctacatcacgctcgtcctcttttgagacaacccttagcgtccttgttcgagttctctcttattctcagatcagcttcccctgctctcgtgctttaccgccagctagctcacgattctcttgcgtctttccctctccaagatgctcgtgctcatgctgaaatcaccaaattagatcccttgcgtcttgggataagcctcaaaagccccggagggaagtgttgttgggttcacacttcccaaaacttgtttttcgatgtctcccaactgctctcatggcttcaaactcaaactccggtgggtgattcgtctcagagaccgcaactgtttgattttgatcatgttcattttgattcgagtgctggaggtccagttgctatactttatggcgcacttgggaccggttgctttaaagactttcatgctgcactggctgaagctgccaaacagggaaaagttaattacgtattgagaccggtgttgccagctggatgtgaaacaaattttggccactgtggctctgttggtgcaagcgactcagtaaacttgggtggttatggtgtggaacttgcttttaagaacatggaatataaggccatggatgacagtgcaattaaaaaaggttggaacaattggcatgctgtagagtgcagattactccttaaggagcgtaaacccgagttagcatctgagatcatgactttcagggattatctattgtcatcaactgtatcagatacacttgatgtttgggaattaaaggatctagggcatcaaactgtacagagaatagtccgtgcctctgatcctctacagtcaatgcatgatatcaatcaaaatttccctaacatagtttcttctttgtctcgcatgaagcttgatgattctgttcaagatgaaataatggcaaaccagcggatgatcccacctggcaagtctttaatggctatcaatggtgctttagtcaatgtggaagatattgacctttacctgttgattgacttggttcatcaggatctgttgttggctgatcagttctcaaaattgaagatacctcatagcactgtgcgaaaattgctgtcaacttcacctccttcagagtccagtatgtttcgcgttgattttcgcactactcatgtacattatcttaacaacttggaagaagatgccaagtacaaaaggtggaggagcaatttaaacgagatcttgatgccggtcttccctggtcagctacgtcacatccgtaaaaatcttttccatgctgtttttgttcttgacccagcaaccatttgtggtcttgaggcaatgaaatccctcatatttggaaccttgcagtccattgatacgatcatatcattgtatgagaataattttcctgtgagatttgggattgtgctgtattcttcaaaatccatcacgcggttagagaatcattctgccaaagaggatggagataaatttgaggaggatatatccgatatgattatacgtctcttcagttatatcaagggaaaccacggcattcaattggcttttgagtttttgagcaatgttaacaaattacgcattgaatcagatgatcatatagatgatgctcatcttgaactgcaccatgttgaaggggcatttgtggaaactatattgccaaaggtaaaatccccacctcaagagatactattaaagctgcaaaaggagccagagttgaaggagttgtcacaagaaagctccatgctcgtatttaagcttggtttgtctaagattcattgttctctgttgatgaacggacttgttattgatccaactgaggaggctttactaaatgccttgaatgatgagactcaaagaatacaggaacaagtatattttggacaaataaaatctcacactgatgtattagataagttcctgtcagaagctggcattcaacgttataatcctcggattatttctgataataaaccaaggttcatatctctgtctaagtttatttttggagaggcatctatactgaatgatattgactacttgcattctcctggaacaatggatgatttgaagcctgtgacacatcttcttgctgttgacatcacttcagggagtggcttgcatttgcttcgccaaggcttaaattacctgaaatacttgctttcatcagctgtggaagctgacagcatccaagcatttattgataaggtctgtgagcttgctgaggctaatgggttaccatctgatggctatagatctgccctcccagaattttctgcggatgaagtgagaaggcatttgagcaaggttgagaacttttttcatagggtacttgggtctgaatctagtgctaatgctgtcttcactaatggaagggtaacctatcctattgatgaaagcacatttttgagccctgatctgcttcttcttgaatcaatagagtttaagcagaggacaaagcacattttggaaattattgaagaagtaaaatggcaggatgttgaccctgacatgctgacaaggtttcttgatctttgctctaagtgtttttga

SEQ ID NO: 3142 - DNA, 1563 bp, Glycine max
  Peptide Sequence Number=SeqID_94827
atgtattcaggggtgaaagggttgttcaacagaagccagaaggtgaagggaacggtggtgttgatgcgtaagaatgtgcttgacatcaacagcataacgagtgtgagagggcttattggcaccggcatcaacataattggctcaacaattgatggtcttacttccttcttgggtcgttctgtgtgtcttcagttgattagtgctaccaaggctgatggaaatggaaatggggtagttggaaagaagacctatttggaaggtattattacgtcgataccaacattgggagcaggccaatctgcgttcactattcattttgaatgggacgcagacatgggaattcctggagcatttttaataaaaaattatatgcaagttgagctcttcctagtgagtttgactcttgaagacattcctaatcaaggaagcatgcactttgtttgcaactcatgggtttacaattctaaagtttacgaaaaggatcggattttctttgccagtgagacatatgttccaagtgaaacaccaggtccattagtgacatatagagaagcagaattgcaggctctaagaggaaatggaacagggaagcgcaaggaatgggacagagtttatgattatgatgtttacaatgatttgggcaatcctgacagtggtgaaaactttgctcgtccagttcttggaggatctctcactcatccctaccctcgtaggggaagaaccggtagaaaaccaacaaagaaagatcccaacagtgagaaacctggcgaggcttatataccaagagatgaaaatttcggtcacttgaaatcatctgatttccttacttatgggctaaaatctttaactcgaagcttcttgcctgcactcaaaactgtttttgatataaatttcacaccgaacgagtttgatagcttcgaagaagtgcgtgcactctgtgaaggtggaattaaactgcctacagatatacttagcaaaattagccccttacctgtgctcaaggaaatcttccgcactgatggtgaaagtgtcctaaagttttcagtacctgatttaattaaagttagtaaatctgcatggatgactgatgaagaatttgcaagagagatgattgctggtgtaaacccttgtgtgattcgtcgtctacaagagttcccaccacaaagcaagcttgatccctcagtctatggtgatcaaacaagtgtttacattgcatttgtggagcaggcgattaaggatcagagattattcatattagatcaccatgacacatttatgccatttttgagaaggatagatgaatctaaatcatcaaaggcttatgccactagaacaatccttttcttgaaagatgatgggaccttaaagccattggccatcgaattaagtttgccacatccaggtcaacaacagcttggtgcctatagtaaagtcatcttgcctgcaaaccaaggtgtagaaagtacaatttggctgttggcaaaggctcatgttattgtgaatgactcgtgttatcatcaactcataagccactggtctgaactctctcattctgatcattaa

SEQ ID NO: 3143 - DNA, 2586 bp, Glycine max
  Peptide Sequence Number=SeqID_94828
atgtcttcaatgatggtgaaggggaaggtggtgttgattcggaagtatgtgcttcaaaccatatccaatgccaaggagcttgttggcaatggcttcaacctaattggctcatcagtcgaatatgatattactaaatctgtgtttttcaacttgattagccgcaccaagtcatccaaggataattattcaaaagatggaaaggaggcctgtttagagaataatgcttcggtgttacgaagcttgggagggaaagaggaggaattcgacatttattttgaatgggatgctactgagatgggaattccaggagcattttacgtaaaaaaccatatgaaagatgagttcttccttgtgagtatgactcttgaatatccacttccaacatgtgaccgccacaaggacaaaaacagtatcattcactttctttgtaactcatgggttcacaatcatggatgctacaaaacgcatcatcgcattttctttgacaataatccatatctccctggtaatcaaacaccagaggcattacgaaagtatagagaagaagagttggataatttaagaggagatggaacaggagaacgcaaggaatgggataggatctatgattatgatgtctataatgatttgggctatctagatagtgatgaaaaggatgatcacccaatccttggaggcaccctctatccctaccctcgtagggttagaactggcagaaaactcctcaatgacaaaaatattaatggtggtaaatacgagaaacctgcagacaatgttatttatgtgccaagggatgaaaatttcagtctggagaagacaacagatttccttgaatttggaaagaaatctttatctggaaaagtggaacccttgctcctatctttatatttaaagctcacaccgaacgagtttaatggctttgaagaagtgcagagactgtatgatcaagaaggtggcataaagctgcctatatcgaccactatgggtactgaaaatgtccttaagtttccaacacctcatgtaatccaagctagcacatttgcatggatgactgacgaagaatttgcaagagagatgattgccggtgtaaacccaaatgtaattcgccttctaaaaagggaggatctcgcaccgcgaaggaggctagattgcaaatgtaatcatagtacaataacaaaagaaaaattggagattaacatgggtggggtcacagtagatgaggcattttgtaataagagattattcatattggattactatgatgcattcatgccatatttgaggaagataaacgagctagattctgcaaaggcttatgccacgaggacattcttgttcttgaaagatgatggaactttgaagccacttgctattgaattaagcaagccgcatcaatgtgtatatgtcctgccacatccaccacatatgcgtccatctccatttctacattattattttccgagccaagtggtgttgcctgcagacaaaggtgatgatggtacaatttggctattggccaaggcttatgttgttgtaaatgacaccaactatcatcagctcataagccactggttgcatactcatgcagtgatggagccattttccatagcaacacacagacaactcagtgtgcttcaccctatttataaacttcttcatcctcactttcgtgacaccatcaatatcaatgcacttgctaggcaatcgctgattaatgcaggcagcattatagagcaaacatttttgcccgggaagtactctatggagatgtcttcagctgtatacaagaattgggttttcactgaccaagcattaccaactgatctcatcaagagaggattggcagttaaggatcacacttccccacatggccttcgccttatgataaaggactatccttatgctgttgatggattagaaatatgggatgctattaagacatgggtccaagagtatgtcaacttgtattactctaatgataaggcagttgaagaagatactgaactgcaagcatggtggaaggaagttgtggagaagggtcacggtgacttaaaagataacgaatggcctaaaatgaagacatgtcaagagcttatagactcttgcactataattatatggattggttcagctctacatgcagctgttaattttggacagtacccttatggaggctatatcctaaaccgtccaactcaaagcagaagattgctcccagaaccaaaaaccaaagagtatgatgagatggtcaagaatcctcaagaggcttttttgagaacaattacaccaaagttccagacagttattgatcttacagtgatggagatattgtcaagccattcctctgatgagatctaccttggacagagggacactccaaattggacctctgatcagaatgcaaaagatgtatttgaaacatttacaaaaacacttgcagagattgagaaaaaaatctcagaaaggaacaacaaccaagagcttaaaaaccgaactgggccagccaaatttccctacactgtgcttcttcctaccagtgaaccagggttgacttttaggggaatccctaatagtgtctctatctaa

SEQ ID NO: 3144 - DNA, 2604 bp, Glycine max
  Peptide Sequence Number=SeqID_94829
atgttagggctatttgacaagagccacaagatcaagggcactgtggtgttgatgcccaaaagtgtcttggacattaacgacttgaattcagtcaaaaatggcggagttggtggcgttgtctctggtatctttggcgccgtcgccgacgtaaccggccaaatagttgatactgcaactgccatcttttcccggaacgtctccttcaagttgatcagtgctacctccactgatgcaaagggaaatgggaaagttggaaacgaaacctttttggagaagcatcttccgacgctaccaaccttgggagatagaagggatgcatacgatattcatttcgaatgggatgctaactttggaattccaggagcattttacatcagaaactacacctatgatgagttcttccttgtcagtgtcactcttgaggacattccaaatcatggaaccattcacttcgtctgtaactcatgggtttacaactttaaagactacgacaaaaaggatcgtattttctttgccaataagacatatcttccaagtgcaacaccgggtccattagttaagtatagagaagaagagttgaagattttaagaggagatggaacgggagagcgcaaggaacatgaaaggatctatgattatgatgtctacaatgatttgggtaatccagatgaagatgtaaagcttgctcgtccagttcttggaggctccagcacctatccttatcctcgtagggttagaactggtagaaaagccaccaagaaagatcctaaaagcgagagaccagcaagcgagctttacatgccaagagatgaaaaattcggtcacttgaagtcatcagatttcctcacatatggaataaaatcattatctcaaaagctcttaccttcgctcgaaaacgtttttgattcagacctcacatggaatgagtttgatagctttgaagaagtaagagacctgtatgaaggtggaattaaggttccaacaggtgttcttagcgacattagccccataccaatcttcaaggaaatctttcgcactgatggtgaaagtgtccttcaatttccaccacctcatgtagtccaagttactaaatctgcatggatgaccgatgacgaatttgcaagagagatgattgcaggtgtaaacccaaatgtaattcgtcttcttaaagagttccccccacaaagcaagctggatccctctctctatggtgatcaatctagtacaataacaaaagaacatttggagattaacatggatggggtaacagtagaagaggcacttaatggtcagagattattcatattagattatcaagacgcattcatgccatatttgacaaggataaacgcactaccttctgcaaaggcttatgccacaaggacaatcctgctcttgaaagatgatgggactttgaagccacttgctatcgaattgagcaagccacatccaagtggagataatttgggtgccgagagcaaagtggtcttgcctgcagaccaaggtgttgaaagcacaatttggctattggccaaggctcatgttattgtaaatgactcgggctatcatcaactcatgagccactggttaaatactcatgcagtgacagagcccttcatcatagcaacaaacaggcgtctcagtgtgcttcaccccatttataaacttctttatcctcactatcgtgacaccataaatatcaatggacttgctaggaatgccctaattaatgctggtggcgttatagaggaatcatttttgcctggacggtattctatcgagatgtcttcagctgtttacaagaattgggttttcactgaccaagcattaccggtcgatctcatcaagagaggaatggcagttgaggatccatcctctccccatggccttcgtcttgcggtagaggactacccatatgctgttgatggactagaaatatgggatgctattaagtcatgggtccaagagtatgtttccttgtattacccaacagatttggcaattcaacaagatactgaactccaagcatggtggaaggaagttgttgagaagggtcatggtgacttaaaagacaagccttggtggcctaaaatgcagactcgtcaagagcttattcaatcatgttctactatcatatggattgcttcagctctccatgcagctgttaattttggacaatacccttatggtggttttatcctaaaccgtccaactcttagcagaagatggattccagaaccaggaaccaaagaatatgatgagatggtggagagtccccaaacggcttatttgagaaccattacaccgaagcgccaaaccattattgatcttacggtgatagagatattgtcaaggcatgcttctgatgagatctaccttggggagagagacaatcctaattggacatctgattcaaaggcattagaagcattcaaaaagtttggaagcaagctggcagaaattgagggaaaaatcacagcgagaaacaaggattcaaataagaaaaatcgctatggaccagttcagctgccatacacattgctccttcctacaagtgaggaagggttgactttcagaggaattcccaacagtatctctatctaa

SEQ ID NO: 3145 - DNA, 1218 bp, Glycine max
  Peptide Sequence Number=SeqID_94830
atgggttcaacgccgcatttggagacaatatgccccaggtactcgacctgggcggttgcgaatgagcattttgagagcttgaggaagaagtggttggcacagaggacttcaaatgtagtctgcaagtggtctaagtgctccggcaaggtcgagcttggagaaccaggtggcaccgcccaactcatcgaggagctcgtcaattgtcgggttcgggaaacggtctttaatggtcaaagcattgagggctcagtagtcaacacagaatctccaggagccatctcgctttttgatcaagagcaccgacgacgagaacgggctcgtgctcgggcgaatgatgccttgttgaagcatcacagagacttaggcctcaatttcctatttctgagaataaggatatctatagggcttgacgttgactggggttggggagtagagacgaatatggaagaaatcactgatggcatcagtctggaccatgcggcggagctgtggggaagagatagcttcgaggtcacggtggcggaccaggcggttttgcacgaagttgtgcgtgctgccgccgtcgaccaagatgatgacggcatgggttgctattcggccgacaaggcggtctttgtctgcgataagaacgaaaaaacgcgaggcacaatgatgccctcgcgtggtggtttcggtggagttggtaacaaaggaagtggtgagggtgcaagggaaggtggagagagaggtctgggtggcgtgaccacggaatggccggcgagtgtctaccagcttctcctcctggagtcgtgcgagcccgatggcgtggacaatgaggccaacaatgcggttagccaaggcctcgaattgcgtcaggtactgagtgactgtccctttttgcgtgagcttgaagaggatcccggtagggtcctcgtatggagaatgcgcaaaacgggcctcaacggcttccagaaagcttggccaggtggtgagttggtggttacgggtgagccattgaaaccatgccaatgttgggccctccatgtaggaggcgatggggtccgagccatcaaagcgtgggacatcaagcttcattttgtgagcatggttgggttggcgacacggaggagtagatcctcgagcttgttggcaacatggatttgggtggctgctaatttggctatggcatcttcaatacggtctaggcttgctttgtcggggtcagccatgggagggtga

SEQ ID NO: 3146 - DNA, 5004 bp, Glycine max
  Peptide Sequence Number=SeqID_94831
atgggaattcctggagtgttctacattcagaattttatgcatgttgagttctaccttgtgagtttgactcttgaagacacataccttccaagcgaaatactgggtccactagtagagtatagagaagaagaattgaatactttgagaggagatggaacagaagagcgccaagaacattacaggatatatgattatgatgtttacaatgatttgggcgatcctgacaccaatgacagattgggccgtccggttctcggaggatccgacacgttgccataccctcggaggtgtagaactggcagaaaaccatctaagaaagatcctaaaagtgagagtcgcagcaactttgtttacattccgagggatgaatcatttggccacttgaagttatcagatttccttcctgagtttactagctttgacgacgtgcatggactctatgaggttggaattaagttgcctactgatgcactaagcaagcttagccctataacattgttcaaggaactcttccaaactgaaggcgaacaggcccttaagtttccaaagcctaaagtaaatcaagcggagcagtctgcatggatgaccgatgaggaattcgtaagagagatgcttgctggtgtaaatccaaccgttattatggcttcggagagcaagctagatagacagctctacggcgataacactagtacaataaccagagaacacttggagcctaacttgggtggcctctctgtagaaaaggctatggaaaacagaaaattgttccatctagaccaccatgatacaatctttccatatttgaggcgaataaacgaaactgacacaaaggcctatgctgctagaaccatccttttcttgcaagataatggaactttaaagccattggccattgagctaagtaggccacatcctgaaggtgataaatttggtcctgttagtaatcttaaccttccatttggctacttgccaaggcttatgtggttacacactcacgctgttgttgagccatttatcatagcaacaaacaggcatcttagtgtggttcatcctattcacaaacttctgcttccacactaccgtgatacaatgaacataaatgcagtagcacggaatgtcctggtgaatgcagagggtatcatagaatcaacattcttggggggaaaacatgctttggaaatgtctgctgttgcatacaaggattgggatttcctttggagttcactacctaatgatcttgttaaaagaggacgggctgatgcggatccatcttcgctgcacggtgttgttcgacttctgatagaggactatccctatgctgctgatggattagagatatggtctgctatccactcatgggtggaagaatatgtcagtttctactacaagtcagatgttgctattgcacaagacactgaactccaagccttctggaaagaagttagagaggttggtcatgctgaccagaaaattaatgcaaggtggccaaagatgcaaacttgttccactctcatatggactgcttcagaccttcatgcagctgttaattttgggcatgcttctgatgagttgtaccttggacagagagatagtgaattttggacttgtgatgcacaaccattagaggcattcaagaggtttggaaaaaagttggcagaaattgagcaaaagctcatccaaaggaacaatgatgagacactgaagatgtcctacacattgctctatccttctagtgaggaaggtttgataaacagggggcataaggtgaaggggacagtggtgttgatgcaaaagaatgtgttggacgtaaacgcccttacttctgccaagagtgtaggtggtatcgcgggcggtgcactcggtgttgtagggggtgtcattggtaccgcagtggacacactcacttcctttttgggccgatccgtggctctcaggttgatcagtgccactagttctgatggaagtggaaaagggaaagttggaaagcaaacatttttggaaggtattgttacctcccttccaaccttgggagcaggccaatctgcattcaatgttcattttgaatgggacactgacatgggaatacctggagcgttttacattgagaattttatgcaagttgaattcttccttgtgagtttgactcttgaagacattcctaaccatggatccatccacttcctttgcaactcatgggtttacaattccaaaaaatacaaaagtgaccgcattttctttgcaaacaagacataccttccaagtgaaacaccgggtccactagtgaagtatagagaagaagaattgaagactttgagaggagatggaacaggagagcgccaagaacatgaaaggatctatgactatgatgtctacaatgatttaggtgatcctgactccaatgccagattggctcgtccagttcttggaggatccaccaccttgccttaccctcgtaggggaagaactggtagaaaaaaatctaagaaagatcctaaaagtgagagtcgcagtgactttgtttaccttccaagagatgaatcatttggtcacctgaagtcatcggattttcttgtttatatacttaagtctgcatctcaaaatgtcatacccaaattacaatctgcacttaggctacagttcaatcagcctgagtttaatagcttcgatgacgtgcgaggactctatgatggtggaattaagttacctactgatacacttagccagcttagccctataccattgttcaaagaactcttcagaactgatggcgaacaggcccttaagtttccaacacctaaagtggttcaagcagtggagcagtctgcatggatgactgatgaagaattcacaagagaaatgattgctggtgtgaatccacacattattaaaagacttcaggagttcccaccaaagagcaagctagatagccagctctacggtgataataccagtacaatagccaaacaacacttggagccaaacttaggtggactcactgtagaacaggctatccaacacaacagattgttcatactagatcaccatgatacaatctttccttatttgaggaaaattaatgcaaccgacaccaaggcctatgctactaggaccatcattttcttgcaagataatggaactttaaagccactagccattgagctaagtaagccacatcctcggggtgataattatggtcctgttagtaatgtttaccttccggcaaaccaaggtgttgaagcttctatttggctacttgccaaggcttatgcagtcgtaaatgactcttgctttcaccaacttgtcagccattggttaaacacccacgcagttgttgagccattcatcatagcaacaaacagacatcttagtgtggttcatcctattcacaagcttctgcttccacactatcgtgacactatgaacataaattcactggcgcgaaatgtcctggtgaatgcagagggtattatagaatcaacattcttgtggggaggatattctttggaaatgtctgctgttgtatacaaggattgggttttcactgagcaagcactacctgctgatcttgttaagagaggtgtggctgttaaggattcatcttctccacatggccttcgtcttttgatagaggactatccttatgctgctgatggattagagatatgggctactatcaagtcatgggtccaagaatatgtctctttctactacaagtcagatgctgctattgcacaagatgctgaactccaagccttttggaaagaacttgtagaggttggtcatggtgacaagaaaaatgagccatggtgggggaagatgaaaactcgccaagagttgattgattcttgcaccatcctcatatggactgcttcagcccttcatgcagctgttaattttggacagtatccatatggaggttacatccttaaccgaccaactcttagcaggcgattcatgcctgagaaagggtctcctgagtatgatgagcttgctaagaaccctcaaaaggcgtatttgaaaacaattacagggaagaatgagacccttactgaccttacaatcatagaggtcttgtcaaggcatgcttctgatgagttataccttggacagagagatggtggtaatggttggacttctgatgcacagataatacaagccttcaagagatttggaaataagttggctgaaattgagcaaaagctcatccaaaggaacaatgatgagaccctgaggaatcgatatggccctgtgaagatgccttacacactgctttatccttctagtgaggaagggaaaattgatgcaaaaattggaagaaaaaaagcgttgaagaaaaattggaagaactggacagcttgcttaacacgcaatccaggcttagcgcgcaccctcgctaagcggaaaagctcaaggcttagcacgaagaaggcaaacgaggaagcccaaaggttagacacccatgcagatgttgagccattcgtgatagcaacaaacaggcatattagtgtggttcaccctattcacaaacttcttccgcaatatcgtgacacgatgaacatcaattcacttgcaaggttagtcctggacaatgaggagtctagaggagtggctgttgaggattcagcttcctcacatggcattcgtcttctgatagaggactatcattatgcttctgatagtgaactccaagccttttggaaagaactcgtagaggttggtcatgctaacaagaaaaatgagccatggtggccaaagatgcaaactcgtgaagagttgattgaactttgcacaactctcataagacagtatccatatggaggttatgtccttaaccgatcaaccctcagcaggggtttcatacctgagaaaggctcccctgaaggcaaagaatcagacccttacactcacagaggtgttgtcatttatcaatgcatgcttctgataatttataccttggacaaagagatggcggtggtgatagttggacttctgatgcacagatga

SEQ ID NO: 3147 - DNA, 416 bp, Glycine max
  Peptide Sequence Number=SeqID_94832
gttatggacagaggtatgtccatgatgtcatcgacaaacgggtgcaagtgaatgacattgtggatattgagggacctaagtctggagtgcttgaaaggatggagattgtggtgggggtggtggagttctctggaactatagagtcctacaacaactacgaaaacatgtcaacggattttagccatgcaacgattaagagcactagaactgagtattccttcaacaacctcgaatcaggcttgcaaactttcaggggcgcagagattctctatgttgacagatctagcgctaaacagattgcgtttagcttaccttgttggaaaccagaccgtgccgtggcccactctggaacacttagctccttcaacaacagcggaaccggatcccagactttcgacggtctcaagtttaactga

SEQ ID NO: 3148 - DNA, 2376 bp, Glycine max
  Peptide Sequence Number=SeqID_94833
atgacgtactttgggattaacatagcggatttctcgtggacttgtctgagagactttgatctcacttctttgtgctcccaaacgagcataatagacattttaaagctacttttcatcgctgtcttctacacgtctttgcttgtttctttaatcagaagacattccgaatgtggtagcaacagaaagaactgggttttcctagttgtctcagtttgttgtgctctcattagcattgcacatttttgcaatggcttgaagttgtggaatcagaagagctggttagcttctactttcagagcatttgtgtggctttctctaacaatttcattacatgttcagagaaacaaatggatcaaatctctaaactctatctggtgggcatcttcctgtgtattggcttcagctctcaacattgaaattatgttcaaagagcacacagttgaacttttcgaaatggtacaatggcttgtacatttctcacttctcttttgcgccttccaaaatctcccttattttgccacatccgaaggtatccaagatactactagtttatctgagcctctgatagctccgagagttgaaactaaacaaacgcaactaggccatgctacccttctcagtaagttgactttctcttgggttaattctttactcagactgggttactcaaagccactagctcttgaagaaatcccatttcttcttcctgaagatgaagcaaactctgcctaccaagacttcgtgcatgcatgggaatcccttctaagtgagaacaacaataacaacaacaacaacaaaaacttggttctttggtctgtagtaagaactttctcaaaggagaacatattaatagcactttacgcattaataagaagtatttgcatgataatttctcctctaatactctatgcttttgtaaactactcgaatagcactgaggcagatctcaaagaaggtttttccatactgggttttatgattatcagcaaagtggttgaatctctgtgccagagacatttcggttttggctcgaggcggtcagggatgaaaattagatcagctctgatggtggcagtgtatcagaaactgcttaagctctccagctcagcaaggagaaggcactcaactggagaagttgtgaattacatcgcagttgatgcatatcgattgggagaatttccatggtggtttcacataacatggacttctgcagtgcaacttgttttgtccattgttctcctttttggtgttgtaggtgccggtgctcttccaggtttagtccctcttctcatctgtggagttctcaatgtaccatttgcaaagatgatacaaaattctcagtcacaattcatgatggcgcaagatgagcgtctcagagcaacttccgaaattctaaatagtatgaaaatcatcaagttacaatcctgggaggataaattcaagaacttagttttgtccctacgtgctaaagaattcatatggctgtctaaggcacagatcataaaagcttatgggtcatttctgtattggatgactcctaccatcgttccttctgttgttttcatggggtgttctcttttcgatagtgctccattgaatgctggaatcattttcacagttcttacgacattgaggataatgggagaacctgttcggttgatccccgaggctctatcgattatgatccaagttaaggtctcctttgatcgtctcaatacctttttgctcgatgaagagttagatagtattaatggttatggaagaaatataaagcaaagttcagttaatgcagtagaaatccaagctggcaatttcatttgggatcatgaatcagtgtctccaactttaagagatgtgaatttagaaatcaaatggggacagaaaattgcagtttgtggaccagttggagctggaaaatcatctcttttgtatgcagtacttggagagattcccaagatctcaggaactgtgaatgtaggtggcacaatagcctatgtttctcaaacttcttggatacaaagtgggacagttcgggataatatactcttcggaaagccaatggacaaaaccagatatgagaatgctactaaagtttgtgccttagatatggatatcaatgattttagccatggtgatcttaccgaaataggccagcgagggattaacatgagtggaggacagaggcaaaggattcaactagctcgagcagtttacaacgacgctgacatctatctccttgatgatccattcagtgcagttgatgcacacactgctgctattctgttcaatgactgtgtcatgactgctctaagagagaaaacagtcattctagtgactcatcaagtggagtttctcacagaagttgatacaatcctg

SEQ ID NO: 3149 - DNA, 477 bp, Glycine max
  Peptide Sequence Number=SeqID_94834
atgaagggaaagattccagagattgtgggctctcacatcttatctcgggttcttcagacttgtgtcaagcattgttcacaagctgaaagagatgcagtatttgaagagctttggccacattttctaactctagcatacaacgcttatcctgttcactcagtgaagaagatgctcaacaacaggtcaccttttcttctaattggtcattctccattttcagcttcccagaaacaactagcaggctttatctccactctccgtggtcatgttgctccccttcttcgccatatggttggtgttaaaaatttgaatgttcagcttttagccaaagttgtcaacttccctaataagttttgtgtatctacatattatgcagttcttgagcatgcttatgagttagcaaatactgcacagaagcaagaactgctttcggaattatactctacgttattgctattgcaagtgatatatatataa

SEQ ID NO: 3150 - DNA, 1245 bp, Glycine max
  Peptide Sequence Number=SeqID_94835
atgagtgttctgttccgtgttcgcattcatgacaggtcaacaactgagaagggtggtggcaagagtaagagacagtggaagctatggaagagcacttcagaagggtttgggattggatcatcaatgcataaggggcaaggtggtggtggttcctttgtggtagatggtggagcatttgctgctgctttggctgctgtggtcagaactccactcaaagacttcatggtcatcaagcaggaatgggctgccattcgtatccaggcagtgtttcgaggtttcttggcaagacgagctttgagggccctgaaggcagtggtgaggttgcaagctatatttcgtggttggcaagtgagaaagcaagcagctgttactctaaggtgcatgcaggctcttgtgcgagttcaagcacgtgtcaaggcaaggaatgttgggaactctcaagaagggaaatatgcacggtgcaatgaagctgatcctgttaagcaagctgagcaagggtggtgtgacattccaagaactgcggaagaggcaaaattacaaatgaggcaggaaggagcaattaagagggatagaacaaaggcatattctcagtctaagaagaaattgacagcgagtccaaactcaagagcttctaagtcagtgattcctctcaagaaccgcaagctagacagaaagagctcgggatggaacatgctagatcgctggatggctgcaaagccatgggagagcaggtcaatggtagagatgtatttggactcacctgtcatgactccagtgaccagtaaaagtgatcatcttgttcttccctttaattcgaatcaacaaattggcacggtcaaagcaagaaggaatggtgtgacaactaggatttcaactaaatctcttacaactagtcaatcaactccatcatcttcagccataagctctgaatgcatgtatgatgatagccctatgtcaacttcatgcacatctggatccccagctcgaccatctaacaacaatgttacagtggaaccaacagaggaaacaaatgcttgtaaaccaagctacatgaatctgacagcatcaaccaaagctaaactgaaaccctgtaggtgtttttctcagaattcaaagacaatctttatggatgattgtgtgtcactaagtggagttactagaagcagttctggttcctacccttctgctaatacatggaagaatctctatgcaacacctctaagaacaagttatcaaagacaatag

SEQ ID NO: 3151 - DNA, 1170 bp, Glycine max
  Peptide Sequence Number=SeqID_94836
atgacgacgtcgtccggttccctaaagaacacgattcccccaggcctccaagaagtgcttctcaacagaaaacgcccccaacaagaacccaacaacaatgccggaccctcttcctccaccgaggacgctgccatcgccgacgattgctccagctccaactccaagctcatcgtgctggtcaccaacagtgacagcattgagtcaccgggccttacattcctcgtcgaagccctcgtgcgtcagggcctctacgacgtccatgtctgcgttcctcaatcgtgggtcccaccattcctctcccaaatggacaaatcggcttcgggccactctgtcactcgcggagaaaccgtcgaagcttgttcggtacaaattaatggcgccaccgcctttgaagtttcaggaactcctgtggattgcgtttcactagcgttatctggggccttgttttcatggtcaaagcctgtgctggttattagcggaattaaccagggatcaagctgtggtcatcacatgttttactcaggtgctgttgctggagctagagaggcgttattatgtggtgtaccttcattgtcaatatcattaaatcggaagaaggatgaaagtcaagagactgatttcaaggatgcagtagtactctgtttacctttaataaatgctgctatcagggatgttgtaaacggaactttcctcaaaaactgctttctgaatatagaaattcctaaatcacctttaaccagcaagggcttcaaattgaccaagcaaagtatgtggagatccactccaaactggcaggcagtttcaactagccggtatcctcctggtcatttcttggccagtaaacaaggctttggtcttcagtttgcacagattggccgagatgcctctgctgctggtgcagctcggagattaactacacagaaaaagaatttggagattgttgaatcaattggagctgccggaaaagctgattccaacagggtgaagaagtacttcaggctagagtttttggataaacagcaggaagatatagatgatgatctagattacatggcacttgaaaatggatttgttgcagttactccactctctctttctcttcatactgagaccgatattcaaatggcagcttctgattggatttcatctgtgctttctggtgaacaatag

SEQ ID NO: 3152 - DNA, 249 bp, Glycine max
  Peptide Sequence Number=SeqID_94837
atgtcttacaaagtagagtggcaaggaggtgctgggagtggttgttgggttgggattttagagaatgctgattgtagtcttctttttgagcagagtgatggtttgtgtgatgatcaaagtagctgccagcttgctggtattgataattgtgttacagaggaggctactagggaggggatactttgcagaggaggtttggctcatgctgaggttaaagttaaccccaatacttggatccttatgatctga

SEQ ID NO: 3153 - DNA, 1593 bp, Glycine max
  Peptide Sequence Number=SeqID_94838
atggagatgaagggttttatgttccaccaccaacagcagcaacaagtagtagtggaggaaaacatgtcaaatttgacttctgcatctggtgaagctagtgctgcttcctcaggtaacagaactgaaattggaaccagttacatggctccaccaccatctcagactcaacaatcaaagaaaaagagaaacctccctggcaacccagaccctgatgctgaggtaatagccttgtcccccaagagtcttcttgccacaaacaggttcatttgtgagatctgtaacaaaggatttcaaagagatcagaaccttcagcttcacagaagagggcacaatttgccatggaaactgaagcagagaacaagcaaagaggtgaggaagaaggtgtatgtgtgtccagagccaagttgtgtacatcatgacccatcaagggccctgggggacctaactgggatcaagaagcacttctgcagaaagcacggtgagaagaagtggaaatgtgacaagtgctccaagaagtatgcagttcaatcagattggaaagctcactccaaaacctgtggcactagggagtacagatgtgactgtggaaccctcttctcaaggagggacagtttcataacccacagagctttctgtgatgcattagcagaggagagtgcaagagccatcacaaacccacttcttcccccacaacaacaacaacaacaaccttcttcttcctctcaccaccaaatgagtactctccaaacccaattcaaccctcaaaataacctccatgccttcccattgaaaaaagagcagcaaagtttcaatgttaggacagaaatgcccccttggcttggcccaccagctgcaacagtagttgttgatcatcaccatcatcatctctcctcatcatcctcatccataatgttctctcctcctcaccaagaaaaccctaatcctaaccctagccttggtcccactcttgctgcctacaaaacagtcgctaaccccccacacatgtcagccacagcattgctgcagaaagcagctcagatgggtgcaaccatgagcagaagtggttcctcaccagccatgactgggccccaccatcatgctcacgtgtcctattctgctgattctgccagtgctcattttgggttgaacttgtcctcacgtgaagacaccaccacctcaacaacaacaacaacaactactaaaactgctacagtgttcagccatggcttattatcatcaccattggggaataaagctggtgctgctgtgtcttcttctgcaccatcccttcttcatgatgttatcaactctttctcagtttctccttctgcctttgagggaaccccttttgaggatgcattcattcagagctcaaagaaactcgatgatgatgatcatcataacttgtatttgcatgacacattctcaaaaacaagtagtagtactggtgcagctggaaatattaacgaagggttgactagagatttcttgggtcttaggcccctctctcatactgatattctcaccattgccggcattggaaattgcatccatgatcaccaaaatcagtctcaaaagccatggcaaggttag

SEQ ID NO: 3154 - DNA, 3414 bp, Glycine max
  Peptide Sequence Number=SeqID_94839
atggctgcttctaattctgccgctgttgttggtaatgcttcttcctctctctctctctctgttaccaaaaagtatgatgttttcatcagctttagaggagaggacacccgcggtgacttcacaagccatcttcatgccgctctcggcagaagcagcatcgaaacctacatagactacagaatccagaaaggagaggaggtttgggtcgaactcgtgaaagccatcaaaggctccactctcttcttggttatcttctcagaaaactacgcaaattctagttggtgtttgaatgaactggttgaactaatggaatgcagaaaacaagaagaagaggttcatgtaattccagtgttctacaaaatagacccatcgcaggtacgcaaacagactgggagttatcgcgccgcagtcgcaaaccaaaagtggaaggacgctctctatgaagcagccaatttatctggcttccattctcacacatacaggactgaaactgacttgattgaagatattatcaaagttgttttgcaaaagttaaatcacaagtacacatatgactttagaggccttttcatatctgatgaaaactatacaagcattgaatctttattgaaaattgattcaatggaagttcgagtcattggaatttggggcaaaggaggtattggtaaaacaactcttgctgctgctatttttcataaagtttcttttcagtatgaaggcacttgcttcttagaaaatgtggcagaggaatcaaaaaggcatggactaaattacgcatgcaacaaacttttttctaagttactaagggaagatattaatattgacactaataaagtgataccctctaatgttccaaaaagactcaggcgtaagaaagttttcatcgtactagatgatgtgaacactccacaacttctagaaaatttggttggagcaggtgctgagtggctaggagctggtagcagagtcattgtgacaaccagagataggcatgtacttaaaagtagaggtgttgaaaaaattcacgaagtcaaggaaatgaactttcataactcccttaaacttttcagtttaaatgcctttggcaaaacctatcctacagaggaatatgaggagttatcaaaaagagtaatggtttatgccaaaggaatccctttagctttgaaagttttgggatcatttcttcgttccaaaagtgaaaatgaatgggatagtgcactgactaaattaaagaagattcctaatcaggaaattcagacagtgttgagattgagctatgatggattagatgatggagacaaaaacatttttctagacattgcttgtttttttaagggacaaaaaggagacagtgtgacaaaagtgttaaatgcctgcggtttttctgcagatatagggataaaaaatcttttagacaaagctcttatcactactactacagatatgcatgattctactacagatagttgcatagatatgcacgatttgatacaagaaatgggtagaggaattgttcgtgaagaatctattgacaatcctgggcagcgcagtagattgtgggatcctgaagaagtcaatgatgtactgacaaacaatacaggaactggtgcaatccaaggaatatggttagaaatgtctcaaattcaagatataaagctaagctccaaatcattcagaaagatgccaaacttgagattacttgctttccaatccctgaatggaaactttaaaagaattaattcagtgtaccttccaaagggtcttgaattcttacctaaaaaattacgatatttggggtggaatggatgtccattagaatctctaccatcgactttttgccctgagaagcttgttgagctttccatgcgatacagcaatgtgcaaaaactttggcatggagtccagaatttgccaaatctagagaaaattgacctttttggctgcataaacctaatggagtgtccaaatctgtctcttgccccaaaacttaaacaagtatcaataagccactgtgaaagcttgtcttacgttgatccgtcaattttgtccctcccgaagctagaaattttaaatgtgagtggatgcacgtcgcttaagagccttggcagcaatacttggtcacaatctctccaacatttgtatttagaaggatcaggtttgaatgaactgcccccatcagttttgcatataaaagatctaaaaatctttgcctcttcaattaattatggtcttatggatcttcctgaaaacttttccaatgatattgtactctctgcaccaagggaacatgatcgtgacactttcttcaccttacataagatactgtatagttctggcttccagtcagtaacaggtctaactttttacaattgtcaaagcttgggcgaaatcccagacagcatctcgctgttatcgtcattgctattcttaagcttcttgcatagcaacatcataagcttacccgaaagcctgaagtatcttccaagactccatcgtctttgtgtcggtgaatgtaaaatgcttcgacgtatacctgcacttccacagtccattcagtgcttcctcgtctggaactgccaatctcttcagacggtgctaagttcaacgattgaaccattggaatcacccaacggcacttttctgcttgctaactgcataaaattggatgaacattcatttgatgcaataattggcgaaccaccaccatcagaagtattagaagatgcattcacggataattatatttatcaaacagcaaagctttgctactctttaccagctagaagtggcaaagttcgagagtggttccattgccacttcacacagtctttggtcactgttgaaattccccctaatctgttgggtttcattttctacttggttgtttctcaagtcaaattatgccacattggttgctgtggaagtataggatgtgaatgctctttggaaaccagccagaatgaaaggatcagtataacaagtttcgttttagataaaaattccatgcttattcatccacttccatttgaatttatgacagatcatgtgtttgtatggtatgatggacgaatttgcaagcagataatggaactagttaaagagaggagagccattagcagtggtgatccaaagcttagatttaaattcttcattcaaacccgacataaccaggaagcagtgaacataaaagagtgtggatttcgttggatttgttcctttgaagaaggaggatgcaagcccgagagaagcagggaaattcatgaagtagaagccaatgtggtcacaaataaagtggagggctctgagtctaatgagcaaaaagaaacttcacacttgaaagcagaagagacagaagacttgagttatcgtcttgaagaaatcatgcatattggatttggaggagaccgcatgtaa

SEQ ID NO: 3155 - DNA, 2334 bp, Glycine max
  Peptide Sequence Number=SeqID_94840
atggttttaagtgaagcaaatagtgagacttgttgttcaactcagcttattgatggagatggtacattcaatgtttctgggcttgaaagtttcatgaaggaggtgaagttggctgaatgtgggctttcgtatgccgtagtttctataatgggtccacaaagtagtggcaagagcacgctattaaataatttgtttggtaccaacttcagagagatggatgcttttaagggaaggtctcaaacaaccaaaggaatctggatggctagatgtgctgacatagagccttgtacacttgtgatggatttggagggtacagatggaagagaacgtggagaggatgacactgcttttgaaaagcagagtgctctatttgctcttgctgtctcagatatagtgctaataaacatgtggtgccatgacattggccgtgagcaagctgcaaataagccacttttgaaaactgtttttcaggtcatgatgagattgtttagtccacgaaaaacaacattgctgtttgtcatacgtgataaaacaaggacaccacttgaaaatttagaacctgttttgcgagaagatattcagaagatatgggattctgttcctaaaccacaggcccacaaggaaaccccattaagtgaatttttcaatgttgaagttgttgctctttctagttatgaagaaaaggaagagcagtttaaagagcaggttgccagcttgcagaaacgattccatcattctatcgctcctggtgggcttgcaggggatcggcgtggagttgttcctgcttctggcttttcttttagttctgagcatatatggaaagtcattaaggagaacaaagatcttgaccttcctgcacataaggttatggttgcaactgtacgatgtgaagaaatcgcaaatgagaaatatgcctcttttgttgcaaatgaggattggtgtcaattggaagaggctgtgcaatctggtcctattcctggatttgggaaaaagctcagttcactccttgatacttgtttttcagagtatgatgctgaagccacctattttgatgaaggtgtgagatcttccaaacaaaagcaactacaagaaaaattgttccaacttgtccaaccagcattccaatctgcgctgggacatataagatctggaactttggataaattcaaggaggcatttgacaaggctttgaagggaggggaagggttttctgtggctgctaataattgcatcgggtctggtctggttcagtttgatgaagcatgtacagatgttgttattgaacaaacaaactgggatacatctaaagtacgagagaaactgctgcgtgatattgatgcatatgttgcaactgtacgtgcaaccaagatttctgaacttacttcatcatatgaggaaaaacttaaacaagctttgtctggacctgttgaagctcttttggatggagctaatagagatacttggccatcaataaggaatcttcttaggcgtgagactgaatcagctgtttcagggttctctgctgcacttactgggtttgatatggatgaagaaacaaggcagaaaatgattttgagtttagaggcttatgcaaggggtctggtagaaggaaaggctagggaagaagctggaagagttctaatgcgcatgaaggacaggtttacaatgttgtttagccatgattctgattcaatgcctcgtgtttggacggggaaagaagatatacgagccatcaccaagactgctcgctcttcttctttgaagttgctatctgttatggctgcaattcgtttggatgatgatgacactgacaatattgagaaagtgttagcagttgccttggtggattcgtcaccaagcagtaatgctacaaggagcatcacaatggttgatccactagcttctagcagctgggaacaggaggccaacaagcgcaacaacaactggttacctcccccatgggcaatagttgctttggttattctgggatttaatgaatttatgacacttctaagaaatcccttgtatttgggtgtaatctttgttggttttcttctcattaaagccctatgggtgcagcttgatgtttcgggtgaatttcgcaatggagctcttccaggaatcatatccttgtctagcaagtttattccaactatcatgaaccttatgagaaaactagcagaggagggacaaaaccctgcagctaacaatcctcagagaaccccatcaaaaaacagttacaatgatggtcatgctgtgtcatctagcgcctcatctaacttgactgcattggacaacggaactgagtatgcaagtccattaaaagatgagtag

SEQ ID NO: 3156 - DNA, 576 bp, Glycine max
  Peptide Sequence Number=SeqID_94841
atgacttccccaccccctgaatgggttgtgtttaagaacttattcggcttcaatctcactggactcaatagtaaggcaactttggatgctcaaggtcaagaatcctggtcaaaagctgcttgctgcaggaaattctggcagacagagattctcaatgatgcttctgactttggtgactatgaagtgctctatgttcattatccaggccttccaccatctccaccttcaaatgttcatggtatagatgttgcatcataccctggtcacggcaacaacggaacaatagtgaaacctttgggagtagatatctcagggaagaaaaaagaagggggtggtggaagaatggttattatgatcgagctgtcatcttttactgcctttgttctattcattggagttgcctggctttgtctcttgaaatgtggttcttgcactctcgaacctgaacaaattccagatgacaaaatttcatcctcttcaaagcaatcaggctacaggtggctagtaggatgtggcagtgaagattctcaaaagagaggactagcatggtcaccatcaattctttgtagaagctaa

SEQ ID NO: 3157 - DNA, 288 bp, Glycine max
  Peptide Sequence Number=SeqID_94842
atggcagtggacgtgcagtggccgacgacggccccatggccagatcggaggctcgcgcagccatgggacctaggtcggagcactgtgacagtctggcatagagggggtgggtgggggaagaagagaggggcggtgcggaagggtgacgaagagattccgaacattggtgtatctcgtggtgctcattccgactttgatatatacctccaaacaagacgttatatgtatcaagaaggttcatcaacaacttcaaataaacttagtaaagcatatttgagaatgttttga

SEQ ID NO: 3158 - DNA, 600 bp, Glycine max
  Peptide Sequence Number=SeqID_94843
atggacccttgtcgtggcgttatgatttgccgtccctactccctacaggataatcacactttctttctcttgtcaaaacatgacaacaaccacctatggcacgatcccaacctcgccgcctcccaacctcgagtatatctcacgcgcgaagcagcggatcaaggccgggctggggatgcggcggccgtggaaggcaatgttcaacttccggtcgctgaaggttcccggcggcggcttgccggaggcactatcgcggattcggatcaatgtgtcgtatttccgcatgaactacgcaatggtggcgctgctgattctgtttctgagcctcttgtggcacccgatctcgctgatcgtgttcctcgtcctcatggcggcgtggctgttcctctacttcctccgcgacgagccgctcgtggtgctgggccacctcgtcgacgaccgcctcgtgctggtcgtcatggcggtgctcacggtggcgctgctgctgctcaccgatgccaccgtgaacatcctcgtggcggtggcggtcggggtggcggcggtggtggcgcacgccgcgttcaggaggatggaggatttattcttggaagaagttgctag

SEQ ID NO: 3159 - DNA, 1548 bp, Glycine max
  Peptide Sequence Number=SeqID_94844
atggttgttgacgctttgaatgaggatttgagaatcaacggagcagttgaaccgttgcctgaggactttgatgcaacagctgtaatcatagatcccgtgcctttggcagttgtagacaatggcattgtcaaggaggaggcgcagatcattaaaggaaaagagaaaagagaaatagtactgggaagaaatattcatacctcgtgtctagaagtcacagagcccgaggcagatgatgaggtcactggggaccgggaagctcatatggcaagtgtgttggccagatacaaaagagctttgactgaaaggacaaagcatcatttagggtacccctataatttggatttcgattatggtgcgctcacgcaacttcagcacttttccataaacaaccttggagatccatttattgaaagcaactatggtgtccactcccggcagtttgaagttggtgttttggattggtttgcccgattgtgggaactggagaaaaatgagtactggggctatataacaaactgtggtacagaaggcaatctccatggcatcctagttgggagagaggtctttccagatgggattttgtatgcttcacgggagtcacattattctgtgtttaaagctgctcgaatgtacagaatggaatgtgagaaggttgatactctttggtctggggaaattgattgtgatgatttcaaggccaagcttcttagtcaccaggataagccagcaattataaatgtgaacataggcaagtttcttcatcattgtttctctctctcgcatcccatgtctcccctcctcttcattttgttgattctagctcatccaactgaaacaattgcaggtacaactgtgaaaggggctgtggatgatcttgatctggtcataaaaaaacttgaagaagctggattttcgcatgacagattctacatccattgtgatggggctttgtttggtctcatgatgcctttcgtgaaacgagctccaaaagttacttttaagaagcctgttggcagtgttagtgtttctggccacaaatttgtagggtgtcccatgccttgtggtgtgcagataacaagattggaatatgtaaatgctcttgccagggatgtggaataccttgcttctagggatgccacaatcatgggtagtcggaatggccatgctcccatattcctctggtataccttgaatcggaaaggatatagaggttttcagaaagaagtacagaaatgcttgcgaaatgcacactacttcaaaggccgccttgttgaggctgggattggtgcaatgcttaatgaactgagcagcacggttgtgtttgagaggccacatgatgaggaatttatacgcaagtggcagttagcatgcaaggggaatatcgcacatgtggtggtgatgccaaacatcactattgagaagcttgatgattttctgaacgagcttctggagaagcgtgctacctggtttcaagatggcaaggatcaaccctactgtatatcatcagacgtaggtgaaaagaattgcctttgtgctttgcacaagtaa

SEQ ID NO: 3160 - DNA, 1065 bp, Glycine max
  Peptide Sequence Number=SeqID_94845
atggaagtaagggcagtggttgggatattgtcagtgagggcagcagtagcagaaatagggaggatcatcgctcattgtgggagtgaggaattgacaatttttaggacgttcaacgaatttttcatacgtgagttaaagcctggttcaagaccaattgcttctgctgaacgtgatgatgttgctgtatgtgctgcagattgccgtcttacggcatttaaatcagttgatgatagtacaagattctggatcaagacatcaatcagtcagaagctggaaactgtttctgattttcaggacagaggtgtggggggaggaaatggttttgcaattatgagagtacgatctgggggtcgaaagttttcagttcaaggtcttttggggaaagaaatgtgttccagtgcttttgttgatggaccaatggtgattttccgtttggcaccacaggattatcaccgtttccattttccagtatcaggaattattgagcaatctgtagatatccctggatgcttgtatactgtcaatcccattgctgtaaatagcaagtactgcaatgtcttcacggagaacaagagagttgtttcaatagtttcaactgtagattttggaaaggtggcatttgttgcaattggagctacaatggttggtagcattacttttacaaagaaaaagggcgactatgttaagaagggagatgagtttggatatttctcattcggtggaagcactgtaatttgcgtttttgaagaggtgaacgttccgaaaacaaagaagacatactgcaagagtaaggagtgcaggaagcacaccctgcacaaggttacccaatacaagaagggtaaagatagcattgctgcccaaggaaaacgccgttacgatcgcaaacaatctggttatggcggacaaactaagcccgtcttccacaagaaggctaagaccaccaagaagattgttctgaggttgcaatgccagggttgcaagcatgtctcccaacacgctattaagaggtgcaagcactttgagattggtggtgacaagaagggcaagggaacatctctgttctag

SEQ ID NO: 3161 - DNA, 1296 bp, Glycine max
  Peptide Sequence Number=SeqID_94846
atgaagctcctcgaatcgaagaaaagagccgaggcatggccagagtcatcggaaaacccttcagacaccggtccaccgcacaagaaaactagggatttgcttaacatgaccgaatgccacgtgtgtggcttcaaggttgacgtctgcacagcgtctcctgaatcatttcgttgcaatcaatgtctgcattctgtgcacaaatcttgtttcttaaagtacagaaacgctgctccctggtcctatgcttgtttgggctctgaattttctgtatgtgtggattgttggattcctaaacacttggcaatttctagaagaaggaataaaataggagttaagaatgggaaacatgttagggttatacctgataagggcagttctagggtttttgggggtgggaatttggtgaggtcaatggaggatttggttgaggatgcaaaacgcacggtggaggtgaaggttgaggctgcttcaagggctagagaggaggcaatgaagaaggctttggtggctagaagttctgtcgagattgctaacaatgctttgagtttagtagcaaaaaatagggaggagagtagttgtctgaatctgcctcccaaggtggatgatgctgttaaagttcttgatggttctgagtttacttttgagttgcatccatgtttcgataggggcttgcccaggatttcaaagagttgctgcttattgaatgcaagttactttgatacttcaaagcggtggacctctagtgttgatttgtcgtgcaagatatcaaaatctaggaatgctagtgatcgtgataagcatgaagtagtatccaacaattctgtaggagcagccttggatagtggttccttaactgatctcaatcttctctacatgggcacaagtggcatggaaactggtttaggcacagctgaatttgacagtgaagggataggggaagaagagctgttgaaggaaggggagggaagctgttctgatcggctgataaacttcagtgaagatagtggcatggaacttgatcacaagcaagcagattctgcattgcatggggaagaacaatgcaatgggcaaccagatcgctatttgttcaagtatagtaggagatgcaatggccaaccagattctgcattgcatacagaagaacgatgcaatgggcaaccagatcgctatttcttcaagtatagtaggagatgcaatggccaaccagatcactatttcttcaagtatatggatattttggaagccatcctagaaaagaacgggtataaacaggtttctgattcttgttttggttaa

SEQ ID NO: 3162 - DNA, 3723 bp, Glycine max
  Peptide Sequence Number=SeqID_94847
atggcaatatggccagtgcacattctaactattttctgtgccttccaaaaccatggcttctttgtcccacaagaaacaccagatgccagtttatgtgagcctctattagttcataaggacatgcataaacaaacagaactaggtcatgcctctttttgcagccgattcagtttctcttggatgaatgctttactcagtttgggttactcaaagccactagcacttgaagacatcccttctcttgcttctgaagataaagctgattttgcctatcaaaagtttgtacatgcatgggattcccttttgagggagaggggcaggaacaattctagaaacttggttctatggtccatagctcgagtttacttgaacgaaaacatcttcatagctatttgtgcatttctcaggacaatttgtgctgttgtttctcctttacttgtttatgcttttgtaaactattccagtagcattgaggaagagctaaaacaaggaatagccatagtggggtgtcttatatttgccaaggtagttgagtctgtttctcagaggcattggtcttttaactcaaggaggttaggaatgaaaatgagatcagctttaatggctgcagtgtatcaaaagcaattaaaactttcagctttgggtaggagaaggcattcaactggtgagattgtgaattacattgcagttgatgcctatcgaatgggggagtttccatggtggtttcatactttaatgttttctgcattgcaagtttttctggctcttggtgtcctttttggtgttgttggtctaggtgctcttcctggtttggtgcctcttatcatttgtggatttctcaatgtaccatttgcaaagatccttcaaaaatgtaggtcggaatttatgattgcacaggatgagcgtctgaggtcaacttcagagattcttagtagtatgaaaatcataaagctacaatcctgggaggataacttcaagaaatttgttgaatcccttcgcgctaaagagtttaaatgtttggctgaagcacagtttatgagagcttatggaacatttatatattggatgtctcctgccatcatttcctcggttatttttgtgggatgcgcgcttttccagagttccccgttgaatgctgcaactatcttctcagttcttgcagcattgagaagcatgggagaacctgtcacattgattccagaagcactttctgttctgatccaagttaaggtctcctttgatcgtatcaacacttttttgcttgatgatgagataaaaagtgatgatattagaagaacttcaaaacaagattcttgcagcaagagtgttgaaattctagcaggcaacttcagttgggatcagcagcaatcagtgcctccaactttgaggaaagtgaattttgagatcaagtgggggcagacagtagcagtttgtggcccagttggagctggaaaaacatctctcctgtatgcaatacttggagagatacccaaaatttcaggaattgttagtgtatgtggaacacttgcctacgtttcccaaactccttggatccaaagtggtacaattcgtgataatattctctatggaaaaccaatggatgaaaccaggtatggatataccattaaggtctgtgccttggataaggatattgatggatttagacatggtgatcttacggaaataggtcagagagggatcaacatgagtggaggacaaaagcaaaggattcaactagctcgtgcagtctataatgatgctgatatctatctcctagatgacccttttagtgctgtagatgctcatactgcttctattctgtttaatgattgtgtcagggttgctttaagaaggaaaacagttattcttgtgactcatcaagttgaatttctctcaaaagttgataaaatcttggtaatggaaagaggaaaaattactcaattgggtaattatgaagatctgttgactgctggaacagcatttgaacaacttttgagtgctcatagagaggcaattacagggatagaaaaaagtagtgcatacaaaagagaagttgaaaatttggttgcagttcagcttgaggactctcatgtttgtaatctcactaaaggtggaagtgatggggacatttctaccaagattcaacttacacaagaagaagaaaaggagagtggtgatgttgggtggaagccattctgtgactatattttcttccccaagggatctttgcttctatgtttgagcatattagcacaatttgcttttgtaggttttcaggctgcatcaacttattggcttgctctagccattgaaatgcaaaaagcttcatcagatttgagtattttagattttgatatcccttttaccaccatctttgtaacatctgaaatagctgaacttctgacaatgattgggataatggtttcggtcacatggcaagtgctcattgttgcagttcttgccatggtggcctcaaaatatgttcagggctattatcaagcttctgctagagaaattatacggatcaatggaactactaaagctcctcttatgaattttacagctgagacatcacttggtgcagttactatcagagctttcaacatgactgacagatttttcaaaaactaccttaatcttgttgacacagatgccacaatgttctttcattccaatgctgctatcgaatggttaattctgaggattgaattacttcaaaatttgacactcttcactgcagctttgctgcttgttctacttccaaagggatatgtggcccctggccttgttggactttctctgtcttatgctttttcattgacagcaaccgtagtttatctgactcgaatgttttgtaacttatcaaactatgtaatctctgttgaaagaatcaagcaattcattcacataccggcagagcctagtgcaattgtagaggataatagaccaccaccttcttggccttccaagggtagaatagatctccaatctctagagattagatatcggccaaatgctccattagttcttaagggcatctcttgtaggtttgaagaagggagtagagtgggagttgtgggaaggactggaagtggaaaaactacacttataagtgctttgtttcgcttagttgagcctaccagaggtgacattcttattgatggtattaatatctgctcaatagggctaaaagatttgagaacaaagctaagcatcattcctcaagaaccaactcttttcaagggcagcattcgaaagaacttggaccctctatgcctgtactctgatgatgaaatatggaaggctttagagaaatgtcagcttaaggcaacaattagtagtcttccaaatctcttggacacttctgtgagtgatgaaggtgaaaactggagtgtgggacagcgtcaactcatatgtctcggaagagtgcttcttaagaggaacagaattcttgttctggatgaagctactgcttccattgattctgccacagatgttattcttcaacaagtcatcagacaagaattttcagaatgcacagttataacggtggctcacagagttccaactgtaatagacagtgacatggtcatggtcctatcctatgggaaagtggtggagtatgacaagccttcaaagctcatgggtacgaactcttcattctccatgctggtagctgaatattggtccaactgcaataggaattcgctcccaaaagattag

SEQ ID NO: 3163 - DNA, 720 bp, Glycine max
  Peptide Sequence Number=SeqID_94848
atggctgggattgtagtgatatttgactttgactcaacaatcattgagtgtgatagtgataattgggtgcttgatgagaccggtttaactgaaaagttctatcagcttcttcctagcatggcttggaaccctctaatggataagatgatgaatgaacttcattcacaagggaaaaccattcaagacattgtagaaattctgaataggacaccaatgcatcctaggactgtccctgctattgaggcagcttattctcttgggtgtcacctgaagattgtgagtgacgcaaacattttctttattgaaacaatcctgaagcatcatggagtgtggaattgtttctcagagggattggtgatagaaaggatccaaaattcccttgcagcagcaggaaagaagaaaataatctatcttggagatggaaatggagatttttgcccaagtttgaggctcaaagatagtgactatttgatgcctagaaaggactttccattgtgtgatttagtttccaaaaattctaataagataaaggcagaggtacatggttggagagatgggaaagagcttgagcatgttctgctacatgttatcaacaaagctattggggaaggaagcaacattaacaattctactcagaaagtctcagttgattgcaagatggggcccattcctattgacactcttcaaccattgcctaaagccctatcagttcctcagtaa

SEQ ID NO: 3164 - DNA, 723 bp, Glycine max
  Peptide Sequence Number=SeqID_94849
atgcaacacccaacaatattcccaggagtgaagccaccaccacattttcccgaacaagaacaactccagtgtccacgttgtaactccaacaacaccaaattctgctactacaacaactataacctctcgcagccacgccacttttgcaagaactgtagaagatactggactaaaggtggtgccttgagaaacatccctgttgggggtggaagcagaaagaccacaaaacgttcttcatcaacctcaaaacgctcttctgcaccatcttcttcttcctctgcagtttcggatcctgacccgacccgtaattgcaccaacccggttgatcaagaccaaagggtgctcaacattggtggtgggagcttcagttccctcttggcttcatctgggcactttggaaccctcctggagggtctgaatccaactgggtcgagtctcaaaatgggtgaatttggggagggtgtgagttctgatccgggtttgaatttggtttcgggtcaaaacccgggtttgcagaaaagtttaggtgagtttgatcctgggaaattcattcaaggcttcacagttcaaaaagcgcttaatcctatggatagcatgctatggaggatcatacataccaccagaatgtcactaaagcagcatcctttaggtattttgagtcaatatatggcttgccaagaatcaagatcactccaaagattgtaccaatttatatataactaa

SEQ ID NO: 3165 - DNA, 561 bp, Glycine max
  Peptide Sequence Number=SeqID_94850
atggaaagtaatcatggaaaagttgttgtaactgccgcattatcaaataagtcggtaccattaatgaagaaggaattttcttgcaagtattgcaataagaagttcagtagttaccaagccttgggtgggcatcataatgctcacaaggctgaaagagaagcagaaaaacaaaacaagattcttagcaacgcttctgcttattataaaaaatcatttgttggttgtcatagtctgtttctgtccgacggtatccacacttttatgaccgatgggagtgcatcttatcaacaatacaaatcacatcaacctttgatttcttctaccgttggagaaggaccaacaaattcagggtcaaagtcacattcatcacatcccagtttatgtgataaagggaattttgggcaagcaaccgcttcttcaatgatacatcagaaggcaatcatagaagggtctgatttgaatgtcaagacttcacgtgatcttttgaattctgctcaagaaaacagttcttgttcagtgaatggagcagtggagaatcttgatttgactctcaagctttga

SEQ ID NO: 3166 - DNA, 678 bp, Glycine max
  Peptide Sequence Number=SeqID_94851
atgatggaaagcaatgttgaagcaaaaagcaatcatggaaaagtttctgcttctgcatcagcatcaaataagtcaccaccaatgaagaaggatttaatttgcaagtattgcaacaagaagttcaataattatcaagccttgggtggacatcagaatgcacacaagaatgaaagagcagcagcacaaaaacagaagattcttagcatggcttctgcttataacaaaaattcatatgctgatgggtttgttaattcaaaccaatcttatggatttggtggcaaaatattaggggtgtcaccactatccatgactcgttttaagccccattattatagtaattggcctcataatcatatgtcacatgttgcatggccaaggcaccagattttgaatagtgttcaacccaccattcatcagttgcagactttgatgatggctgatcaagggagtggattttatcggcaccataaatcatatcaacaacctttaagttttcctatacttagagaaggagcagtactaaattcagcaagcaattcttcaataatacctcagaatggaatcatagaggggtctgaggatttgaatatcaagacttctggtgaagcaaaaaacagtttttcttcaatgcttgccaatggagacgtgatggagcttgatttgactctcaaaatttag

SEQ ID NO: 3167 - DNA, 2355 bp, Glycine max
  Peptide Sequence Number=SeqID_94852
atgggtagctcaggtgagtcgaacctgaacggaatcgatgcgtcggtgggtgggttggtttgggtccgacggagaaacgggtcgtggtggccgggtcggataatgggtcttcatgaattgtcggagagttgcttggtttctccgagatcgggtactcccgttaagctcttaggtcgtgaagatgcaagcgtggattggtataatcttgaaaaatcaaagcgggtaaaagcttttcgctgtggagagtataatgaatgcattgagaaggcaaaggcatctgctgctaattcaagcaagaaggcagtgaagtatgctcgcagggaagatgctattctccatgctcttgagctagagagtgctcacctggacaaggaatcattaagcttatgctccagattagataaacctggtagtgaacatggaggatcagctggcgaattacccctcatgtctggtgaagacaatgaagatgtggcagatgatttgagtgactctgatgacaattctaatgcagctccagaattgtctcaatctggtatatcttttgaagagcctaatcacaatggtactttaaagatgcaatctgtgcaaggaaggaggagaagaacacctaatgattcagaagatgatggatttgaaggagtcaagcgaatgagaggacttgaggacctaggcattggtgtagtgtcaaagagaaaggtccaaggtactggtgcaactgagatagttcagcacattagtgcttcactcaacaattcaactgcagggaactgtctggcaaatggaacttctgtaaatggtggtaaaggctattcttcaacactgaaaagaaagagatcacaagtggcaaatgctcatgaattattgaaaaggaaaaatcgacaccggcccctgactaaggttttggagagtacagccatggtgtcagttcctgtcatttgtgatcagcttcccagttcaagcggttctccactatgtggggtaactgatggaagaatttcaggattagattctaatggttcaaagaaaacttttccaacgccaacacataattcagatagtactgaggctacttgtgagaacgggacttcattaattggtcatgaccatggtagtgatgatgcttcccaaatcaatcacaaagtcaaggagaatgaggcttctggcttaccagggctagttggcaaagattctcctgatgaactatttgatgttccatttgttggggttttaggggaggagaaacacactctggatttctcacccatactggtttcttgttcatctggcaagcctcaagttagtccattgggagaacagtcttgtaatgctagtcaatgtgaagctgtgtcattgagaaatgagagcaagaatgaaccaggctgtaccagttcagttgctggtcacagtattgttggccatagagcagacaaaggtagttcaaagtggcagtcaaaaggaaagaggaattcaagaaatacgagtaaaaatataaaacatgcctcaagaaaatatgtggacacagaccgccaatccagtgcatattttccaggaatagggaactcggacggaatctatcagggtgcttgtcaaaaagttgattggaatggcatgggtgaaccaaatacttcatacaactgtacttctcaagttaactgcaaacctgttgctgaaggtcaactagaaggacttcgggacttgaacaagcatgtcaaggtgacaacaacggaggcaaagttattgcctgatggatctctcacacctcagagattgcttccttatcgccattcacgcttcactgttaactccagatatcaaacggcagatttccctggaagaaattattgttctgatgcttcattatatgacgttaagctagaagttaaatccagctaccggccacaacatgtgcctttggtttcccttgtgagtaaactgaatggcaaagcctttattggacaccctttggcggttgaggtcatggttgaaggtcattgtgataaaatgttgagtgacattggatgtgacttggaagttggtgatgtctattgtgtagccaagccaaactcggtgactggaagaatacattcgaagaattcaacgcgattttctcctagtaaatcttccaagatgaagaaaaccgggctgttgaataaaaagattcggaagttgtcgtcattgacaggtcacaggcagtcagaagaggaaagaaaggaaaaaaagccagtggtagataagaagggtcctgttattgcttgtattcccctccaagtagtattcagtaggataaatgaagctgtgagcggtcaagcacggtccacgcaccgtgcattaccaacatcatccaacccttga

SEQ ID NO: 3168 - DNA, 1635 bp, Glycine max
  Peptide Sequence Number=SeqID_94853
atggagcttgtggagagagccaaaggtattgaagtttctacggttgagaaggatcctctgatctccaccatgcctgaacacatcattcatgaaattctcagtcgactttcaatgctagacgttgctcgaaccagttgtctttccaagcaatggaataacttttgtgtctcctttccttgcttgaacattgaccagagtgactttaatcatcttccttttcaccacttcaagaatactatgctccacaaagttatgagcatcaaagaagaagaagaacgtttggttatccacaaatttaggctacgcatgcattttgaatacgtgcaaaatgccacaaaagagattgaagaatgcacaagactagtattgcagacgagcacagtcaaagagttcgatttccaaatcatgcatcattgtctttacgcgactaaaggtaattggtgccaactttttcatcatatttataatgcgaagacgtttgtggtgctaaggttaagtggtttgacattgattcagccctctgatagggatataataaagttttcccacctagaaattctaaggttagaaaatgtatgggtaaaaagagaaaatgtcattgattggttgtttactagttgccctctgataagggaaatatcacttgttagatgtaatggtttgaagcatttgaaggtgtgtggtaatcttggtcacctcaaacagctagaggttgttttttgtcaaatgcttgagagtgttgaaatccaagtgccaagtctagagaagcttgtgttgtccgagattgaaagaagaagaggaactgaattttgtatggctttgagaatagattcggaaactagtgaaaccttaagggagttgacattgtgcaattctaccattggaggcttaaccttcacccgtctattttctagatgctcaaaagttgagtctttggtactggaacggtgcatccgtttttttaagattaagattgcaagtcagaagttgagaaaacttgtcgtgaaaaggtgttacgatcttgttgtgacagacattgaagctaccaatttgacttcattcatgttttgcaattatgtacccaataaagtttatcaagattttgctgttgacaaacaaatccaatattgtgaggagatcagtcagctacaagaatgcttgcttgactttaacaaagtgcttatgagcaaaaacatatggacatatctttggtttgataaatttaactactctgcagaccaaaagatgattatctacccgctgaagaattacaaagggtatgatgttgtggtattggaagactggagttcgatggcagaacttacacttatgacccagataagtgaatcatcgtcaagaacaaccattacaaccatgagttttcttgatctggctagttacgtgtttggggattgtggcaagggcttaaaaggggttttggccatctcaatctctggtaaaagcatgttacatgaggttctaaataacaaaccaaaactttcatgtacgcaatgctcttctgtggtcataacagaaatactaatggatgaattcttgtccaccacatgttggccttccttctcaagagctggtgcaactctgaaagcaacatcattttctgtttcttccgtttga

SEQ ID NO: 3169 - DNA, 5412 bp, Glycine max
  Peptide Sequence Number=SeqID_94854
atgtacggcggcgcctcctcgaagcttggccgcggcgcccccaaccgccgctcctttccccctcctccggcgccgcaccgttcctccgccccgggcggccgcctctccctcggctcctccgcccgcaacgctgcgaaggagacggcggcgccggcggtagaggagacattcagcctcatctccggcagtaacccgctcgcgttctcgatgatcattcgcctcgcgcccgacctcgtggaggagatcaggcgcgtggaggcacagggcggcaccgcgcgcgtgaagttcggccccaatccacacaatcccaccggaaacattattgatgttggtgggaaggagttcagatttacctggtcgaaggatggtgacctctgtgatatttacgaagagcaccggagtcgcgatgatgggaatggcttgcttgttgaatctgggtgtgcctggcgcaagctgaatgtgcagcgtgtcttggatgagtcaaccaagaatcatgtcaaaagacggtcagaggaagctgaacgcaagatgaagtctcgcaaagccattgtcctagagcctgggaacccatctatgaagagccagataaaggcattagcagctgttgaggctacaccatggaagaattacaataaaaagaaagaggctgcacttaagaaaaggaaagtggaaacccttcaagatcattttgctgcttcatcctctccaatgggagctgtaaatatgtctaagagctttgaggatgctgtgccagcacaaatgacaggcaaacaagatactaatgctgtttctgagaaagaaatccctaccaggacaaacaatgctatgaggaacacaccaggaggcaagggaaaaaatgggtctaaaccagtagatttgcagggcatgctaatttctcttttaaaggataaacctaatggaatgactttgaaggccttggagaaagctgttggagacccacttccaaattccatgaagaaaattgagccaattataaaaaaaattgcaaaataccaggctccaggaaggtatattttgaaaccaggaggggatttagaaagcttaaataaacctcagactgaaagtggaagttctcctgatgacaatcacagccagatacctgctcgtgaagagtttcatgatcagacatcagctccacaggaaggatctgaagaaagagtcccaaatattgatttggaggaaatggttaaagaaaattccaaagtagaagaagaatcaaacactttggaaaaagttgatgcccaacatacttcacctgatatccttggtgacaaaaaaggttctgatcatagtgaagggcaagcaggaagctccagtgatagtggaagtgacactgacagtgacagtgacagcagcgatagtggaagtgatagtggaagccacagtaggagcagaagcagaagtcctactgggacagggagcgggagtagtagtgacagtgaaagtgatgcatcttctagcagcaaagagggacaggagggatctgatgaggaaatagatattatgaccagtgatgatgaaaaagagtcaaaacaaaaaacagaagtctctgaccaaaggatgcccttacccattccagtaaaatctcctgacggaaggtcaatgcagaatgtggttgatgagaagcaggatggcaatgaatctgatgcagttgaaattgaaaaggacttacctgaggaacaggggactgaaatggctctacctccggctaccatttctaatagaggtggaaaatatgcagaagagacaagaccgtttccacttgactatcaacagctccaggaacgccaaaattatatagggagtttgtttgatgaaagagaaaatgaagttaaagatagctccaggcatgaacagaatgacagctctaataggttttccaaaggtaaacataagaggggttctgatgtgaagaagaacattgaggagaaatcagaacgtgcaaagaggttgaaagcagaaaacttgacccgtgaaccattttctccaggtatagatgtgcagacactggacaattctcggaacttgtctcctttcgaattgactgaagacactggtaagggatctaatgtacaagtgttgaacagagcagagagacaggggaattcaagtgttgggttacagaaaggatccaatcgagcatttcctggaaaatctagttcagattttccacaaataggtcaaaggtcatcagttcaaaccccttcagaaaaccctccctacccattggaaaaatcagataagcaagttgagagtgtaaggcatggtaaaaaacactcaggaaaggactttcatacacgtgaagcctcttctgtgcagaaagataaatctagtagagattccttgaatgaagatattcatgccattgagaaaaaagtccccaggaattccagggatggtagtaatggaagtaaacagtcactatccatggattcttattaccaaaaacaaggtgaaatggttggtaaattaaaggaaggccgacaaagtacacagtcacacttgggaacatcacctaaggacaacaatcgaattggttttgatgaatcccctgtaactaatgggcgaggtatctcccttcaaagagagctttcggacttggagttgggtgaattccgtgagtccactccagatgaaactcatgttgcaaagcaatttgaacaaaaaggttcatttaaactgttggaaaacaaagcaaacacttctgaggataggaattcagatattactaaagtaaagccttcattgaaagcaacttcagattcaggaaagccatcttcagcctttgtaaattctggttttcccagtaatttggacaacactaataaaaagaattcggataaccattttgaagattcaacaaaatctcgttctagagttatgcaggctcatttgcaacatttgagagcagatcatgcagaagttggatctcaaaacaaattggcagaaatgagcagtaaatatagaaatagtgaatctggggttagccaagattttgacttggaaggtcgcagtgaaagcaatagaagagtgcctgcaaatgcatctaaaccacaagacagtaaacgcggaaacgtttcctaccctgtgaaagaaattaaaagacaaacacctaattcagtggaagagatggctgatggaggaaaggattctgttgcagatagaaatcatagcgatcaaaagaagagagaatcatcttcagatgaaaatagttgctcttattcaaagtatgaaaaggatgaacctgagttgaagggaccgataaggactttctcccaatataaagaatatgtgcaggagtttcaagataaatatgatagttactgctccttgaacaagattttggagggatacagggatgagtttcagaaactaggcaacgatttagaacacgctaaaggcagggatatggatagatattatgacattgtggagcagctgaaggaatcctatcgacgctgtggaccgctggtggactctggctttatgtattgtgaggattctgaggtttatgatgtgccttcgggtgtaaatgattgtcaattcaaatggtacttggtaaatgttgggttgagggaagttttgaggggaactgaagactggcctagacagtgccactttttttgtttctacttgagtggtagtggagtagggatgaattctgcaatggatgatatgaatttgattcagcaaacccagaggcatcacttggttgtgagggagattggcgaggagattgatttagaaataggagctggggaggatgacccgtcatttggtaacgctactctgattggtgcaccaatgcgggaatcttctgtagaagaacatggagagagcaagcagacggggatgatttctcagcttcctaatgatgctcaagatatgtccaagacccaacaggggaaaaggaggaaaaaggttgttaaaagatggagagaagaatgggcagacacctataaatgggcttatgttgatatgaaggatgggacaccaaggattttctgctctgtctgcagggagtacggccggaagcatagaagaaatccttatgggaatgagggcagtcgtaatatgcagatgagtgccctggaagaacacaacaacagtttgcttcacaaagaggctcttcgtcttcaaatggcctctaaagataaaattgtggtcgacaagcctgtttatgtaaaaggttggccatctcagcatgctttaataactgccatggtaaaaagcgattacagaatatggatccttgattccttgggagagtttaagcctcgcaaagtgcccgagagagttcctgttactaatttcttcctcgtttgtactgtgaatagtgctatatctcaggatctggttcttaatcccagacctgaagacactttaaagaatgccttatcaccatataaattaggaggagcagctggtggaagtgattttgatccaaaaggaaaaagtgacaatgagattatgcgattttgccaaagtttcatgagtgaaatgtatcgctacctggggcctgacaaggaccttccgtcagaggaaatgggtgttggtactcgggaaatgggatatctttttggacagtataggcgtctcgcaggtcattttcagggaagttttacagggccaaggatattttggtctggctccagtcttcgacctgaagccactggctatgggctggttttctttgcccagctcatgcttgctgacatgaataaagaacttaaaggattaagatgtgttgtgagtggttctgggaagatcgcaatgcatgtcttggagaagctaattgcttatggtgctcttcccatttcagtatcaggatatttggttgatgaggatggatttgactacatgaaaatatcatttttgcgagacatcaaagctcaacaaagaagtttacgagactattcaaagacctatgctcggtccaaatattatgatgaagcaaaaccttggagtgaaaggtgtgatgttgcatttgcctgtgcttcacagaatgaaattgatcaatctgatgccattaatttggttaattctggttgccgtatactagtagaaggttcaaacatgccttgtacccctgaggcagttcagattctgaggaaagctagtgttctcattgctcctgcaatggctgccggtgctggaggggttgtggctggagaacttgaactgaatcatgaatgcagtttgatgcactggtcaccagaggactttgaatctaaattgcaggaagcaatgaagcagacttatcagagagctatgaaagctgcaactgattttggttatcaaaaagaaagccctgaggctctggtacatggagcagtcatctctgcctttctaaccattgctcaagccatgactgatcaaggctctatatag

SEQ ID NO: 3170 - DNA, 477 bp, Glycine max
  Peptide Sequence Number=SeqID_94855
atggcactcacgaagcaactcaagaagaagagcgagtgggacactctcgaggaggccattaaagccaaacttgaagatatcaaatctcacaagagaagagtggcggcgtcgattggaggagcgatgagcgctgaagcagaaactggaacaatggggcgtgggtgtcaagttctaatggtggaggcgagtttagtgatggtgtttttggtgtgtgcaacggaggagaggaagcaacctgcggtccttgagatttcttttcaaccttgtaaaaatccttttacaagcaaagatccacaagggatgtatcctcccttgttctctttgaacaacctagcggatgtaccctccactagtactgatccacaagagatgtaccctctcctgttctcagtcaataacccaagtagatgtacattctacttgtaccacgaaggatgtactctccaatgtgttaagacaaagttctcaggcggttag

SEQ ID NO: 3171 - DNA, 794 bp, Glycine max
  Peptide Sequence Number=SeqID_94856
gtgaagtggcctctaggtctggtccattgttggcaggaagtggtttctttgaagcaataataagtggaaaaggaggtcatgcagctattcctcaacaatctatagaccccatattggcaacttctaatgttataattagcttacagcatcttgtttctcgtgaggctgatcctctggattcccaggttgtgactgtaggaaaattccaaggaggtaatgcattcaatgtcattccagattctgtcacaattggaggcaccttccgagctttttcaaaagaaagcttccagcaattaagacagcgcattgagcaggagggcgaggcgagattcgagggtgcgttttccaagaaaggaaaacgcgtgggagtcgccactaaagtttatgttgtgattgcacaagctgcggttctgaggtgcaatgcaacagtcaatttctttgagggagagaagcctttctttcctgcaactataaacaacaatgacttgcatgaacattttgggactgttgcggtgaatttgcttggcatcaataaagttaatgacatgccaccattgatgggagctgaagacttttcattctatcaagaggttatgcctggctactttgcctttattggaatacagaatccctcacatgaaaaactggagcaagtacactcaccctatttcaagatcaatgaagatgtgcttccttatggggctgcacttcatgcctcattagctgttagttatcttctaaaacatccgcaggatgtaccgtctgcagaggggaaacatcatgatgaattgtaa

SEQ ID NO: 3172 - DNA, 1389 bp, Glycine max
  Peptide Sequence Number=SeqID_94857
atgtgttccttcaaaaaatggttcaacttgtacatcattttccatgtcttggcttcaactccaatattctcattatcagatcattcctcaaaccaactctccacaaactttctagaaattgccaagaagcccgatgtatttgattggatggtgaaaatcagaaggaagattcatgagaatccagagttgcgttatgaggaatttgagaccagtaaactcattagagaggaattagataaactgggtataccatataaacacccagttgctgtcactggtgttattggcttcatagggacaggagggtcaccttttgttgcagtaagagctgatatggatgcacttcccatccaggattttgacatttttctaataatagatggttggtttatttgggtaactgggttgaaggaaatggtggagtgggagcacaagagtaaagtacctggaaagatgcatgggtgtggtcatgatgctcatctcactatgcttcttggagctgcaaagattctcaaacaatatgaaaaagagatacagggaactgttgttcttgttttccaaccagcagaggaaggaggtgcaggggctaagaaaattatagattctggagccttagataatgttactgctatctttggattacatgtggtgcctgagcttcgagtaggtgaagtggcttctaggtctggtccagtactggcaggaagtggcatctttgaagcaaaaataagtggaaagggaggtcatgcagccattccccaacattctatagaccctctattggcagcttctaatgtcatcattagcttacaacaccttgtttctcgcgaggctgatcctctggaaccacaggttgtgacagtttcaaagttccaaggaggtgctgcattcaatgttattccagattatgtcacaattggtggcaccttccgagctttttctggagaaacattgcagcaccttaaacagcgcattgagcaggtcatcattggtcaagctgctgtgcagaggtgtaatgcaagtgtcaacttctttgatgaagagaaacctttatatcctccaactgtaaatcatggtgaattgcacaagctttttcttgatgtagctggcaatttgattggcatcaataatgttatcattgacgagtcaccaagcatgggctctgaagactttgcattctatcaagaggtcatacctggctactatttcatgcttggagtgaagagttcacctgaaccgaatcagtcattgcactcaccctatctcaaaatcaatgaaaatgggcttccctatggggcttcacttcatgcatcattagctgctaattatcttataaaatatcagcacgacgtagccaaggtagcggggaaatatcatgataaattgtaa

SEQ ID NO: 3173 - DNA, 909 bp, Glycine max
  Peptide Sequence Number=SeqID_94858
atgacgaaaatacccttgatccttttccaaccagcagaggaaggaggtgcaagggctaagaaaattttagatgctggagccttagataatgttattgctatttttggattacatgtgaagcctgagattcctatagcaataataagaggaaagggaggtcatgcagctcttcctcaactttctatagaccctgtaatggcagctaccaatggcattattagcttacaaaaccttgtttctcgcaaggctggtcctcttgacccccaggttttgacagttgcaaagctccaaggaggtgctgcattcgatgttattccagattatgtcataattggtggcaccttccgagctctttctagagaagcattgaagcaccttaaacagcgcattgagcaggattatgattatgagtttaagggtgatcctatacataactgcaatgtggccttcaagtttatcactgtggtgggggctaaggctgattcatatatgcaggttatcattggtcaagcagctgtgctgaggtgcaatgcaagtgtcaatttccttgatgaagagaaacctttatatcctccaactataaagaatgatgacttgcacaaggtttttgttgatgtagctgggaatttgattggtatttataatgttaacattgatatgcaaacagacatggcagctgaagactttgcattctatcaagaggccatacctggctattacttcacgcttggaatgaagaatgcttcttcaattgaaacggttgcgccattacactcaccctatcttgtaatcaatgaagatggacttccctatggggctgcacttcatgcatcattggccactgattatcttacaaaatataaacaggacgtagccagggtagtcgggaaatatcatggtcaactatga

SEQ ID NO: 3174 - DNA, 261 bp, Glycine max
  Peptide Sequence Number=SeqID_94859
atggcaaagaaaaagaagtttgaggaacaaagtgctgaatcccttcacactttttctcccttactcttgaattgcgccagatttcaatggaagtgggaattgtgctatccctgcaatctctactctttcattctcatcatcactgtgcaaaaagcgtgccaagtggttgctgctgtcgctttgggtttggttgggttcggcccacaccattgccgttgttttctacttcttagtgtcaacgctaatgcatggacactttaa

SEQ ID NO: 3175 - DNA, 312 bp, Glycine max
  Peptide Sequence Number=SeqID_94860
atggttttgcaacgtcacccgcgaggaagtatccagcatactgacattgactcatatttctgcacatcagcaaagagagggagcaaccatacctccagaaggtttagaagggtgcaagcgaaacacagagactggattgtgcagtatgatccacctgatgaaccaaatgaatatattcacagggttggtagaatagctcgtggtgaaggtgggaaaggaaatgctttgcttttcctgatccctgaagaattgcaatttcttcgctatctgaagggagaccaaaattctcctggtatcataccctggctataa

SEQ ID NO: 3176 - DNA, 354 bp, Glycine max
  Peptide Sequence Number=SeqID_94861
atggaccaccaagctgacactaacagaactgatttgatgactatcacacgctttgttctgaatgaacagtcaaagtatcccgaatcacgtggcgatttcaccatccttctcagtcacattgttcttggctgcaaattcgtttgttctgctgttaacaaggcgggattggcgaaactcataggacttgctggagagaccaatgttcaagcagcttttgttgtggctgagttaggtccaaactcaaattttaatatggtatcaaagtctttccttaagattgttattaggcttattgagacattcactattaggttgatatctgcatatactcggtcctacatacttcacgcttga

SEQ ID NO: 3177 - DNA, 201 bp, Glycine max
  Peptide Sequence Number=SeqID_94862
atgcagtcaagtcttatcaattctaccttggaggataagaatctgtctgagattcgaaactttaagttactgttgaaacagttggtcactatggaggttatccagtgcacaactctttgggattcatacaaggatgagtttgagaatgagagtgttgtccacgatgatggtgttgtatcctatttaaaaattcagttctaa

SEQ ID NO: 3178 - DNA, 162 bp, Glycine max
  Peptide Sequence Number=SeqID_94863
atgaatgaggagtactcttgggtgtggttacaagaatctaatggagggtacttgatgaatttggcctacttggctattagtgagttgaaagaaggaagtcctccttgggatagcctcaatgcattttatgtagcagagaagattgttgaggagccatgttga

SEQ ID NO: 3179 - DNA, 993 bp, Glycine max
  Peptide Sequence Number=SeqID_94864
atggctgaccacggaaccagaaagacgaccaccaatcgccttgaagaagccatcgtccgcctatccaacagtcaagcttccctccatgacaaatacgcagaactttctggcaagctggactcaactcttgatcacctccacctgcggtcacccaaccataatcatctcaattccaacacccagctccatcaacgtaatgtcgccaaattagatatatcgcgattctcgatcacccaccagtcgtccatgactgcctctacctctactcccggccatgccataacacatcacccacaaccacccctgcaggagccatcccttccttctctttatgtacatccagctcaatccattgggattgattttgcaagtactcagcaccgtcattccatggctgcctctacctctactcccggccatgccataacacaccacccacaaccatccctgcaggagccatcccttccttctctttatgtacatccagctcaatccattgggattgattttgcaagtactcagcaccgtctgttaagcttgtttagtaccacagctctgcaaaccatgccgccttccatggattccacagcgccaacggcactgctggaacatcaccacacaatggatccgaacacctcgccatggtgccccggcacaatcaccgttccccggagagctcacgtcactctccaaacgatgccgcaaagcttccacttacccaagatcgcgccattcccaaacgaagacgttttgtccacagcacaagcaccagaaacttatggaggcttcttgcgtgttttctcgtccaactcatctcagtttcaagtgtacaagagaatgttgaaacctctggtggaggagtttcttagaggtagtaatggaatgttggctgccattgctaatggactccacaaaaagaccatcagctttggtgcaaagaatgctctcattttttttatcccggaagaagccattgcaaccaataaagcataa

SEQ ID NO: 3180 - DNA, 475 bp, Glycine max
  Peptide Sequence Number=SeqID_94865
catcagagcgtcgatttcccccacaagagtttcacatgcttcagtcaagtgttgaaactcgaggttttgacagacgaagggagattgttcaagcggaagatttttcccaacatatggagcagcgtggccatggaatgtattacacgccaccaacatttgctcagtatccttcgcagatgtatcagtatcctttcgagggccatgacactgatatgtctgcaagcgaacattcgtttggtggtgttgccgaaacacaacctcatttttcatggccgaccatgaccccttcgcagcaacatgatgccccaatggcaacacctaatgccccattaggtcagcaatgggatgtacctggagcaatccctcctatgggtgatttattaggtgttgatttgcgtcacgagttttctgcagaggctgaggaacaagggcggagacagcgcgcaagaagaaatccggatcgtcaagcccgaag

SEQ ID NO: 3181 - DNA, 225 bp, Glycine max
  Peptide Sequence Number=SeqID_94866
atgaacatatgcaattttgggcacaataccttgagcatgcgtgaaatggccccgaggaaacttgcctcaaaaagatccaggaaggataaggcggccgaaggaactagttccgctcctgagtatgacagtcaccgcttaaggagcgctgtacaccagcagcgcttcgaggccatcaagggatggtcatttctccgggagcgacgcgtcccagctcagggacgatga

SEQ ID NO: 3182 - DNA, 876 bp, Glycine max
  Peptide Sequence Number=SeqID_94867
atgggtttaccttggtatcgtgttcatactgttgtattaaatgatccaggccgtttgctttctgttcatataatgcacacagctctggttgctggttgggccggttcgatggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggggtggcttgttttggttttggcgcatttcatgtaacaggattgtatggtcatggaatatgggtgtccgatccttatggactaactggaaggatacaatccgtaaatcccgcgtggggcgtggaaggttttgatccttttgttccggggggggtagcttctcatcatattgcagcaggaacgttgggcatattagcaggtcttttccatcttagtgtgcgtccaccccaacgtctatataaaggattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagtttatcagaagcttggtctaaaattcccgaaaaattagcttcttatgattatatcggaaataatccagcaaaaggggggttatttagagcaggttcaatggacaatggagatggaatagccgtcggttggttaggacatcct

SEQ ID NO: 3183 - DNA, 159 bp, Glycine max
  Peptide Sequence Number=SeqID_94868
atgttcaaaattataatgctcaaaatcaggatgttcaaaatcaccagtaacagaatgctcaagataatcaaaaggatcaaagggttgtcagcaatactggtcgctaaatccgtcgcaaagcactattcacaacaaaacacaaaaactgaaacaggataa

SEQ ID NO: 3184 - DNA, 127 bp, Glycine max
  Peptide Sequence Number=SeqID_94869
atggtcgacgcccttgctactctatcgtccatgttcaaagtgagccctcacggagatttgccatacatcaaattcagatgtcgtgttgaccctgcacattgttgtctgatagaagaggagaaggatg

SEQ ID NO: 3185 - DNA, 204 bp, Glycine max
  Peptide Sequence Number=SeqID_94870
atgaatcattcgttccctaacaagggaagtccaccaatagagggcatacccttgaaagctaagggtagccaatggaactattctctcttcactaatatgatggcaaacaaagagttgttcaaccttcatttccctatggcgcctgtcgcaacctacccttcggcgggagggcgacgcgtgactcgcgggatgcgtgttccatga

SEQ ID NO: 3186 - DNA, 936 bp, Glycine max
  Peptide Sequence Number=SeqID_94871
atgatctccagacttgagagtggttttacacaaccaacggtcgagaatatccgctcaaaccttcaagctcgaggcaaaacaatcatgacaaagaaaattgctgaaacgtctcgagctgatgtgagacccaagaaacccactggggtgaagatccaagaatggaaacaagaagagaagagtaaaaagaaagatgatagcactgagactaccacgacctcaaaacgctcgaagcgtgtggtcatcgaattcgacgaagaaaaagatgcaaatgcaggcaattcccaggctcaaatgcctaagaagaaaaagaaagtgaagcaggtcgagcctgaaccttctgtgactgtcgagggtggcgagccagccaggaagaaaaagaaaaagaccaagtcttcaaaaaaacaaggtcaccatcaacctgttgacgtcacaccaccttcgactgaagttgacggtactgaagcagaggctactccctctattgctgagatgggcaaccctatcgagcaaccggactcaccacaagaacaacctcccgtcgaggtacaaaatgtttctgtagaagaaataccctcatgtgctcgaacctctcctgctcctgagacggatgcagtgaatgttgaggaacagggtgaaggtcaaggtattcgatccagcagtcctcatggattgagtcagaaaagttcctctgaagaacatttttccgatgaagcggccatacaagaggctgaagctggaggttcagacattttcccggcgtcttcgacatctaagctttccgctagtatagggatgacagaggatacattcattcaactgcaagacgaagaccctgctgcagcccttcgactcctactgaacaccagtcaagccaacacttcgagtgaaaaaattcctggtgcttcgtcctcatctgatgctgacataacctcttca

SEQ ID NO: 3187 - DNA, 1167 bp, Glycine max
  Peptide Sequence Number=SeqID_94872
atgagcggccatgccatcgatgcggctggcccggccggtgaagccacgcgcctgccgtgggcgggactgctggcgctggccggtggcggcttcatcactctgctgaccgagaccctgccggccggcgtcctgcggccgatgggcgaaagcctcggtcgtgtacgcgctcggctcggtgatggccgcactgccgatgaccgcactgacccagcgcctgccgcgacgtcccttgctgctcgccgcgattgccggcttcgtggtggtcaatacgctgaccgcattgagcagcagctacccgctgatcctggccgcgcgcttcctggccggcgtgtgtggtggcctgctgtggtcgctggtggccggctacgccgcgcgcatggtggtgccctcgctgcagggccgggcgattgcggtggcgatggtcggatcgccgttggcgctgtcgctgggcgtaccggccggcacgttgctgggccagcagatcggctggcgctgggcattcgcgctgatgagcgtgctggcagtcgtgctgctggcctacgcgcgctgggcattgcccgcgttgccggcggcggcggccggtcagcgtacgtcgttggctacggtgtggcgcatgccgggcgtgcgcagtgcgttggcggtgatggtgctgtacgtgctggcgcacaacgtgctctacacctacatcgaaccactggcggtggaggccggtgccggcccgtggctggaccgcctgctgctggccttcggcctggccgccatcgccggcattggcattgccggctggggtgtggaccgtcatctgcgcacgctggtgtgggccgcggtgatcggtttcatcgtgccggtgctgaccctgctgttgtggccgggcgacgcgatcgcgctgctgctggcgacgatcctgtggggcgttgccttcggcgcggtacctacgttgttccagaccgcattggcgcggcgtgccggtgccgccgcggatctggcgcagtcgatgctggtgaccggttggaacctggccatcgccgccggaggtgttgcagggggtgtgctgctgcaggcgggcggcccgaaccagttgggatggctgccgctgctgctgctgtcggtgagcgtggcgtggctgctggcacggccgaaggcctgggcgtaggcggcgaccagtga

SEQ ID NO: 3188 - DNA, 777 bp, Glycine max
  Peptide Sequence Number=SeqID_94873
atgccccgtcgccctctcctgctagcgctgttgctgctgcccagcctgtggcccgggctggctgccgcgcgcaccgtctaccgctgcgtgcagggcaacaccgtcagcctggccaccgcgccggaacccggttcacgctgtaccccgaaggaaatcgacgacaacgccatccagaccccgaacctgtggggcaacatgggcgtgttcagcggcgtgctgtacgagcgcgagcaggatggcgcgctggtctactccacccgcaacctgcccggctcgcgggtgttcctgaagttcaccatggccacgccgccgggcgagccggcccacgaaggcctgggcaaggtcggcaagccgcagctggcgcagcacgccaaacagttcagggccgcggccaaggctacgggcgtcgatgacgcgtggctgcgcgcgattgcccatgctgaaagcaacttcgatgcgctggcggtgtccagcaagggcgcacagggcgtgatgcagttgatgccggacaccgcgcaggagtacggcgtgaatgatccgttctcgccccagcagtcgatcgatggcggcgcccgctacatgcgcgcgctgctgcgtcgctacaacggtgatcggccgctggcggcggctgcgtacaacgccggcatcggcgcggtcacccgctacaagggcgtgccgccctatgccgaaaccctggcctatgtggacaaggtgatggcgctgtacgcgcgctaccgcgaggcgatgggcatccgtaccgaggtgccggcgcgctag

SEQ ID NO: 3189 - DNA, 435 bp, Glycine max
  Peptide Sequence Number=SeqID_94874
atgacagaaccatcgaagaagagaaagggatcatcctccatcgccgctgctgctgcccatcaccgccacggaccatccgaagcacccacaacacctatccatccctctttgtcatctccaagatcatccactttgttttcttccgatgatcagcgtctacgtgtttcaaaatttggcttggttgatttcatgtctttaaaattgccatattatcctgaacttatcaaggtcttctactgcaatttaaaaattcaggatggcattatttcttctaaggtgcatggtattcccattatcattgatcaatcattgttcttttctttgactcatttacccagtcaaggtgcaccttttgagggcaccattgttgatgactggaaatttgattattctagtcatgatgctcgccgtatggtttgcaatgaccaggcttaa

SEQ ID NO: 3190 - DNA, 319 bp, Glycine max
  Peptide Sequence Number=SeqID_94875
acccttttggggaggcttcaaggcaataccattgttatctccactcgttctttctccacagccaatttatgcagatatcactattcaagttcgaacatcagagaagaatgggaataatggtatgaatgagggtaaaagtactccaaccagaggctgggaacatccagctattgcttcatttcccgagccatctactttgtgtagtttcttccaaagcaatgcgaggaagggtgtgaacaacaaatggtgggtgtttgtcatcataaggactagcggaagtgtggacacaggatcagaactggctctgataccatcttag

SEQ ID NO: 3191 - DNA, 231 bp, Glycine max
  Peptide Sequence Number=SeqID_94876
atgggtgaagtagaggagatacaagagaagatgaaggtcgacatggaggccatgaaagagcgaatggccacgatgatggccctgatgagcatgaggaagataatggaagccaatgtggttacaattgccgctaccagcactgttgctaaggtgaagcccgatgcccccatctggcctcaaccaaatgaatcatccaaccttagatatggtaggcaaagatttgggaagtag

SEQ ID NO: 3192 - DNA, 728 bp, Glycine max
  Peptide Sequence Number=SeqID_94877
atcttgaagggctggacgtggccaacgtgcttagccagcagggctacgcttcatttgtgttaatttatcgtctgccacacgacggttcagcgcagtatcgccagcaggcttttgccgatacccagcgagcgctgcggctgattcgggccaatgcgcagcagtaccaggtagcgcctgaccgcattggcgtgatgggcttttccgccggtgcctttctcgccgccaatctgagcaacactcccgatgaagctaactatcaggccgtcgatgcgcaggataagcgccctcatctatccggtgctgtcgctgaaacagggcgtgacccacccaggcacgcgcgcggcgctgtacggaaaagatctcagtgcccagcaaatggcgcagctttcgcaggaagatcgcgtcagcgcacacacgccgccgacttttctggtgcaggcgctgaacgatggcaccgcctcaccgcaaaacgcgctgggcatgttcagcgccctgcggcagaacaaggtcaacgtggagctgcatctgttccagcagggcggtcacggctttggcaccggccagaagcaacatctgccggtgcaaaactggctcaccctgttccacgcctggcaaagcagcctggtgaagcggtaagcgggaagcgccgcggtaacgcagatgccgcagaggaaacggaattcctccctgggcagttatacggtgtctgccagcacaccgtcggttag

SEQ ID NO: 3193 - DNA, 355 bp, Glycine max
  Peptide Sequence Number=SeqID_94878
atgacgtttccacatgctatcaaactcgatcgtcctcgcctagcagagaagaatctcgtgcgtcatcgggcttcaatgtctctgaatgacgaaagtgtggataaccaaaaggtatcccccgcatgtcatcggactcattgtccctggatgacaaaaggtgcagaagacgatgttagtctctgcgcgtcaacgggctcatttgcctctgggcctctccgcgtgccaacaaactcacaggtcacgatagtgaaagggcaaggatgggaattctcactctgggtcaaggtttatggtgaattgggattttggatcaaggcttgtagaacggctggacatgatatatgtcaggctgttg

SEQ ID NO: 3194 - DNA, 726 bp, Glycine max
  Peptide Sequence Number=SeqID_94879
atggcccgtacgaagaaaacaagggagatgatgactgaggccgcaaaggaaatcgctgtgaagatcgattcctttaaggagcaggtgacacagggatccttcatcccccacggacgtcaggatgttctcaccactgctattggacgtccagagcaccctggacgtgtctgtgctgttggaaccggtgtcaccatcaagcaatactttggatcggctccacggacgtcccgcagctcttcctccctgcctcctgaagaattgcagcagctgacccaacaaatcagggaccaactagaggagtccatcacagaaagagtgacgcggcagctcatggcatccttcagccagatgcagtcccagatgcaatctcagggacttgcactacctcccgagcctctggttggtccctccgctcctcgagtaagcacaaaggggagttgtgttgatccctcaggaaacgatcttgagatgggtgactcagataggtgcggcttgtacattgaaggagatcatgcccgcctggtttccctagggagagtttatgagggatccactgttgttcataacactcctttgttgcctggccaagtaaaggtgggtgtcgaggaggttacagatgcagatgctccagttcctgtacccactgatgaggtttccttaatggggcagacacttcacaccttccttgcttggccgacacatctggtcaagtctttatcacagcag

SEQ ID NO: 3195 - DNA, 552 bp, Glycine max
  Peptide Sequence Number=SeqID_94880
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtggatccccctgtgggtgcaccgccgaccgaccctgatcttctgtaagggttcgagtgagagcatacctgtccgggaacccgaaaagaatggtgaactatgcctgagcggggcgaagccagaggaaactctggtggaggcccgcagcgatactgacgtgcaattcgttcgtctgacttgggtaggacggtgcggctgctctgttgagccgcgccatggaatcgagagctccaagtggaccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggagtgtgtaa

SEQ ID NO: 3196 - DNA, 210 bp, Glycine max
  Peptide Sequence Number=SeqID_94881
atgctgacatctccggaaagggtgcagatgaccacattggcctctgcttgtcaatcgaacttggggtctctgaatgacgaggttcggataactgtaaggtgtctctgcatgctaccggactcttgggtcatgatagcaaaaggtggggtggttgacaaaagcggggcttttgctcctacgtatcctcaatttgtgaccagacctacgtag

SEQ ID NO: 3197 - DNA, 222 bp, Glycine max
  Peptide Sequence Number=SeqID_94882
atgattcatttggatgaggccagatgggggcatcgggttcactttagtaacagcgctgatagcggcaactgcaaccgtattatcttcttcatgctcatcatggcctccatcattgtggtcattttctctctcatggcctccatgtcggccttcatttgctcttgcacctcctttacttcacccattactctagctcttgcacggattcggacatggggttga

SEQ ID NO: 3198 - DNA, 516 bp, Glycine max
  Peptide Sequence Number=SeqID_94883
atgattatgaggggccaagacatttatagtagccaagatgaggctactacttcacctttctctagtgaaagtgaaaaagcaaaaagggaagaatctagtgaagaaatctacccccaagaagaaggacaacctttaatgaaaaatattaaagaaatttcccctcttagacaacctccaaatcttctcctttgtaaaaagacacttgttagcactgccacacctcttgggcttgatattattcctcaagtaaaggagttgttggatgagggtttggtttgtattattaggcatcaaatccctaaaataggttatatgatgaatgtgttgagtggtgcaaccatcttttgtaaaatcactcacacgcccaacatcttcaagattcgtgtagatagggagtcattaggtgttgaggaaagaaccccagagtttcaagaaccgctggattttaggtcaaatccttttcagggggggatgatgcaatcctactctccaatggcattggatagaggactctaa

SEQ ID NO: 3199 - DNA, 816 bp, Glycine max
  Peptide Sequence Number=SeqID_94884
atggcttctagaaagagaaaaagcattgttacaaggcccacatctcagtatgacacaaggagattctcttcattagatgcttggactagatacattgataatgttctgggaagaaacattttacctgagaggaaagtagagatgtatcacactaagctagatgactttaaggctgagctggagaggcataatttctataaatgcctcaccaatttagccgatgggagcatagacctggctttggaccgtccaccaaagcagtccagagtcagaggtcatttggtgaagattgatgctgacagtctcaacacattcttggagacacctgtggtattagctgagggagagactctacccgcatactccagatactacaggttgcctacagacttcagagagatagaggttgctttatgcatacctggccgagggttcatcttgaactctgagggccatcccgggaggattctcaagaaggatttgactacactagctcaagtgtggagtgtcctcttatactccaacttggcccccacatcacatacctctaatctgtcagtggacagagctaggctgatctttggcctagtctctcacttggatatgaacatagaagcattgatttctggtcaaatgacttctatagtccagtctaacacctctagacttgggttccctgctttaatcaacgcattatgcagagccagaggggttgtatctgacagccttaccttcgagcgcctgagcctggtcactaatttggcctacatcaggaagaactattggaaccccgaggatctaacagtctctatctga

SEQ ID NO: 3200 - DNA, 318 bp, Glycine max
  Peptide Sequence Number=SeqID_94885
atggccataacttttgctccgattatcagaatcgcaattattatatatgcatttgggcattccataacttgtgaatctgtgcattctgttattggtgattttgaacatcctgatcttgagcattataattttgagcattctgattctgagcattctgattttgcacattctgagaacatggaacaacctccacctcgtgagaggactctaagggaaatggctgcacctgatttcacctatgaaagcttgtgcatccaataccctgatgaggatgtcccatatgttcttaagactggactgattcatttgcttccatag

SEQ ID NO: 3201 - DNA, 132 bp, Glycine max
  Peptide Sequence Number=SeqID_94886
atgactaaacaaacttttacaaaaggtattgagggaaaaagcccagagtttaaagaacctctggatttgaggtcaaatccttttgaagggggagggaatgatacaatcctaccacccaagggcattagatag

SEQ ID NO: 3202 - DNA, 477 bp, Glycine max
  Peptide Sequence Number=SeqID_94887
atgactaggggtaatccaggtgatttacaaccctttgatcttgaaacagatagaacctttcatagattagttaggcatagtgtgcatcctgatcattctgtgcattttgagcattctgagtattctgtagctagtgattctgaatattctgattttgagcattcgactactaattttcataatgagaacatggctcaacctccacctcgtgagaggactcttagggagatggctgcacctgatttcacttatgaatgcttgtgcactcaatatcctgatgagggtgttccatatgttctcaagactggactaatacatttgctgcccaagtttcattgtcttgcaggtgaagatcctcgtaagcatcttaaggagttccatattgtttgttccaccctgaagccccctgatgtccaggaagatcatatcttttctaaaggcttttcctcattctctggagggagtggcaaaagattg

SEQ ID NO: 3203 - DNA, 165 bp, Glycine max
  Peptide Sequence Number=SeqID_94888
atgtccccactacactgccaaagcgatgacgagggcatggcaagtcctggatttgggctttatgtggagccatttggtgggcttcaaaaggagagggtagagaaagaagttggtgctagaaatgggtctgtgagagaaggagtgaagagaggagagaggtcttga

SEQ ID NO: 3204 - DNA, 465 bp, Glycine max
  Peptide Sequence Number=SeqID_94889
atgagtcaaccaaatccccttcaggatttgccaggggattcctccttcaattttgagcgttttgacatattatgggtctcaaacggacattcctatcaaaagttacaaccatttgaagtttacttgccacaaaccctaactaaagtaagtgcagtgttggtgttggtgttgaatgctgaagtcggactccaacggaccccagcaatcacgaaccccaacggaggtcatgaaccccgacgacggtcattaaccttgacggcggtcacgaaccccagcgacaacaatggtgaggaggagacgataggcattaggccccctactaatcgagctttcatcaagaagtaccgcgtccccaggcaggcacagggcgaaataccacagcagcctggggatggccggcagcgggcaacagacgcaccgccatcacctctagagttcacctcagctcatccacaaaaaggttag

SEQ ID NO: 3205 - DNA, 330 bp, Glycine max
  Peptide Sequence Number=SeqID_94890
atgatgataacaaaagatgatgacaaaggtgatgacaaaaagctcaaagatcaatcaaagaacaactcaagtgaatcaaagatcaatcaaagaacaactcaaggtacatcctttgtggtacaagtagagggtacatctacttgggttgttgtaactgagaacaagagagggtacatctcttgtggatcaattcaagtggagggtacatccacttggttgttcaaagagaacaagggagggtacatcctttgtggatctttgcttgtaaaggattttacaaggttgaaaagaaatctcaaggaccgcaggtctcttggggactggatgtag

SEQ ID NO: 3206 - DNA, 147 bp, Glycine max
  Peptide Sequence Number=SeqID_94891
atggaaacattaacacatgcacatcgatatcacatcccattagttaaaaaagtcattttctataaaggaaaatcagcatgcaacagggacaggaagatattctcagagcgaggttccctgaccctaactatggtgtcaagacggtaa

SEQ ID NO: 3207 - DNA, 303 bp, Glycine max
  Peptide Sequence Number=SeqID_94892
atggcttctacaagtggagatgctactacaccatctccaaaaactgcaaggctcatggtggagatgattaaacttggtgatcaaatgagaataataagttatgaagatgaagaaatgatggagagaatgagaaaagagaatgaggagagtttgggaagaatacataggagcagtgaagctttaagtgcgaggattgaaaatatagagcgaagaagagaggacaaatcatctaattcctctcatggagaagatgaagggtatgaagaggatgaaggaggaatgagaggtataaggagagaataa

SEQ ID NO: 3208 - DNA, 318 bp, Glycine max
  Peptide Sequence Number=SeqID_94893
atgaagacccccgaggaagcaatggacttgattgaaagcatggctgctagtgacattgctattttgagagacagagcccacattcttactaaaaagatcttattggagctaacctcacaagatgctttgttggcacaaaacaagttactatccaagcaactagagaccttaacagaaacactcaaatgtacaatttgtggtagagctcatgaatctggatgttgtatccctaatgaagaacaaattacacatgaagctaattatatggggaatcaacctagaggcaatttcaatacaagtggatttccaggattttaa

SEQ ID NO: 3209 - DNA, 570 bp, Glycine max
  Peptide Sequence Number=SeqID_94894
atggaggccatgaaagagcaaatggccacaatgatggaggccatgatgagcatgaagaagataatggaagccaatgtggttgcaattgccgctaccagcgctgttgctaaggtgaacccgatgcccccatctggcctcaaccaaatgtatcatccaacctcatatatggtaggcaaagatttgggaagtataggtggcccccattatgcgcaaattcaaaacaagcacgccttcccgccatatggcttgcctcccaactatacaccacccaatacggcgtacactcccagtgagaatgtcaataactccactcccatactcattgagagccgacaaccccaaactgatcatgcacatgtctctcaaaccgtgggggagacacatgaaattccctaccataatctagccgacttcgagccttgcctcagttatgccactaaagggcaagtagttggtggtatactcctacaaaaaactttggagggccttcaatttctcccccaaccacaacccttgcattccacaataggtaaaatcccttatattatggaaggaatgggaaaagtttga

SEQ ID NO: 3210 - DNA, 487 bp, Glycine max
  Peptide Sequence Number=SeqID_94895
atgacccctgttgttctttctgggaatcatgatgaacacgctaagggagctgagctaagcgcgccctgcagcactaagcccaacttccccactgtgattgagtctttggtaataagactgagcacgaacctctgtgctaagcccatgttcacatctcaagaagcttgggagaggtataccgatattgtagtgccttggaaacaactaccggggaggaatgtggtagtttattacactgagtttgacgagttcaaggaggaacttgagagaagacactgggatgaggagttgactgattttattgacagcagcatagatgttgctattgtgaaggaattttacgcgaacctctatgaccccgaggataaatcacctaagcaggtgagggtgagaggtcacttggtgaaatttgatgaggatactttgaacacattcctaaagacccctgtaattctagaagagggggaaatttgtgtgcctattccag

SEQ ID NO: 3211 - DNA, 462 bp, Glycine max
  Peptide Sequence Number=SeqID_94896
atgagcaatttacatgttgacgaagatgatgatgatgatgattattattatcttgtgtctaactcatacgttgaagagtctttagacgaagatgacagtgttgacggtatatttgatacagacgatgaagtcaccgacatgattcaaccagtaagaattgttcacccagcagaaggtgtacaaggaattcaaaatccattttggaatgatgctttgcattataataatatcaactggagtcatcttgatgaagaggacatttgtggtttggagatgccatccagttttaatgttggccaagaattatatgttggcatggattttgatagtaaagatgcagttaagaatgcagtcaaacaatatgttatgaaggtgcatcaaagtttcaaagtggttgaaagcaaatgggacaaacatgatcagagaagatccatcaatcaaaatttctttgattcaagatag

SEQ ID NO: 3212 - DNA, 1146 bp, Glycine max
  Peptide Sequence Number=SeqID_94897
atgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattgcgtcagaccccgtagaaaagatcaaaggatcttcttgagatccttttgttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataa

SEQ ID NO: 3213 - DNA, 654 bp, Glycine max
  Peptide Sequence Number=SeqID_94898
atggcgttgctgctcagcaatgtcctagccagtgatcataactccgaccttcctctgccgaagtgtcagctggtgtatgccatcctgacacggatgagcatccatgtggctcagttgattgctgacgccatctatttatttgaaggtatgccacccaccaggcaccctctagactcggataagtctaacagggccttggggtttccagcgttgatcacgggcctctgccagtcattcggggttcctgtcacacctagtaaggtgatccgaccgccgatcacccgggctttcattgagaagtattgcactcctaggcaggcgcaggggaatgcaccacaggccgcagatgcaccaccaccacctcatcaggctgatcccgctgggtcattaggcacgaagcgttattacggcacttggttcgccagcaggcggccaaccactgggggcagcctcagtcagcagggccagggtttcgctccttttgcatgccctactccagatcagtttagggttgaggtcgcatggcccggagattggcccaaggaccagacggaggaggcacctgcaggagctcccgacaatgcagaggacgcccacatggatgaggagatgacagacttgttcggcttcttgggaggaagcagagccacgtga

SEQ ID NO: 3214 - DNA, 492 bp, Glycine max
  Peptide Sequence Number=SeqID_94899
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaaagcaccactggcagcagccactggtaattgatttagaggagttagtcttgagtcatgcgccggttaaggctaaactgaaaggacagtttggtgactgcgctcctccagccagttacctcggttcaaagagttggtag

SEQ ID NO: 3215 - DNA, 1071 bp, Glycine max
  Peptide Sequence Number=SeqID_94900
atgatcgatgaattccaggataccgatccgcagcaataccgcattttccaaaaactttacgtcggccggcccgattgcggcctgctgttgatcggcgatcccaagcaggcgatttacgccttccgcggtgccgacatctttacctacatgcgggcgcgctcagaggtgagcgcccactatacgctggagaccaactggcgctcgtcgccgtcgatggtcgccagcgtcaatcacctgttttctcaggtagaaaagcctttcctgttcggccaaatcccctttatcgaggtcagcgcggcggaaaagaaccaagggttggcgtttgacctgcacggcaagccgcaaccggcgatgcagttctggctgcagcagggggaaggcgccggtgtaagtgattaccaacagttgatggcgcgcctgtgcgccacgcaaattcgcgactggctcagcgccgggcagcagggccaggcgtggctgcagggcggcaaggagccaaggccggtgcaagcctccgatatcacggtgctggtgcgcagccgcaatgaggcggcgctggtgcgcgatgcgctgagcgcgctgtccattccgtcggtctacctgtctaaccgcgacagcgtgttcgacaccccggaggccaaagacctgctgtggttgctgcaggcggtgttggcgccggagcaggagcgcacgctgcgcagcgccatggccaccgggctgatggggctggacgcgccgacgctggacggcctgagccgcgatgagcgtgcctgggacgagctggttaacgaattcgatgattaccgcacgctctggctgcgccgcggcgtgctgccgatgctgagcgaggtgatgaaagcgcgccagctggcggagaacctgctggccagcgccggtggcgagcgtcgtttgaccgacgtgctgcatctgggggagttgtgcaagaggcggcggcgcaactcgacagcgaacatgcgctggtgcgctggctggcacagcagatcgcccagcctaatcgccagtccgataatcagcaactgcggctggagagcgaccggcatctggtgcaggtga

SEQ ID NO: 3216 - DNA, 413 bp, Glycine max
  Peptide Sequence Number=SeqID_94901
tcgggaaacctgtcgtgccagctgcattaatgaatcggccaacgcgcggggagaggcggtttgcccccgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccggattagcagagcgaggtatgtaggcggtgctacagagttcttgaagtggtggcctaactacggctacactagaagaacagtatttggtatctgcgctctgctgaagccagttaccttcggaaaagagttggtagctcttgatccggcaaacaaaccaccgctg

SEQ ID NO: 3217 - DNA, 278 bp, Glycine max
  Peptide Sequence Number=SeqID_94902
gtgctgtgtccaaggatgccttgattgctgaactcaaggacacatgcaaggtgctggaagcaaccatcaaagccaccacagagaagaagatggagctagaacggctgatcaaaaggctctcagaaagtggcattgatgatgaagaagcagctgaagaagaggaagaggcagctgaggaagacaaagaagcagctgaagaagaagaagaagctgctgaggaagaggaagatgcagcagaagagacagaatcagatgatgattctgaagccaccccatga

SEQ ID NO: 3218 - DNA, 255 bp, Glycine max
  Peptide Sequence Number=SeqID_94903
atgtcagctgaaaaagatcagtcggggctacttgatgaggacataaccaagggcaaggaccatgaagcacttgaaggtcccatgaccagaggcagacttaaacaagcccaacacgtcatagagacaaggctgacttatcaaggtaatccttcaccgcaagtggcgtctaccctgacttatcttccttcaccggaagtggcgtctaccctgacttatcttccttcaccggaagtggcgtcatccaaacctccgtag

SEQ ID NO: 3219 - DNA, 264 bp, Glycine max
  Peptide Sequence Number=SeqID_94904
atgggagaggtgcatttgcccgtaatgccttatgcatacggtaacgaacaagatgggcccagtcaatttgacggccagtttttagtgcccataacaaaatcaaatcttcctcagaggcttgcacaagtgagagagcgtggtgaggaaagagatgggtttggtggtgccagagagtcaatggaagcaccatggcggcggtggcttgcagtggtggtcgagaaagatgagcccttgcgcttctttgatgattcaaccatttggtga

SEQ ID NO: 3220 - DNA, 324 bp, Glycine max
  Peptide Sequence Number=SeqID_94905
catgtttgcattttagtggagaaaacaccgagacttttgcagagtctcacaagttatccagaacgacgtaggtttgagttcctcattggaggatacataggagcaggagcctcgcttttgtcgaccgcaccgctttttgttaccatgacccaaaagctggtagcccgtggagacaccttacggttatccgcacctcgtcattcagtgaccccaagtgtgattgacgagcggaggccaatgtggtcatctgcgccctttccggaggtatcagcattttccggtggagactttctcaagtcttacaagttatctagaactacgtag

SEQ ID NO: 3221 - DNA, 540 bp, Glycine max
  Peptide Sequence Number=SeqID_94906
atgaacaacatgatgacacttcaacacacccagattaaagcatcttttgagacaagcacgcacatggttgggcatgtgtttaaagtgaccttgtacaaaaaagtacttggaatggtatcaagaaaaggtgaagaccaagggtgctccaaaaaaatcattgaccaaacaacaaaagtcaacaacgtgatccgtcttattgggagtatgttgatgcattacactctgtgcaaaatagattctattgaaaacattattaatgtcaaaacggatggtaactgtggttatcgggcaatagctatcttattgggtatgggtgaagaatcatggtcattggtgtgcaaccatctgcataaagaactgacaagctggttggaagagtatatcaacctgcttggtggcattgagagatttaaggaattaaagcattctctacttgttgacgaattatctatggttaccatggacaagtggatgaatattacggatatgagatatgtcattgcttcacgatacaacgtgctagttgtttctctttcatga

SEQ ID NO: 3222 - DNA, 144 bp, Glycine max
  Peptide Sequence Number=SeqID_94907
atgtcggcatcctttttttttgaatcgtcagaattcggggtggcactgccaccggcaacatcgaaatgtgaattcccgaggcgaacaacaatcccgttgcctaaaagccagcgtgtggcggccatcgagagttaccaacactga

SEQ ID NO: 3223 - DNA, 234 bp, Glycine max
  Peptide Sequence Number=SeqID_94908
atggcaaaacctatatctaaaaagggttcgcgtaaaaatgtacgtattgatgtacgaggtcgggtgatttcttggtcctccgccggtacttgcggattcaaaggtacacgaagggggaccccttttgccgctcaaactgcagcaggaaatgctattcgaacagtatcggatcaaggcatgcaacgagcagaagtcatgataaaggtcctggtctcggaagagatgcggcattaa

SEQ ID NO: 3224 - DNA, 605 bp, Glycine max
  Peptide Sequence Number=SeqID_94909
atgcacaccgccacaactccgatcttcccctgccgaagtgtcaattgggatcacgcccacaagacacccagtggacccggagaagtcgaacagggccctggggtttccagctttggttatgggcctttgtcagtcctaccgggtgcccgtcccccccagcaagagtgctcgtcgcccccaacaaagtcatcatgccccctattaaccgggctttcatcaagaagtactgcgccccccaggcaggcgcagggcgagacaccacagcagcctggggatggccaacaacgggcaatagacgcaccgccgccacctccagagcccctcatctcatctacaaaggctggagcgttgcctatgacacgtggccgaccagcgagcgaccaagcccgtgaccgacaagtcatcacgcgtccggctcaagaggttaaagaagcgctactcggaggcaacctagaattggttatgaagaagctccctgcaaagcaatccaggaagggcaccattgaagagggttctagtgcggccccgcaagccgacacaggctttgacaaacaccgattccagagcgtggaacatcagttgcgtttcgaggccatcgagggatg

SEQ ID NO: 3225 - DNA, 424 bp, Glycine max
  Peptide Sequence Number=SeqID_94910
atgggaaacaccctcgtcgaccgcaaaaagataaaaaataaaaaatcacgtcttttccggtttttccgacgttttcctcaaataaacgttggtggcgactccgcgcgtattcctttcttggaacacgcaccagcgatcacgcgtcgccctcccgccgaagggaagatcatttacaatggcctaactaatgaaattaccctcacccatcttggcactaaatttttgttgcatcctcaaacaccttcacaggtggccaaagatcaactaactatgaaagataagagggatgaggaagaaaaactagaaaaacaaaagaaaaagaaggatagtaaggccttgtcttcaaaggccaaggggaaggaaaaggaggaaaaggattcctcagagaagattgttaacaaggaaaatcattttgcaaccaaag

SEQ ID NO: 3226 - DNA, 527 bp, Glycine max
  Peptide Sequence Number=SeqID_94911
atttcaaagctcatttagagcacacaatttcgtgctcttctgttcctctcccttcattcatcgtgcttcttcctccaagctcttatccatggcctcttatggtggaatccattgatgaagaagatcctaggcctacaagctccaatggagcttacatcaaaatataccaccaaaggcttaagccttccaaaacttccctcatccgcggactgcatacatatatgctgctcttcactcccctcatcgccgacttccagtcggcctcggtctatcatctgttgcaacagggcctcgtagatacacctcctgggggtcgtcacgtccttcaaaggcttggtcctgcactgcctatccatctcgacgacattaactgctccccctccatgattggcaagcgggttcgttttcacgtttgggccggttctcttaaaacgtcagccatccggttgcgtcagggttataccactttgggaaaggaggctagtagatcttctcaggagttatcacagccatctgattggcgatga

SEQ ID NO: 3227 - DNA, 246 bp, Glycine max
  Peptide Sequence Number=SeqID_94912
atggatatacctgaacgctgcgccgtacccaccttggttgacattggaatctattgctacgaggatgcaagcgatgactcattcgaggccatgtttggtgctcgaatcctcctggctgatgaaaggatgtggttgacgctccgtcaaaccatgccatttgtcccgatcttcgtccaacctttcctcgaacaaggccatgatgtcctcatccgggaattcctggatgcatgggctggtagtcgttaa

SEQ ID NO: 3228 - DNA, 237 bp, Glycine max
  Peptide Sequence Number=SeqID_94913
atgacaaaaggtgcagaagacgatattagtctctgcgcgtcaacaggcatgctccccccctggttgacgaaagggtgtgtgcgggttatcgtcgggtgtctctacatgccaccagactcttgggtcatagaaacaaaaggtggggtggtcgacaaaagtagggcttttgcccctacgtatcctcaatttgtgatgaggaactcagacctacgtagttcttgcctttgtgatgtgtga

SEQ ID NO: 3229 - DNA, 264 bp, Glycine max
  Peptide Sequence Number=SeqID_94914
atgacgagcacacgttgcgttcgagtcgtatcctcaaaaaaatggagattgaggaaacctagcagggtttatggctaccactgcattatcgagtggacatggaaccaagtcaacataggacaccggaatttgggtgaattctacaggttttttttcgctgcaaaactcatttcttggcgcgtgtttttggattgtgctaaagggatggcctttgtcgataactgggcggtgggtaaggagaaggtttgtttattggctgagtaa

SEQ ID NO: 3230 - DNA, 102 bp, Glycine max
  Peptide Sequence Number=SeqID_94915
gaaatgttcgatcggcgtcatccgatgatgcttcctttatagaccctgatcgttcatctttcctggccgacgtcaactgccatttatatggaatcaatatcg

SEQ ID NO: 3231 - DNA, 283 bp, Glycine max
  Peptide Sequence Number=SeqID_94916
atgactaggggcaatccaggtgatttacaatcctttggtcctgaaatagatagaacctttcatagattagttagccatagtgtgcatcctgatcattctatgcattttgagcattttgagcattttgttgctggagattctgaatattctgattttgagcattcgactgttaattttcatactgaaaacatggctcaacccccacctcgtgagaggactcttagggagatggctgcacctgatttcacttatgaaagcttgtgcattcaatatcctgatgagg

SEQ ID NO: 3232 - DNA, 105 bp, Glycine max
  Peptide Sequence Number=SeqID_94917
atggctcttcagcatagagattctagcaataattggatgcagcatctcttggtcaatgctcccagtgagagaatcttagcttttgacacaactggtaaaatttaa

SEQ ID NO: 3233 - DNA, 288 bp, Glycine max
  Peptide Sequence Number=SeqID_94918
atggtagaggcccttttagtttccattgattcatcaagagaagtaatgcaagcatcaggttcatgtgaagaagtgcatgaacggcagctagcacaagtaactcctcatcatcatcaacaacaacaacatgctcatcatcatcaaatttcaaactcagcttttcatattagtaggtcgtcacatcccatctctaccattatctctcctcccctccatcacacttccatcattctcgatgacaactcttaccatgtctctagcataatgctccaaaatgaaaatttttag

SEQ ID NO: 3234 - DNA, 889 bp, Glycine max
  Peptide Sequence Number=SeqID_94919
tttcgaggctctttccgtggacgaggcggtatttttgttgacggtgttgctcgaggtgtctggtgaggaggctagagccgagacagtacgagcacgcggggcatatgtacgcctctcatgggttcgggacatctatgagatgagatgccaagcaagacgacggattgtagcagctcgtgcttatctcctgcatccggtcggttgcactcttttttctaacaagagtgcaacaaatgttcatgtggtgcatctagaggcttttcgcgacctgggtcagagtgggggttatgcctggggagctgcggccctggttcatatgtatgaccagttagatgaagcttctaggatcacgacacgacagattgggggacaccttactttattacagtgctggatctatgagcattttctgagtgtgcatcagtgtgtcaccgatgatgcgtatgaggagatgtcccctcgtgcctctcggtggttgacgatgaaggctcatatgaagggaattataggagcaccatactgggcatgttgtgatgctttgacggtcatagacgtgtgctggttgccttacagtgaccatcgagggagggtgctacgccagtttgggtacattcagagcatccttctgccgcctgttagcgcttcgttgtcatatgatgatatagatgacagacatgcacctgccccagaccatgaggactacatgcagccggacatcccacaggatgattacgaaggttatgaggcgatcgcagaaaggttggagtgtgtgctcaaccttaggttggtcactgcagggacagagttacatgatatcatccaagattgcctgaggatcgccagagggggtgccagcgtagatggaagtgttagggctcgacaaagatag

SEQ ID NO: 3235 - DNA, 171 bp, Glycine max
  Peptide Sequence Number=SeqID_94920
atgatgagcaccagatctaaagaagtcggaggtgtcgctctccctcaagttcagaagagaaaagtcatagcaccacaatttgatgcacgcgctagttggtggactcaaggacccgatgctataatgcagttggtatctttggatatttgtggtcatcttcatgttgcttaa

SEQ ID NO: 3236 - DNA, 313 bp, Glycine max
  Peptide Sequence Number=SeqID_94921
gaaacatccatttttatctgatttgcatacttgtcattccttatgcatcgaatttgaatctgagtttgaatgtgatcctgtgtctgatttttatgctgaggctgaatctgaatttgagtctggttctgattttttgggtgttgtacctcttgatgttgattttttagagttagaatgcactaaccatgttgcaggaagtacatatgcttttgacttgctttatgaggtacaggccgaggaaccttcttctcctaccatggtgcctcccactgttcagccactgcccacaccatgttgcaggatgattttttag

SEQ ID NO: 3237 - DNA, 207 bp, Glycine max
  Peptide Sequence Number=SeqID_94922
atggagatgggaggagatctccatgaccacatcaacaagttgaaccaactagcgttgttgttgttggccttactaccaaggtccttcaaagctttggttcaaatgttacttgtggaaagatcaactttgaagttagatgaggtgatcgtcgctcttagaataaatgagagaatgatgagaactgaaaatgttgatgatgagcattag

SEQ ID NO: 3238 - DNA, 1126 bp, Glycine max
  Peptide Sequence Number=SeqID_94923
atgcgttacgctgctccgggagaaaccggttctctcatccacctgcaatcgcgttatggcaacttcatcaacggcgaatttgttccgccggtaaacggtaactattttgttaacaccacgccgatcaacggttcgaccatcggcgaattcccgcgctcggataaacaggatatcgacaacgccgtcgccgccgcacaggccgctgcggacgcatggggcaaaacctcgccgcaggcgcgttcgctgctgctgctgaaaattgccgaccggctggaagccaatctggaagtcatcgcggtcaatgaaacctgggataacggtaagccggtgcgtgaaaccctggcggctgatttgccgctggcggttgaccacttccgctactttgccggctgcgtgcgcgcccaggaaggcaccgcggcagagatcgacgagttcaccgccgcctaccactttcatgagccgcttggggtcgtcggacaaattatcccgtggaacttcccgctgctgatggcggcgtggaaactggcgccggcgctgggtgccggtaactgcgtggtgctgaagcccgccgaacagacgccgctctccattaccctgttgatggagctgattaaagacctggtgccgccgggcgtgattaacgtggtgcacggctacggcaaagaggccggcgaggcgctggcttcgcatccgggtatcgccaaaatcgcctttaccggatcgaccgccaccggcggccacattcttgagctggcggcaaaaagcctgatcccgtccaccgtcgagctgggcggcaagtcgcccaacattttcttcgaagacatcatgcaggcggaggaaagcttcatcgaaaaagcggccgaaggcgtggtgctgggcttccttaatcagggcgaagtctgtacctgtccgtcacgcgcgctggtgcaggagtcgatttttgagccgtttatggcggcggtgatgaagcgcatccagaccattaaacgtggcgatccgctcgataccgagaccatgatcggcgcgcaggcgtcgcagcagcagttcgacaaaattctctcttacctggagattgcgcagcaggagggcgcgcaggtgctgcacggcggcggggtggagaaaatcg

SEQ ID NO: 3239 - DNA, 558 bp, Glycine max
  Peptide Sequence Number=SeqID_94924
atgaccccgaggaaacttgcctcaaagagatctaggaaggataaagcggctgaaggaactagttccactcccgagtatgacagtcaccgctttaggagcgttgtacaccagcagcgcttcaaggccatcaagggatggtcatttctccgggagcgacgcgtccagcttagggacgacgagtatattgatttccaggaggagataggtcaccggcggtgggcatcactggttatccccatggcaaagttcgatccagaaatagtcctcgaattttatgccaatgcttggccaacagaggagggcgtgcgtgatatgaggtcctgggtgaggggtcagtggatcccgttcgatgcagatgctatcggccagctcctgggatatcctttagtgttggaagagggccaggagtgcgagtatggccagaggaggaaccggtccgatggattttgcccggactactgccgggagacgagtgcggatcatgcgtaccaacatgaccaccctgactcagatatggatgactttgctgctcagcaacatcctgcccaccgatcataa

SEQ ID NO: 3240 - DNA, 1913 bp, Glycine max
  Peptide Sequence Number=SeqID_94925
atggcggtagcgcatcaacaggcgcaggatctggctgcgccggttcatgcctttgaccagcgggggattgccattggcggtgggcggattgctcaagcggaactcccatgcggcaaagacggtcgtgccggccgctggccagcaatgtccggattccgcagtgtcgccggggggcgcctgttcgccctgctcgacgatatcgccaccctcctcgacgatgtctcggtcctgaccaaggtcgcggcgaagaaaaccgccggtgtgctgggcgacgacctggcgctgaacgcgcagcaggtgaccggggtcaacgccaaccgcgagctgccggtggtgtgggcggtggccaagggctcgctggtcaacaaggtgatcctggtaccggcagcactggcgatcagcgccctggaggcctggctgcacagccgcggctggaacgtgccgctgatcgtgccgctgatgatgatcggtggtgccttcctctgtttcgaaggcgtggagaagctggcgcaccgcttcctgcactcagccgaggacgacgccgagcatcaggccgaacggcgcaaggcgctggccgatacgcaggtggacatggtggcgtgggagaaggacaaggtgaagggcgcgatccgcaccgacttcatcctctcggccgagatcatcgtgctgaccctgggcgtggtggccaccgcgtcgttcaccaaccaggtggtcacgctggccgtggttgcattggcgatgacggtgttcgtctatgggctggtcgcgggcatcgtgaagcttgatgacgtcggcctgtacctgtcgcgcaagggcggagccattgccgctttcggtcgcggtctggtggcgtcggcgccgtggctgatgaagttcctgtcggtggctggcaccatcgccatgttcctggtcggcggcggcatcctgtgctgcggccaacatggtggtcggcatcatcgccggcgccatcgtgctggcggcggtgaccgggttccagaagctgcgcgggaagtgatctgtagagccgagcccacgctcggctgctctacggcgctgcgcgccgccgcccgagcatgggctcgggcgctacagcgtctgcacgctggatcatcagcccgcctgcacccggttcttgccttgccgcttggccgcatacagcgcgtcatcggcgcggcgcagcagggtctcggtatcgtcaccgggctgccattgcgccagcccggcgctgaaatgcaccggcacccgccggtcctgcacggtcagcacgcgtaccagaacgaactcgtcgccgcccaaccgtgcgatgccgtcggtggcgcgcagcagcagcttgcacacggccaccaggtgctgcagcaaagcatcgccacccgcgtgaccgtgcgcctcgttggtcaggtggaaatcatccagatcgatcaccgccacgcccagcggcgagttgttgcgcatggcacgcgccagctcacgctgcagcagttcgtccaggccgcggcggttcagtgcctgggtcagcggatcgatacgcgccaggtcaccagcagcacgcagttcctgctccagctcggcaatgcgctgctctgcgcgttccacttcctgccgcgcgctggccagatgatcgcgggcctgcgcggcctgctgctgcaccttgccggtatcgcgcatcacctcctgcagcagctggttgaggtcggcgatgctgcgcgcctcacgcagctgcagcgcgtagctgccgatgcggtcgtggtattcaccggtgctggtggccatgccatccatgcgctcgatgaactcgcccatcaacccgcgcatcgccgccttcgaatcatcaatgccctggcgcagcagtccctgcttgtagatcacttcgcgcagttcggcgcgggtgcgctcgaccgcttcggcttccagcg

SEQ ID NO: 3241 - DNA, 186 bp, Glycine max
  Peptide Sequence Number=SeqID_94926
atggccttcatcatcctcagattcatgcattcattccataattcaaagattcatgcaaaagtcattacccaatatccaacaccggtgcaactggtggatcctgaacaatgggctgatcaagcactgatgctggtgcagatggctatggatcatcaagaactagagctggagatgactgaggaatag

SEQ ID NO: 3242 - DNA, 465 bp, Glycine max
  Peptide Sequence Number=SeqID_94927
atgagtcatgtttggttacaacgtgtggtgctggcgagtctggtcaccgtgctggcagcgtgcgattctatcccgtttatagataacagttcggattacaagggtgctggccgctccaaaccgctggaagtaccgccagacctgaccgccgtacgtaccagcagtacctataatgtccctggcagcactagctactctgcctacagccagggccaggaggctcaggagcagaatgggccgcaaccggtgttggcggacatgaaaaatgtgcgtatggtgaaagcaggccagcaacgctggctggtggtcaatgcacccccggaaaaaatctggccgatcgtccgtgatttctggctggatcaaggctttgcggtcagggtagagaatcctgagcttggcgtgattgaaactgaatggctgcaatccgacgccatcaagcccaaagaagataccgtgctatggtga

SEQ ID NO: 3243 - DNA, 165 bp, Glycine max
  Peptide Sequence Number=SeqID_94928
atgaatttatattgcattgatgatgctcatgtttcatacttcatattgcatggaaatggtacaaactttttcatttgggactcccttgagactcaggctgatcaccgtggggggcggggggagttgcctgtgcacgacagggtgacctcgacacttactgcctag

SEQ ID NO: 3244 - DNA, 1002 bp, Glycine max
  Peptide Sequence Number=SeqID_94929
atgaatttattgcctagcgcttttcatgtgtcctccaccttcgagtctggagccccacgaattcattgcctggcgaagttcgccaattctccattctcctcttttattcggagccccatgaattcattgcctagcgctgttcatgtgtcctccaccttcgagtctggagccccgcgaattgattgcctagcgctgttcgccaattctccattctccacttttattaggagccctatgaattcattgcctagcgctgttcatgtgtcctccaccttcgagtctggagccccgcgaattgattgtctggcgctattcgccaattctccattctccacttttattcggagctccatgaattcattgcctaacgctgttcatgtgtcctccaccttcgagtctggagccccgcgaattcattgcctagcgaagttcgccagttctccattctccacttttattcggagccccatgaatttattgcctagcgctgttcatgtgtcctccaccttcgagtctggagccccacgaattcattgcctggcgaagttcgccaattctccattctccacttttattaggagccccatgaattcattgcctagcgctgttcatgtgtcctccaccttcgagtctggagccccgcgaattgattgtctggcgctattcgccaattctccattctccacttttattcggagccccatgaattcattgcctaacgctgttcatgtgtcctccaccttcgagtctggagccgcgcgaattgattgcctagcgctattcgccaattctccattctccacttttattaggagccccatgaattcattgcctagcgctgttcatgtgtcctccaccttcgagactggagtcccccgaattgatcgcctagcgctgttcgccaattctccattctccacttttattcggagccccctcaatttattttttagcactgttcatgcgtcctccaccatcgagtctgggagtcccgcgaaatga

SEQ ID NO: 3245 - DNA, 1245 bp, Glycine max
  Peptide Sequence Number=SeqID_94930
atgggaaagttggatcatctagaggaaaggctcagggccattgaaggaggcgaagattatgtctttgctaacctagaagagttgttcctagtacccaatatcatcacccctcccaagttcaagaggctgcacaccctcaccttcagaggactacacgccctcaccttcagaggactacacgtcctcatcttcagagggttgcacaccctcaccttcagaggactacacgcccttaccttcagaggactacacgtcctcgccttaaaagggctacacgccctctccttcagagggcttcatgccctcgccttcagaggactacacatcctcctcttcagagggccacacgccctcccattcagagggctagacatcctcgccttcagaggactacacgtcctctccttcagagggctactcgccctctccttccaaggactacacgtcctcgcctttaaaggactacatgtccttgccttgagagggctgcacgccctcgccttcagaggactacacgtcctcatcctaagaggactacacgtcctcgccttcgaggactacacagggctgcacgccctcgcctgcaaaggactgcacgtcctcgccataagaggactacactccctcgccatcagaggactacacattctcaccttcagtgggctacacgtcctcaccttccaagggctacacgtcctggccttcagagggctacccgccctcaccttcagagggctacccgccctcgccttcagaggactacacgtcctcgccttcagaggtctccacgccctcgcctttagaggactacacgtcctcgccttcggaggactacatgtccacaccttcagaggagtacacgtcctcgccttcagatggctacacaccctcgccttcaaaggacaacacgttctcaccttcacactactacacgtcctcgccttcagaggacaatacgccctcctcttcagagggctacatgccctccccatcaaagggctacacgtcctcgacttcagaggactacacgccttcaccttcagaggcctacacgccctcgcctttagaggactacacatcctcgtcttcagagggctgcactccatcaccttcaaaggactacacgtcatcgccttcagatggctacacgccctctccttcagagagctacacgccctctccttcagagagctacacgccctttcctaccgaggactacacgtcctcgcctttagaggactacat

SEQ ID NO: 3246 - DNA, 192 bp, Glycine max
  Peptide Sequence Number=SeqID_94931
atgtcacgaaatgttcgccgaggtggacaaatatgggtacgcatatttccagacaaaccggttacagtaagacctactgaaacacgtatgggttcaggaaaaggttctcccgaatattgggtagctgtcgttaaacctgggaaaatactttatgaaatgggtgggctgataatagcggagcacgcgaactga

SEQ ID NO: 3247 - DNA, 291 bp, Glycine max
  Peptide Sequence Number=SeqID_94932
atggagggaggcataggtcaaatactaaacatcactcccaaagaagagaaaaggaaagaaggcctcaagagagtctgcccacaaggtctggattggctcccaaagctaagggctgtgagagaggaagagactgaagctctgaaagagagcaaagaggtacaagccctaaaggcagagcttgagaaagcccaagcagtcaaggaaaagttcaagtcaacagccgtcaaagttcaaaaggagtatgatgaactgaaagacatcaacatggccatcgccgaagccttggagtga

SEQ ID NO: 3248 - DNA, 509 bp, Glycine max
  Peptide Sequence Number=SeqID_94933
ggtggacccttgggtacttgtacctatcacttttagaggactacacgtcctcgccatcagagggctgcacgccctcaccttcagaggactacacgtcctcgccttgagagggctacacgccctcaccttggaggacttcatgtcctcgccatcagagggctacacgccctcaccttgggtactagttaccctcaccgttgagaggactacacgtcctcgccttgagaggactacacgtcctcaccatcagagggctgccgcgaggactacacgtcctcaccatcagagggctgcacgcccttacctccagaggactacatgtcctcgccttgagagggctacacgccctcaccttggaggactacacgtcctcaccatcagagggctgcacgcccttacctccagaggactacatgtcctcgccttgagagggctacacgccctcaccttgggtactagttaccctcaccgtcagaggactacacgtcctcgccttgagaggactacac

SEQ ID NO: 3249 - DNA, 656 bp, Glycine max
  Peptide Sequence Number=SeqID_94934
gcaatccatctgacttacaaccctttgaccctgagatagataggacatttcatagattagttaggcatcattttataccttttgatcatcctgagcattccattactggtgaatctgtgcattctgttattggtgattttgaacatcctgatttggagcattctgattctgagcattctgattttgcacattctgagaacatggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcagtggcaaaggagtggctgtattaccttgctccaaggtccatcacgagctgggatgaccttaagagagtattcttagaaaaaaatttccctgtttccaggaccacaaccatcaggaaagatatctcaggtattagacaactcagtggagagagccttaatatggagagaagtatgatagatgctgccagtggtggagcccttggagacatgactcctgctaaagccagaaatttaattgagaagatggcttccaactcccagcagtttagcgcaagaaatgatgctatagtcattagagga

SEQ ID NO: 3250 - DNA, 351 bp, Glycine max
  Peptide Sequence Number=SeqID_94935
atggtgtggcatctccaatcacctttcctccttctccattctgctgccatttctcttcaagaagcaaaggactccattggtgaagaatatccaaggactacaagctccacatggagctacatcaatgggggtgagataatcctacaaagtgtgctcctgcgggtctgcctcattacctctgtcgcaacctacccttttgtgggcaagcgaggcgaggctcacgggtgcgtcttccaaaggaggaaaatgcacggagtcgccaccaacgtttatttgtggaaaatgtcgaaaaaaccgaaggaaaccggtcatgaagaatattctagattcgggagttgtatttacgtttga

SEQ ID NO: 3251 - DNA, 822 bp, Glycine max
  Peptide Sequence Number=SeqID_94936
atgaatgataaagatctctcgacctggcagacgttccgtcgactctggccgatgatcactccttttaagaccgggctgattgtggccgccattgcgttgattatgaacgcagcgggggacacgctgatgctgtctctgcttaaaccgttattggacgatgggtttggaaaaaccgacagcagcgtgctggtgtggatgccgctggcggtgattgcgctgatgctgatgcgcggcgtgaccagctttgtttcaagctactgcatttcctgggtttccggcatggtggtgatgcagatgcgccgccgcctgtttggccacatgatgagaatgccggtggccttcttcgatcagcaatccaccgggacgttgctgtcgcgcattacctatgattccgagcaggtggcgtcttcttcttccagcgcgctggtgaccgtggtgcgcgaaggggcctcgatcattggcctgttcatcatgatgttctactacagctggcagctgtcggtgatcctgatcgtgctggcgccgatcgtctccatcgccattcgcctggtgtccaagcgttttcgcaacatcagcaagaacatgcagaacaccatggggcaggtgaccaccagcgccgaacagatgctgaaaggccataaagaagggctgatcttcggtggccagcaggtggaaaccgagcgctttaactcggtgagcaaccgcatgcgtcaacagggcatgaaactggtctctgcgtcttccatttccgatccgatcattcagctgatcgcttcgctggccctggcgttcgtgcatttgccgccagcttcccaagcgtga

SEQ ID NO: 3252 - DNA, 435 bp, Glycine max
  Peptide Sequence Number=SeqID_94937
atggttacctcggaggaaaagcgaaaggtcagattagggtttcgttctctatcgaaaccacaaggcaagttggaaaatttcgcttcggttgaagggttcctctcggtgtggggtttcaacggagaacaacggtggtttgtgctgcagaccaaatttcgagaagagccaacggttaacgaaggctgtgaagcatttttaccgaggcagttccatgtagcttccatgagaagcttcattaagaggcttcctcaagaagcttcttcatggcttctttgtgaaggaagcatcatcctccttgcggcagggtataaagtgtgtcatcttgctaaacctatcaaccaccacaaagatagagtcaacacctctttgggttctaggaagcccaaggacaaagtccatactaatgtctacccaaggtgcatatgggatggataa

SEQ ID NO: 3253 - DNA, 249 bp, Glycine max
  Peptide Sequence Number=SeqID_94938
atggattcaacaagcaattctcctcaaatttcagctagcccacatcaattagactttgcaccttatgcttcagggtcctacaatgctaaatggaatgccctggggcttctccatgacaagcacacgttgcgttcaagtcgtactctcggagaaatggaggttgatgaaccttggctggggttatggataccattgaattatcaagtagatatgggagcaagtcagcataggacactggaattggggtga

SEQ ID NO: 3254 - DNA, 438 bp, Glycine max
  Peptide Sequence Number=SeqID_94939
atgacaaggggcaatccaggtgatttacaaccttttgatcctgaaatagatagaacctttcatagatttgttaggcatagtgtgcatcctagtcattctgtacattttgagcattctgagcattctactgagggtgattctgaatattctgattttaagcattccattactaatttttatattgagaacatggctcaacctccacctcgtgagaggactcttagggagatggctgcacctgatttcacttatgaaagcttgtgcattcaatatcctgatgagggtattccatatgttctcaagactggactaatacatttgttgcccaagtttcatggtcttgtaggtgaagatcctcataaacatcttaaggagttccatattgtttgttccaccatgaaaccccctgacgtccaagaagatcatatctttctaaag

SEQ ID NO: 3255 - DNA, 453 bp, Glycine max
  Peptide Sequence Number=SeqID_94940
atggcagagccatcgaagaagagaaagggatcatcctccactgctatcgccgccacggcccatccgaagcacccacaacacctattcatccttccttgtcatctccaagatcatcaacattgttttcatctgacgatcagcgtctacgtgtttcaaaattctggccttgttgatttcatgtcattaaaattgccatattatcctgaacttgtaaaggtcttctactgcaatttaaaaattcaggatggcattattatctctgaggtgcatggtattcctatggtcattgatcagtcattgttcttttcgttaactaatttacccagtcaaggtgcaccttttgagggcaccattgttgatgactggaaatttgattattcgagtcatgatgcttgccgtatggtctgcaatgatcaggctgaaatgaccgtagattgctggccgggtcattaa

SEQ ID NO: 3256 - DNA, 483 bp, Glycine max
  Peptide Sequence Number=SeqID_94941
atgcatagagcaatcagaattttcgagtcatcaccaaaggcttctgcatcagcgttgacactctccacccctctttggtttatgcttctgtgttttcttccatgcttccaccttataattctcagatttattggaggtcccactagaaggatcaacaccaatccgtgcctgttcctcctctaccagctcaatatctttcctttcaccttagcttttgaaaactacactgtaatttacaaaacaaaagttgaaaggaaagatattgacatgatagacgaggaagaagcacagattggtagtgatcgttctagtgcaacctcgaataaagctgagatttataacgaggaggcacggaagaaaacacagaagcataaaccaaagagggtggagagtgtcaatgagcttccctttattgttggaaaactttgtcgtgcagaacaagttggaaccaactggggaagtgaagtcttgcaagtgttgtaa

SEQ ID NO: 3257 - DNA, 114 bp, Glycine max
  Peptide Sequence Number=SeqID_94942
atgtggataaacttttggcaccaaatcgtccatgtcatagcagcttatggttgtgcgtgtctgggacgcaagatcaggatcaaagactataaagctaagagggcatacagataa

SEQ ID NO: 3258 - DNA, 147 bp, Glycine max
  Peptide Sequence Number=SeqID_94943
atggagacgccacttcaagtagaagatgagtctagaagaagctcaccaccacaggaagccatggataagagcttgaagggaatttcagttatggttcagcccactaatccaagatcaagtctaagattctccactaagtgtgcttag

SEQ ID NO: 3259 - DNA, 423 bp, Glycine max
  Peptide Sequence Number=SeqID_94944
atgtcacgaaaccttacggattacgcaatcgtcccctctttggcttccgaaatgttatggaactttacggattgcgcattaacacttcctttcaactcccgacatgtcgcagaacttcacggatcgcctaacgatgggtgtcaagtacctcgaagtggtcaagcgaaggtcgcatcccaccaaacagatggttcccggacgaaattaggattgaaaggcatgtggagaagcatgcataaggaccttcaagctcaaactcacataattaagcagctggaagaccttaacaacactccaggacacgatggtgagcgtgacgatgaacataatggtgagcgcaacggcgaacacggggtcagagatggtggcagtgatgacactgaggaggtcaaagtcgtgacgagggtgggtttgcaagactga

SEQ ID NO: 3260 - DNA, 264 bp, Glycine max
  Peptide Sequence Number=SeqID_94945
atggatgataacaatcaaactcttaaggaattggctacacgtgatgttgtgtatcaaccttggtgtattcaatatcctgagatagaggttagttatgacattaagtctggattgatccatttgctgccaaagtttcatggtcttacaggagtatgtgatgcaatcttaccccctagggtattggatagaagactccaagaggattgggctagagttgctaaagaagaccctagggttctcatgaacctcaggatagatttctga

SEQ ID NO: 3261 - DNA, 990 bp, Glycine max
  Peptide Sequence Number=SeqID_94946
gcttgggagaggtatacagacattgcgatgcctcggaagctgctaccggagaggaatgtggtggtttattacaccgagtttgaggagttcaaggaggaactcgagagaagacattgggacgagaagttgaccgattttgctgacagtagcatagacattgctattgtgaaggaattttatgcgaacctctatgaccccgaggataaatcacctaagcagggggagaacttgtgtacttattccagatttgcactcctgaggtctgatcctcaggagttggctgctaagctctatatcccagggaggggattcaagcttaacgttgatggactgcgattaaagatcttacagaagaatctgaccacactcgctcagacatggagtaagatggatataaacctgggttatattatttcagctcaaatttctctgatcgcccaacatgactcttctaggcttgggtttcctgccttaatcactgatttatgcaaggccaggggagtcatttttgattcattgacattggagagcctcgatccagctattaatgtggcttatgccaaggggaagaggtgtaaggctcccccatcttctgagattcctccttcctcagctccagcaccaattgcatctgccccatctgcatctacatctgtggcctggctaggagcccatccttctccttctggagggagtggggcctccacagcccagaagcctgctcctgaagagccagcagcagcagcagcagcagtagagggggaggatgagctcacccctcctgagcccttttattttgatgtagatgcacacatggctcagggggaggggacttccacatatcagatacctaagccatctcctgcacctgttcctgaagagacccagccatctacaccagtcacggagccagaacaacctatccaggattcatcagtagctccagcattggatcttaatgaagatcaaccacaggaacaggatatgcaa

SEQ ID NO: 3262 - DNA, 363 bp, Glycine max
  Peptide Sequence Number=SeqID_94947
atggcaaacctgtggatccagacgtgttgtttcctactaacacctcctcccactttgagtaaagtgtgctttcagccaaagcacaggcttcaaattcctgaaatgagaaatttagagtacttacctcgtaagttatggtgggtagcgacgaaagccctccaacgacgtccaaagttgcgggttttgattcgtaagagtaaggaaaaccaaaaaaggggtagagaagagatgaagagagagggagaaggtgagaaatggaaaggagaaaaggaagtgagaaatctgagggaaagggagggagaggggctagggttcagtaacgaagaggggaaggccttagaatgccaccgcgtcattacctag

SEQ ID NO: 3263 - DNA, 1353 bp, Glycine max
  Peptide Sequence Number=SeqID_94948
attatgagtcgttactcgataccgcgatgctggaacagtacatggatctggttggcccgcagctgatccaccaaagcctggagatgttcgaacagatgatgccgggctatctggcggtgctggactccaacatgacggcgcgcgatcagaaaggcatcaccgaggaagggcacaagatcaagggcgccgccggttcggtcggtctgcgccatctgcagcagctggcgcagcagattcaaacgccgacgctgccggcctggtgggataacgtgcaggattgggtggatgagttgaagcaagagtggcgcaacgacgtgcagtgtttgtcaactccgagcacgaaccagttgacagcagcgacaggagtaagagtgatgaaaaaggtgggtgtagtcctcagcggcagcggcgtttatgacggtacggagatccatgaagcggtgctgacgctgctggcgttggatcgtgccggcgcgcaggcggtgtgctttgcgcctgataaccacaacgccatgttattaatcacttatcgggcggaggccgcgcagctggatgcgctgatcgtgcccggcggctttggcgccgccaagaacctcagcaatttcgccgaagctggcgcggaatgttgggtcgatgaagatttggcgcgcctgacgcgcgagatgcataaggccaacaaaccaattggcctgatgtgcatcgcgccggcgctgttgccgaaactgctggatcaacaagcgcggctgaccattggcaacgatccggacctgggggaagtgattgacgccatgggcggcgaaccggtgatttgcccggtggacgacatcgtggtggacagcgatcacaagatcgtgaccacgccggcctatatgctggcgccgtcgatcgcgcaggcggccctcggcatcgataagctggcgctcagccacaacgagaagcgcccgacgcgtatccgcggcgcctccacgctgtcgcagcaaaccgccaagaacctgtttctgtgggatggccgcagctggctgcgcaaagggctggaggccggattgacgtcgggcatcgagctggtgtggaccaaacggcgcattctgacggtgtatctgaacatcgtcgagttcggcgacggggtattcggcgtggaggaggcttcacagcgctttttccataagccggctaaacggctgagcgcggccgaggcggcgctgctggcagcggtattgccgaatccgcatcgtttcagggccgatgcgccgtccggctatgtggtgcagcgtcaacagtggatcatgcgccagatgcggcaactgggccggggaagcgtttttacgcgagaactcgcttggattaaacgggcgg

SEQ ID NO: 3264 - DNA, 719 bp, Glycine max
  Peptide Sequence Number=SeqID_94949
attggctcgccaagttaaagattatcaacgaaaagaacttcgaagctccggaagaggatgaagaagtccgagctctgaaaaccgaactaggaaaagcaagacttgccaaagaaaaatttaagttggtcgctacagatgtccggaaagagtatgccgggttacgagaagaaaatgcagctaccgcaaaagcccttgaacaagaaaccaagagggcttacaaggaagagcatggccatgacaaattccgtggagcgttatggggcagcaacagtgagctcaagcttcgaagggaagagagagaccgatcacgagcacatagcatggttttaaaagaagagttagccgtttgctcaaggtccaaaagaaacttgtctcagcgtttacgcgagacagagaccaacatgttagctatcatcaccaagtaccaagaagaactaagtctagccacggcccacgagcatagggtggcagacgagtatgcccaagtgtacgcggaaaaggaggctagaggaagggtgatcgactcgttacaccaagaggcaaccatgtggataaaccgatttgctcttaccttgaacgggagtcaagaacttccccgattgctagccaaggctaaagcaatggcagacacctactccgcccccgaggagatccacggacttctcgactattgtcagcatatgatagatttaatggcccatataattaggaaccgctag

SEQ ID NO: 3265 - DNA, 301 bp, Glycine max
  Peptide Sequence Number=SeqID_94950
atgtatgaatatcctaggagaacccgcgcgttaacgcataagcattcctttcaaaattcgtgtggatattcgtgttttgttggaaaaaaggaaatggctccgaagaaactctccacggagaggtctagaagacatgccacaggagaaggatccagtgccgccccagagtttgatagtcatcgtttccggagtgccgagcaccaacaatgcttcgaggccattaggggatggttgttcgacagggagaggcgtgtccagctcagggaggatgagtatacagactttcaggaggagatagctc

SEQ ID NO: 3266 - DNA, 1047 bp, Glycine max
  Peptide Sequence Number=SeqID_94951
atgggacctctccaaaggcaagccttccgcaaagtgtacgggaagattctagatttgaccgcagcggaggtatttacggaagctgtcatatccctcgcccaatactatgaccagccgttgaggtgtttcacgtttggggacttccaaatggatgccctcttgggggcagaaaaccgtatattttctccggatttcttgggggccttgagcaagattgcagcggtgggtggagatttagcaaaagagttggatcgcatgaagcaaactcggaacggcctagtgggcctgccttggaaatacttggaaggcaaggcaagggatatggcaagccaagagaagtggggcccgtttgcggatatattagctttgttgattttttgggttgtcctctttccgaacgttgacggtttggtagacttagccaccattgatgctttcctcgcatatcaccatagcaaggaatgtccagtggtggctatcttggcagatttgtttgacacctttgaccggaggtgtgagaaaaacagtgcacggattgtctgttgtttacctgctctctgtgtgtggttgatttcacacctattccaacaagacacaagacacccgtgtccgcttcaaagttatcgctcatgcgccgaaaaaggaagagtcgattgggaccaacatttggcgaagatagggggcagcgcaatcaattggttttctcgttggaaggaaggcaaggaaggagttcttttctcgtgtggggactaccctaatgttccattgatagggactagggggtgtattaattataatctcgtgctcgccataagacagctagggtaccccatgaggggagcgccaacagaagggagtctctcacctttccttgtgaaagatttaggcgcgcaaggtctcaaggttatacaaagaatccacaaggcgtggaagagtccgttgaggaaagacaaggagcttaggggcatccgtaatggcgtcatcggaggttatcatggatggctaagaattcacacgcgagggttagattggctctccaagttgaaa

SEQ ID NO: 3267 - DNA, 262 bp, Glycine max
  Peptide Sequence Number=SeqID_94952
gctaaaggcccaagtggagaaggacgaaggcccaagtggagaaggacaaagcccccgagtggagaaggatgaaggcccaaacttatcttccttcattggaagtggcgtctaccccgacttatcttccttcaccggaagtggcgtctatcctgacttatcttccttcaccggaagtggcgtctaccctaacttttcttccttcaccggaagtggcgtcatccaaatcttcgtagcctgtatcaaacgatccgctcctactcag

SEQ ID NO: 3268 - DNA, 686 bp, Glycine max
  Peptide Sequence Number=SeqID_94953
atggtggccggtgttccggcggccaagagcaaatccatcagcgttgggcgaccgcattgtgggcgtcgccagccgggcaagcccatggaagatgtgattggctggcgtctggacgacgtggtgtccaaaatcaaagggccgaagggcagcaaagtgcgcctcgagatcctgccagccggcaagggcaccaaaacccgtaccgtgacgctgacgcgtgagaaaatccgtctggaagatcgcgcggtgaagggcaccgtgcacaacgtcggcaaagagaaagtcggcgtgctggatatcccgggcttctatgttggcctgaccgatgatgtgaaagtgcagtgcagaaactgcagaagcagaacgtcgacagcatcgtcatcgatctgcgtaccaacggcggcggacagcgacaacgacggcatcgtttactacaaaggtccgctggtggtgctggtcgatcgcttcagcgcctcggcgtcggaaatctttgccgcggcgatgcaggattacggccgcgcgctgattgtcggcgaaccgaccttcggtaagggccggtgcagcagtatcgctcactcaaccgcatctacgatcagatgctgcgtccggaatggccagcgctgggctcagtccagtacaccattcagaagttctaccgcatcaacggcggcagtactcagcggaaaggc

SEQ ID NO: 3269 - DNA, 237 bp, Glycine max
  Peptide Sequence Number=SeqID_94954
atgtctcacgctgtcaaagataatcgagggaagtgggcccctgatgaggacatgaccaagagcaagggcaaggatccacttgaaggacttggagggcctatgacaagggctagagcaaggaaagccaaggaagctcttcaacaagtgttgtccatactatttgaatacaagcccaagtttcaaggagaaaagtccaaggttgtgagttgtatcatggcccaaatggaggaggactaa

SEQ ID NO: 3270 - DNA, 1980 bp, Glycine max
  Peptide Sequence Number=SeqID_94955
acagatttccggcagcggcgcgcgctgcgcatccagcatcagctgcagcggctggcgcgcataatcgctcgccgggctgagcgggtgcggacaggtgtgcagcagcaccagcgtgttgaggcaggccgccatgtcgcgctggccaaggccatatttcgccagctcgacgaggaaactgtcgtagccgttttgatggcgcaggttgcgcgcctgctgataatcgctgaccccatagcgcgcggccgtttgtgccgcgttcagcgtgccgcacacgctctcgtgccagccgaaactgtcgtgttcaatgccgcagaaaatgcgccccatgtccgagtagagacagtggccggcggtgagccggaaagtgtgctggcacttgagcgtatccggcgcgttgtagcgctccagcaggttttccgggttataaaacagcaggctggcgctggcgccgccctccacatcggtcagcgtcagcgcgctaccgctgcgcatgacaaaagaccagtgcgccccggcgggcagcagggtttggctgaagccctctttcagatcgtgggtgatcatgaaaatggtcagctgatgctgctgccacagctgggtgatcagctgatgcatctcgctgcgaataccgggatcgagcgcgccaaaaggttcatccagcagcagaatgcgcggctgtttcatcagcgcctgcgccagggccagacgttgctgcatgccgcccgacagctgatgcggatatttgctctgcgcctgttccagtccgacctgcgccagcattgcctgcgcgcgctggcgaatcgcctgacgtttgcgtccccagacgcgtcccagccagcgtgcgctgctgaactcgtcagccagcatcacgttgccgagcaccgtcagatgcggaaacaccgagtagcgctgaaacaccacgccgcgatgggcatccggctcgtcgggaatcggtgcgccatccagcagcagctcgcctttggtcggcgcttcggtgccgagcagcatattcagaaacgtggttttgccgcagccggaggcgccgacaatcgccacgaattcgccgcgctcgacctgcatattcagccgctccagcaccacctgatcgccgtcgagggcaaaggccagcagggtgatccacgccacgtacggcagaatcacatccatggccagatagcggcgcatcaggaagatgcgataaccgaggccttccgtggccgcaatcgcttcggcagcaatcaggaacagccacgccgaacagagcgacagccgcaccgcatcgcacaggcgcggcatcagctgcggcagaatcacccgccacagaatctgcgcgctatgcgcacccagcgtctgcgctttgaccagctgctcctgcgggattttctgcacctgcagctgcagatcgcgggcgatcagcggcgtgatgccgataacgatcagcaccactttggagacttcgccaaggccaaagcagataaacagaatgggcagaatcgccagcggcggtaccagcgcaaacagcgtcaccagcggtgccagcaccgcgcgcaccaccggcagcgcgccggtgaacaggccgattgccagcgccagcagcgcgctgatagcaacgccgctcagcaaacgcagcaggctggcggcggtatcgctccacagcagatactcgccggtgcgcgggctgggctgaaacgccatccggctgatggcctcgcccatagcgttaaatcccggcagcagtttgtctgccgcgttcaggctgagacgcgcatccgacgcgaacagatagaccagcagcaccgccagcagcggcagaatgccaagcagcaggcggccgagcggcagcggttgctgaccggcggcggccagtttggtgaaggtgtcggtaaagcgcagtttgatgttgccggcatcgccccagttaccggccggggtagcgacccctaccgcatcggcccccggcgcgccttcgcccagcagacc

SEQ ID NO: 3271 - DNA, 879 bp, Glycine max
  Peptide Sequence Number=SeqID_94956
atgtcgcagagttcagatgtatcgtatttcatagggatgtcgtctgtttgccacaggagggcggcgcgtggcgacagcgccgcaggggaagcgttacacggcgggcttcttgaaggcctgtttgtgcgagatacgggaaatcagctcggtcagcgacagcaccatggtggagcgcaccatctgcaggtagcgctgctgctgcatggcgcgcagcgcggcgtcgtcgcgggtgaaatcgggttgcggcggccaggccagcacgcagtgcagttcgccgaacgggccgagtatttcatcgtcggtaaagcggtagtcgctggtgtcgtgattcagctcctcacgcagcgccagcagcagctcgcagtcttcgtattcgtggcgattgatcacccccaggccgtagatgagcttcaggcgtaccgagagctcgcccagcgggccgtcgcccagcagcagcggttccaccgcatatttcaccgcgtagtcgtctttgcgaaagacctgcagcaccagcagattgactgcttccgccagcagttcgacagcggcgatcaggaagcttctcaccgaacgaccggcgttcagccgctcaagcacccggttttcaaaagcctgcttctcttccattattgcctgcatcattcagctaccgtcgacgggcacgcggctgccgtgcccgaattgaccactaaagggcgcgcattatgccatagcgtgaaatctccgccagcgccgcctgtgggcctttctgcgcgatcagcgacgccagctcctgcgcctgcggatcggcttcgctgcgatagtgcatcgcggcggcaatgccttgcaccaggctggcgtgcggcagctgatactccagcgtgcccagcgtcggcttga

SEQ ID NO: 3272 - DNA, 213 bp, Glycine max
  Peptide Sequence Number=SeqID_94957
atgttctatcggcgtcatttggtgacaacttcggttgagctcgatttcttaatggagtttgttgaaatggatgatttgattcacaaagcaatccaagtggagcaacaattaaaaaggaagggagtggctaagaggagttttaccaactttggttcttctagttggaaagacaaaggtaagaaagatggggggctgctacttctagtgatatga

SEQ ID NO: 3273 - DNA, 303 bp, Glycine max
  Peptide Sequence Number=SeqID_94958
atgcaagatataacgttcactcattccatactccccctatgttttggaattaatgatctcttgatttctaagcttctaaaccctgtttctctccccctttggcaacatcaacaagccaaagtacatggaaggtggtggaaggtcgaagcaccgacgaagataactcacatagtcttcaagctaagtgatgcgggtatccatttctttcaaagcgaacatccaaggaatcaaagtgttgccaacatagtgcagaggcctcacaattccgaaagaacttcattcataagggctgagaatcatctc

SEQ ID NO: 3274 - DNA, 93 bp, Glycine max
  Peptide Sequence Number=SeqID_94959
atggagaatttgattgtagagaagtttgagggaaatgcaaaagaagagagtgcgatgctcaatcaagaaatcaattttagagaaatcttatga

SEQ ID NO: 3275 - DNA, 1161 bp, Glycine max
  Peptide Sequence Number=SeqID_94960
atgagtcatcatgaagaggagactcctaagaatgagtctcataagcaagaagaacataagatgaccgaaaatagtggacaaggtaagccaatgcagcgaatgagaactggacgaggaaaaggaggaacaattggtgcaaatgctacgcacagtggtggaacaagtgtagacaccaggatctcagaaggagacaattcaggtgaacatgataccaatacatggataattgacacagggacttccaaccacatgattggaaacctgaatcatatgcatgaactacgagatattcaaagttgtccagttggacttcttaatggacaacatacaacaacgattaaagaaggaagcgtggtgctagatggaggcttaaaatttactaatgttctctatgaccgtatttcgaagacgctgattggagtaggtgaacaaagggatgaactcgatttcttcagaggagttcgaaatgtgagagcttacaaaattgatggtttgcattccatagacttgtggcacaaacggttgggacatccttccttgaagatcacccagttgattcctgaagttagaaaacacaaagaaagccaggcagtgaataaaacattgggagtaaaaagtgcatgtggctacccatatgacaagaaagggtggaagctgtttgacttagaaacaaaagagatttttatctctcgagatgttgaattcgttgagaccaagtatcctttttctattgatgttattaccagaaaagatgttcctcctaaaaattggagttgtgaagaaattgttaatgatgtgactaatggtgtagaagaaacggatcacacaagaggtaccaaagaaagtgatgatatgacaatggatgatagaggaggtgagccagatgcggggtttgatgaacaagccgaagctggacttctaggagctaagccatcaaatgtgtcaattgaacagaatcatcatctggcacttgtagcaagcttgccttttccttatcctaatcaatatcggtggttagcgcctaaagagacccattgggaggctaatctccatgttgttcgatacctgaaagggaatctggatagggtgttttgttgcataaggattgtgacctacaactatctgattgatgtgactctgattgggctgaatgtcctttaa

SEQ ID NO: 3276 - DNA, 129 bp, Glycine max
  Peptide Sequence Number=SeqID_94961
atggagcatgagcaaggggaaatgatagttaaccaacaagtgaaggcatggaatattctcttaggaaggccatggcaatttgataaggagatcatttacaatggcctccctcacccatcttggcactaa

SEQ ID NO: 3277 - DNA, 219 bp, Glycine max
  Peptide Sequence Number=SeqID_94962
atgggtctcaaaatctaccctaaggctcatgagaaccctagggtcttcccttggatctctggcccaatctacttggagtcttctatcaatgcccttgcgggggatcgtgcctgcaagacacccggtggacccggagaagtccaacagggtcctggggtttccagctctgattacgagactttgtcagttctacgggagtgcccgttgcccccaacaagg

SEQ ID NO: 3278 - DNA, 420 bp, Glycine max
  Peptide Sequence Number=SeqID_94963
atgtgggcatgggaacgatgcacgactttggttccaaagagaactcctcctataatagaaaacaaaccactaggacacatgtggctgcgacgtggaaaccaacatattggcaatgatgatctaatagttttccgtcgcaaattggatatcatgaaacgacatgaggagccttacacaacaactgttatgtcaatgttgcctcccatttgtttggttggcagtatggcgtggtgcgcaatggtgccactcatttgtttccatgttgtagagtggcaccaaccggatagagtgttgcgacaatttggaatgcaacaacctattccggagtctccttcgcaaccatggaatgtccatgggctaacactgaaagacaaacaagatgaaaattggttccagctgttggccccatttatcagttag

SEQ ID NO: 3279 - DNA, 426 bp, Glycine max
  Peptide Sequence Number=SeqID_94964
atggtaccgggccccccctcgagcaaagggagagatggagggcaagagggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 3280 - DNA, 800 bp, Glycine max
  Peptide Sequence Number=SeqID_94965
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatccctcttgccctccatctctccctttgctttatgtccaaatgtgccatctgttgttgacttgttgcatcgcctgtctcctcaggaaactatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 3281 - DNA, 144 bp, Glycine max
  Peptide Sequence Number=SeqID_94966
atgtcacgaaaccttacggattacccaatcatcccttctttggcttccggaatgttacgaaacttcatggattgtgcaacaatgcttccttttgacttccggcatgtcacagaacttcatggattgcctaacgatgggtgtcaa

SEQ ID NO: 3282 - DNA, 333 bp, Glycine max
  Peptide Sequence Number=SeqID_94967
atgccgcagaacttcatggattgcctaacgatgggtgtcaagtacctcgaagtgggaagtaaagataaggcactaatttcgttcgagcggaacaccattcggccggtcaatctccacgccagcggtacctgcaaaaatcttgaaaatgatcagcaccgaacgaccaacatcatcctgatactgccgaattcgttcctctcggttgacacaaggcgcagaatgaccataatttgtctctacgtgccatcggacacgatcgtatttggatggcaaaaggtgccgaatgaccataatttgtccccgcatgtcatcgggctcgccgcctctggatga

SEQ ID NO: 3283 - DNA, 435 bp, Glycine max
  Peptide Sequence Number=SeqID_94968
atgcatgagacatcggggtttagtagtccaagagacaacatagaacacaggaacattgttagatctcctacaggtaatctagttcctctcgacttggaaattgaagccacttcaagaaggaaccgagccaaaaggagaaggaaattggtgcaagacaaggcagtagcgtccattttagaggaagaagctcaatcctctgattctgtatcatcttattcatcttcatcaagggaatccactacagatttaccagaagcctctgtcatggctgaagaacatcaacacagggttacccttgaagattactccagtagttctgtgccacaattctttacaagtattgcgcgaccagaagtccaagcacacaatataaactatcctcattctttgattcatctaatacaggggaacctatttcatggattaccaaactag

SEQ ID NO: 3284 - DNA, 330 bp, Glycine max
  Peptide Sequence Number=SeqID_94969
atgttcgttcgcagccttgggctctatggctcagatcacatctatcccccacatggaaaagggccacggtgcggccaatacattcaatggcaagggtggagcgttgacattgtttgcaaacgtctggcatttgtgacacttccttacatggaggcaacaatcgctttccatggtgagccaataatagcccgccctcaggatcttcctagccatggccttcccgttagcatgcgtaccgaaagagccctcatggacctcctccagcatgcgtccagcttccttagtgttcacgcatcggagcaacactatgtcatggtttctcttgtatag

SEQ ID NO: 3285 - DNA, 165 bp, Glycine max
  Peptide Sequence Number=SeqID_94970
atgacgaggataagggctatgtatgagtacgtgagctcagttgaagagtggtacttggagatatgtcgcgggggtcaggagaccttggggacgtcaagtggggtgctattgcccaaaaccaagcttgaccaatcccgacccaacccgggcatagtcagtcagtga

SEQ ID NO: 3286 - DNA, 296 bp, Glycine max
  Peptide Sequence Number=SeqID_94971
atgctgcactccatgctccagagcttacacagggggcagtccatcatcatgcagagcctttagcccaggagcctgaaccagagcagccaacagtagaagcaacaaagggggaggatgagctcacccctcctgagcccttttattttgatgcaagtgtacacatggctcaagaggaggagacttccacagaccagatcccagagccatccccagcacctatacctgatgatgccataccatcttcaccaacatgtgagttagagaaacctacctctcaggatttaccagttgctcag

SEQ ID NO: 3287 - DNA, 495 bp, Glycine max
  Peptide Sequence Number=SeqID_94972
atgaaggctgacatggaggccatgaaagagcaaatgaccacaatgatggaagccatgatgagtatgagaaaaatgatggaggtcaacacggctacggtcgttgctgcaagtactgccactgaggtggaccagactcacccatctggcctcaatcaattaaatcctccagtctcggatatgaacaagcattccttcccaccatatggcttgcctcccaactatacaccatccaatgttgcacacgctcctgatgagactgtcaataactccactcccatactcattgagagtcaacaaccccaatctagtcaggcacaggtccctcaactcatgggggagacacatgaagtaccccgagaccatactctagccgactccgagccttgcctcgaatatgctactgaggggcaagcattaggtggggcgtatccctgtcaaacactttggggggcccttagtatcgctgacaaccacaacccttgcattttgcggtag

SEQ ID NO: 3288 - DNA, 222 bp, Glycine max
  Peptide Sequence Number=SeqID_94973
atggcagaagagcatgaccagaggattacccttaaggattattcaagattatctaatgaagacccctgtgcacacttggcaacgttcattgaaatatgtaacactgttaagattgtcggtgtaccagatgaagctattaggctcagccttttctcattctcattggcaggagaagccaagaggtggctccactcattcaagggcaacaatctgaaaacctag

SEQ ID NO: 3289 - DNA, 219 bp, Glycine max
  Peptide Sequence Number=SeqID_94974
atggtgaaagttggaacctcttacgtccgatcaacgtctcattttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 3290 - DNA, 756 bp, Glycine max
  Peptide Sequence Number=SeqID_94975
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaagtcacgacgttgtaaaacgacggccagaattcgatcctggaatcttgacatctgcaacagcagccttgatagattcgactgtcttttctggagctgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgagaaaaaaggctgcaccggtgcgtcagcagaatatgtgatacaggatatattccgcttcctcgctcactga

SEQ ID NO: 3291 - DNA, 372 bp, Glycine max
  Peptide Sequence Number=SeqID_94976
atgaatctaagagggagacaagtagagataagtgacccaatgtgcccgttatgtaacaattcggaggagtcactctcatgggttaattcagtgggtgctttcccgaaagaacagaaagatcattacatgcagcacagcagaaggaatgctacacgaacaaaagatataagatggagctattggtggatagccctcacaaggaccatatggcaacatagaaataaggtggtctttgataaccaaacttttaatgcaagcaagctgatggatgaagcgcttcttctagtctggtcctggcttaaagctatggagaaagatttctatacacattttaatcagtggtcttccaatttgacaaatgcctttgtgtaa

SEQ ID NO: 3292 - DNA, 978 bp, Glycine max
  Peptide Sequence Number=SeqID_94977
atggccaagttcgacccagacacagtcctggaattttatgccaatgcttggcctacacaggagggcgtgcaggatatgcgatcttgggtgaggggtcagtggatccttatcgatgtggatgccctcagccagttcctgggataccctttaaggaggaatcgggccgatgggtttgatgaggaggccatcgcccaattgctgtgtataccgggacaggattttgcctggactgctgccgggagacgggtgcggatcatgcgcaccaacatgactaccctgacccagatatggatgacgttgctgttcagcaacatccagcccagcgatcataattctgacctccccctgccgaagtatcagctggtgtacgccatcctgacacggatgagcattcacgtggctcagttgatcactgatgccatttatctatttgcaggtatgccacctaccaggcaccctctggacccagataagtctaacagggccctgggttttccggcattgatcacgggtctctgcctgtcgttcggggttcctgtcgcacccagtaaggtgatccgaccaccaatcacccaagcgttcatagagaagtactgcacagctagacaggcacagggtggcgacccgcaggccccagacgcaccgccgccaccccctcaagctgatccagctgggttatttgacacagagcggtatttacgacatttggttcgccagcaggcggccaaccacagggcgcacgtgcagacccatgactctctctaccagcttagtctcagcctgcagagccagggttttgtttcttttccatgccctactccggatcagttcagggcagaggtcacatggcccggagattggccagaggcccaggcagcagaggcacccacagaggctcccggtgaggcaaatgaggcccgcgaggacgaggagatgaccgatttgtttgatttcttgggagggagcggagccacatga

SEQ ID NO: 3293 - DNA, 228 bp, Glycine max
  Peptide Sequence Number=SeqID_94978
gaacgtggtacgggttggacgattggcgtaggacatgaatctcatggtctttactacctcaagcctaatatttcttggcgtagggcattctccatcagtcatcttgtcctcatactcctcaacagaatggcattgtcgaaaggaataataggcatcttgttgagactgctcggacattattacttcttgccaatgtacctatccgacattggggtgaagcagttttga

SEQ ID NO: 3294 - DNA, 286 bp, Glycine max
  Peptide Sequence Number=SeqID_94979
gtctgagttcctcattggaggatacgtaggagcaagagcctcgcttttgtcgaccataccgccttttgttgtcatgactcaagagctggtagcccgcggagacaccttacggttatccgcacctcgtcattcagtgaccccaagtgtgattgacgagcagagaccaatatggtcattctgcgccctttccggagatgtcatcattttccgatggagaccccttttcaagtctcacacagccggccccgatgacaagaagtccaagtttggtcattctgcaccctga

SEQ ID NO: 3295 - DNA, 423 bp, Glycine max
  Peptide Sequence Number=SeqID_94980
atgcagctggcacgacaggttttcccgactggaaagcgggcagtgagcgcaacgcaattaatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 3296 - DNA, 515 bp, Glycine max
  Peptide Sequence Number=SeqID_94981
ggatcgttcgtccctcatggatgtcaggatgtcctaactgctgccattgggcgaccagagcaccctggtcgtgtccgtgctgctggagccggtgtcaccataaagcaatactttggatcggctccacgaacgtcccgcagttcttcctccatgcctcctgaagacctacagcagctgacccaaaaaattagggaccagctggaggagtcgatcatagaaaaaggacttgcactgcctccagagccaaaggttggtccctcaggtgctcgtgtcagcacaaaggagagttgtgttgctccctcagggaacgatccagagacgagtgactcagacaaatacgggttatacattgaagaaaatccttcccgcctggttgccctaggaagactttatgagggatccacagcagttcacaacgtccctttgttgcatggccaagtcaaggttggtgttgaggaggttaaagatgcggaggctttcgttcctatacccactgacgaggttacctcagtggg

SEQ ID NO: 3297 - DNA, 81 bp, Glycine max
  Peptide Sequence Number=SeqID_94982
atgagcaagaggctccacgaggattgggctagagctgctgaagaaggccctagggttctcatgaaccttatgaaccttagg

SEQ ID NO: 3298 - DNA, 288 bp, Glycine max
  Peptide Sequence Number=SeqID_94983
atgggatgcttgagtgcccacttggctgtagccatgactaattttgcacgttgttttcaaatcatcatggtcacgcgtgccttatggagtaatatgggagttcggcccgagaccgacaccttgacacccaaatttgttttgccccagatatcaagattgggttcccacgataaaagaccccactgccacacaaccttagacttttttgaaccttggcctatcaaaagaatcctcatcctttcccccgaagcaaaggacagcgtaatctcctcaagggagagcaaatag

SEQ ID NO: 3299 - DNA, 213 bp, Glycine max
  Peptide Sequence Number=SeqID_94984
atggcggattttgcactgataaatcttgatggaggaaagaatctcgctatgaatttatcctccacctcttcccaagtgttgaggcttttatttggatgtgattggagccatgttttcaccttacctaatggaagcttgcttgagaagcttctatggagccatggagttacagcagaggataaagaagaggtgagaggagacgccatccactaa

SEQ ID NO: 3300 - DNA, 450 bp, Glycine max
  Peptide Sequence Number=SeqID_94985
atgacagacattcagcatgattctaggatcatggtcttaattcatcaccccgaggacacgctcaagaccctatctcagtatcagacaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 3301 - DNA, 526 bp, Glycine max
  Peptide Sequence Number=SeqID_94986
tgcgaccttggtcagtgagctggtgttgccgcaacgcctgtgggaaaacattcaggcagtcgtacgcagcaagtttcgtgatttcagcgtcttgctgggcacaggcgcacctgcagggctcaaccagccgtttttgaagttcatgcaagatgtgtatcagttggaggcttttcgttcgtctgcacaatttgaaacggatgatgctcgggtacatagtgcaaccatcaaccggctcaatgtgcagtttatggcagtttctacgacttatgtcgtcttgcagcggctgatccagcgattacacacccgtgcggcgtcaaaagaagcagatgctttgcaggtcttgatgcagccgctgtcttctgcggtgctgattgaacggagcagccaggccagtcatgctgaaaaagccgattacgcaggtcgcagcagtagcggtgaattaccgcagccgggttatcagcaaccgggtattttgatgatgcctgaccaacgtactggtattgcagttacaacaaaagcgttctga

SEQ ID NO: 3302 - DNA, 540 bp, Glycine max
  Peptide Sequence Number=SeqID_94987
atggatggcgttgctgctcagcaacatcctgcccagcgatcacaacttcgacctccctctgccgaagtgtcagctggtatgccacctaccaggcaccctttagacccagataagtctaacagggccctgggttttccagcattgatcacgggtctctaccagtcgttcggggttcccgtcacacctagtaaggccccaaatgcaccgccgccacctcatcaagctgatccagctgggtcatttgacactgagcggtatttacggcatttggttcgccagcaggcggccaaccacaaggggcacgtgcagacccatgagtgcctctaccaactcagccttagtttgcagagccagggtttcgctccttttacgtgccctactcgagaacagttcagggcagaggttgcatggctcggagattggcccgaggcccaggcaggggaggcgcccgcagaggctcccgacgatggagaggaggcctgcatggatgaggagatgacggatttgctcgatttcttgggaggaagcggagccacgtga

SEQ ID NO: 3303 - DNA, 375 bp, Glycine max
  Peptide Sequence Number=SeqID_94988
atggtgggttacacaccttcaagctttgcggatttggtcttcgttggtgaaatgatcgaagtgggtttgaaaagaggcaactctgatcatcatgctttggtaaatgcaaaaactggggtaaatgaagagggtgagaatgagggagaaacccatgttgtgattgtcattcctatacggccaagtttcccaccaacccaacaatgtcattactcaaccaataacaacccttctccttaccaaccacccagttatccacaaaggccatccctaaatcaaccacaaaacccacctaccacacaaccaatgctaaacaccacctttagcacaaaccaaaacactaaccaaggaaggaattttgcagcaaaaagcctgtag

SEQ ID NO: 3304 - DNA, 205 bp, Glycine max
  Peptide Sequence Number=SeqID_94989
gctaaaaggagagaaggttcaagcggctgatgtctcgctaagcgaggcaaatgcgcttagcgagtggcatccgctaagcgaggcatgcagctcgcttagcgtgctaggaaaccctagaagaggatcagttagagatgtgctcgcccagagtgccacaagcttgcccaacgagtcatttgtctcttctcgcgcacagcatgcctag

SEQ ID NO: 3305 - DNA, 818 bp, Glycine max
  Peptide Sequence Number=SeqID_94990
atggtgaaagttagaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcgggtaattgctggagtgtttcaagatattgctcaggcatgatcgtcaagtcgtacaccacattagccggcgcgctatctatagcagctgcaagggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 3306 - DNA, 285 bp, Glycine max
  Peptide Sequence Number=SeqID_94991
atggagaaatccgagaagaagaactttggagaaaagaaggcaaagaaggcctacatcacatgggatgataacgacttagaatcatctgatgattctgaaaaagaagttattaatctatgtctaatgggcaaaaactatgaaagcgacgaagaggtaacatcttctaacaaatctatttcctttgatgaattacaagatgcatttgttgaattacatagtgaatctattaaacttgcaaaacttgtttcttcatctaagaaaactatttcagatttagagaaatag

SEQ ID NO: 3307 - DNA, 332 bp, Glycine max
  Peptide Sequence Number=SeqID_94992
ttggcccagggcttcccggtatcaacagggacaccaggatttatttattctgcgaagtgatcttccgtcacaggtatttttcggcgcaaagtgcgtcggctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 3308 - DNA, 156 bp, Glycine max
  Peptide Sequence Number=SeqID_94993
atggcagaaatcaaccaagggatggatgcaagtggggatggggtcacgaccgaccaactgatgccctttcccggcgctaaacaagcagaggacgtcgctgcaaggcagcccagtatcctttgcgttcacagtttcttttactattgtttgctttaa

SEQ ID NO: 3309 - DNA, 227 bp, Glycine max
  Peptide Sequence Number=SeqID_94994
atggcgcagttgccatctgttcgtcgttatggccgactgacccgcgccaccggtctggtgcttgaagccaccggcctgcagctgccgctgggcgcgacctgtgtaattgagcgtcaggatggccaggaaacgcgggaagtggaaagcgaagtggtcggatttaacggccagcgcctgtttctgatgccgcttgaagaggttgaaggcatcctgcccggcgcgcgcgt

SEQ ID NO: 3310 - DNA, 537 bp, Glycine max
  Peptide Sequence Number=SeqID_94995
atgggtgccaagtaccttgaagtggtcaaacgagggtcgcatcccaacaacggatggtccccggacgaaattaggcaattattaggaaataatcgaattagagctgtagctatgagtgcgacagaaggtctaatgagaggaatggaagtgattgacacaggagctgccctaagtgttccagtaggtggagcaactctaggacgaattttcaacgtgcttggagagcccattgataatttaggtcctgtagatactcgcacaacatctcccattcatagatctgcgcctgcctttatacaattagatacaaaattagccatttttgaaacaggaataaaagtagtagatcttttagctccttatcgtcgtggaggaaaaataggacttttcggtggagctggagtgggtaaaacggtactgattatggaattgatcaataacattgccaaagctcatggaggtgtatctgtatttggcggagtaggtgaacgtactcgtgagggaaatgatctttatatggaaatgaaagaatctgga

SEQ ID NO: 3311 - DNA, 333 bp, Glycine max
  Peptide Sequence Number=SeqID_94996
atggcggaaccatcgaaaaagcggaaaggaacttcgagtcggagtcagcggcattccgggtcacaggaagcaccaattcctccctccattccctctggatcattagtttcatcggaacagcgtaatatggacagatggatcatgggtaaagaagtgtctagaaatatggatgaagaaggacatgagggagcaatattcatctcttctttcgaagattctgtggaaaggtttgatggtcttcaaacctttgttgagaggtttgcatactttggaactgcaaaattgatttctctgtgcatgatgcgcttcaatcaaaggatcaagaatgactaa

SEQ ID NO: 3312 - DNA, 526 bp, Glycine max
  Peptide Sequence Number=SeqID_94997
atggggacaaatcaaaacggaaaaagattttatcaagtcaagattaagggtctagatgtcaccagccttaatgagttgagacggttgatggggtccctccaaaggcaagccttccgcaaagtatacgaaaagatcttagatttgactgcaatggaggtatttacagaagttgttgtatccctcgcccaatactatgaccaaccattgaggtgcttcacgtttggggacttccaaatggtaccgactgttgaagagtttgaggagatattaggatgccctcttgggggaagaaaaccgtatcttttctccgggtttcttccctccttgagtaagattgcagctgtggtcagagattcggcaaaagagttggatcgcatgaagcaaactcagaacggcatagtgggcctgccacgaaaatacttggaaggcaaggcaagggatatggcaagccaagagaagtgggtcccgtttgtggatatactagctttgctgatctttggggtcgtcctctttccgaacgtggacg

SEQ ID NO: 3313 - DNA, 327 bp, Glycine max
  Peptide Sequence Number=SeqID_94998
atgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggcgtatcacgaggccctttcgtctcgcgcgtttcggtgatgacggtgaaacctctgacacatgcagctcccggagacgtcacagctgtctgtaagcgatgccgggagcagacagccgtcaggcgcgtcagcggtgttggcggtgtcgggctgcttactatgcgcatcagacagatttactga

SEQ ID NO: 3314 - DNA, 781 bp, Glycine max
  Peptide Sequence Number=SeqID_94999
aacacctgcatcaaccagatgccttgcgtgtccctgtggcgaaccaattgaacgcggcgacgtcctggccgacggcccgtccaccgacctcggtgatcactcagggcgctgggtggaacggctacaacgttcgaagactccatcctggtatccaagaggcaggtcgtcacggtaacaagggtgttatctctaagatcacacccgatcgaattcgaactggcgtgcgtcacgatgcaccaacggtacgccgtgacccacctgggtatggctgcgaaaggtatcggcgacaagataacgccatgctgaaacagcagcaggaagtcgcgaaactgcgcgaattcatccagcgtgcctacgatctggaacctgcgcaaaggtatgccaattgcaacgccggtttcgacggtgcaaaagaagctgaaattaaagagctgctgcaactgggtggtctgccaacgtctggtcagattacgctgtttgacggccgtaccggtgaacagttgagcgtccgcctggttactcagcagccgctgggtggtaaggcacagttcggtggtcagcgcttcggggagatggaagtgtgggcgctggaagcatacggcgcagcatacaccctgcaggaaatgctcaccgttaagtctgatgacgtgaacggtcgtaccaagatgtataagaacatcgtggacggcaaccatcagatggaaccgggcatgccagagtccttcaacgtactgttgaaagagattcgttcgctgggtatcaacatcgaactggaagacga

SEQ ID NO: 3315 - DNA, 144 bp, Glycine max
  Peptide Sequence Number=SeqID_95000
atgggtgcaaaggatatgtcattcattcacaagagatttatgcaaaaaccattacttaatgcttgtcgttcactcacaattaaagatcacactctcaccgggttgtggctaatgagtaccttcacaatcaaactgtcaaactga

SEQ ID NO: 3316 - DNA, 449 bp, Glycine max
  Peptide Sequence Number=SeqID_95001
tacaatctaaatcccttaacgaggatccattggagggcaagtctggtgccagcagccgcgttaaaaagctcgtagttggaccttgggttgggtcgatcggtccgcctccggtgtgcaccggtcggctcgtcccttctgccggcgatgcgctcctgtccttaactggccgggtcgtgcctccggattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcacttatgagaaatcaagtctttgggttccggggggagtatggtcgcaggctgaaacttaaggaattgacggaagggcacaccaggagtggagcctgcggcttaatttga

SEQ ID NO: 3317 - DNA, 220 bp, Glycine max
  Peptide Sequence Number=SeqID_95002
atctctcacaggaaatttagttcctcttgacttggagattgaagctacactgagaaggaacaaagccaagaggagaagaaaattactgcaagacaagacagtagcgtccattcttgaggaagaaactcatttttctgattcttcatcatctgactcaccatcatcaagggaatccgtgaattatttacctgaagccgtttccatggctgatgagcactag

SEQ ID NO: 3318 - DNA, 264 bp, Glycine max
  Peptide Sequence Number=SeqID_95003
atggagcgatggaagaatattgactttaaagatgatgaaaaggtcatcttagacctggagaatgattcgagcaattggagtagcccattctcactcctacactctgctagggttttacctagtaaggattcaaaagggaaaactgccaggaaaccacattacaagcgaaacctcaaagagagttgggcttcatcctcaaaaggaaacaacaccagaaaatctagccttccatggattcaaacagaaaacgcaaatgaaatatga

SEQ ID NO: 3319 - DNA, 234 bp, Glycine max
  Peptide Sequence Number=SeqID_95004
atggcacgcaaagacaaatatggtcatcttctccctttgtcgaagactcaatgtctgtcgaccgagactcttaaagtctccctttgctatccagagacaagcgagtctgatagcacgcggagacaaattgtggtcattcgcaccctttaccatctagagacaatcaggggagaagtaaccagctcgcctgggcaagctgagcttgcctgggcgagcaagttgcttctagagtaa

SEQ ID NO: 3320 - DNA, 297 bp, Glycine max
  Peptide Sequence Number=SeqID_95005
atggtcatcttctcttttgtcgaagactcaatgtctttctaccgagactgttacagtcttcctttgccatcaagagacaagcaagtccgatggcacgcagagacaaattatggtcatccacaccattttgctatccagagacaaaaacaagcgagtccgatggcacgcagagacaaattatggtcatctgcacccttttgctatccagagatagtcgagtctgatagcacgcggagacaaatatggttatccgccacctgtcaacctgaggcaagcgagcctgttgacccacagtga

SEQ ID NO: 3321 - DNA, 369 bp, Glycine max
  Peptide Sequence Number=SeqID_95006
atggctagaacacgaggtttaggtcgtgctatagctagacttataggtagagatagacatgatgaccatgatgcaactgatgttcccgagaggcgtaggcctactgcctcagcccgtaggcaacgggtttatcagatgactgcggatgcacttgatatggttgaggatgttgctgacatgattgaggatgtccctgatctggctgaggaggcacctgagatgactgcggacgtacagggtgttgatggtgctgaggggtcagatgctgatgatgttgagggattccctggtgggccacatgacccgtcagtgctgacatcatttgcggaccatgttgcacatgctgtttggagtggacatgtattttaa

SEQ ID NO: 3322 - DNA, 540 bp, Glycine max
  Peptide Sequence Number=SeqID_95007
atggacaataccattcagctaatcaacaatcaatatttggatgaaatttactaccggcggccattcacagatgcaggtaaccaatttctctttcaatctatgcaattgaaaaacgatgatgatgttaacacaatgttaatgtgtaatcatcaattctcgtgtgttggcccgattgagttattatgcatcattggcagaataccggatggtatattaaacttacttcaagcaactatgacccctactcatgatgccctgctatattacaacgggaggtggaacatgccatgccaacacgactttgtcggttactcgttcacaggaaaaaatccaaaaaaatttgacattccttccagatgtaccatcgatgaattgaaggatttgatcaagcaagttgcacctcaagggattcccccttatggtattcatgaatcacaaacggtaaggcaattgttttttcgacaactaggtcattatgagtattcagacaaagttatcaaatttaaaattattgagttgaaaactgatgatgacgtgtga

SEQ ID NO: 3323 - DNA, 75 bp, Glycine max
  Peptide Sequence Number=SeqID_95008
atgaagcccaaatgcgcacttggtgcgaaagtccgcactaagcgcaaggtcaacgtgaaaactcctgaagtgtaa

SEQ ID NO: 3324 - DNA, 321 bp, Glycine max
  Peptide Sequence Number=SeqID_95009
atggcttctatggacacctctgctatggtcaactctaagatctttccaagggatcaagacagaacccatatgcaatgcctatgcaaaagacacaatgcgggaatgtacacatccccagtggagtcgccaactgtcgcaacctaccgttcggcgggagggcgacgcgtgactcgcgggatgcgtgttccacgaaaggaatacgcgcggagtcgccaccaacgtttatttgaggaaaacgtcggaaaaaccggaaaggacgcgatctacgaacttttaagtgaaaggttcgggagttgtatttacgcgcggggaaggtattag

SEQ ID NO: 3325 - DNA, 189 bp, Glycine max
  Peptide Sequence Number=SeqID_95010
atggaggatagggtcacgaccgaccgatcttcatcccttcccggcgctggtcaagcagagaacgtcgctgcaaggcagcccagggatggccctaggcctacgttgcattttgaagcaatggggcatgccacattgcccccattctcttgctattcatgcctaaacatgcgcccaccaagtgttcgatga

SEQ ID NO: 3326 - DNA, 144 bp, Glycine max
  Peptide Sequence Number=SeqID_95011
atggaggagatacatggagaagaagatgaagaacaaggaattaaactccaagtagagcttgtaggccttggatcttcttcatcaattaagtcttttacctctggaatatcaatggcaacggaaatggagaaggaggaaaggtga

SEQ ID NO: 3327 - DNA, 96 bp, Glycine max
  Peptide Sequence Number=SeqID_95012
atgcacaactgcccgacttgtggggtatcacgctacaaagtgaacgatgacgaatgcagtaatggtgcagccacaaccaacagtcttccaacaaag

SEQ ID NO: 3328 - DNA, 143 bp, Glycine max
  Peptide Sequence Number=SeqID_95013
gtaatcgattaccagagagtaatgtggaagcaatgccttccaagattattttgatgatgccaaagaatcaagagtcaaacaagtttcaaaaatcaagatcaagattcaagaataatcaagatcaagattcaagattcaagtaa

SEQ ID NO: 3329 - DNA, 317 bp, Glycine max
  Peptide Sequence Number=SeqID_95014
ggggtacatctacttgggtttgactgagaacaagagagggtacatctcttgtggatcagttctagtggagggtacatccactaggttcaaagagaacaagggagggtacatcccttgtggatctttgcttgtaaaaggatttttacaaggtgatgagtattacggaagatatgatgaaactgggcaacacccaggtccatttgctaagcttgttcagaaacgtgcatttatgtgcaatacacaattcccgactttacccgtatctttgtggatgtatgccttgaaaactgccatgtatttgttgaacagggttccta

SEQ ID NO: 3330 - DNA, 408 bp, Glycine max
  Peptide Sequence Number=SeqID_95015
caaaaaagaaggagtagagacgagaatcgtcatcacggaaagggcaggatggacgaaatcagtgtcttatctttgctttcctcttatctccgatgagagatatttggcaccctttgttgcacaatatatgaagtcccgagacgtgccgaaaatcaaaaggaagcaggcttacgcgatccgtgaaaattccgtgatgggggtacaaatagcaatcaagcccacttgggccttccagattcttcctccagaaggttgttgcttctggtggaagcaaccttgctcgcctgggcgagctggtaaatccaagccgaggcgcttccgtaacatttccgtgagtaattacgcgaagattgtcgaccgttcttcaacattcgtcgttcgttcttcgttttcttcagtcttcaacgg

SEQ ID NO: 3331 - DNA, 168 bp, Glycine max
  Peptide Sequence Number=SeqID_95016
atgggtgccaaatacctcgaagtggtcaaacgagggtcgcatcccaacaacagatggtccccggacgaaattagggttaggagttgtagcattttaaaatgtactgcatccttagaactggatagggcaaggctaggttatcgaactaccggacatggagtgtggtaa

SEQ ID NO: 3332 - DNA, 381 bp, Glycine max
  Peptide Sequence Number=SeqID_95017
atgtttctaaaggagctgtgcacccacaaaaggaagttcaagggcaatgaaaggattagcatgggcagaaacgtgtcagcattgataggtaaatttgttcctcacattcttgagaaatgtaaggacccaggtgttgtacctcttgatgttgattttttagagtcagaatgcactaaccatgttgcaggaagtacatatacttctgacttgctttatgagccaccaaccacactagagttaaagcctttaccaacaaacctcaaatatgcttacttggaggacaaggaaaaatttccaatgatcatctctgcctcctttactgctgagcaagaggagaagttgttgctagttctcaagaagcacaagaaagccattggatga

SEQ ID NO: 3333 - DNA, 180 bp, Glycine max
  misc_feature (109)..(109): n is a, c, g, or t
  Peptide Sequence Number=SeqID_95018
atgttgatgcacaatcccagagggggtgtacttagtaaaaatgggggtgcaaatagcacccaggcccatttgggccctccagaaggcggttgcttctggaggaagcaancctgctcgcctgggcgagctgagctcgcctgggcgagctgggcggcaaccacctcccctattttgctataa

SEQ ID NO: 3334 - DNA, 615 bp, Glycine max
  Peptide Sequence Number=SeqID_95019
atgacgtctgaggtaacaaaggaaattgctgagaagattgcgtcacagggttcctttgtcccccatggacgtcaggatctcttaactgctaccattgggcgaccagaacaccctggccatgtgcgtgctgctggagctggtgtgaccataaagcaatactttgaatcggctctacgaacctcccgcacttcttcctccatggctcccgaagaactagagcaactaactcaacaaatcagggaccacctagaggagttgatcacaaaaaaagtgactcgacagcggatgttatccttcaaccagatgcagtctcagtttcaatcacagatgcaatcacagggacttgcactgcctccggagcctgaggttggtccctcagttgctcgtgtcatcacaaaggggagttgtgttgatccctcagcgacagatccaaacacgggaagagtttatgagggatccacagtcgttcacaacatccctttgttgcatggccaagtgaaggttggtgttgaggaggttaaagatgtagatgctcccgttcctctacccactgacgaggtagttgtgtctctagcaaaacctgcagataggccggatcctgaggcatttgactga

SEQ ID NO: 3335 - DNA, 138 bp, Glycine max
  Peptide Sequence Number=SeqID_95020
atgtgggatgtagttgaagatgattttggatcacttgatgattgtgatatcaagggcacaccggagaccggcttacaaaccccaggttttcataaacaaagaaaccgaagcggcggcagagccgcacaggatcggtga

SEQ ID NO: 3336 - DNA, 270 bp, Glycine max
  Peptide Sequence Number=SeqID_95021
atgcgtatatcttttgcagcaaccttcagaagaaacaacgcagagagaaaaagaaagtttttgcacgacagaacagtagcatcaatccttgaagatgctcacttttctgagtcatcatcttctaattcacctacatccaaggaatctcaaacagcagaatttgaagccaaagtcatggttgaagagcaacctcgacgagtgaccttggaagattactcaagtacatctgtgttgcaattctttactagcattgcgtggccggaggtttaa

SEQ ID NO: 3337 - DNA, 549 bp, Glycine max
  Peptide Sequence Number=SeqID_95022
atgttgaaaggaaacacatgtcaagaggatgccaccttgggtacctccaaccatttccacaccatcagcaaaccactctcatctccagtgaagaagaggccaccaggacctaactcaatcaatgccacatctttctttgataatgatagaaagaatttgaaaacagacttcattacaaaccatgttacttacaatatgaatttactgctcagacaaataaagtcatccttatcaccatctgcttcaagaggaaatagatgggataatacaactccaatgttgaaaggaaacacatgtcaagaggatgccaccttgggtacctccaaccatttccacaccatcagcaaaccactctcatctccagtgaagaagaggccaccaggacctaactcaatcaatgccacatctttctttgataatgatagaaagaatttgaaaacagacttcattacaaaccatgttacttacaatagtaatatatttatcaaagcaggagaagattacatctgctgggaagaatataaaagaatgaaattggtatttctataa

SEQ ID NO: 3338 - DNA, 339 bp, Glycine max
  Peptide Sequence Number=SeqID_95023
atgggtactagtaccctcaccttcagaggactagacgtcctcgccttcagagggctgtacgccctcaccttcagaggactacatgtcctctccatcagagggctgcacgccctcaccttcaaagggatacacgccctcaccttcagaggactacacgtcctcgccatcagagggctgcacgccctcaccttcagaggactacacatcctcgccttcagaggactagatgtcctcaccttcataggattgcacaccctcgcctttagagggctacgcgtcctcacttttagtgggctccatatccacaccttaatagaatttaaggtcctctacccttaa

SEQ ID NO: 3339 - DNA, 229 bp, Glycine max
  Peptide Sequence Number=SeqID_95024
gttcgatttcgggaacttaccggttgaagacagaagaacgacaaacaacgaacgaagaacgatgaagaacggtggaaaatcttcacgaaatcgcccacggaaacgtctcgaaagcgttagggaaaagagggaggtggttgccgcccagctcacccaagcgagctgggttgcttccaccagaaggcaccgccttctgttggaacatcctggaaggcccaagtgggcctga

SEQ ID NO: 3340 - DNA, 369 bp, Glycine max
  Peptide Sequence Number=SeqID_95025
atgactgagacaagtatacgagcgagaaatgcctctgtgtatggattccttgagccacagtccatacagagatctgggcaatcacaatttgaatcaaaaaattatattaagaactggatgcttaattcacataggtatgtctacctaggagcttacttgaatggtgctttgaaaggattcgacgatagtcaacaaagtaaatccaagcctgttgctagatggattctaattaaatgtaataagaaaaaaggaagcactgagtgcgagtactacgtaatgcattggatgtcaacgatagtcttaggaaatttcaaggataattggaaaatgtattttacgaatcaagaccattggacacagagagaatga

SEQ ID NO: 3341 - DNA, 222 bp, Glycine max
  Peptide Sequence Number=SeqID_95026
atgcaagtcgcaagtgggaatgacgatttagggcagaagtggacacgtggcatgcaacacgccagttggagtagcgacttcatgcatgatcgacacatggcaagggctgggggacgcgccaggctcattggcgatttccgcctaccacactggaagctccaggctcattggcggtttgagcctgctatggtcacatcttgtcggagcagtgcagcagcgtag

SEQ ID NO: 3342 - DNA, 279 bp, Glycine max
  Peptide Sequence Number=SeqID_95027
atggagatgttgaggaaaatgaacataagagagtcaatggataagaatgaagtattgaaggtgcatcaaaatattgctcgcttttggtaccaagcagccattggtcaatatgggccacatttgcccattcctagctatcatgacatcagagttccactcttgaagaaggaagttgaatatactgaaaatttgatgaaaggccatagggagcaatgggtcaagtatggttgtactattatgtccaatgcatggactgatcgaaaacaagatgctcattaa

SEQ ID NO: 3343 - DNA, 225 bp, Glycine max
  Peptide Sequence Number=SeqID_95028
atgaagttatacccacttcttgcaatgaatccaaaagacgatggtcttttgtgtccagtgatcaaccaagaagcaaatcttgcttcttgcaatgaacctaaggaacgttggtcccttgtgttcattgtttgcaaccaagaataccttctcttgaaaacattcaccaagagtaggtctcttgaaaagctttttgtaagaatggaggagaggaagagaatagaatag

SEQ ID NO: 3344 - DNA, 501 bp, Glycine max
  Peptide Sequence Number=SeqID_95029
atgttctttgtcattacaattttatcagatttgaatgtacctagcacatgggtcagagccagagtcttcctagatgtgagcttcataagaactttcttttctcccaaaactgaagtagtgatgaaatcaccaagaagtgtaggaggtaaaagcatttctatcgcccggaagacgctgacatctccggaaagggtgcagatgaccacattggtctctctgacaaaaggtgctgataaccataaggtgtgtctgcgtgctaccggacccttgggtttgacgacagaattgagactttttcacggtctcggccgaaagacgctgacatctccgggaaaggtatgtccgtgtgctaccggacccttgggtcacgatagcaaaattgagacttttttgcggtctcgaccggaagatgctgacatcttcgggaagggtacagatgaccacattggcctctgtttgtcaatcgaacttgggtctctgaatgacgaggtgcagataacc

SEQ ID NO: 3345 - DNA, 384 bp, Glycine max
  Peptide Sequence Number=SeqID_95030
atgggtttatacacgagcgtgatggaagagataagtttttacacagggctatctcccgctgcgtttttcaccattttggctatgatggtcgtcgtttacagaaccgtgagcggcatgtttgtgtcccccgaagactacaacaagccccccgtcgtttcggcccgagccaattcccggttagacgagtccgagccgccgcgcgaaccggtccaattgggcgaaataacggaccgggaattgcgagcctacgatggctccgaccccagcaaacccctcctgatggcaatcaaaggccagatctatgacgtgtccaatggcaggcctttaattcctttctatgaagcaccgacaccgacatggacaccggacacgacacggacatga

SEQ ID NO: 3346 - DNA, 186 bp, Glycine max
  Peptide Sequence Number=SeqID_95031
atgggtcatgaaggtggttttcaaaaagctatttgccaaattgctttcttcgcccctgaaattgatgtgaataaattcgatgtgctaaaagatgcaaaggatggggagttggtaagagaatttgaaatagggagttatgaagaggcttctaatagtgaaacaacctctaaggcaggtgatgctgag

SEQ ID NO: 3347 - DNA, 291 bp, Glycine max
  Peptide Sequence Number=SeqID_95032
tggcaaccaacggcggttcgtggtggccaccgatggtcgtgggtggtggagaagaagttcagtaaaatcgcaatcccggattcgttaaccgttggatcgtcctcaaatttttttctggagcttcctaagacatgtttccacagtctaactattgggattttgacaatcacaacttttgatctctcgctaagcgagaatggcgtgctaagcgtgattccaaccagagagggaattgcgcttagcgaccagaggtgcgctaagcgggccgtagtgcagagggggttgcgctaa

SEQ ID NO: 3348 - DNA, 399 bp, Glycine max
  Peptide Sequence Number=SeqID_95033
atgaccggtagattgctgcccggatcattgacctttgataatcgcatcatgcactatattatagttagaattttgcttccccggtcttcaaatttggctcaagcctttgaggaggacttgattttgatgtgggctcacttggttcggtaccaaatgcataaggcattacgggccaatgcacctcttccatatcctcaattggtcactttctttctccgtcattttcaaattcctcttgatgatgaaccttttgttcaagtcaagcgttcctttgctataggtgctggtgcagtcacttcatttggttaccgaatggatatttgtctcacgcagcttgaagaggatgtgggttatattcgtcagagctttgatcttccaccaccaccaccaccctcttag

SEQ ID NO: 3349 - DNA, 679 bp, Glycine max
  Peptide Sequence Number=SeqID_95034
agggctgcacgccctcaccttcagaggactacacgtcctcgccttcagagggctgcacgccctcaccttcagaggactacacatcctcgccttcagagggttgcacgcccttaccttcagaggactacatgtcctcgccatcagaggattacgagtcctcgccatcagaggactacacatcctcgccttcagaggactacacatcctcgccatcagagggctgcacgccctcaccttcagaggactacacgtcctcgccttcagagggtcatctaccttcatcttcagagaactacacgtcctcgccttcagagagctgcacgccctcaccttcagaggactacacgtcctcgccttcagagaactacacgtcctcaccatcaaagggctgcacgccctcaccttcagaggactacacgtcctcgccttcagagggtcatgtaccttcaccttcagaggactacacgtcctcgccttcaaagggctgcatgccctcaccttcagaggctggacgccctcaccttcaaaggttcttgggccaccccctgatattggagggcgaccaactatgcgagcacaaccaaaggaaggctatcacgcagctactgtgcataccggggcaaggggtcgcgcccacaagacacccagtggacccggagaagtccaacagggccctggg

SEQ ID NO: 3350 - DNA, 868 bp, Glycine max
  Peptide Sequence Number=SeqID_95035
aattctatgcaaacctatatgtccctgaggacaaagaaccaaagcaagttagggttcgagggcacctgattaagttcgatgcagactccctcaacaccttcttgaagactctagtggtcttggagcaaggggagagcttaccttcttactctaggttctgcaggttgaggccagaccctcaagagctggcagctcgactgtgtatccctggaaggggatttgttcttaacaccgagggcttgccgtgtaagctcttgaggaaggatcttacaactctggcgcagacctggagtgttttatcttattctaacctagccataatttcacatacctctgatcttaatcttgacagggcttggttagtttatgggctagtaatgaagatggacatgaacataagagcacttatatctgaacagatctcgctcattgctcagtccaactcctcgaggcttggatttcaagccctcatcactgccttgtgcaaggcccgaggagtcacctcatattctctcacttatgagtcactcagcccagccattaatttggcttatattaagaagaattgttggaatctgaatgacccttcggtcacttttccagggacccaaaaatccagggctagaagatctgaggccccatctccttcagttgaccatgctccccctacttctgctccctctacctttgctctcccttcagctccacttagagcctttcatgtctatgctgcagagcctgcaccagggccagctcctgattttgcagagcttgcaggatgtggtctagcaatgaccagttatgagcgtggaggagtttctgcagaaggttgcctggtcaggagtccaaccttctcctttgggagggg

SEQ ID NO: 3351 - DNA, 237 bp, Glycine max
  Peptide Sequence Number=SeqID_95036
atggctacctcaccaaaagaaacttcagcttctggttcaccctctgtaccatcatctccgcaccaggaacaacctgaattcaacatccaacccatacaaataattcctggtcaagcccctgttcctgagaaactggtccccaaaagacaacagggagtgaagatctctgaaaaccctagccttgcaacaagtcctagggaagtagacccggagatggataagaaaatccgcagtatt

SEQ ID NO: 3352 - DNA, 198 bp, Glycine max
  Peptide Sequence Number=SeqID_95037
atgcggaaattgattaaggaaaggatggaaaataaggtggctaatttcgtgggtcttaataaggtggttcttggcataaaatggatgaatgagatgaacaagggtgatgatggaaaatggaagttatggcataaaatggaaggaaagaatcactctttccagcgagggcaacacacaaaggttgtgaaagtcctttga

SEQ ID NO: 3353 - DNA, 177 bp, Glycine max
  Peptide Sequence Number=SeqID_95038
atgtctcatgcttgccagaaggacttgagaatattgtggacaattgacaacttgttgaaagtcataggagatttcgaatcatccgttcctgggatcaagatgggtatcgtgttgcagaggttgaatggctacaagatatttagccaccagaaggaacaagtgaaagagagactataa

SEQ ID NO: 3354 - DNA, 123 bp, Glycine max
  Peptide Sequence Number=SeqID_95039
atgggtctacgaattttaagagcaaaggttcgggagttgtttatgtgcgggaagaggagagaggcattaaggtgttggacctttgaacggatgcaagtgattttcttgtggataaaagcttga

SEQ ID NO: 3355 - DNA, 216 bp, Glycine max
  Peptide Sequence Number=SeqID_95040
atggcggatagggtacctgggaatggccactttgatgacggcgacggaggacatcagtgtagggggaggttttgggtgagagaagaggtagccgccataggatttgggagaagagattgtggcaacggaggggtttggtttgagggttttgagcaactaagagagggaacaaaagttttcgaaggagctaggggaaggactcatcagatagagtga

SEQ ID NO: 3356 - DNA, 883 bp, Glycine max
  Peptide Sequence Number=SeqID_95041
atggcagaatcatcaaagaagcacaagggcttatcttcctctaccaccactacaggccaacgccgccacggtgcttccggtgactttccagcaccacccaatccatccctttcttcaccatgctctctcactctattttctttcgatgatcaacatcagaggtattactcctccttttccaatcgtgccattcttgatcctaaattccttgattttgatttctttgaggatgaaacctttgactgttatcaagtttttcaaaactctgagttagtgaattttatgactctgaaatttccttattattcggaattagttcaattcttttataacaatttagaaatttgtgaaggaatcatattctctgaagtacacaaaatatccattgttgttgatcaatcattgttttattctctcaccaaattgagtagtcaaggtgtaccttttgaaggagccttagttgatgattggaaatccatttattccagtcatgatgctcgaaaaattgtctgtgatgaaaatgttgataagactggttgtttacttgttggttcttttacctttgaatgtcgtatcatgcattatattctatgtcaagtgatgtttcctcgttccacaaaccttgctcaagcttctgagaaagttttaattctattatgggccctgcaaactggtcgtcaaattgactgggcccatcttgttcactatcgtatgcataaggcattacggaaaaatacacctctttcttatccccacctagttactctgattctgcagcacttcaacattcctcttgctaatgaaccttttgtcaaggttcaacgttcatttgccattggagccgctgcagttgcatcctttgggtataggaaagatctagatg

SEQ ID NO: 3357 - DNA, 651 bp, Glycine max
  Peptide Sequence Number=SeqID_95042
atgacaggtactagttaccctcaccgtcagaggactacacgtcctcgccttgagaggactacacgtcctcaccatcagagggttgcacgccctcacatccagaggactacatgtcctcgccttgagagggctacacgccctcaccttggaggactacacgtcctcgccttgagaggactacacgtcctcgccttgagaggactacacgtcctcaccatcagagggttgcactccctcacctccagaggactacatgtcctcgccttgagagggctacacgccctcaccttgggtactagttaccctcaccgtcagaggactacacgtccttgccttgagaggactacacgtcctcacgatcagagggttgcacgccctcacctccagaggactacatgtccttgccttgagagggctacacgccctcaccttggaggactacacatcctcgccatcagagggctgcacgccctcaccttcagagggctacacgccctcgccatcagagggctgcacgccctcacctccagaggactacacatcctcgccttgagagggctgcacgccctcacctttagagggctacgtgtcctcattttcagtgtgctccacatccgcaccttaagagaatttaaggtcctctgtccttaa

SEQ ID NO: 3358 - DNA, 628 bp, Glycine max
  Peptide Sequence Number=SeqID_95043
cccggtcgtcgccattttggccatgtatgacacgtccgaccggggatgtgaaagagcggcgcaagaattgtttgttgtgcactggctctctatgtgtgactggtttcacacctttttctccaagaaggtaggcccgtctatccgctacaaggtcaccgctcgaaggaagaatcaggattctatcttcatgcgaaggatgcccaaatgttcccttgatggaacaaggggttgtattaataataatcccatcctcgccataagacagcttggctaccccatgagaggagtgccatcagacgaaagcatcacgcctttcatcacacggggtttcagtgaccccaatgcgagggacagagagcttaggggaagcagtaatgggagcatcggcggctatcataagtggctgagagtccggacacaaggattggattggctcccaaatctaaagactatgagagatgatgaggttaaagcttcggaagaaagtgatgaggtacaagccctaaaggcagagcttgaaagagcccgggtagtcgaagagaagttcaagtccctagccatcaaaggcagcaatagtgagctcaagctccgaagaggtgaaaggaatcatcacgggtcaaaggcatga

SEQ ID NO: 3359 - DNA, 270 bp, Glycine max
  Peptide Sequence Number=SeqID_95044
atgaagttaggtggtaggaggagatacccaagtggttattcgtataaacactatttcgctatccgtaagactcaaagcacgatagcaagcagagacgaacgtcgtcttctgcaccctttgtcaatcgcggccaacgaacccgttgacacgcggagatttacgtcgtcttccatgcttcctgtcatcctgacccgtgaagtcaggcggagatgcccaagtggtgatccatataagtctcgtttgctatccgtaagactcaaagcacgatag

SEQ ID NO: 3360 - DNA, 126 bp, Glycine max
  Peptide Sequence Number=SeqID_95045
atggaattcacatatgatggctcacctgaacaaatggcacacaccgagatgaaaaacctcgtcgggcgcctaggagtacatgacaggacatgcctcacaatgggtaagtcaggtcactctcactaa

SEQ ID NO: 3361 - DNA, 307 bp, Glycine max
  Peptide Sequence Number=SeqID_95046
tacctacaaaacaaataggtacaaactgtcgttgcttgatattgttggtgttacaccaacaggaatgacattcttcgttggttttgcttacttggaaggagaacgtcttaataatgttttttgggctctagagcggtttcagggtcttttcatgagagttgatgcactccccgggattatcactattagaaattacactttcaacatcgattattttgggcattctacatcagctctaaaaccgatgttgaaagtgacgatgttgaatgtatcatcggtaacatcggttttgaaaaatcgatgttaa

SEQ ID NO: 3362 - DNA, 792 bp, Glycine max
  Peptide Sequence Number=SeqID_95047
atgcacctgcccctctgcctcattgccgccctgctgctgccctgcgcggcactggccgccccgccccaggtcgtcaccgacgacatcggccgcttctgggccacctatgacgcggtacgcgccgagcccgacgttgaacgccaggtcgcactcgtgcaggagcgctacatcgatccaggcagccccggcctgcatgcgctgatgcaggtccgcaactacaccgcccgcgaatacgccgaggccatgcgtgcgtggccgcgcttctggacgtcggttcggccgttgaccgccaacgcgcagcaggccagcgccacactggaacgggatctttccaaattccgggcgctctacccggctttgcgcccggccaccatcacctacgcagtcggtgtactgcgcaccggtggcaccacgctgggcgacaaggtgctgatcggtgccgagatggcgctgggcgatgagcgcgtggacgtgagcgaactgcccgaaaagatgcgcgagcggctacggatcttctacgacagccgtccgggggcgaacaacgcgcagaacaacctgcacgagtacgtgcatacccagcagcgcgagaccaccggcagcctggcccagtacgcggtgcgcgagggtgttgccgagtacgtggccgaacgactgagtgggcgtcggccggcgcttccgctgtacagctacggacccgcgcatgaggcggacatccgcacgcgtttcattgcagagatggacgggggtaacctcgacaactggctctacaacagcgcccgcaatccattcggg

SEQ ID NO: 3363 - DNA, 97 bp, Glycine max
  Peptide Sequence Number=SeqID_95048
atgctccaccccgtcagacagacgggcttacaggggctcggtaccggcgctacgtcatgccgcacaacacagagcgggcgatgggagtacagcggaa

SEQ ID NO: 3364 - DNA, 417 bp, Glycine max
  Peptide Sequence Number=SeqID_95049
atggcgagcaaccccttcaaatctcaaaagaaggccaagtcctctaagaggaagcaaggagagtgctctcaagctactctcaacaggcttgatacatggttcatagatgagagtaagaagaacgacttcaagatgatatatgttgtaaagaatgtgagaatacccaagtatctggacttggagaggttctctcggcaagggtttaacttcccttgcatagatgaaaggaactttttattcgaagccggtgagagtcttctatcttgtgcccatgccgatttggaaggtaatctgttttctactattaatggtgtaaaaatggttatcgatgctgaagttcagaaggcaatagccagactggacttgggtggagtccacaagtttgaagaatctactgatggttacagcaagatgtag

SEQ ID NO: 3365 - DNA, 570 bp, Glycine max
  Peptide Sequence Number=SeqID_95050
atggcagcacaattaatccatgatcgagtggagatggagtgccgagagggtgtttcggagaccctcgaaggcaatgcgaggtgccgattccgtggcacgattcgactcacggctacttcattggtacatccagaggaacccgcacgcacgcttcagcaaattgtggagtggatattacctacacctactccatatcgactagtggagccagtccaagtgatagaggtgtcgtcatctgaagaagaccctgaggaggacccagaggagctacctcctgagcctgctgtggatgctcttgactttccagagggtgatgaggacccactccctgatgtggattctccagaggacgtcatgtcggcatctgaggcaaactctacggaggagagcggccctggagggatacgactagtggagactcttcatcatagcagacggctccttttgggggacctattgtataggaattttgatgattgtatacatgtggctgaagccaccacagttgatacctttgctctggatgtcactatgtattttgcaaaactcccatattttggacagctttag

SEQ ID NO: 3366 - DNA, 813 bp, Glycine max
  Peptide Sequence Number=SeqID_95051
atggcttcccgtaagagaaaagccacaactttagcgtctcgggatggttatgatagatcaagatttgtatcacaagaggcctgggaccgttacttagataatgttcttgccaggaacattctgacagaaacaaatgtcaagttgtatatcaatgagtttgatgatttcagaagagaattgattagaagaaactggcataaaaaactgactaacttgaccgagagaagcattgatgtggcaattgtgatggaattctatgaaaatctttatgtcccagacgacaagtttcccaagcaagttagggttcgagggcacctgataaaatttgatgttaattccctcaacacctttttggagactccagtggttgtggagcaaggggagagcttgcccttttactccaggaggggatttgttcttaatgccgagggtctgctgtggaagctcttgaggaaaaatcttaccactctagtccaaacctggagtgttctatcttattctaacttggccccaacatcccatacttctgatcttaatctggataaggccaagttagtctacgggcttgtcatgaagatgaatatgaacttaggaacccagaaatccaaagctagaagatctgaggccccatctacatcagctggccctgctccccctgcatcagctccatctacttctggtcttccttcaccaccagcagctccaattctttcaggtccctccgctcagagcttagagctttccttgtctatgctgcagagcctgcatctgggccagctcctgatcatgcagagtttgcaggatatggtctag

SEQ ID NO: 3367 - DNA, 276 bp, Glycine max
  Peptide Sequence Number=SeqID_95052
atggttacgtggatggctatggagaacctcatgctagaggacgctgggacactatactctgacaggattgctaaagatatatgggacactcttgcgttaacgtttgagggttcccttaagacagtggagaccacaagtgattgcactgacaacaagaagaaaggcaagaaaggctttatgtcaaccagggaggatttggacgacacatctttagaagaagaagaggaggaggaagcaaatctatctttgatggatgatattgtaactgaaggataa

SEQ ID NO: 3368 - DNA, 227 bp, Glycine max
  Peptide Sequence Number=SeqID_95053
atggattcctttgcttcttggaagatgaatggtagtggaatggagaaggaagagagagagaggagatgtcacttcaaggagaaggtgattctagaagaagctcacaatatgatgcaatcctaccccgcaagggcattggatagaagactccaagtagattgggccagagatccaagggaagaccctagggttctcatgagccttagggtagattttgagtccatggg

SEQ ID NO: 3369 - DNA, 330 bp, Glycine max
  Peptide Sequence Number=SeqID_95054
atggagccgatcagaacggtgtggaggacactgtctgtgagaaatacaacattagcaaggaaaaatgggcccagttatgctagactcgcagagacccttcttgggagccatttgaaacattattgcgttatttttccaagatgtgcgcaaaaaggcacaggccatccagaagctgaacactgcccccccacgttctatctcgtggggtttatgactatttggagccgaagctcttggctgagaagaccaagaagaagctggaggaagttgtacagtaaggaagcgttgatggtgtcatcaaccctccatccccggttagacgccacgtga

SEQ ID NO: 3370 - DNA, 374 bp, Glycine max
  Peptide Sequence Number=SeqID_95055
ctggtagaggaggaagaacaacgattggtgctgattgttctagtgaaacctctaataaatctgagatttataaggaggaagcagcgaatgcagcacagaagcataaaccaaagagggtggagagtgtcaatgcagatgcaaaagcctttggtgatcactggaaaacaggagattcaactgtgctgaagataggagattcgactaaagttgtgataaaacaagacatgaagggaggacagcataaatatgggtttaacaacaacaaatgtgagaagccagagaaggtcttcatgtcattccttcatcattcaacgtcttcatgtcattccttcatcattcaacgtcttcatgtcattccttccccgacagtttga

SEQ ID NO: 3371 - DNA, 288 bp, Glycine max
  Peptide Sequence Number=SeqID_95056
atgactggggtacaaaatcagcagtttcaggaacataggttgcttgacaagaatggacaagttactgaagtttccaaagttgatcactcaaaggcaaaacctcaggagagaaatagtgagaataacaatgagtggggtacaaagtcattgctaaaggagagaaaggcagaacttgatcactcaaagacagaagctcaaggagaggaagacccgaagaagggatacaaattcatatcaagacaattattctttccaaataatagtttggccttagaaccttgcacttaa

SEQ ID NO: 3372 - DNA, 237 bp, Glycine max
  Peptide Sequence Number=SeqID_95057
atgatacgcggagataccttacggttatccgcacccttttgtcatccagaggcggcgggcccgatgacaagcagagaccaagtttggtcattctgcacccttgtatcatccagaggcggcgggcccgatgatagcgtggagataccttacagttatccgtataaacattcttttgctatctggaacgacaagtcatggtcacccgcgactctcgtcaaccgagaggagcgaaattag

SEQ ID NO: 3373 - DNA, 237 bp, Glycine max
  Peptide Sequence Number=SeqID_95058
gggaaggagggcagagcaaatgggttcagcccttctggtattgagaaatctctcgaaattaatgagaaaaattgtttccgtgaaaaaaatccaagccgaggtacttccgtaactctttcgagacgtttctgtaagcgatttcgtgaggattcttcaccgttcttcatcgttcttcattcgttcttcggcctccaaccgaaaaatctaaccgatcgttcatgttgtaacctcggttaa

SEQ ID NO: 3374 - DNA, 888 bp, Glycine max
  Peptide Sequence Number=SeqID_95059
atgccgaccgccacggcgctgcgcctctgtccccatctgaaactgctgcccggccgctttgatgcctataaagaagcctcgcagcagattcgcgccatctttacccgctatacgcccctgattgagccattgtcgctggatgaagcctacctggatgtcaccgacagtgaacactgccagggatcggccacgctgatggcgcaggcgattcgcgccgatatcctgcgcgaaaccggcctgaccgcgtcggctggcattgcgccgatcaagtttctcgccaaaatcgcctcagacatgaacaagccagacggccagtatgtgattacgccgcaggcgatgccggactttctgctgacgctgccgctgagcaagattcccggcgtcggtaaagtggccaccaaaaagctggaagagatgggactgcgcacctgcgctgacgtacaacaggccgatctggcgcagctgctgaagcgctttggaaaatttggccgcgtgctgtgggagcgcagcaacggcatcgacgatcgtgacgtagtggtggagcgcgaacgcaaatcgctgggcgtcgagcgtacgctgggcgaggacatccatcactgggagcagtgcctggagattattgattttctctacgccgaactcgatcgccgtctcagcgcgatccgcccggataagcagattgcgcgccagggcgtaaagctgaaattcaacgatttccagctcaccacccaggagcatgtctggccggtgctgaataaagacgacatgatcgccgtggcgcgtcaggcctgggacgaacgccgcgccggacgcggtgtgcggctggtggggctgcacgtcacgctggtaaatccgcagctggagcgccagctggtgctggggttgtaa

SEQ ID NO: 3375 - DNA, 862 bp, Glycine max
  Peptide Sequence Number=SeqID_95060
atgaagaaaagcacactggcactcatcgtttccgcgctggctctggcctcaaccgcacaagccgcagaagtttataacaaagacggtaacaaactggatctgtacggtcgtgtgaaaggcatgcactacttcagcgacaacgcagccgctgacggcgacaaaacttacatccgtctgggcttcaaagggcagacgcaaattaacgacctgatgaccggctacggtcagtgggaatatcagttccagggtaaccgcgcggaaaccaacaccgacgctaacatcggtaacaaaacccgtctgggctttgccggtctgaagtttggtaactacggctctgttgattacggtcgtaactacggcgtggtttacgatgtgctggcatggaccgacgtgctgccagaattcggtggcgacagcgcctacaccgacacctacatgctgggccgtacttctggcgtcgccacttaccgcaacagcaatttcttcggtctggtggatggcctgcgtttcgcggtgcagtatcagggcaagaacgattccaccagcgccaacggccgttcagagattcctaagcagaacggcgatggttacggtgcgtcactgggttacaccctcggcgatagcggtgtcagcctgatgagtgcgatctcctctgctgaccgtaccaactcgcaggacgtggcgacccgtctgggccgtggtgacaaagcggaagcctggggcgcgggcatcaaatatgatgcgaacagcatttacctggcatcgacctactctgaaacccgtaacatgacgccaatcacgggcggcgtggcgaataaaacgcagaactttgaagtggttgcgcagtatcagttcgacttcg

SEQ ID NO: 3376 - DNA, 233 bp, Glycine max
  Peptide Sequence Number=SeqID_95061
atgcaggttagctcgcctgggcgagctgagctcgcctgggcgagccaccctgtcgcaacctacccttcggcgggagggcgacgcgagactcgcgggatgcgtgttccacgaaaggaatccgcgcggagtcgccaccaacgtttatttgaggaaaacgtcggaaaaaccggaaaagacgcggtctacgaactttttagtgaaaggttcgggagttgtatttacgcacggggaag

SEQ ID NO: 3377 - DNA, 135 bp, Glycine max
  Peptide Sequence Number=SeqID_95062
atgaagataaagaaggaagacatggagaagttaatcaccactgaaggttttgaattcgccatcaataaagaagcttcaatggtttcgcaaaccattcacagcattgaagctgcgtctgcttttcaaatacgataa

SEQ ID NO: 3378 - DNA, 285 bp, Glycine max
  Peptide Sequence Number=SeqID_95063
atggtcagcttcggcaattcatctggcccggtaaccggcgtgaatttgggtatcctcaatcagaaaggctcactctatgtgacccgcccttctctgcaaggctacatcaccaaccgggaagagctgacggaagctagcaacgagctattttcgctgatcgccaggcggcgtgatcaaagtcgatgtggcggatatatcagaaatacgcccctgcgtgacgcccggcgcgcgcatgagattctggaaagccgggtgaccgaggggtcgagcctgctgctgccgtaa

SEQ ID NO: 3379 - DNA, 387 bp, Glycine max
  Peptide Sequence Number=SeqID_95064
atgagtacatggcatggtctaaaggacaagttagctgcttgctcaagatccaagaggagtttggaccaacacttagaagccacggagcaaagcatgctagctataatagggcagtacaaagaagagttaaaccagtctttgacccatgaacaaaaactagtagaggacttcgcacaagcgtacgccgagaaggaagcaagagggagggtgattgatgtgttgcatcaagaagcgaccatgtggatggatagggaactcaccataactaaaaaagcgcaaaggcacccttataacactcgatccagaagtaagatggataacgaagagggagtgcaagaacagatgaaggccgacctatcggccttaaaagatcgtgggatcctctag

SEQ ID NO: 3380 - DNA, 171 bp, Glycine max
  Peptide Sequence Number=SeqID_95065
tgtaatagacaaaaaggaagtactgagtgcgactattatgtcatgcactggatgtccaccatcattttaggaagtttcaggaataactgggaagcgtattttaacgatccaagaccattggagccagagagattaaaggcgttgcggatccagtgggtgtggaagcaatga

SEQ ID NO: 3381 - DNA, 390 bp, Glycine max
  Peptide Sequence Number=SeqID_95066
atgcataaggcattacgggccaatgcacctctcccttatccacatttgattactctgtttctgtgtcattttcaaattccgcttgatgatgaaccatttgttcaagtcaagcgttcctttgcaattggtgctggtgccgtgacttcctttgggtaccgtaaagatcggaatggtcaatggctgaagaaggatgcactccctcctcaagatgaaccactcatgaatgaagtcctctccgaattacggggtcttcgttcttatgttggttaccgtttcgactcattagatacacgcttttccggcatggacattcgcctcacacagctcgaagaggatgtaggatacattcgtcagagtttcgatcttccaccaccacctcaaccttcttag

SEQ ID NO: 3382 - DNA, 824 bp, Glycine max
  Peptide Sequence Number=SeqID_95067
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcataatgcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 3383 - DNA, 429 bp, Glycine max
  Peptide Sequence Number=SeqID_95068
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggtaaggctaaactgaaaggacaagttttggtgactgcgctcctccagccagttacctcg

SEQ ID NO: 3384 - DNA, 228 bp, Glycine max
  Peptide Sequence Number=SeqID_95069
atgccttccaagattattttgatgatgccaaacgatcaagagtcaagcaagttccaaagaatcaagagtcaagcaagtttcatgaatcaagatcaagattcaagattcaagaataatcaagatcaagattcaagaatcaagagaagactcaatcaagataaaaaatttttaccagagttttactctctggtaatcgattaccagaaggcagtaatcgattaccaatag

SEQ ID NO: 3385 - DNA, 148 bp, Glycine max
  Peptide Sequence Number=SeqID_95070
ggagaccagtcagggtcacgctgttttggcgagaatgctcaaatcatgcgggatcgacataggcttaaaggggcactcaaactgagtgtatttacccccaaggcctacactccgaagagtctgttagggtctctccctcctgattcag

SEQ ID NO: 3386 - DNA, 477 bp, Glycine max
  Peptide Sequence Number=SeqID_95071
atgtgggcttttcataccggccgacaaattgattgggcacatttagtccgatatcgcatgcataacgcattgcgattaaattctcctttaccatatccacatttattcactcttttcctccaacatttcaacatccctcttgattctgaaccttatgttccaatcaagaaatctttcttgatcggtgctgctatggttgcatcctttggttaccgcaaagagcgtgatggctcttgggtaaagaaggatactcaaccaaatgatgatgaaggacaattaccagttgaaggggactcttctctccttcaaagtattttggacaggttcgatgaactccaaacatatgttggtgaaaggtttgatgctttggaacaacaagtggacatgcgattcgatgcaatggactcaaggatcacaaaggttgaagaagatgtcaccatcattggcgactgccttgatttacctccaccaccataa

SEQ ID NO: 3387 - DNA, 990 bp, Glycine max
  Peptide Sequence Number=SeqID_95072
atggcgtcgaagccctgctggaactcgtcgatcgagaaacggtgggtgatgatcggggtcaaatccagaccggactggatcagcgccgccatcttgtaccagccctttgaagatgacctggttccagtcgatcgacatatccgaaggcggaatgcccagcatggcgatgcgtccgccgtggttcatcgcattgagcagcgtgcggaacgccggcggcgcgccggacatttccagaccgacgtcgaacccttcggtcatgcccagctcggccatcacgtcgctgaggttttccttgctgacgttcaccgcgcgggtcacacccatcttgcgcgccagttccaggcggtattcgttaacgtcggtgatcaccacatggcgagcgccgacgtgtttgcacaccgccgccgccatgatgccgatcgggccggcgccggacaccagcacgtcttccccaaccagatcgaacgacagcgcggtgtgcaccgcgttgccgaacggatcgaagatcgaagccagttcgtcggagatgttatccgggatcttgaaggcattgaacgccgggatcaccaggtattccgcaaagctgcccggacggttcacgcccacgccgacggtgttgcggcacaggtgcgtgcggccgccgcggcagttgcggcaatggccgcagacgatgtggccttcggccgagacgcgctggccgaccttgtagccggcgacgccggggccgagctcggcgacgcggccgacgaattcgtggccgatgaccaggcccggccggatcgtgcgctggctccactcgtcccacaggtagatgtgcaggtcggtgccgcagatcgcggtcttctcgaccttgatcagcacctcgttcgcgccgggcacggggacgggcacgtcctccatccagatgcccttgccggggtcgcgcttcaccagcgccttcatggtctgcgtcatcggggtgccggacttgcggggagtcgcctattctag

SEQ ID NO: 3388 - DNA, 708 bp, Glycine max
  Peptide Sequence Number=SeqID_95073
atgatccgccgtgccatcctgaaggcggtggcgatccccggctatcaggtgccgttcggcggccgcgagatgccgatgccctacggctggggcaccggcggcattcagctcaccgccagcgtcatcggccgcgccgacgtgctgaaggtgatcgaccagggcgccgacgacaccaccaacgcggtgtcgatccgccgcttcttccagcgcgtcgccggggtggaaaccaccgaacgcacgccggaggccacgctgatccagacccgtcaccgcattccggaaacggcgctgcgcgaagaccagatcctgatctatcaggtgccgatcccggagccgctgcgctttatcgaaccgcgcgaaaccgagacccgcaagatgcacgcgctggaggagtacggcgtgatgcaggtgaagctgtatgaagacatcgcgcgctacggccatatcgccaccacctacgcctacccggtgaaggtcaacgatcgctacgtgatggatccgtcgccgatcccgaaattcgacaacccgaaaatgcacatgatgccggcgctgcagctgttcggcgccgggcgcgagaaacgcatctacgccctgccgccgttcaccaaggtggagagcctggacttcgacgaccatccgttcagcgtgcagcagtgggacgaaccctgcgcgctgtgcggttcgcgccacagctacctggacgaggtg

SEQ ID NO: 3389 - DNA, 285 bp, Glycine max
  Peptide Sequence Number=SeqID_95074
atggaaggttcccaacaaaacactcactatcctaaggaaaaattgccaaaaattgttacacacaaatggaagtttggtaacctattggaggctcctaacacacttctaatgaaaggcctttttgttacaaaacttgaaagcaatgaagtgcttcttagtccaatagctcttaaggtggttggtccctttcttcttgactcaaattcttcaagggatggcaccaatccttcttccagttccccattcggcaacccccaaccaaggaaacgaagagacaagcaataa

SEQ ID NO: 3390 - DNA, 461 bp, Glycine max
  Peptide Sequence Number=SeqID_95075
ggctcgtagggaagaacacggccagaacaaatttcgaggggctctgtggggtagtaacagtgagcttaagctccggagagaagagagggaccaatcacgagtagacagtttgatcttgaaggatgtgttgaaggtttgcctaaggtccaagagaagcttgtctgagcgtttacgcgagacagagaccaacatgttagccatcgtcagcaagtaccaagaagaattaaatctagccacagcccacgagcacaaagtggcggacgagtatgcccgagtgtacgcggaaaaggaggctagaggaagggcgatcgactcgttacatccagaggcaacaatgtggatggaccgatttgctcttactttgaatgggagtcaagaacttccccgattgctagccaaggccaaagcaatggcggacacctactccgcccccgaggagatccacggacttctcagctatt

SEQ ID NO: 3391 - DNA, 324 bp, Glycine max
  Peptide Sequence Number=SeqID_95076
gtttgtggcatagaaagcttttattttgatgataagtttagatatcctgtgaattctgctcctggtcaactcccaagaacagtggatgctcttgaaggaaaaggtagtgtgaatggagtatttaggactgttctcatagccaacaatgtttctcttctcaacaaagaggataatgcaccaatctacagtgttgaagatgtcaaaaacattaaagagatagctgcaagagatgatgcatttgatctgctaagtgattcacttgcaccttctatatatgggcattcttggataaagaaaggagtggttttgttgatgcttagtggg

SEQ ID NO: 3392 - DNA, 319 bp, Glycine max
  Peptide Sequence Number=SeqID_95077
cgactccgcgcgtattcctttcgtggaacacgcatcccgcaagtctcgcgtcgccctcccgccgaagggtaggttgcgacagaagggttgtccttgtgtgtttagaacttgtaaaaggaatttacaagatagtggaactctcaagcgggttgcttggggactggacataggcacaaggggttacgagaattttatggaagccccggaagccatttttcaacaaaacaggggaggaggttgtcgcccaacttgcccaggcgagctacgttgcttcctccttaagcaacccagattccaaaatgtgctggaagggccttga

SEQ ID NO: 3393 - DNA, 441 bp, Glycine max
  Peptide Sequence Number=SeqID_95078
atggtcaagaaaatcaataagatatccattagcattcctctacactattttgagtttgtttcaatggaaactctacctcatagggtggatgatagagctgtcttgacaaacattattggtacacttcatgcacttagaaataaagaagagagaggcttactcaagcttgaggataaagacttcccaagctatttatcttctctctcaaagaggctctctacttggatggttaggaatgaaggctcctacccttatttatactactccatctccacaatgaatggtggagattacttgtatcctaggatgaagattaattctctagaatgctccacacattctaggagtctctacactcttttattccctttcatactcttccataaggttccagcccacacatctccagaatattccagaggtttccacatccttccataa

SEQ ID NO: 3394 - DNA, 150 bp, Glycine max
  Peptide Sequence Number=SeqID_95079
atgtacgatgcaatcgacagaagtttcaacgttttaacgaggccattagcggtgatttgtggtctctttcacgattcgcaatgggatttactaggttcaggtggtaaagagacaaagggaggtgatggagagagagacgatgaaggatag

SEQ ID NO: 3395 - DNA, 120 bp, Glycine max
  Peptide Sequence Number=SeqID_95080
atgactgttaaaaagaggctaagtcatgaagtgctaaaagtgacagttgaactcagctcatccgtggggctaagcgcgcatccatcgctaagcgtagctttagcgcgcttagtgcgatag

SEQ ID NO: 3396 - DNA, 976 bp, Glycine max
  Peptide Sequence Number=SeqID_95081
tattatgaccagcccctgaggcgcttcacattcgaggacttccacctagtgccgactgtgaaagagtttgaagaaatcctgggatgcccactgggaggaaggaagccatatcttttctctgggttctatccctccacgacaagagttgccaagtaccaaggaagtgtttggaggaaagggcaaaggccttggaaaatcaaggcgaatgggctttcttttattgacatcttggcgcttttgatctttggagtggtcctctttccgaatatggaagggttagtggacctagcagtgattgacgcttccctcgcctttcatcatggcaaggaaagcccggtcgtcgccattttggccatgtatgacatgttcgaccgaggatgtgaaaagagcggcgcaagaattgtttgttgtgcattggctctctatgtgtggctggaaggaagaatcaggattctatcttcatgcgaaggatgtccaaatgttcccttgatgggaacaaggggttgtattaattataatcccgtcctcgccataagacagcttggctaccccatgagaggagtgccatcagacgaaagcatcacgcctttcatcgcacggggtttcagtgaccacaacgcgagggacagagagcttaggggaagcagtaatgggatcatcggcgactatcataagtggctgagagtccggacacaaggattggattggctcccaaatctaaagactgtgagagacaatgaggttaaagctttggaagaaagtgatgaggtacaagccctaaaggcaaagcttgaaagagcccgggtagtcaaagagaagttcaagtccatagccatcaaaggcagcaatagtgagctcaagctccgaagaggtgaaaggaatcatcacggcgagactgaagggaatatgtgggccatcatcgatgagttgcaagagaagctaaatctagcggcgaatcacgagcaaaggctagaag

SEQ ID NO: 3397 - DNA, 369 bp, Glycine max
  Peptide Sequence Number=SeqID_95082
tagtcatgactcttgcaagagcctaagtgaagaactttgtgactattatgaaggagagcataggtcacatcttagacctcactcccatagtagagaaaaggaaagaaagcctcaagaggctaacactaagctcccatacttccatgtgaaggacaatgtagaggcttacttagattgggaaataagggtagagcaacaaattaaaatgaagtctacttcaaaatcttatggctctcactcttatccaaagaaagaacaaggtcaaggcatattaggggtggcaccttctaagcccaaagatgataaggggaagacagaagaaaagcaaccccttaaggctagtatgcaagagaagactagctctacaaa

SEQ ID NO: 3398 - DNA, 692 bp, Glycine max
  Peptide Sequence Number=SeqID_95083
atggtgaaagttggaacctcatacgtgccgatcaacatctcatttttcgccaaaagttggcccagggctttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggttggagatttcagtcgctttgagaccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 3399 - DNA, 288 bp, Glycine max
  Peptide Sequence Number=SeqID_95084
atgactaatcgccttagatatcttttgtttccccttacaaagattcaaaggactaaccgcctgagaattctttgtgccaacacattggagggtacatcctttgtgagagggtacatctcttgtggatcagttcaagtggagggtacatccacttggttattcaaagagaacaagggaaggtacatcccttgtggatctttgacttgtaaaggattttacaaggttgaaaagaaatctcaagaactgcaggttgcttggggactggatgtaggcacggtttgtggatga

SEQ ID NO: 3400 - DNA, 222 bp, Glycine max
  Peptide Sequence Number=SeqID_95085
atggaggataggatcgcgaccgaccaagcgccaccccttcccggcactaaacaagcagagaacgtcgctgcagggcagcccagttcaagtgggcaaacgctaacccataaggaaggaggggacatggttaatgtttccctccaaccaaaaaaaaatggcaggttagatcgcctgggcgagctgagctcgcctgggcgagcaacccctgcattcaaaatataa

SEQ ID NO: 3401 - DNA, 384 bp, Glycine max
  Peptide Sequence Number=SeqID_95086
atgatgatggaagcaatgatgagcatgaggaagatgatggaagataacactgctacagttgttgctgtgagtactgctactgagatggacccgattcacccagccagtttcaatcaagtgaatcgtccaatctcatatgtagtaggtcaaggaggggaaacacatgaagttccccaataccacactttggtcgtgttcggggtttatccaggatataccactgaaggagaggcattttctggcatccctgtgctgagcgctctcagaatatctcaatgtcgcctgttatcacaacccttgcatatcgtaaggggacaggagtcttccacactacttgagaaggaacggattgagcatatggaggagaggctacggcgccattga

SEQ ID NO: 3402 - DNA, 510 bp, Glycine max
  Peptide Sequence Number=SeqID_95087
ggtacattgccaagtgtgtctgcaaatgttgaagtgctgaatgttgccaataactcaatttccggaacaatttctccctttttatgtggaaaggaaaatgctactaataagttaagtgtgcttgatttttcaaataatgtcttatctggtgatcttgtcactgttggggcgagccctggtgcagcggtaaagttgtgccttggtgatttgttggtcatgggttcgaatccggaaacagcctctttgcatatgcaaggacgacaaccgcttctctggatatattccttcaacactgcaaaattgctctacaatgaattcattgacatgggcaataaccaactttctgacgcaataccagattggatgtgggaaatgcaatatctaatggttcttcgtctaagatccaacaatttcaatggcagcattactcaaaagattgtcaactttctcccttatagtgctggatctggcaatacagcctgtcaggatccattccaaattgttggatga

SEQ ID NO: 3403 - DNA, 249 bp, Glycine max
  Peptide Sequence Number=SeqID_95088
atggcctcctatggtgaagcaaaggaatccattgatcaagaagaacctaggcctacaagctccaatggagcttacatcatagaggatgaactcactcctcttgagccctcttcagttgttgcagatacatctatagctcaggaggaggtatcttcaccagatcccatgccagagccatcccctacacctatatctgaggacactatgccatcagaaccaaccatggagccagagcagcccattctttag

SEQ ID NO: 3404 - DNA, 441 bp, Glycine max
  Peptide Sequence Number=SeqID_95089
atggttaaggaggagtgtaatgaggtaagtgtctcctccaagagattagctaagaaggaaagtcattttgcaataaagacaaacattaaagaaacttcccttcctaaacaacctccacatcttctcctttgtaaaaggacacttgttagcaccaccatacctcttgagcttgaggttattcctcaggtaaagatgttgttggatgagggtttggttcgtaagatcttaaatccttgtgctttgttggtgcccaaaataggtattatgaggcaccaaatccctatgataggtggtatggtgaatgtgttgagtggtgcaaccctcttttgtaaaatcacccacgcatccaacatcttcatgattcgtatacatagggactcattaggtagtgatcaaggggttcccacggatcctaagagaatagaggtcattcctgagtag

SEQ ID NO: 3405 - DNA, 165 bp, Glycine max
  Peptide Sequence Number=SeqID_95090
atggatatgataaatgcaggaatgatatgtccattacgatgccatgaagagatgcatgatgccatcaaggaacaagccaaaagatatcatcctcctaggaaatacattatggtgatagggactatcagtgacaatgcatcactaaaagaggaaaactctagatga

SEQ ID NO: 3406 - DNA, 540 bp, Glycine max
  Peptide Sequence Number=SeqID_95091
atgggttctgtcttgatccctactgtaaacaaaccaacggagggtccgtgtcgccttcttaaaaacgtgcgttggggcatttcgctacccctaggcgtcgtatctaagaaggggacaaattccccggacccccgcattcctagattgcatctgtgtcatatgcattccatcatgcattcatccatcccacccatgaggtatcggagttttgatttgcaccagcttttgtctcactttaggcggttgatggaacccctccaaatgcaagccttccgtaagacttacggaaagatcttagagttaaccatagcagaggtgtccatagaagccattgtatcacttacccaatactacgaccagcctttgaggtgcttcacattcggggacttccaattagtaccaaccattgaagaatttgaggaaattctaggatgtcctctcgggggaagaaaaaccatatctttcctccgggtgtctcccctctttgagcagaattgcaactgtggtcaaaggattcagcaagaggtttggaccgcataa

SEQ ID NO: 3407 - DNA, 156 bp, Glycine max
  Peptide Sequence Number=SeqID_95092
atgattgaggatgagtgggagaggttgcagttggcagtagcagagaaaccaggaggaatagagggagctgaaagggaattggagaaaggtatttgggaaagtgaaggtgtagaggctgcaacaggaggagataggtcaggattgaggctgaaatag

SEQ ID NO: 3408 - DNA, 294 bp, Glycine max
  Peptide Sequence Number=SeqID_95093
atgcgtaaggagaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaacgacggccagtgccaagcttgcatgcctgcaggtttgttcctgtaacacatattcaagtatctaatcctagaaaccaaattgagcttcctggaagaaagttagctgttgatcccaggtga

SEQ ID NO: 3409 - DNA, 1054 bp, Glycine max
  Peptide Sequence Number=SeqID_95094
atggacgatttaaagcaacgcgcgctggattaccaccagtttcccaagccagggaagctgagcgtggagtcgtccaagccttgtgcgacacaacaggatttgtcgctggcttatacgcctggcgtcgcggaaccggtgcgcgaaattgaggcggatccagccaatgcttataaatacaccaataaaggcaatctggtggcagtgattactgatggtaccgcggtgcttggactggggaatgtgggtgcgctggcaggtaagccggtgatggaaggcaagggcgtgctgtttaagcgctttgctgatattgatgtatttgatattgaagtcaatgcggcgacaccggatgattttatccagaccgtggtgaatattgcgccgacgtttggtggtatcaatctcgaagacatcgccgcgccgcactgtttctatattgaaaatgaattgaaaaaacgtctggatatcccggtatttcatgacgaccagcatggcacagcggtcattgtggcagccgcgttgttgaacgcacttgatctccaaggcaaaacgttgccccgcgccaagattgtgtttttaggcgcgggtgcggcgggttgctcatgtgccaagttgctcaaattgatgggggcgaccaatatcaccatggttgaccgtaaaggtgtgctggatagtaaccgtgatgatttgcatgataacaaccgtgaattggccatcactgcaggcagcgtcaaaacgttggctgatgccatgcatggtgccgatgtatttattggtgtgtctgccaaaaatggtttgccgccggaactggtggcaacgatggcggccaagcctgtcatttttgccttagctaatcctgatccggaaattttgcctgaccaggtatttgctgtgcgcgatgacgtgattatggcgactgggcgcagtgactttcctaaccaggtgaataatgccttgtgcttcccgtatctgttccgcggtgcactggatgcccaggcgaaacggattaccgagcagatgaaagtggcggcggccaaagcgctcagtcagctagcac

SEQ ID NO: 3410 - DNA, 669 bp, Glycine max
  Peptide Sequence Number=SeqID_95095
atggatttacctaaagattggaaacactctgcaaatatttatgaagtcaatgtaaggcaatatacacaagaagggacttttagagcttttgaaaaagagatgccccgtttaaagtttatgggaataaaagttctttggtttatgccggttactccgattgctcagcaaaataaaaaaggaagcctgggaagtccatatgctgctgcagattatacttctgttaatcctgaatttgggacacttgatgattttaagcacatggtaaatgaagcccacagattaggatttaaggtaatcatcgactgggtggcgaaccataccggttgggaccatgtctggacaaaaacacatcctgaattttatttaaaagatccggatggaaaattccatattgcatcgggaatggatgatattatcgaacttgattataagaatcaggagatgcgtaaggaaatgattgatgcaatgaagttctgggttaaagaaactaatattgatggtttcaggtgcgatcttgcttcatgggttgaggttgatttctggcagcaggcccgtcctgaggtagagaccctaaagcctcttttctggttaggcgaatttgacgaattggagaatccagaatacgggaaaatttttgacgcaagttactcgtggaccctggatgcataa

SEQ ID NO: 3411 - DNA, 513 bp, Glycine max
  Peptide Sequence Number=SeqID_95096
atgaccatgattacgccaagctcgaaattaaccctcactaaagggaacaaaagctggtactgctgttcgagggacaagttaggcaatgcagtttctacagggtttccaaaaggcctgtgtcccaaggagcactgtgaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcagatccccctttcgccagctggcgtaatagcgaagaggcccgcaccgattgcccttcccaacagttgcgcagcctgaatggagaacgggacgcgccctgtaacggcgcattaagcgcggcgggggtggtggttactcgcagcgtgaacgctacacttgccagcgctgatgtccggcggtgcttttgccgttacccaccaccccgtccgtag

SEQ ID NO: 3412 - DNA, 606 bp, Glycine max
  Peptide Sequence Number=SeqID_95097
atgacgtttgaggctacaaaggaaatcgctgagaagattgattctttggaggagcaagcgtcacagggtttgtttgtcccccatggacgtctggatgtcctaattgctgccattaggcgaccaaaacaccctagccgtgtgcgtgctgctgaagccggtgtcaccatcaagcaatacttcggatcagctccaagaagctcccgcaattcctccttcatccctcccgaagaacttaagcatctgactcaacaaatcagggaccagctagagaagtctgaggttggtccctcagcttctcgtgtcagcacaaaggggagttgtgttaatccctcagggaacgatccagagacgggtgactcagaaaaatgtgggctgtacatcgaacaaaatccttcccgcctagttgccctaggaaatgtttatgagggatccacaatggttcacaatatccctttgttgcatggccaagtgaaggttggtgttgaggaggttaaagatgcagaggctcccattcctgtacccactaacgaggttattttagtggggcagacacttaacatctttcttgctcggccgacacatctcgtgaagcgtgtatcagaatag

SEQ ID NO: 3413 - DNA, 697 bp, Glycine max
  Peptide Sequence Number=SeqID_95098
atggccgttggacgacctgagcatcaatgccatgttcgcgtcgcatggtcaggtgtcacaataagccaatactttggccaagcctcacgtgcttctagcacattgtcaccatcgatcaaccaacaacaattggctaatatcatcggtggaattaaggatgacataaaaaagcagctacaagatgagataagaaatgaggtacaggatgagataagaaaggaggtacaacaagaacacaagcaacaacaagagtcagcccccattaaggcgctagaaatacaagctctacttgcacgtgttagcacaaagggtagctgcgctagacttgaaggaagcggattacttaaagagcttttgaatggtgatgacgatctgatgggcttgttcgtagttgttgtcagaacatacatgcctcacgctgaggtccctattcctacatcagaggttcattatcttgagcaggtcgttggcacattcgttgcatggtcgacacatcttgttagggaagtaactaatgaggtggtcgtaggacccgataagcctccatcaaagtttgttggagagccgaacaggttaacatctatggccacagatgacccactgggagaattggttaagaagtcatatgtggtttacacaaagccaatggaattgccatgggacggggcgaaatttgggttacctaatgccacaaatg

SEQ ID NO: 3414 - DNA, 171 bp, Glycine max
  Peptide Sequence Number=SeqID_95099
atggtggacttcaagggtatcaacctcgtcaaccaagatgaccccgtggttgtctccatcatcattgcaaacttcatggtttccaaggtcctcatcgaccaagccagttggaagcttgcttgtggggcttctatggaggctggatctttgagcttcaatgaggtcctttaa

SEQ ID NO: 3415 - DNA, 654 bp, Glycine max
  Peptide Sequence Number=SeqID_95100
atggaagaatcatcaaataagcgaaagggatcttcctcctccaccaccgctactggccaccgccaccatggaacctccagagacccaccagcactagttcctccctctctttcatcccctcgtcaaggtgttccttttgagggcactcttgtggatgactggaaatttgattattcaagtcatgatgctcgcaaaatgatcgactgggcccatctagttcggtaccggatgcataaggcattacaagccaatgcacctctgccttattcctaccttgttactcttattcttcatcatttctatgttcctttggatgatgaaccatatgtcaaggttaaaaggtcattttccattggtgtcattgcagttacctcctttggttaccgaaaggatgttgatggtcagtgggttggcaaacaagactttccaccacctattcctaatgaacgtacctcatctcctctaccacaaagggatgatttcacttctcttatgactgaagtgctcacagagctccgcgatcttcgagcatttgtgggtgagcattttgatgcgatggatactcgctttgatgagatggatactcgtatcactaggcttgaagatgatataagcctcatcaggcgttgcttcgatccccctgccgactcttag

SEQ ID NO: 3416 - DNA, 720 bp, Glycine max
  Peptide Sequence Number=SeqID_95101
atgaccaccctaactcggatatggatgactttgctgctcagcaacatcctgcccaccgatcataattccgacctccccctgccgaagtgtcagctggtgtacgccatcctgacgcggatgagcatccatgtggctcagttaatcgctgatgccatctatatttttgcaggtatggcgcctaccaggcaccctctggacccagataagtccagcagggccctgggatttcccgccttgatcacaggactctgccagtcgttcggcgtccccgtcacacctagcaaggtgattcagccgcccatcacccgagcttttattgagaagtactgcacgcagagacaggtccagggtgatgcaccacaagccgcggacgagccgccacctcatcaggctggtccggccggatcatttaacacggagcagtatttgcggcatttggttcgccagcaggcggccaaccaccgggcgcatgtacagactcatgattgtctttatcagatgagtctcagcctgcagagccagggctttacttctttctcatgccctactccggaccagttcagggcagaggtcgcatggcctggagattggcctgaggcccaggcaggagaggcaccagcaggggcaccagcagaggctcccgacgaggcagatgaggcccgcgaggatgaagagatgaccgatttacttgatttcttaggagggagcggtgccacatga

SEQ ID NO: 3417 - DNA, 192 bp, Glycine max
  Peptide Sequence Number=SeqID_95102
atgccccatgggttgtttccttacaaaggtcgcgcgctaatgccattgaggcatttcaccgaacacttggtgggcgcgcgtttagcgcgaaacggaatcaaaaatgcgaaaaatgatgaccctagggctgcaactcgtaaatcccgtgggttggctcgcccaagcgagctaacctgcatttttgttttttga

SEQ ID NO: 3418 - DNA, 1557 bp, Glycine max
  Peptide Sequence Number=SeqID_95103
atgaagggcggccagtacggtgccttcggtgccgttaccttggagaaatccaaactcgatttatcccaaaagcaaacaagctttagccccgagctagacattgggggaggtggaggagacattggaaagaaaatcaatcatggtggtggtgatggaggtgatgatgatggggatgatgacgattactttgatgacttcgatgatggtgatgagggagatgagggtggcttgtttaggagacggatactttttgaagagctatttgaccgaaaatttgtggatgctgtgttaaatgagtggcaaaagactatgatggatttgcctgctgggcttcggcaagcttatgaaatgggcttggttagctcagctcaaatggtaaaatttcttgcaatcaatgccaggccaaccaccagtaggtttatttcccgaactctgcctcaagcactatcaaggtctttcattggcaggttgcttgcagatcctgcattcttgtataggtttctattggaggaggctgcaacagtaggttgctctttgtggtgggagataaaaaatcggaaagataggataaagcaggagtgggatcttgcattaatgaacgtgatgacagcagcagcatgcaatgcactagttgtttggtcccttgctccttgtcgatcatatgggaacacttttcggtttgatttacaaaatacattgcagaagcttccaaacaacatatttgaaaagagctatccacttagggaatttgacatgcaaaagagaattcaatgctttctgttcaaggctgctgagttgtgcatggttggtttgagtgctggtgcagtacagggtgcgttgtcaaactctctggctagtaaaaaggagggaagattatctgtgacagtcccaagtgtgagcagtaatgcgcttggttatggtgcctttctcggaatttatgccaacctgagatatcaactgttatgtgggtttgatagagcaatgatgacccattttgatgttattggagttgccttgttcttcagcacaacattcaggatcttgaacgttcaattgggagagacttctaagcgtgcctggcttggagttgaggcagatcccctggctcagtcggatgacctcttgaaagtgtataacaggacttctgagaatgtagaaaagtcatcctcaaaatggtttatatcaaaaaatgcagttgtttctgggcttgggctcttgggcatcaaacaaaggaatacagacgggtctggtgcagaatcttcagctcctaaaactcgccgaaaaaggattgttcggaagaaggttgcggcggatgggttcaacttgcctgtaacaataaaagctgttaatggcaccggcaactctagcactgctggctgtgatggagatttgaggaagaattctccgtctcagctagcttcaaagaatggtgacaaagttattgctggccgaagtgcctgtgatgtctttaacactgatgagtattgcttgctgcagaggcacttatggaaaccctgcagccacatgtttgtcttcaaacgattcaagcatttttga

SEQ ID NO: 3419 - DNA, 882 bp, Glycine max
  Peptide Sequence Number=SeqID_95104
atggtaggtttttctttcgaagaggttggttgccttcattcaagcaaaagcaaggttttgtctagccatttttcatcagatggaaaagttttggcaagtgctggacatgagaagaaggttttcatttggaacatggaaaattttgattgtgtaactactacagaaacacattcacttcttgttacagatgttaggtttagatcaggttcaactatctttgcaacttcttcctttgatagatctgtgagactatgggatgctgccagaccaaccagttctctgctcaaacttactgggcatgccgaacaagtaatgtcattggacttccacccaagaaaagtggaccttctttgctcatgtgatagcaacgatgtaattcgactgtggaatatcaatcaaggtgtttgcatgcatatatctaagggaggtagtaaacaggtcaggttccagccttgttttgggaagtttttggctactgccacaggaaataatatcaaaatatttgatgtggagaccgacagtcttctgtacaatctagagggacatgttaaagatgttcgttccatttgttgggataaaaatggaaactatgttgcctccgtcagtgaagatagtgcacgtatctggtcatcagacggacaatgcataagtgaattgcattcaaccggaaacaagttccaatcatgcatatttcatccggaatatcataacctcttagttattggtggttatcagtccctggaattgtggagtcccgctgagagcagtaaaacatgggctgttcatgctcacaagggattaattgctggactagcagattctcccgaaaatgaaatggttgcctcagctagccatgatcattgcgtgaaactatggaaatga

SEQ ID NO: 3420 - DNA, 222 bp, Glycine max
  Peptide Sequence Number=SeqID_95105
atgaaagggacaaaaagccattatcttaagaacctaggaaggccacgctttgctcttaagaacctcttgctatgctcgttctttctcctctcccacctggtaataaaaccgttaatgggggtgtcagaaagagacagagaaagggttggaagagtgaggagatggagccttgaggtgcagaatcatgtggtggcagctcagcttctaaggaaaaggaattaa

SEQ ID NO: 3421 - DNA, 1098 bp, Glycine max
  Peptide Sequence Number=SeqID_95106
atggatgcgcgtgtggaatttctggaacgagggttcgaaggcatgatcaacacacttgaggacgtcgcaagtttgaagcgattgtttgaagaggaacgcatcgagcgagcggagctgaaggcgcaaatggcggagctaatggcagaggtgaggatcttgtcgagcaccgatcggggaagagacaatcgtgaccatgtagaacagcaaaatcgcgatcgagaggtaaagtggcggaaacttgagattccaatttttgacggaggagatgcgtttggttggacaaataaggtggaacgctatttcgagattaaaggtgtagaggaagaagatcgaatccaagcagccatggtcgcaatggaaggaaaggcactaacctggtaccagtggtgggaattttgcgcgaaaaaccctaattggacagatttcaagaatgctgtgattggtccattgagaggaacaaaacctaagtatttgaaaggcatatttctgaatggactaaaagaagtggtgagggcagagttaaagttgcatccagtaaacaccctccctgaattgatggactatgcgcaatggatagatgagaaaaattcactaatggaaaaaggtaatgttggaggtaatagaggtggtccaactagaagttatagtttcttaagaactgtaacgtgggatccaggaaacaaaggcaccacggcaaaaacaagagagacgagttcgagctcggaatcaaatagtgtgaagtccactggggcatacaaaggtaggccttttaggaggatgtcagatgcggagttccaagaaagggcagaaaaaggactttgttcccgctgtgatgggaaatttggccctggtcatatgtgccccaataaacaatttcaagtccttatttgggagaaggacaagatgaagaagacgaaaaagcaggaatcggttgatgttatgaagcagcaatttcctgcatttcaccttgaggacaaggtggctctcttgggggggagtattgttaggttaccgattacgcaagtgtatgaaggaaggacacatgacaagtataagaggaagtcagagcagcagccagaacctggattaggtagctga

SEQ ID NO: 3422 - DNA, 405 bp, Glycine max
  Peptide Sequence Number=SeqID_95107
atggttctgctagagaagctctgggatgatgttgtggctggccctcaacctgagcgtggccttggcaagctcagaaaactcaccaccctcaaaactattgatgaaggagaaagtagcaagctgcagaagacgttgtcgatgccgtcgacaccaacaaccccgatgactccgacgactccaacgacaccgggatcggcccgtaaagctgacaacgtttggaggagcgtcttccatcctgggagcaactccgccacaaagaccatcggtgctcagatgtttgacaaaccacttcccaacactcccactgtctatgactggtatattattgctgtacagtggggagaccagaagcaggcaccgctgaagctgaagtctttagctaagatgaccgtgggttgcatgtaa

SEQ ID NO: 3423 - DNA, 1908 bp, Glycine max
  Peptide Sequence Number=SeqID_95108
atgagacccaccgcgcgtcggcaagcgaaggactccttcattcccccggcgccgcccactccgctggacttccaccaccgccagtactcctcccgcgactccgacgtcagcagccgcccctcctccgtcggcatcggcagacgccccaccctagacctctacaatgagccttcctacaagcaaacggtggtttccaccatcaactccttcctctcctcccacaacttcccaatcaccttcaaaacgacgctcccctctgccaaagacatccacgaaaccctaaaatttctcctctctctcctcgacttccctttctccaaactcgaagaggatctccctcccctcctcaaacgcctcaattatccttttaaactcaacaaatccattctccgttccccagccgcgcctcaccaatggcctaccttcctcgctctcatccactggctcgtccagatcgccaaattccacctccacctctcttcttcccccaaacagcacaactccctctaccaatacaccgtcaacagctacatgcacttcatccacaacgaggacgacgccgttgaggacctcgaccgcagcatcaaggataagctccaccacgagaaggccgccgccgaggaacgcctccaggccacgcgccgcagcgccgccgagctcgaggcggagctcgagcggctccggtccgcgccctcactgaaggaggcgctggagaaggagaaagcaatgctggaggacgacgtgaagaagttccacaagatgatcgaggagttatccctgcggatcgagcaggcggagagggttctggcggagaaagagaagcaggtggaggcgaagcaagcggagaacgagaagatctgcgaggagaatgaggagctgaagcgtcgcgtggaggcgcagagcttcaacgcgagggacgtggagaggatgaagagggagttgcaggcggtggagagggacactgcggaggctgaacttgcaaggaatgcgttggaggagcaggcgtgggatctcgacaccactctctcacacaaaatcaaagacctcgaggctctcggcatggagtgcaaccaagcccttaagaggttgaagattggtaatggaattcaatatctgctgaatgccaagggtactactcctgctgagataatgggaatcgatcacaaacttgtgctgaagcctgcacttagatccttttctgatgaaatcaagaaaagttctatggaaaaactggaggagtccatttcttatcagcagaagtctggtgaaaatgctgttaggcttgaggggaaaagaaatcagcttgcggcagtgcaatcacgtattgatgaaatgggtattggaaagaggaataatgttgcctgtgaggacttctgtttcacattcctttctgctgcttatcgatttatctaccagatggaagctcaactgaacaggataaagaaggaaacacatgaatacacaagtagagcttctgctgaagctaagaaaatgttggaggatgtccagctggcagatcatgaaattgacattatggaaagagaggcagctgaggttctcaagacatccgaattgaagttgcaggaagtgattaaacaaagtgaagaagaaattcaaatgcatgccagggaactctttcagctggttgattccgtctcaaaattcaaagaacatgtgggttccaaaatttcagagattgggagggatctatctgaaactgccgctgctgtctcagatacatataggggagcttgcccatcaacctctggagagaagaaattgagcaaggttgatagttgctgtcaaagagtgatgacgagagcccgaactgtcgcaaatcgttgtttgccgttcaaattgtgcacaatctatctttcaggaaccgttgttgaaggatacagtggttga

SEQ ID NO: 3424 - DNA, 1650 bp, Glycine max
  Peptide Sequence Number=SeqID_95109
atggtttcatttttcccaggttttctaactaaaggtagcgatgttcagaagctcaaggtggagctctatgaagcaattgcaccccttgaccgaggtgccgaggctactcctgaggaccaacaacgtgtggaccagattgctcgtaaacttgaggctgtgaatcctgttaaggagcctctcaagtctggtttgctcaatgggaaatgggagcttttctatacaacatctcaatcaattctgcaaacacagagaccgaaactcttgcgaccaaatggaaagatctatcaggcaattaatgtggataccttgagagctcaaaatatagaaacttggccgttctacaaccaggccactgccaatttagtgcctcttaactcaaaaagggtggctgtcaagtttgacttcttcaagattgctagtctgatacctattaaatcacctgggagtggtcgtggtcaattggaaattacttatttggatgaagatctacggtcagggatgggtccctgtatctgctcctcccatgctcagcgtctcccctatgcagcaaatctaaaccctaattcttctattctccgtcgacgcgcacaattcatcagcttcgcctcgaattcttctccacctcaagacgaggaggccactgccaagaaatcgtttgccgtggcgaccggcgagctgtttctagggctggcgacgcgcctgattaagagccgaaacaagggaagcagcagcctcgcagaagattcgggttcggtgggcatgtttgagaataattctgaggagagaatcggagcggtggtggaggacgagattgatcccgacgtggtttgggagcaaagagtgaaagacgtggaggcggagcgcaataggtatagccgcctcgtcaccagccctggctttagtttctctgccgctggacttctcttcccttaccatcttggtgtcgctcaatttctcattcaaaatggttacattaaggaaacaacaccgttagccggttcctcagctggagctatagtttgtgctgtgattgcttccggagctagtatggaagaagccttgaatgctactaaaatattggctgaagattgccgcaatcgggggactgcattccggcttggggctgttctacgtgatattcttgacaagtttttgccagatgatgttcatataagatctaatgggagagttcgagttgctgtgacacagcttctttggagaccccgaggtttgttggtagatcagtttgattccaaggaagatctcatcaatgcagtttttacctcttcctttattccaggatatcttgcaccaaggccagcaacgatgtttcggaatcgactatgcattgatgggggtttgacattgtttatgccaccgacatctgctgcacaaacggttcgtgtttgtgcttttccagcaagtcgattgggattgcaagggataggaattagtccagactgcaatcctgaaaacgtgtgtagcccacgacagcttttcaactgggcacttgaaccagccgaagatgcaattcttgaccgattctttgagcttggatatctagatgcttctgtctgggcaaaggaaaacccagttgaagtaatagttcaagatgatagtcctgcgtttggaagtagcagtgcgacatag

SEQ ID NO: 3425 - DNA, 231 bp, Glycine max
  Peptide Sequence Number=SeqID_95110
atggtgcgtgggctatgtaactacacgactggtggcacagtgccacattctcaattcgctcccatcttcatgatgaaaatgaatttcatgaatatcaaattaagatttagatcaaactttaaccgatggaagtatcaatctagtagtaccttagaatttcttcctggtctcaatctatgctgtaactttcctggccatctatctctagtgccaccagcaccatgggcataa

SEQ ID NO: 3426 - DNA, 159 bp, Glycine max
  Peptide Sequence Number=SeqID_95111
atgtcaaacttaagattcaaattgtttgcaaaatgccacttaagaattgcaattcttgttgacttggatactgttaataatctcaggggtgatgctgaatgccataatttctggtctggtcgtgatcatttgctctttggctttaggcttgaggactag

SEQ ID NO: 3427 - DNA, 1020 bp, Glycine max
  Peptide Sequence Number=SeqID_95112
atgggagtagattactataagattttgcaggttgacaagcatgccaccgatgaagagttgaagaaagcttacagaaagcttgcaatgaaatggcaccccgataagaatccaaccaataagaaagaggctgagactaagttcaagcagatatccgaagcttatgaggttctgagtgatccccagaagagagcaatctatgatgaatacggagaagaagggcttaaagggcaagtgccacctccagatgccggtggccatacattcttccaaactggagatggcccaacaacgttcaggttcaatccaagaaacgcagatgacatttttgctgagtttttcgggttctcgagcccgtttggtggtggtggtggcggcggcggcaatggcatgaggggtggttccttcggtggaatttttggtgatgatatatttagttcatttggagaaggaaggaccatgagtcagcaaggtccacgcaaggcacatcccatcgaaaagacattgccttgcacccttgaggaactctataagggcactacgaaaaaaatgaagatctctagggaaattgctgatgcaagcgggaaaactttgccggtggaagaaatcttgaccattgacattaaacccgggtggaaaaaggggacaaagatcacattccctgaaaaaggaaatgagcagccaaatgttattgcttcggatcttgtgtttgttattgacgagaaaccccaccctgtgtttaccagagatggtaatgatttggttgtgacacaaaaggtgtcacttgaggaagctctaacgggccacattgtccatcttacaacacttaatggcagggttctcaaaattcccataaacaatgttattcatccaacctatgaagaggtggtccccagagaaggtatgccaattccaaaagacccttcgaagagaggtaatcttaggatcaaattcaacatcaaattcccagcaaagttgacgtcagagcagcaagccggaattaagaaacttctgccgtattga

SEQ ID NO: 3428 - DNA, 1035 bp, Glycine max
  Peptide Sequence Number=SeqID_95113
atggactacctagacgaggagcagcgtcgcgccatcacgatgaagagctccttcatccttctctgctacgccgtagggtttggtctagggtcggccaaggctggcgagtatttgggtgaagtaaatggcggattcgagtggtgcgagcgtggtgttgcggcagcggcggcggcgttgatagtgttacagcatgacatcatgaaggctgtaacagtgtgtgagggttcagtcctgcaaaatcgttttggtgtatttaagcattcagactggataggaaagccttttggatctaaagtattcagctgtaagggtggctttgtgtacttgttagctcccacaccagaattgtggactctggtattgaaccacaggactcagattctctatattgcggatattagctttgttatcatgtacttggagattgttcctggttgcgtggttcttgaatctggaactggcagtggatcgttgacttcttcgcttgcaagggcagttgctccttcaggacacgtctatacctttgatttccacgaacaaagggctgcatcggctagggctgattttgagaggacaggtctaagcagcttagtcactgttcaagttagggacattcagggtgaaggatttcctgatgacttgactggcatggctgactctgtatttttggatctacctcaaccttggcttgccatccctgcagctgcaaaagtattaagacatgatggcacactgtgctctttctctccttgtattgaacaagtacaacgaacatgtgaaacactccgaacccggttcacagacacaaggacatttgaggtactcttacgcacgtatgaagttcgggaagagaaaatgcaaagcttatgtggggatagcaatggttctgttcctagcaagaggaaacaatgctctggtggaagctatgtactaggcagcagtccatctacttcttctgtcatggctagaccttgtggtgaagctcgaggacacacgggctatttgacatttgcaagagttaaatcactctcatga

SEQ ID NO: 3429 - DNA, 393 bp, Glycine max
  Peptide Sequence Number=SeqID_95114
atggagctattagaggagttttgggccaaaatcactcaaattgagggccaacgtggtcatttcaaagtttccctccgcaagtttaaactgtctctgttcttgtttccccggttctcaacacaagatagggaaccagaagaactagaagaagatgataaagcgacgccttcttcgtcgccggtgattgatccggcgagtccaattcgccttgtctattgcgacgagaatgaacggttccgcatggaccccgaagccgtcgccacgctccagctcgtcaaggaactcgttggcgtggtctctgtgtgcggccgtgctcgccagggcaagagtttcattctgaatcagctgaattttcaattgaagtcaatgcatgattctttctttggagtttag

SEQ ID NO: 3430 - DNA, 327 bp, Glycine max
  Peptide Sequence Number=SeqID_95115
atgggagctttgtatcccctcttgttttactttatttgtgctttgggcccttttgctagtctgagagctgaagcaggagcagtggtgcagagttgctgcaatgctctgactgttgggtgtgatgtgtggcagaaagagagagagaggtacaaacaaggctacaagaacaaagactgtagtagtggtagtgcctcacttggtgagattctccaatcactttcgtacattgttaaaatttacgcggatttcaaaggccaaaataccagtattgcaccattttttttttccattatgccatatgcaaaaatgatatcaaacacgcgttag

SEQ ID NO: 3431 - DNA, 1071 bp, Glycine max
  Peptide Sequence Number=SeqID_95116
atggtgaaaatgatactagcactagcaatgggcatgatgatgatgatgccatggtattcacttgctgtggacattgagcgagtgagggaagtagcagctaagcataacgtgtcttgcatcctagtttttggagactcaagtgttgatgcagggaacaacaatgcccttcacaccactatgaaaagcaactttcctccctatggcaaagacttctttgacagccgcccaacaggaaggtttagcaatgggagacttgccacagacttcgttgctgaagcattggggtacagaaaagcgattccaccttttcttgacccaaatttgaagccggaagatctgcaatatggtgttagttttgcatcagcagccacgggttttgatgactataccgctgaagtttcgaatgttctgtctgtttccaaacagatagagtattttgcacattataagatccacttgaaaaatgcggtgggtgaagaaagggcagaattgattacgagaaatgcgttgtatataattagtatgggtaccaatgactttctgcagaactatttcttggaacctactcgccctaagcaattcagcttgcttgaatttgagaatttcttgctctcccgcttctctaaggacgttgaggcaatgcatagactgggtgccaggaggttgatcattgtaggggtcctacctctgggatgcattccacttatcaagacgattaggaacgtggaagactgtgataaaagtttaaacagcgttgcttactcattcaatgctaaattattacagcaattagacaacttaaagacaaagctgggcttaaagactgctttggttgatgtttatggtatgatccaacgcgcggtcaccaaccctaaaaaatacggttttgtcgatggttcaaaaggatgtgttgggacggggacagtagaatatggagattcatgcaaagggatggatacttgttcagatccagacaaatatgtattctgggatgctgttcatccaacgcaaaagatgtacaagataatagctgatgaggccactgaatcttttattaataacttcttttaa

SEQ ID NO: 3432 - DNA, 1299 bp, Glycine max
  Peptide Sequence Number=SeqID_95117
atgtgcagcaatacttgcaacagtgcttgtggctgtgagactggtgggaacgttgttagtagtatttggagctctggttccggcttgaagaagcaatcaaaacgtccaagagttccaaaaagaggacccggagtggcggaactcgagaagatcttgagagagcaagaaaccatagacttagttgacaacaagggaaatccagaaggattttcatcttttgtttcccatcattctaattccaattcttatccttcttcttctatgaaactgcagcctccaacctcaccaaaaaagactataccttatccttcctttatgtcaagcaattttcctactaatgttccttcagccccaatatttgatcatttaggtgccactacacccccaaccataacatctatctatggtaactatggatcactagaaaaaaacaacggtggatctggtctggtttctcctgaaaaagaattgttccctttgaatctcaattcatgtaagtctaatttgaacatgaatgaaccaatcgatgtaaatcggtgtgactttgccaattctcccactaggaatttgtccaatgagactaattccatttggccttaccatgcaactgttcagaagagaaacaacaataagtattcttcttccacggcaaatcaattccctgggatcccaacctcctcagtatcattgtcaatgagacttcacagcaataatcatccagatccagagcttccttcaaaccaaagtttgtgttacagttacatgtctagagtcccggaagaacataaaatggttggcatgaagcgatctcactcttccgccttggaaaactctctgattccaccatcaaactttcacgttcttccaagtttttctcactacaatagagcacaccaatcatccataaatgatagtcatggtgcaagtagtttcaattccaccaaggagtgctacagggatgccaaatggggtagcactctggagctcagcaacacaaggttcaattctgacatcacagtgcctggtcatgcaatcccaccatttgttactcctgaggttccttcacctcctatgcatttgtttcctggtgttctttccaagggaaatgtgctccctagccaagttaatgacgaaaaaatggactcatacaaacattcagaatcaagtgaatcaaatcgtaagcctttctataacttcctagaagtggaggactcagaggtatcagagaccacgcgtggcgcaaatcgtgggggacgtgaaacaggaagagttggcattgatctcaacttgaagctctga

SEQ ID NO: 3433 - DNA, 1476 bp, Glycine max
  Peptide Sequence Number=SeqID_95118
atggattcttcaaacagcaatggaggatcacagaggctcctggacttggcgcaacggctccgccttgacaagcccccaccattccctgaagacattttggatcagatcatggaagagaagggagataaggttgtctcagaagtgagttacacagaatcagccaccccaattgctcaaaacacagaaaaaattagatacaagagagctgcagttttgatctgcatatttgaaggagatgctggggatctgagagtgatactcactaaacgctcttccaagctttccacttactctggtcaagtggccttgcctggcgggaaagcggaggagggggataaagatgatggggacactgcaaaaagagaggcaatggaggaaattgggttggaccctgaacttgtcgatgttgttactgttcttgaaccatttttctccaagtacctaatgagagtgattcctgtcattggcattcttcatgacaaaaaagcattcaaacctgttctgaatcctgctgaagtagaagctgtatttgatgcacctttagaaatgtttcttaaggatgaaaaacggagtcagaagaagatgcagtgtatgggagagaattatctgatacatttgtttgactatgaaatcgagcataaaaaattccttatatggggtttaactgctgggatcttgataagggctgcatcagttgtgtaccaacgacctccagctttcatggagcagaatcctaaattcaagcttcctggggatttaactatgggaatgggttcgaacagggcggaggtacgaggttcacagagattacaggctctgattcaccatctccactcttctattccctctgactctaacgaacccaattcaaaattcaccgtttggaagaagagagcagcagttctgatctgcgtcttcgaaggcgccgatgggaatcttcgagtatttctcacccagcgggcttcctctctctcaacccactccggtggcaagagggaagaaggtgatgctgacgatgtacaaacagcgctgagagaggctaaggaggaaattggcttggacccttctcttgtttctgttatcactcttctccctccctttcatactaagaaattggatgaggtagcttctgaaaaggttgagtatggtgttacaataatacctgtggttggagtactgttcgacaaggatgcattttcacctgttttaaattcagctgaagttgaagcaatatttgatgttccattggagatgttcctcaagaacgataacagaagagccgaggaaagagagtggatgggggagaagcatcttgtacattattttgattatgaagatgggaataagaagtatgtgatatgggctataactgctgcaatcttaattcggtcggctactcttttacttcagcggccacctgcatttctagagcagaggcccaaaatatggggaggaatgactgaaaatgacatatga

SEQ ID NO: 3434 - DNA, 1630 bp, Glycine max
  Peptide Sequence Number=SeqID_95119
atgggatcagtttgtgaagagcgatggataacagttaccatcacaacggtggcattggtgatagcttcttcagcaccattattattggcggcatgcccttacacctccatcttcagcttcggtgattcacttgcagacactggcaacttgtatttcagcccctacccacccaccaaccactgccttttccctccctacggcgaaaccttctttcaccatgtcactggacgctgctccgatggccgcctcatcatcgatttcatcgctgagtcactggggattccacgggtgaagccgtatttgggaatcaagaatattgggagatggagtgtggaagaagggggagccaattttgctgttattggagccacggctttagatttcagcttctttgaagagaggggcgttcctgtgaaaaccaattattctttgtcagctcaattgaattggttcaaggaattgcttcctactctatgcaattcttccacaggttgccatgaagttcttagaaactcattatttctggtgggtgaaattggtggaaacgatttcaatcatcctttctctatacgaaaaagcatagtagaagttaaaacatatgtgccatatgtaatcaatgcaatatcttcggcaatcaatgaattgattggtctaggagctcgcacgctcatcgttcctgggaattttccaataggatgcagtgcaagttatttaacaatctatgaaaccgaatataagaaccaatatgaccaatttgggtgtttaaagtggttaaacaagttcgccgaatattacaataatgagctccaaagtgaattagataagcttcgaagactttatcctcgtgctaatatcatctatgctgattatttcaatgctgcattgcttttctatcgtgatcccacaaagtttggttttactggtcttaaagtctgttgtggaatgggaggtccatacaattacaacacatcagcagattgtggcaatccaggcgtgagtgcttgtgatgatccttcaaagcatattgggtgggatagtgttcacttgactgaggctgcatacagaatagttgctgaagcttcttcttcagctccattattggcggcatgcccttacacatccatcttcagcttcggtgattcatttgccgacactggcaacttgtacctcagttcccacccacccacccatcactgcttttttcctccctacggcgaaacctactttcaccgtgtcaccggacgctgctccgatggccgcctaatcatcgatttcatcgctgagtcactggggcttccgctggtgaaaccgtattttggaatcaagaaatttgggggatggagtgtggaagagggagcaaattttgctgttattggagcgactgcgttagacttcagtttctttgaagagaggggcatttctattccaaccaattattctttgacaatgcaattgaattggttcaaggaattgcttcctgctctctgcaattcttccacaggtccatataattacaacgcagcagctgattgtggcgatccaggcgcgattgcttgtgatgatccttctaagcatattggatgggatagtgttcacttcaccgaggctgcatatagaataattgctgaag

SEQ ID NO: 3435 - DNA, 1311 bp, Glycine max
  Peptide Sequence Number=SeqID_95120
atgtcaaccccttcatcatcatcatcatcatcttcttctatttgggtgttgtctaacataaagcttcagttctttgcccgcatcagaaggtttctccaatccaaagcaaccagaaagcgttgtgacccctctgatcggtttgacacagctaagagcagagttgaacacaacaacaaggttgaaaatcttgaaacagttcacgttatggagaagcataaggaggaggaagagtctgtgatcatgttgcagagaactgtgaagatgcttcactttggaagctgggaagagaagatagtggcagcaaaggagattgaaaagttagccaaggaagatgttaaggttagtaagttgataacagaacttggcgtggtgccggtgttggtatctatggtggcgtcgccggtggctagccgccggcgagtagggttgacggcgttgatccacctagctgatggaacctacacgaacaaggctttgatagttgaggcaggaatattgtccaagctgcctaagacaattgaccttgtagatgaatcaacaacaagtaaattggcagagatacttttgtcattgtcatctcttgcaaacactcaattccctcttgcttcattagactttataccgttacttagaaacattcttgagacaggcccaagttttgacaccaaaagttcgtgtttatgtgccttacataacctatcaactgtgttagagaatgcatgccctttggtttcaagtggggtggtccctatcctcttggatgtgtcctcaataaaagaaatttcagagaaagcacttgccactctagggaacttgtcagtgactttgatgggaaagaaagcaatagagaacaattcaatggtgccagaaacctttattgagatcttgtcatgggaagacaaacccaaatgccaagagttgtcagtgtatattttgatgattctagcacatcaaagctcactgcaaagaaagaaaatggcacaggcagggattgttcctgtgcttcttgaagtggttttgttggggagccctttggctcagaagagagcaatgaaactattgcaatggttcaaggatgagaggcaaaccaaggtggggccacattctggtccacaaacaccaagatttgcaatggggtcaccagtgaatcaaagagaagcaaaagaagggaagagattgatgaagagtttggtgaaacaaagtttgcataggaatatggaaataatagcgcagagggcaaatgcagcaggggagtcttctagattgaagtctttgattattagcacaagttccaagagtttgccttactaa

SEQ ID NO: 3436 - DNA, 2439 bp, Glycine max
  Peptide Sequence Number=SeqID_95121
atgtcaggaagcattcccaaaggtgcgttcttattacccctcactctgtttctcatcgtgctactccttcctctgttcagaaacttcattcaatcatctccaaagacatatgccagcaacttggaaaccaaagaaacaaggagatgcaacatattttcaggaaactgggttccttaccccaaagaaccttactacaacaatgaaacctgccctttcatattagaccagattaattgcatcaagaatggtagacccgacagagatttcctcaaattaaggtggaaacctcatcattgtgagcttcctctgtttgatgcgactcagttcctggagctagtacgaggaaagtcaatggcctttgttggagactcaatggggagaaatcaactagagtccttactgtgcctcataaatactgttgcacatcccgaggacattacagagaaatatacatcaaacgataacatatttttcagatggtggttcgtgcctgattacaattttacagttacaacaatgtggtcaccatttttagtgaagttcaacgactcagatcccactggtcgtggtttctacagcgccacgaagctttatctagaagaggcagatgaagcatggagaagcaaaattaaagattttgactttgtggtgttctcaacgggacagtggttcttccgaccattaacgttctatgagaaggggcaagttgtcgggtgtcaaaaatgcgagaacagtacagagcttaactactatgggtacaagaaggcgtttcaaacagcttttaggactatcagaaagcttgaagggttcaaggggttggcttttttggtgactcactctccggagcactttgagaacggggcgtggaatgaaggtgggacttgtaacagaacaaagccatttgaagaaaagggggtttatgaaaatggggatattgtggaagcgttgcatcagatacaagtggaggagtttaatgcagcgagagaaaagggtttgcggtttggtttgatagatataactgatgcaatggggatgagggctgatgcacaccccggtaggtttaggcttggggggaataataataacaatttgaatgtgaatgactgtgttcactggtgctccccaggtgctgttgacacttggaatgagtttttgctgtatttgatgaaattggaagctgaaatacagcataaacataaagtcaaatccgttgatgctgatcccaatgctagttctttctacagagccacgaagctttatctagatgaggcagatagagcatgggccattgttgggtgtcaaagatgcgagaagaacatgacagagcttaacttctacggatacaacagggcattccgaactgccttcagaactgtcatagattttaacgggttcaaggggttgacttttttggtgcctcactctccggaacactttgagaatgggttgtggaatgagggtgggatgtgtaacagaacaaagccctttaccatggaagaaagaggggtgtataaaaatggggatattctggagacattgcatcagatacaaacggaggagtttgaggaagcggaaaaggaaacaaggaaaaagggcctgatggggcatcctagtagatatgggaaagtggttgataagaatgtgacggttagtgactgtgttcactggtgcatgcctggtccaattgatacgtggaatgagtttttgatctatgtaatgaaattggaaggggaaaatgacaccatgcaccatgaagccgtgaaggtgctattatttttgctttttcatgtaactcaggtgaaggatcgagttggatgtgggtcattcacattagaggaaggtgatggtggttgcaatgaccacggaaaaatggaaggggaaaggggaggagatgaaaaaagggggaagcctgacgaatgtgagcttccactgtttgatgccaaacagtttctgaaggttgttcgggtaaagtacatggctttcgttggagactcaattgggagaaaccagatggagtcattgttgtgtctcctaaatagtgcaaataaagcttgggcaagccacattgaaaatttcgactacgtgattttctcaggaggacaatggttcttccgaccattgacattctacgaaaacggccaagttgtcgggtgtcagaagtgccacaacctgatggaagatcctcaaaacttgtacggatacagacacgcattccgaacggcttttagaaccgttataaacctaaaagggttcaaggggatggtgtttatggtgagtcattcgccgaaccattttgagaatggggagtggaataaagggttgaccaatataactgccgttatgcttatgagatctcataaatatggccacaatttggatagaaatgtcagcatcaacgactgcgttcattggtgcatgccgggacctgttgagtgttga

SEQ ID NO: 3437 - DNA, 1161 bp, Glycine max
  Peptide Sequence Number=SeqID_95122
atggcggcgagcgagaggaggcccagaaatggtgggaagacgacgacgttttcagagccgaaccggacgagaaaccatcttcttcgccgggcgagaagttcttcatacactattttcttctctccattggatggtcaaccttgtgctgattatgatagggccagtggtgaaggagttcagccgcaagaagaaattcaaggtgttgcaactttgagacctgagactatgtatggtcaaaccaatgcttgggtattgcctgatggaaagttggagcttttgaaatctatgaaactgatgtgtttgttcttgctcacagagcagctgttaaccttgattaccagaaccattcgcgggttccggagagaccctcttgcttgcttgagctcactgattggacttccattgaagtctcctctttcctttaatgagggagatgaggatgaatgggtgtttccgtttgagattgtgcctatcattgaggttccgcggtttgggaataagtgcgtcaagacggtttgtttgcagatgaaaatcaaaaagccagaattaattgataaggaaaagcttgcagaagccaagaagcaaacgtacttgaaaggtttcactgaaggaaccatgattgttggagaatttgctgggaggaaattcctggttgagtctttatcggattccaccatttacatggcttattacactgttgcgcacccatttgcagaatggtggcatgatggttttgtggtgaatgcaggctggccaacagctgatgctgctccagatctcaaactgaagagttccaataaatatctgcagcgatcgtttcgatcagaaagttggctaataagagaggagactccagattcagaacaaagttctgtagttcagtcttggaattttaaacaaaaaatccaattcttgaagtttaagaaagaggaagcaattgcacttggggctcaagccctggatttgagattgccatttggtgaaattgaggttcttaaggaaaacttggacgtgatcaagagacagataggtctagaagatgtggaaattttatctgcagtagatgccgattccttggccagagctgaaccattagcttctttactaaatcaaaatcctccttcacctggaaagccaactgccatctttttaactcggtag

SEQ ID NO: 3438 - DNA, 176 bp, Glycine max
  Peptide Sequence Number=SeqID_95123
ggaggtatatggaagatctacaactctctctatattggagcccaggatgctcttgtagcagcataccctgccttggaggatgagcatagcaatgtttacatattctgtacttcctcgcatcaatgtaaagctcagttgttggaacattatttcgtgtcttgttacatagatagcag

SEQ ID NO: 3439 - DNA, 517 bp, Glycine max
  Peptide Sequence Number=SeqID_95124
atggatttctcttcggtgagagctgcgttggattcgaagtcgtacgacaaggttgcagatgtgtgcgacaacttgatgcttcaggttgcagctgacggcattgcttatcaggacgattggccctacgcagctcacctcctctctcacatttatgttcacgacatcaatagtgcgcgctttctttggaagtcaataccttcctcaatcaaagagagccagcctgaagtcaccgcggtttggaaaattggtcagaagctctggttacgtgactatgctggagtgcatgaggcaatccgtgcctttgattggactcaggaactccaagccctagagatgtttcagctgcttctctctgcatattctacgataagcattaaagacactgctttatttctgggaatgaatgaggatgatgctacaaattatttactgcagcaaggctggactgtggaccctgcctctcggatgcttattgtgaagaagcaacctgttgtgacagagcagaaacttgatccta

SEQ ID NO: 3440 - DNA, 108 bp, Glycine max
  Peptide Sequence Number=SeqID_95125
atggcgaagatcgaagagaatgcaaaggagcttaaggttggtgcgatggagaccaaggtgttgagtgaaagtgaatcactgatatggagaacaaccttctgtcaatag

SEQ ID NO: 3441 - DNA, 483 bp, Glycine max
  Peptide Sequence Number=SeqID_95126
atggattatgcttttgaatgggttatgtacaatggtgggatcgacacagaaactaattatccatatattggtgcagatggtacatgcaatgtcacaaaggagaaaacaaaggttattggcattgatggctactacgatgtggggcaatctgatagttctctattgtgtgctacagtgaagcaacccatcagtgccggtatagatggcacttcatgggattttcaactatacattggcggaatctacgatggcgattgctcaagtgatccagatgatattgatcatgcaattttagttgtgggttatggctcagagggtgatgatgattactggattgtgaagaattcatggagaacctcatggggaatggaagggtgcatttatcttagaaagaatactaatttaaaatatgacgcatggagatttagtgggagaggctgcaaagtaaagaaagatgggaaggcaacagttaccatggactaa

SEQ ID NO: 3442 - DNA, 1215 bp, Glycine max
  Peptide Sequence Number=SeqID_95127
atgtcttcctctgtcaccaatggcgatgattccctcactggtcacatcatatctacaactattggaggcaaaaatggggaacccaaacagactattagttacatggcagaacgggttgtaggaactggatcatttggaattgttttccaggcaaaatgcttggaaactggggaagcagtggctattaaaaaggttttacaggacagaagatacaagaatcgcgaactacagttaatgcgtgttttggatcatccaaatgtgatctctttgaagcattgtttcttttcaactacaagtacagatgagctttttcttaatttggtgatggaatatgttccagagtctatgtatagagtcattaagcactataccaatgctaatcaaagaatgccaatcatctatgtaaaactttatatgtaccagattttcagggggctggcttatatacacactgtgcccaaagtttgccacagagacttgaagcctcaaaatatattggtggatcctcttacacaccaagtgaagctatgtgattttggaagtgcaaaagttctatttcttgtgtcgatgtcttgttctgctcaacagcaagctgtggagctctctgttttttcctttttttcaagatttctatcataccagtgtgtaaaaggtgaagctaatatatcatacatatgttcacgattctatcgtgctccagaacttatatttggtgccacagagtatacaagttcaattgatatttggtcagctggctgtgtccttgctgagcttcttttgggccagccattattccctggcgaaaatgcagtagaccagctcgtacatattataaaggtgcttggcacacccactcgagaggaagtacgctgtatgaatcccaattacaatgactttaggtttccacagataaaagcacacccatggcacaagatattccacaaaaagatgcctccagaagcaattgatcttgcatcccggcttttgcaatactccccaagtctccgatgcactgcgcttgaagcatgtgcacatcctttctttgatgaacttcgagaaccccatgctcgcctgccaaatggtcgtccatttcctcctctatttaacttcaaacaggaattatctgaagcatctccagtgcttgttaacaaattgatacctgaccacgtgaagcggcaaatagggctgcaatttgttcctccagcaggatcatga

SEQ ID NO: 3443 - DNA, 324 bp, Glycine max
  Peptide Sequence Number=SeqID_95128
atggactctctctaccaaatcatctcctccttcccttccttcatggttgctgttgccgccacgctccgtcatcgccgaacccccttacatcatcggtcaacagcttccttcgaagattttatccgacctatgtcttcttgtgcgaagactaatttcgctcttcctttcgataatgttaagaacgcaagttctagccaaagcaacaccgtcgggtcctctagtcgcaaccgccacgtggctgctcgacttgaacctcgcccccacgcggcgtcggtgacattgtcctacacgccaccatggccagtcctcgtggctttgggttag

SEQ ID NO: 3444 - DNA, 1098 bp, Glycine max
  Peptide Sequence Number=SeqID_95129
atgccagaagggtatgagattcatgacaatgaggaaacttcatcgggatgttcgtcttcatttgatttgaatgaagaattagcttgcagtgaagataacagtgatacagaagagtgctgtgagctcacaacaactaatgagaaagcaaaggatgaaggcacttcagcaaatggaagtagcatatcatcaagagaaggaaatgagagaagaggaacggtaagacaatatgttagatccaagatgcctaggcttcggtggactcctgagcttcatcattcatttgtgcatgctgttgaaagacttggtggtcaagagagagctacacccaagttggtgcttcaactaatgaatgtgcgaggactcagcattgctcatgtcaaaagtcacttgcagatgtatcgaagcaagaaacttgacgaggttgggcaagtactaagtcaaacgtccaagtccaaccaagaagtagctcgtagacctttgatactccatcagtgcataattcctcagcaacatcttatgatggggaatggtggaattattctagcaagtaatttcaacaaacataatcatttcccaagtcttctgcatccctccttctccctatcacgttcacagacaaacgactccgattcaaggcaccaacattggtacaccaatcaccaagattttagcataccaatagcttcaagccaaattcaaccaaaggatacacgcggccgaattgcccccatgagaccaagccaattgcttgaagagaaaaggtggcctccgttagaaattttgaacaatcatcaatcgatgttgaaaaggttacctgccattgttgctcctaaaaatgggtcacaagctgttcaaccagctgaatggagttttgtgaataacacaagcatcagagattatctatcgaacaactccaatgaacctctcaacaattccaacagtttaaagctagaatttgatcctccatttcggattaagaaagacgagcaacaattgcctgatttgcaactgggtttgagtcacacagttggaactgatggcaagatagatcattataaagaaaccccagaaatcagcaccaagctttcactttcttag

SEQ ID NO: 3445 - DNA, 873 bp, Glycine max
  Peptide Sequence Number=SeqID_95130
atgcacccaattacccccaaacactattccctaccgtgtcctctcctcctctctccatctggtcacactcctcccttaaaagtcacccacacattcccctctctcttcacttcacttatgaagaaccccgtcgcccagagtttcaccgagttctacgataaatgggtttggaagctcgaggagatcctccaccagctccttgaggtgtccaagcagagaacccaggtggtgaaaactgaacaagagctgcaggttttgatttccaaggtcacatcccatttgaaggaatattacactgtcaagtgggcttcggctcatgaagacgttctcgtgttcttctcgccaacgtggctgagtcctttggagaatgcttatttgtggatgacggggtggaagccatccatggtgttgaagcttctggaaaccctgaagaagcaggcggcgagtggtggtgattttgtgatgacggaggagcaggcgaggaagatcgaggagctgaggaagaggacgaggatggaggaggagaaggtggagagggagatggagaggcagcaggtggccatggctgaccgcaagatggtggagctggtcaagctcaccactcgagcaaggaacggtggtggcggtggtggtgatgcggtggcggaagtggcgttgaaaggggttcttgcggggttggagagggtcatgaaggcttcggattgcgtgaggctcaagacactcaaaggggtgttggatgtgcttagtccaatgcagtgtgtggacttcttggctgccaatactgctatgcagctgagactcaggcaatgggggaagaagaagagggacatgcctgcaggctccacactcaatgccaatcatcataacaactaa

SEQ ID NO: 3446 - DNA, 264 bp, Glycine max
  Peptide Sequence Number=SeqID_95131
atggctaatgaaggtcttcatatcagaatgggtttggaggtgggtgtggtgacaggtttgaaggacatgctaagtgcacccagcaaaattaacaatttattctaccagaagaatttgttctaccggaaaaaggttcttccggatgaacaatttgttttatcggaagaactttcttccgatagaagctatggaaagaacttctttcggactaaggagaatgacatgcgaatgggcattgtgagaaatgcttgggataaaggttga

SEQ ID NO: 3447 - DNA, 702 bp, Glycine max
  Peptide Sequence Number=SeqID_95132
atggggaggaataacaaggaggaaaattccacccaaaaaaagaacaaggaggaaaagaaggaatcagacaaggctgttgttttgaaagcactcgtacattgtgaaggttgctcgaaccaaatttctaagtgcttgaaaggtttagctggagtgaggcatgttcaggttgatagagaacatcaaagggtcactgtgaaaggagaagttgtgaatgatccagcgaaggttttggaaagacttcgaaagaaatacagcaaaaacgttgagttaatttcaccaaaaccaaagcctgaaaaacagaaaaaagccgaagagaaaaaggaacagcctaaaatcaaaattgtggtgcttaagatgtatatgcattgcgaaggctgtgtaagtgatgtcaagagaaaaattgaggaaatggaaggtgttcattctgtggaagtggacaaagaaaaatcacgggtcatggtcagaggaacgatggattcaacaaaacttgttgaaaaagtgaagaagaaactgggaaagcatgtggagatcattaaggaagacaataaaagagaacccaaaagagaagggagtgataatgaaaaaggcaatgaagatgttaatgttattatgtatagttatcctcctcaatactctacccaatatctttatcccaatcaatcctttagtgatgaaaacgtttttgcatgttcaataatgtaa

SEQ ID NO: 3448 - DNA, 1062 bp, Glycine max
  Peptide Sequence Number=SeqID_95133
atgaggagtacttgtgatgaatggaaaccttttatagtaatgatagcaattgatttttcttttgcggcagtgaatatccttctcaagaaagtcctggaagagggaatgaaccatttggtttttatcacataccggctgtcaattgctaccattttcatagccccaatcggctactttagggaaagggcatcagtgactcaatactttttccttctggggatccaatatacttctgctaccttttcttgtgctttcatcaacatggtgcctgtggtcacattcatgatggcattaccatttggattagagaccgtgaaaatcaagagcaaaagtggcagagctaagattcttggttcattggtgtgcataggcggcgcattgatgttgacactttacaaaggcaagccactgtttaatttttctcactatgaatctgtatctcctgtggccaagagttctgaagtgaatctagcttctacaaggacaacgggaaaatggactattggtgtaatagcgttggctttgggaaccattttttggtcttcttggtttattttacagtcaaaaataagcaagagatatccatgccagtattctagcacagccatcatgtccttctttggagccattcaatcagctgttatttgcttcttcactgaccacaacttgtccatttgggttctccagggaaagatacaaatcattgctattctatatgctgggatgataggttcgggtttgtgttttgtgggcatgtcatggtgtgtgaagaagagaggtcctgtctttactgcagcattcagccctcttgttcagataatggcagcaatgattgatatccctgtcttgcatgagcagctccatctgggaagtgtgatgggttccatcttggtgattattggattgtacattcttctatggggtaagagcatggaaatgcagaatcgtgtggtcaagttagtccaagaagctgaagaaaccaaggaacaagagccgcaaccgcaaatacaacagttgacagtgtatgttcacgcagaaacgtgcgattcgcagtgccactga

SEQ ID NO: 3449 - DNA, 849 bp, Glycine max
  Peptide Sequence Number=SeqID_95134
atgaagctaatcatcttctctttcctactacttctctttgttcccatattttctaccacaacttcagcccagtcacctgctgcagcccctaaaccccaagcaaaacctgcccctgccacaccagctcctgctccagcaaaaccattggtcccctcattaccccaatcacccttgtctgattcttcttctaatcaagacatcatcagaattctaaggaaggccaaatcattcaacacgctaattcgcttgctcaaaaccacccaaattatcaaccaagtcaatgcacaacttgtgaccacaaaatctggaggaggtttaaccattctagcacctgatgatggtgccttctcacaactcaaagcaggttacttcaactctctcggcgatcgccaacagaaagcattgatacagttccacgttcttccagtttatgtctcaagctctaactttgactctcttagcaatccagtgatgacactggccagtgatagccccaatgggtatcaaataaatgtgacagcttatgggaacagtgtgaatatttcaactggggtggtaaatgccactctcacaggcattgtgtacactgataagacacttgccatatatcacgtggacaaggtgcttattcctttagatttctcaaagcctaggcctccagctcctgctcccacgttggcaaaggcacctaaagctgataaggataactcatcagcagatgatgatgatcagggagagttaaacaaggccacttctgctgcaaattccatcaatttaattagcattcgtggaacaatgttggtgtcccttggtgttgctttagtcgcagcagtaacattctccatatga

SEQ ID NO: 3450 - DNA, 1136 bp, Glycine max
  Peptide Sequence Number=SeqID_95135
catttgaatctggacaaaggtttcacctttgggtgagtgattcaacaccagctatagctgggggagtgaaggaagctcagggcaattctagttccctgccacctttcctcaccaagacttatgagatggtggatgatccttccactaattctattgtttcatggagtgccaccaataggagtttcattgtttggaacccaccagagttttcaagggatttgttacccaaatactttaagcacaacaacttttccagtttcatcaggcagctcaacacttatggctttagaaagattgatcctgaacaatgggaatttgcaaatgatgattttgtaagaggccagccacatcttttgaagaatatccataggcgcaaacctgttcatagccattctttgcagaatatccagggtcaagggtcttctttgctgactgaatccgaaaggcggagttttaaagatgagatagagaagcttaaacatgaaaaagaaagacttcttcgggagttagagaggcatgaacaggagtggaaaatgtacgagaaacctgggatagccttgaatctcttactgctgacagaaaacatggatagaaaaaggaggttgccaagaagtggtctctttagtgatgacgctggcattgaagatcatatggaaacttccccagtattaccaagggaaaatgcagatggttcctctattttctcatcgagcacagagcgattggatctgctcgagtcatccatgacgttttgggaggatattacacatgatgttggtgacatctttgttcaaagtcatttaaacctggattttgatgcatctacaagttgtgcagatagtccagctatatcttgtgtgcaactagaagttgaagatcagcctaagtcacctggaatcaacatgaattctgagccatctgtagttgctgttcctgatcttgatgcatcaaaagaacaaccagtgggaaaagcccctgtgactactggtgttaatgacatattctgggaacgattcttgacagagaatcctggttcatctgaaatgcaggaagcacagtctgaaagaaaggattctgatggcagaagtaatgccaaattttggtggaacattaggaatggtggtacccaatattga

SEQ ID NO: 3451 - DNA, 867 bp, Glycine max
  Peptide Sequence Number=SeqID_95136
atggtatcaaaggtgaagagaagcccagtgaagtccatcaaggacctccgcaacaacaacaaccgtcgctggcgacggaaaacccccataaaaaatgtggtggcggcttcctccgccgcgctggccaccatccgccgccgtatcacgaaactcttctcgaagatcgcgcgcctcagcaccagcgcccacaagaaaaaagcaacctcctacaaaatcctcaaaaagactacaacaaccgacggagaactcgacaacattcgccgaaccctcgtgttcgacgacaccaccgccaccaccaccaccccgctcctccctccgttgttctccgtccgaaaaacggtgttcctcgacctcgacgaaacgctcgtccactcgcacccctcgccgccgccggagcgcttcgacttcgtcgtccggccggtcatcgacggcgagcccatggatttctacgtcctgaagcgccccggcgtcgacgagttcctcgagtccctcgccgccaagtacgaggttgtcgttttcaccgcggcgcttaaggagtacgcctccatggtcctggaccggctcgaccggaaccggttcatctcgcaccggctctaccgcgactcgtgccgaaacattgacgggaagctcgtgaaggaccttaacgaaacgggtcgcgacctcaaacgggtcgttatcgtcgacgataacccgaattcgttcgcgaaccaacccgagaacgcgattctgataaggcccttcgtggacgatattctcgaccgggagctttggaaattgagaagcttttttaatgggtcggattgctgtgaatgtgatgatatgagggatgctgttaagcactacgtcactgtgcagcatcgacgttag

SEQ ID NO: 3452 - DNA, 852 bp, Glycine max
  Peptide Sequence Number=SeqID_95137
atgctgcacagtgacgtagtgcttaacagcatccctcatatcatcacattcacagcaatccgacccattaaaaaagcttctcaatttccaaagctcccggtcgagaatatcgtccacgaagggccttatcagaatcgcgttctcgggttggttcgcgaacgaattcgggttatcgtcgacgataacgacccgtttgaggtcgcgacccgtttcgttaaggtccttcacgagcttcccgtcaatgtttcggcacgagtcgcggtagagccggtgcgagatgaaccggttccggtcgagccggtccaggaccatggaggcgtactccttaagcgccgcggtgaaaacgacaacctcgtacttggcggcgagggactcgaggaactcgtcgacgccggggcgcttcaggacgtagaaatccatgggctcgccgtcgatgaccggccggacgacgaagtcgaagcgctccggcggcggcgaggggtgcgagtggacgagcgtttcgtcgaggtcgaggaacaccgtttttcggacggagaacaacggagggaggagcggggtggtggtggtggcggtggtgtcgtcgaacacgagggttcggcgaatgttgtcgagttctccgtcggttgttgtagtctttttgaggattttgtaggaggttgcttttttcttgtgggcgctggtgctgaggcgcgcgatcttcgagaagagtttcgtgatacggcggcggatggtggccagcgcggcggaggaagccgccaccacattttttatgggggttttccgtcgccagcgacggttgttgttgttgcggaggtccttgatggacttcactgggcttctcttcacctttga

SEQ ID NO: 3453 - DNA, 126 bp, Glycine max
  Peptide Sequence Number=SeqID_95138
atggagtggctgatggttgggtcatgcgagtcaattagtgatccagtgactcaattatccaatgatttgattaggtcgatcactggttcgatgcttaaaattatgaatggtagtgggatggaatag

SEQ ID NO: 3454 - DNA, 912 bp, Glycine max
  Peptide Sequence Number=SeqID_95139
atgaagagggagcgatgccaatggtgcgattggccaaacgggcaaatcgggattctaaggcctgcagcatcgccggccaagaagagaataacccattccagtgcatccattgataccaggagagggcgggtccgtccatatagaacgaggcaatgcgagggacatcgagtttcaggtggtggtgccgggcaacggggggcggagggagatggccgcgagacagtcgaagagggattcaatctgagagggcggcttgggtctgggaaagacgaaggacggcctcttcgagcttatcggtggtcgtctggcgggtatggtggtcgggcatggctgggaaaaaaaagcaggctggtctgttggcttgtcgtatccgtcatattcggaaaagtggataacgagggaaacaatgcatttcacttggcagccgaactaggagattataaaccttggctcattcctgacgaagcccttcaaatgcattgggaaatcaagtggtacctggacctcgttaggagtggtggagaatggctgaaaaaaactgctggatcctgctccttggtagcagcactgatagccactgtagccttttccacatccaccaccatccccggcaacttcaaagatgacacaggtgccccaacccttgaagacaggccagaattcaaagcctttgccattgcatctctcattgctcgttgctgttctgtcacctcactggtgctgttcctctcaatactcacatctcggtatcaagagcatgatttcgatagcagtcttcccaggaagctgatccttgggttgacatcgttgttcatgtccattatctccacgatggtttgtttctgtgctggccatttctttgtgctaaaggacaaactcaaatctgttgcatttcctgtgtatatgccgtga

SEQ ID NO: 3455 - DNA, 213 bp, Glycine max
  Peptide Sequence Number=SeqID_95140
atgtcaacccaaggatcagcttcctgggaagactgctatcgaaatcatgctcttgataccgagatggttggggcacctgtgtcatctttgaagttgccggggatggtggtggatgtggaaaaggctacagtggctatcagtgctgctaccaaggagcaggatccagcagtttttttcagccattctccaccactcctaacgaggtccttgtga

SEQ ID NO: 3456 - DNA, 450 bp, Glycine max
  Peptide Sequence Number=SeqID_95141
atggaaaagcccgaggttgtagatgtgaaagaggaagcagattttcagctggttgatgaaaataaagtggattggaaaggaagacgagctcttaaattcaaatatggggggatgtgtgcttctgtgctcatactagtgacatatgcatttactaatttcaatttggatgcagctatgattggtttcgagaatttgggaacattttcactagctgtgaactcggtgccatacttcagtgggataatgcattatagtataccagatgcagctaacatgctcaccaactacatgggaaccggttacatactcgccattccagtggctgttcttgctgacacatggattggcagatacagatctgttttaatttctggggtcttcgagtttgtggtaagctacaaaacttccctcctaattgtggtcaacatccaactaaactggcgctattga

SEQ ID NO: 3457 - DNA, 1128 bp, Glycine max
  Peptide Sequence Number=SeqID_95142
atgacttgtgaaaccaagacatggttggttatgcttcttttcttggttgctaactacatgatgcaacattgtgtccatggggtatcccaagttccttgccttttcatctttggggactctttatctgatagtggaaacaacaatgaacttccaacctctgcaaaatctaatttcagaccatatgggatcgactttccattaggaccaactggaagatttaccaatggcagaacagaaattgacataattactcaacttctgggatttgagaaattcattccaccctttgcaaacactagtggttcaaacatacttaaaggtgttaactatgcatcaggtggagctggaatacgcattgaaaccggctcggacatgggtgctactatcagcttgggattacagttagcaaatcacagagtcatagtttctgaaattgctacgaaacttggaagtcctgacttagctcgacaataccttgaaaagtgcttgtattatttgaacacaggcaacaatgattacatgggcaactacttccgtccccagctctacccagcaagccgcatttatagccttgagcagtatgcacaagctctgattgaagagttatctctgaatttgcaggctttacatgaccttggagcgagaaagtatgtgttggctgggttgggccttataggatgcacaccagctgtgatgcattctcatgggacaaatggatcttgtgttgaagagcataatgctgctacatacgattataataacaagcttaaagctctagtggatcagttcaataacaggttctctgctaattccaaattcatccttatacacaatggatcaaacgcccttgacattgcacatgggtttttggtttcggatgctgcttgctgcccatcagggtgtaatcccaaccaaaagccgtgcaataataggagtgactatgtgttttgggatgaagttcatcccaccgaggcatggaacctagttaatgcaatatcagcttataattctaccattgatccagcctttacttatccaatgaatatcaagcaacttgtagactgtgaagttaagagggaattggagttcaggaatgaatccacttcacagctcagtgccactgaataa

SEQ ID NO: 3458 - DNA, 561 bp, Glycine max
  Peptide Sequence Number=SeqID_95143
atggcagaggttgtggcaggcacagagtctgaagacaacatgagcatgagcctccaggatttgttgggctctcatagtcatggaggaagaagggtaaagagaaagagcgtagtggaagaacccctcgttgtcgataaggtcactcttcagaaacagagaaggatgatcaaaaacagagaatctgccgctaggtccagggaacgcaagcaggcatacacagttgagctagaatctttggttacacatctggaggaagagaatgccgtattgttacaactagcggctgataggaaaaggctgaggttgaaccagctcatggagtgccttattccagttgaggagaagcgtataccaaaacgaatgcttcggagagtgaattcatcccaatggatatcacttggagttacattgctgtatagagaaataatgcagctaaataattcaactaatttgattcaagctgaagcttattattggttcactaggtggaggataggtctatattgggggaagagagttgaaattagaatgtatgttaatgctagattgtctgctttttga

SEQ ID NO: 3459 - DNA, 369 bp, Glycine max
  Peptide Sequence Number=SeqID_95144
atggagaaccatcacagttcacagttgtttcaagagcctattctcttcaatgatagcattcgtgtcaacatagcttatagtaaagagggaggtgccacagaggaagagataattattgcagcagcacaagaagccaatggacacaagttcataagttctcttccacatggttatgacacctctgttggagaacgaggcacacaattgtcaggaggacaaaagcagcgcataaccattgcaaccattgcacttgatgcagaatcagagtgtgtggttcaagaggctctagatagagtgagtgtgaagttgatgaagattgatggtggagtttatgcttcattggtagctctccatattagtgaatcatag

SEQ ID NO: 3460 - DNA, 1251 bp, Glycine max
  Peptide Sequence Number=SeqID_95145
atgtcattccgcagcatagttcgtgatgtaagggatagtttcgggagcttatctaggcgtagttttgatgtcagacttactgggcatcatagaggaaaatctcaaggatcagtgcaggatttgcatgaccaacctctagtaattcaaaatagccgttgggccagcttacccccggaattactatttgatatcattagacggctagaggagagtgagaatacatggcctgctcgaaagcatgttgttgcatgtgctgcagtttgccagtcttggaggaatatgtgcaaggacatcgttaagagcccagagttttgtggcaaacttacattccctgtgtccttgaagcagttatttttagatgttgaccagatgaaagtacaagtgatctttgcactagctggggctttgttagttgaaaatggaaaattcctcctttctgctaagaggacaaggagaacaacttacactgagtacgttatttccatggatgctgacaacatctctagatcaagtaacacttacattggaaagctgagatcaaattttcttggtacaaagttcattatatacgatacacagcctccatactcttctgcccatatatgccctcctgggactgggaagacgagccgcagattttattccaaaaaggtctcgcctaaggtcccatctgggagttacaacatagctcaggtaacatatgaattaaatgtgcttgggactcgaggaccaagaaagatgcactgcgttatgcattcaataccagcttcagcactagatgcaggtggcactgttcctggccagccagagcttcttccccgttccctggaggactcgtttcggagcatctcgttttcaaagtctctagatcattctattgagttcagcagttcgcgattttctgagattggggaatcctgcatcgaagatgatgatggcaagatgagacccttggttctgaaaaacaagcctccaagatggcatgaacagttacaatgttggtgccttaatttccgtggacgagtaacagttgcgtctgttaaaaactttcagttgattgctgccacccaaccagctgctggtgcacctacaccatctcaaccagctccaccggagcacgataagatcattcttcagtttggcaaagttgggaaggacatgttcaccatggattatcggtaccctttatctgcattccaagcttttgcaatatgcttgagcagctttgacaccaaattggcttgtgaataa

SEQ ID NO: 3461 - DNA, 1004 bp, Glycine max
  Peptide Sequence Number=SeqID_95146
atggatatgtgtaacgtagtgcatgcattaaaaccagttatgctaatggtgctggtgcaggttgcaaatgcttgggtcaatgttctctacaagctcgcgcttaacgatggcatgaacttgagtgtcattgttgcttaccgttatgtttttgcaactgctttcattgctccacttgctttcattcttgaaaggttcttcttctgctcatggttttacgttacggaagacgaggacaaagatgacttggaggatactgtttcaggcatttctttgcggcttaattgggtaagtaatgtgttctttattgatatgctcctccatggagtattgcctcaaaacttaaacatggaagcgattgctttaacttcagtaacgtttacaaccgccatatccaacctcattccagccatcacttttatcatatccctctccttcggattggagagattaaatttaaaaacaaaaggagggaaagcaaagataattggaacgataactggaattagtggggcaatgatactgacatttattaaaggcccagaagttaagatgttgtctttccatgtaaaccttttcaaccaccaaaacggccatgtcgtacattcacacgcttcttcaggccttatgaccatatttggtgctctcgcctctgtcgcaagcaacgtctcttatgccatgtggcttatcattcaggcaaagatgagtgaaagatacccgtgtccttattcgagcacagcgttgatgtccctaatgggggcactcttatccatttcatttgctttttgtgttgaaagggatttgagtcagtggaggttggattggaatgtcagactattgactgtggcttatgcgggtatagtagtttctggagtgatggtagccgtgatttcgtggtgtgtacgcacgagaggtccactgtttgtctccgtttttagccctctaatgcttgtcgttgtggcctttgctggatccactattttggacgagaaactataccttggaag

SEQ ID NO: 3462 - DNA, 1533 bp, Glycine max
  Peptide Sequence Number=SeqID_95147
atggaaaatctccataaccatcggggaattactaattctaactcttgtcctccacgtggctttacagatattttcagaagagagttaggtttgtctcatcccaacagtttcgcgcgtcgcttttcagcttccgaggtccttgtgaagagcttggatttatatgggaagttggatggtcacgaagggtgtgtgaatgcagtggagtttaactccactggtgaccttctggtctcaggttctgatgaccgacaagttatgttttggaattgggcatccaaaactagattgtttgcatacccttctggccacacagacaacatattccagacaaagattattccattcaccgatgactgccgaattgtaacttctgccggtgatggccagctaaatatatttattatgctaaaagaacatcagatggaggggttgactctagcagaatggactagtctcatagaacatggtgaatcaagatttgaatccctaccaggacaggtaaggcttggccttctctgggaggatggtagagttgacactacaatgttggggaagcaccatggttgtgtatacaagcttgctgtggagcctggaagtgcccacatattttacagttctggtgaagatggatttattcaacattttgatttgcgaagtaattctgctacgaaacttttctgttgttcctcgtcaataggaaacaataaacagactctaagcaaagtagggttgaattccattgtgattgaccctagaaatccatattactttgctatcggtggatctgatgaatatgcacgtgtttatgacattagaaaatgccagtggggttcagcaagaaattcagatcgacctgttaacacattttgcccttgtcacttaattggttcaaataatgtccatatcactggattggcttactcaagctttagtgaactccttgtttcttataatgatgagctcatctatctgtttgaaaagaatgtgcactcagattcctcaccttcatctgctacatctgaggatccgaagaatattcatgaggcccaagtttactcaggccacagaaatgcacagacaattaaaggagtgaatttttttggcccaaatgatgaatacatcatgagcggttctgattgtggccatatattcatctggaagaagaaggaagctaagctggtgagattaatggtaggtgatcaacatgttgtaaatcaacttgaggcccatccacatatacctattctcgctacttgtggtatagaaaaaaatgtgaaaatctgggctcctctagggaatgatatacctccacttcctgcgaatgtgaaagagataatggagacaaacagacagggcagagaagaccgatcacggaggcggcagacattggcgtatattgaaagaagacataatagggcagatattgtaagtgatgaagaagatgcagagggctaccttttaggattctcagatggtgatgcctcttctgaagaggattctcctggaaattccagagattgcaacattagctag

SEQ ID NO: 3463 - DNA, 807 bp, Glycine max
  Peptide Sequence Number=SeqID_95148
atggattgtggtggttttgttcttgagtgtccaaagaagaatttggaacatgggttgagtccttgttcatatagagcactggcaaaagtggaagagaagcagataaaggaagggattatagagttagataggttcattggattcaaaccctcccctgattgcttagaattgagaggttggttgtatgttgcacttgaggactatgacagtgcaatgagagatattagggcactgctaaccattgaaccaaattacataacttcacatgggaagatcaaaggggaatacttgctccaacttctaaactatgaagttcagcaaaagtgtcaggctgattgctggatgcagttataccaacaatggtcgtgtgttgatgatattggttctttggctattatacatcagatgttagacaatgagcctggaaagagtgtgctacagtttcgtcagtctctactcccattgagattaaactatcaaaaggctgcaatgcacagtttgcggttgcccagaaaccattctagcccaatgcaagagaggctaatttatgaaggatggatcctatatgacactggctatcgtgaagaagcagtggcgcgggctgacagatccattgcgattcagagatcatttgaagctttctttctaaaagcatatgtgttggcagatacaactctggatcctgaatcttcttcccatgttattcagcttctaaaagaagcacttaaatgtcctgcagatggtcttcgaaaaggacagacattgtccaattacaaaatgctgaaagtagtaaaagataaaacttaa

SEQ ID NO: 3464 - DNA, 1554 bp, Glycine max
  Peptide Sequence Number=SeqID_95149
atggttggaagtgttgacgctttgaatgagggtttgagaatcaacggagcagttgaaccgttgcctgaggactttgatgcaacagctgtaatcatagatcccgtgccttctgcagttgtagacaatggcattctgaaggaggaggcgcagatcaataaaggaaaagaaaaaagagaaatagtactgggaagaaatgttcataccacatgtctagaagtcacagagcccgaggcagatgacgagatcactggggaccgggaagctcatatggcaagtgtgttggccagatacaaaagagccttgactgaaaggacaaagcaccatttaggctacccctataatttggatttcgattatggtgcactcacgcaacttcagcacttttccataaacaaccttggagatccatttattgaaagcaactatggtgtccactcccggcagtttgaagttggtgttttggattggtttgcccgattgtgggaactggagaaaaatgagtactggggctatataacaaactgtggtacagaaggcaatctccatggcatcctagttgggagagaggtctttccagatgggattttgtatgcctcacgggagtcacattattctgtgtttaaagctgctcgaatgtatagaatggaatgtgagaaggttgatactctttggtctggggaaattgattgtgatgatttcaaggccaagcttcttagtcaccaggataagccagcaattataaatgtgaacataggcaagtttcttcatcattgtttctctctctcccatcccatgtctcccctcctcttcactttgttgattctggctcatccaactgagacaattgcaggtacaactgtgaaaggggctgtggatgatcttgatctggtcataaagaaacttgaagaagctggattttcacatgacagattctacatccattgtgatggggctttgtttggtctcatgatgcctttcgtgaaactagctccaaaagttacttttaagaagcctattggcagtgttagtgtttctggccacaaatttgtagggtgtcccatgccttgtggtgtgcagataacaagattggagtatgtaaatgctcttgccagggatgtggaataccttgcttctagggatgccacgatcatgggtagtcggaatggccatgctcccatattcctttggtataccttgaatcggaaaggatatagaggttttcagaaagaagtacagaaatgcttgcgaaatgcccactacttcaaaggccgccttgttgaggctgggattggtgcaatgcttaatgaactgagcagcacggttgtgtttgagaggccacatgatgaggaatttatacgcaagtggcagttagcatgcaaagggaatatcgcacatgtggtggtgatgccaaacatcactattgagaagcttgatgattttctgaacgagcttctggacaagcgtgctacctggtttcaagatggaaaggatcaaccttactgtatatcatcagatgtaggtgaaaagaattgcctttgtgctttgcacaagtaa

SEQ ID NO: 3465 - DNA, 847 bp, Glycine max
  Peptide Sequence Number=SeqID_95150
atggcgctctttgttttgtctctcttattcttctcattcttaatggggagttccgagagtcagcttcaagtaggtttctactccaacacatgtcctcaagttgactccattatccgtgccgttgttagagacgccgttctctctgaccccaatatggcggctgtcttactcagacttcattttcacgattgctttgctcagggatgtgatggttcaattctgattgagaatggtccacaatcggagagacatgcatttggacatcagggggttagagggtttgaagtgatagaaagagcaaaggcacaattggaaggctcttgccccggcttggtttcttgtgcagacatagtggctttggcagccagagacgctgtagtcatggcaaatgggccagcatatcaagttccaacagggaggagagatgggttggtttccaatctttcgcttgcagatgacatgccagatgttagtgattcgattgagctactcaagaccaagtttctcaacaaaggtctcacagtgaaagaccttgttcttcttagtgacccagcaattagacaaaacttcctccctcggctaaaggcaaggtgccctcagaatggagatgttaatattcgcctagctattgatgaagggagtgagcagaaatttgacataaacattttgaagaacataagggaaggttttgctgtgctagaatctgatgccagactcaatgatgacatagccaccaagaatgtcattgactcctacgtttctcccttcagtccaatgtttgggccttcttttgaagctgattttgttgagtcagttgtgaaaatgggccaaattggtgtcaagacag

SEQ ID NO: 3466 - DNA, 2116 bp, Glycine max
  Peptide Sequence Number=SeqID_95151
tggtagtggtggttgtgacaacaatgatggttgcggtagtggcgacgatgacattaatggtggtggtggttatggtggtagtaatgtcagtggcgacgacattggtgatgattgtggtgatgctgacggtggtggtgataatgatgatgatagtgaaagtaacattgatggtagtcataacaatgttgataataatgatgatgtcagtgacgatgatggtggtgatggtgatggcgatgatgaagttgatatcggtgatggtggcggcgttgacaatgaggatggtgatggtgcaagtttggaagaaaatctaggtagagaaagcatggctccaagctctaaattcagaagagcccttggggcagtgaaggatcaaacaagcataagcctagcgaaggtgggaagcagcacctcagttgctgaccttgatgtggcgattgtgaaggcaacaaggcacgatgaatacccagcagaagagaagcacataagggaaattctgagcctaacatgttactctcgagcattcatcagtgcatgtgttaataccctcacaaggcgtctcaacaagacaaagagctggacagtggctttgaaaacacttgttttgattcaaaggttgctattagaaggtgatcctgcctatgagcaggaaattttcttttcaactcgacgcgggactcgccttctcaacatgtctgattttcgtgacaactcaaaatctgattcttgggacttctctgcatttgtgcgaacatatgcattgtatctagacgaaaggcttgagtacaagatgcaaagccggcgtggaatgcgcagcatgtatggtttagatgaagatgaggaggaaagggaaagagaaaaggaaatcattgtgagatccacaccagtgcgtgacatgaagttagaccaaatcttttccaaaatgcagcatttgcaattgctgcttgagcgctttttagcttgccgccccacaggaggtgcaaagaaccatcgaattgtgatagtggctctctacccgattgtgaaggagagttttaggatatattatgatatatcagaaatacttagtatcttaattgatcgcttccctgacatggaagtgtcagactgtgttaaggtgtatgacattttctgccgtgttggaaagcagtttgatgagctagacctcttttttggatggtccaagagcattggaattgcacgctcttctgagtaccctgagattgaaagggtcacacttaagaagttagaggtcatggaagagtttatcaaggacaagtccgccttagcacaaagcaacaaacttgaagcaatagaatataagacccaagaagaagaagtagcttacgaaccggaaccggaaccagaaccggaagaggatgttaatgcaaccaatgcactaccaccaccaccagaggaaatcaacgaggaagcggttgaagaagtgaaggaggagccaaaggaaggaaaagttgtgcagacagagggagatttgttgaatttaggcgatgatatgatgacaagtgaagaacatggggagaaactagcattggctttgtttgatggagcagtaccagaagcagcaacaggtgccacacaagcacttccgtggcacgcatttgatgaaggagcagcagattgggaaacaacactggtgcaatcagcaaccaacttgtccaaccaaaagccaacatatggtggtggctttgatacattgttgttggatggcatgtataaacaaggagaagtgaatgcagccatgcaaggacaagggtacggggtgagtggaagtgctagtagtgtggcacttggttcagctggaagaccttcaatgcttgcactgccagctccaccaacatcaaggagtggtagtgattctattagttcagatccatttgcagcttcattggctgtggcacctccttcttacgtgcaaatgtcagagatggagaagaaacagaggtttttggttgaagaacagatgatgtggcagcaatatgcaaaggatggcatgcaaggacaagcagcacttgcaaaattacactctaacaacaacaataataacaattcttacacaggaggttatccacaaaactatggcaactattatcgttaa

SEQ ID NO: 3467 - DNA, 159 bp, Glycine max
  Peptide Sequence Number=SeqID_95152
atggccaatcaccccgcaagacaatctgtaaaggctgtagagttttcatctagaaataataaatcaaacatggaagcatccttgattttcacaaggcatctagcatgggattatcacatcacacataaggagagagaaatggacgaagcttttttatag

SEQ ID NO: 3468 - DNA, 198 bp, Glycine max
  Peptide Sequence Number=SeqID_95153
atgtataaactgcgatattcgttggatagccgcagttttggtggcacgtgttcggtatacacattttctatcttctcgacagacccacctctcgccgacaacccaaatctcctcgcccatatcatgcctcccactcccgcctccactctccatacagctttcctattggatcgtatcagcaaggaggaaataacgtaa

SEQ ID NO: 3469 - DNA, 2226 bp, Glycine max
  Peptide Sequence Number=SeqID_95154
atggttattttggcagaacattccgatggtagttttgtgttccggttcgccagtgctaatgagattagagaacaattagatgaattgaacaaaaagaaaaaatcagatgcattgaacaaaaagaaaaagaaactcgctcgtgagggtgttttggaagaaggcaaagctggtgttcgagctttggtgagtgaaagtgttaaaaaattgaacactgaggttgatcgtactttagggggtgaaattgagtcttcttcaactgtagtagttgatgttgctgatcaaaaccctcagcttctcttgaatgaaaaggagggtgatgttcttgatagtgattctgggccaccagtgaccaatgatttgcaaaagatcgatagacatttgaagttggattcagtggaggatggcgatggtcaacgtggaatttcaagtgaagatgttggtactgagagtaatggtgtcccgagtgcgtctgaggcggattcagaacttgatagtcaccgagaagctgtagtttcaactgttgctactgaggctgatgtggtttctgatctgaagagtgacgcttttgcagaagttgaagaggaagaagaaggtgatgctaacattgaagttgctcatctctctacagctggcaagagttatggtgtagatagaacgacaaacaacctggctgctgctgttgatgctgagttaagtgaattggtgccggaatccacttttttagattctgaacaagttggtgacagtgcatcaaacaaccagactgatgctgtgaatgctgaatcaagtgaattggttccagaatccacttgtttagagtctgaacaagttagttatagtgcaacaaacaaccagactgatgctgtggatgcagaattaagtgaattggtgccagaatccacttctttagagtctgaacaagctggttatagtgaaacaaacaacctgactgatggtgttgatgccaacttaagtgatttgatgccagtatccacttctttagagtctgaacaagttggttatggtgcaacaaacaacctgattgctgctgtggatgccaacataagtgaattgttgccagaatccacttctgcagagtctgaacaagttggttatagtgaaacaaacaacatgactagtggtgttgatgctgacttaagtgaattgacgccagtatcctcttctttagagtctgaactagtagctaatgatgaagaaacagctcacctcattgtggatgacttcatcaatgcaagtaaaatgggaaagtcagaattgtcacttgacgaggttccatcctcaaatttggaaaacaacatagatgttgacaacaccgaaagaagtgattatgaaagcacatcacagcttactgtgccacagatactttcagctgaggtggctagtcatggggaaaaaacttcaaaaacggagcttttcctaatttctggtgctgcatgcttgcctcatccctctaaggtaccttccatacttcaatatcatgactcattctgctcagttaatagggatgaaaatgaagcatatgataagccaactaataacaagtttcaggcattgacaggtcgagaggatgcttatttcatttctcaccaaaactggctagctgtggctgatggagttggtcagtggtcacttgaagggagcaatgctggactgtatatcagggaactcattgaaaaatgtgaaaatattgtgtcaaattatgaaaacaattcaacgatagaacctgcagaagttatcaccagaggtgctgctgaaacacaatctccaggatcatgttctattttggttactaattttgatggacaggtccttcatgcagccaatgtggggaacactggatttatcattataagagatggttccatctttaaaaaatcaactccaatgtttcatgaattcaactttccattacagatagttaaaggagatgatccctcagaactcattgagggatacacaatggatctacatgatggtgatgtgatagtaactgccacaaatggcctcttcgacaatctctatgagcaagaaatagcatcaattatatcaaaatcattagaagctagcttgacacctcaggaaatagcagaattcctggcgacaagggcacaagaggttggaagatcaacatccatgagaagtccttttgctgatgcagcccaagctgttggctatgtgggattcattggtggcaagcttgatgat

SEQ ID NO: 3470 - DNA, 993 bp, Glycine max
  Peptide Sequence Number=SeqID_95155
atgggagcgcagttggggcctaggaccaacataatgttgccatcgggcaagctcagaagaaagagagttgtcgttctagaaagagaatcaagaggtgcatctcaaagacagggcattgaagacgtgtgcgctggtgcccttagcaaagaaaagggccaaccaagaaagtattcacccgatggctacattgcgttgggcctaggtctcacccacactccagcttcttccagtgaacatctcgccaagaagcatcgcggtcgccctcgactccggaaagaagtagatggacacactcagaattgtttcaccccttcccatgttcgtgacagtgggggtgtgggtgagggttggttggtgatattggcatttgtgatagtggtgggtggtgacagagtagtcaaaggtggtggaggagtcgccggaggcggcaaagagggagggagactcgggaggagctctgtaacagagtacatttttattgtggaaaattgtccgtgcaacaatcacactggcgtatatcaatttaagagaggtttactaagaagtaagagcaaagatgcaaaattaagtttagaagaggttgttccttcttatagtttcaaacgagctactattctgagaataaatccagcattggcagcatcggaggaacaaaacgtggtgagcgacgtcgttttcctcgacaagggatgggatctggggttggggaatttgacaagtggaaatttgggttgcaatgaaatggctttggctttggctttggatgaaagagaaatgggagaaaccaatgtgttggagaaagctgaggctgccattgggtttcaagcgttaacgttaaaagcaaagcaaggcgacagaaacaatgaagttgaagttaaaaaggctgcaaagtgcaagttcactgttgggttgttggaccataaaaagtacaacactcactgggtgtcgggcattgctaacacccctagtaaaattgctgctgctacaccttga

SEQ ID NO: 3471 - DNA, 1763 bp, Glycine max
  Peptide Sequence Number=SeqID_95156
tgagagacgatgtggaactggaggaggagctagaaatgttgctggatgagatccctcacgccacatcgcacaatctccttcgctatcatcatcatcatcggcatggtcatggtgatgacgatggcggcgctttcgtaacgaaacagacacaatatggtcatggtcatggccatggaatgtattatgatgatgacttcaaatcccctataagtgggttttttctgcaatctgacggttcttcttcgagtttgttctcgtcatcgcctcctccttttgaggacctcaaatccagcgtggcttctagaagctcctattaccccaacaccaccaccaccaacaacaacagcaacctcttcttcgatcctaagatccctgattccactgtcaagctcaatgaggctgagaggttggttcatgaactaagcctctgcgccaatttcagcaaaatgcacgttgctgataataataataataataataacaatagacgccacaatcccaatgtgcttacgtttcgtgattttgtcaatcatgttcacaacacgcgacgaggtggggactgtaccgattttgagagagggttttgtgattctgtggggtttcaatccccgtttaccaggacaaggagtcctatcgctcctgctgctgagattaattcagctttgtcaggattaactcaggatcataaaatacctaatttatttggatcatcgctgcagccatgtaccggatggcgtgaacatgatagtatggtctctcaattgaatggattcagtgctggttcaatggattctctgaggtgcggaagccagctgatgaacgactaccattttaggggaggcatggcaccggagcttgttggttccttgagcaggagtccggcgtttgattcttcattttatgcgcagaaatatctaatgaatttattggaagaaaggggggggtcaagattgcctaacaattctttctgtggtaattttaagccttgtgtgagtgttcaggagttgctgcagtatggcctttttcagcctaatcctaatgcaagaggtgtgccactttcaaatgctaggatcccccaaggtaatctagatgctattacaagtgaggggagtttcattatacaaggggaaggtttaaattatgtaggggttagtaggggttcggatcattcatggtgtcagcgtgctgtgctcgaaagtggctttgctaagcagctaccgaggtcggagctagacatccaacaccagattaccggatatgaaaatcctaggagtccaaggaacgcttgctcattccctttgctacccaattataattccctagcagaagctcaagggttgatatatttaatagccaaagaccagcatggctgtagattcctgcaaagaatatttgatgagggtacaccggaagatgttcaagtgatatttaatgagatcattgatcatgtcgtggaacttatgatgaatccttttggaaattacctaatgcagaagctgttggatgtctgtgatgaaaaccagagaatgcaaatgatactcatggtgaccgaggagccagggcagcttgtcagaatctctttaaacactcacggcactcgcgtggtacaaaaggtgattgagactcttaaaactaggcagcaaatttcattagttgtagcagctcttgaaccaggattcttggccctcatcaaagatcttaatggaaatcatgtggttcagcattgtttgcaatgcctaagcaatgaagataacaaagtatga

SEQ ID NO: 3472 - DNA, 285 bp, Glycine max
  Peptide Sequence Number=SeqID_95157
atggagatagttgagttaaaagtggaaatggttggaatacacgagaaaagactaaggaaatgcctcgcaaaattgaaaggttggtttgggatagagaaggtggaagtggattgtaacagccagaaggttgtagtgacgggatacgcacacaagaacaaaatcctaaaagcattgagaaaagctggtctcaaggctcatttctggtcttctaaaaatgacttgcttaatgcttatctcagtgctagttatgccaacctcaaatttaacaacttcagcatcttctag

SEQ ID NO: 3473 - DNA, 2901 bp, Glycine max
  Peptide Sequence Number=SeqID_95158
atggtggtcatatctcttggtattagagttggtctgggttcaaatctcaggtttgaaatgtttccaaatcatctcaagggtaacaaaaatattgttgtaaataatgaaggtgatgaagtcccaacagattcccaaaaggtaacttctccatcgtctagccttcccacacatcatagctgtgtttcttcactgagtacagattccgtgagcccaacaaccagtttgatgtctttacatgaagatgctgattctgaggatatccaccatgcaagttctgggttgcacccattacatgagtcacaacatagtgggaatagtccattgacggaaaagattggtgctggtgataatgaacagtcatcaatttctggaacggattatatccctgttgttcatggggataaatttagaggaaatgatactgcttatactgatggtcagaaaccgcatggcatggcaccatggggcactgtcttgcaaagcactgccaaattgcacaatgatccttctcttgcatcatttccttccatcctacctagttcaatgggagacgtccttgaacaagaacataccatttttggtgaccttttaatgagcaaaagtggtctcactgaggaagcagagagttctcagtctctccaatcaaattggcagattccttttgaagacaattcaggaggcatgccaatgttaacccaaacccaatcatttggtctgcaatttagatctgattatggcaccggtttactagggaacgaaactcgtaatgcaagttctgaaattgctccgatcctgtacagttttcatggtgaaccaaaagagcagcctatgcagcaaaactatccacaagagcttgaagatggacaatctcaacatgcactaaaatccaattctgcaaataaagttcctgatgaagaaactatcaactatggcttaacagtgaagagcacattattggacagagacgagagcctgaagaaggttgatagcttctctcggtggattactaaggaacttggagaggtggctgatttgaatatgcagtcctcacctggtatttcatggagtacagatgaatgccagcatgtgatagatgatacctcattgagcccatctctctctcaagaccaactgtttagtataaatgatttttcacctaaatgggcttatgctgagtctgaaattgaggtgttgattattggatcatttttgaagagtcaaccagaggtgacaacctgtaactggtcctgtatgtttggggaagttgaggttcctgctgaggtcttagctgatggaattttgtgctgtcaagctccttgtcataaggttggacgggtccctttctatgtaacatgttccaataggttagcttgtagtgaagtgcgggaattcgatttcagagagggctttgctagaaatgtagattttgcagatttttatatcagttcaactgaaatgctgcgtcatttgagactggaggattttctttctttaaagccagtggacccttcaaatcattcttttgagggtgatatggagaaaagaaacttaatttttaagctcatttcactgagagaggaggaggactattcaattaaggatgaagttactagagaattggatatatcccaacacatggtgaaggagcatctgtttcacaggcagtttaaagagaagctgtactcatggcttcttcacaaagtaactgagaatggtaaagggccaaatgtattagatgaggatgggcaaggtgttctacatttagcagcttttcttggttatgattgggccataaatccaattatatctgctggagttaatatcaacttccgagatgtgaatggatggacagctcttcattgggctgcatcctgtggcagagagcggacagttgctgtccttgtctccatgggtgcagattgtggagcactgacagatccatctcccgcatttccatctggtagaacagctgcagatcttgcctctagctatgggcacaaaggaatttctggttttcttgctgagtcttcattaactcaccacctcgaaaccctcacaatggatgatcaaaaaggtggtcagcaagaaatttcaggaatgaaggtggtgcagacagtttcagaacgatctgcaacacctgtgcactattgtgatatcccagatgccatctgcctcaaggattcacttactgctgtgcgtaatgcaacacaagctgctgatcgtatacatcaagtatacagaatgcagtcatttcagaggaagcagttaactcagtatgaaggtgatgatgagcttggattgtcagatcagcaagctctttctctgctagcttccagggcatgcaaatctggacaaggggatggtttagccaatgctgctgcagtacagatacagaaaaagtttcgtggttggaagaagagaaaagaattcttgatgattcgtcaaagagttgttaaaatccaggcccatgttagaggtcaccagataaggaaacagtataaaccaatcatatggtctgtgggaatcctggagaaggtcatattacgttggaggcgcaagggtagcggtttacgtggatttcgaccaaatgccattaataaagtccccaatcaacaaaatgattctctgaaagaggatgattatgattatctcaaggagggacggaaacaaaaggaagaaaagatccaaaaggccctatcaagggtgaagtccatggttcagtatccagaggcacgtgctcaataccggcgtctgctaaatgttgttgaggacttccgtcaaaccaaggcatctaacaagggtttgatcaattctgaagagacagttgatggtgtggaggatttgattgatattgatatgcttttagacgatgataatttcattcctatagcatttgattga

SEQ ID NO: 3474 - DNA, 1944 bp, Glycine max
  Peptide Sequence Number=SeqID_95159
atggaagcatcattgaagttggagtcccttgcgtgcatagactccaccactctctctcactcagagctcctcgctctttctctctcctctctatgctccacccatgatctcctcactcccaatatcgaccccgctctcttcaaccagagcaccggctccctccgccagacctactccctcccccactcctcccctaccgcccgccgccgccgccgcctcgccggcctcctcccttcccccaagctccctcccctccccgcccacgaccccgaaaacgccgagaaccgcctcatcatcgactacctcaaacagttcatcagagacgaccccaatttcgaccaagtcgaactcgctcccccttccctcccccaaccgagaatccagaggaagcgtggcagaaatcccaaagtcaaagtccacttggatgactgctaccgcggcatcgacattgttaaccaaaacggcgtctctgtcgatctccaactgttggccaactcccaagaccccttcgccgaggaactcaagagacgcaccgagggtttgcacaacgaagaggagctgttagggtttctgagggacttgccgggccagtgggggagccggaggaagaagcgcaggatcgtcgactctgcggatttcggcgacgtcttgccgcttagctggaagattctcctcggtttgaagagaaaggatggtcgcgcatggatctattgccgcagatacattagccccagtggacagcattttgtgtcttgcaaagaggtttcttcctatctgcagtctcttttgggtaatggtgatgcacagttgcaaattagtcggaggactgaaaatgtagtgcaagaacacaaattgtctgccgataattctgcagctgttaccaaggagcatcaagatgagatgcagattgttgctgtgaacatggctgtgtctggtttgtctgctgctaatgagcgagtgaaggaggttgccttgttggggattgaaaatcttgcggatgtgcagattcatgacctgttggaatgtcgcaagtgcaacatgagcttcaatgagaaggatttgtacttgcagcacctgttgtcctttcaccagaggacgacaaggcggtaccggcttggttcgtctgttggagatggagttataattaaggatggcaagtttgagtgccagttctgtcataaggtgtttcttgaaaggcgtcgctacaatggtcatgtggggatccatgttaggaattatgtgaggaaagttgaagattcaccgggtcagccaaatgtccaggggacagacgacaagtctccagatactgtcactgaaccccatagttcagctaaactgaataggattcctggttcagatgctgttggttacttagatcaagatggaaactctgagtctccagtcagtgaacagcaaatggaagatagcatgactggaaaaaatgtggatcatgatttggatgaaaaagtagaggaaattgacgatgataaccatgcgattgatgtaaaagatgatgtgccattgactattgaggaactggatcagtctgggatggatttggatgacaattctcaaaactgcatcagtaacaagagtgagttggaatttagtttaaatggcttgaaggatgtacctgttactgttagcactaatgtccaagagatgggaggaaaacagttttgcagtgttgatcatgaacatgataatgtcaaggggttccaggaattgagatttgatgaaatagatattgttgagtatgattttttcctgataaatcagcttacaactgtgtgtgtatggtgtggaatagagtttgaccatgatgctgttaattctgaaatacaaccagattctgttggattcatgtgtccagcttctaaggcaaaaatctctggtcaagtcaatgtgttggactgtggatccccgaatgctggctgtctatag

SEQ ID NO: 3475 - DNA, 2598 bp, Glycine max
  Peptide Sequence Number=SeqID_95160
atgagctataacgaggagagaaaaccgcacgctgtgttgactccatatccagttcaaggccatgtgaaccctttgttaaaactagcgaagctgcttcacctgagaggcttttacataacctttgttcacactgagtacaactacaaacgcttgctcaaatcaaggggtcctaatgcccttgatggcctaccagattttagatttgtgagcatcccagatggccttcctcccttggatgatgctaatgttactcagcacgtaccctctctctgtgactctatcagaaagaacttcctcaaaccctattgcaaccttgtgcgttcacttaaccactctgccactgagcatgggggtaccatacccccagttacttgcttggtctctgacggttgcatgccctttactatacaagctgctcaacaacttggactccctaaccttatcttttggcctgctagtgcctgttcattcttgtctatcatcaactttcccactctagttgagaaaggtctcacaccactcaaagatgagagttatatgagaaatgggtatttgaactcaaaagtggactggattcctggaatgaagaacttccggctgaaggacatacctgacttcataaggacaacggatctaaatgatgtgatgttgcaatttttcattgaagttgcaaataaagttcagagaaactccactattcttttcaacacttttgacgaacttgagggtgatgttatgaatgctctatcttccatgttcccttctctttatccaattggtcctttccctttacttttaaatcaaagtccacaaagccacttggcatctttaggttccaatctttggaaggaagatccagagtgtcttgaatggcttgaatccaaggaatctggatccgttgtttatgtgaattttggcagcatcacagttatgtctgcagaacaactcttggagtttgcttggggtttggccaacagcaagaaaccctttttgtggatcattaggcctgaccttgtcattggtggatccgtgattttgtcatctgagtttgtgaatgaaacaagagacagaagcctaatagcaagttggtgtccacaagagcaagtgctgaaccatccttcaatttgtggattcttgactcattgtggatggaactcaactactgaaagtgtttgtgctggagtgccaatgttgtgttggccattttttgcagatcagccaacaaactgtagatatatctgcaatgaatgggagattgggattcaaattgatacaaatgtgaaaagagaggaggtggagaagctggtgagtgaattgatggtaggagagaagggaaagaagatgagagaaaagaccatggggttaaagaagaaggcagaggaggccaccaggcccagtgggtgttcatacatgaacttggacaaagtaattaagaagacctgggacgagctattgggtggtctccacaaacgatgcatgggttatccgccaaacattttaacgatagacgggggtcctaatgcccttgatggcctgccaaactttcgatttgagaccatcccagatggtcttcctcccttggatgatgatgataatggtgatgttactcagcacataccatcactttgtgactctatcagaaagaactttctccaaccctttcgcgaccttcttgctagactgaaccattctgccactgaaggtctcatccccccagttacttgcttagtttctgacggtggcatgacctttactatagaagctgctcatgaacttggagtacctaacgttctcttttggcctgctagtgcgtgttgtttcttgtccatcatcaactttcccgctctggttgagaaaggtctcacaccactcaaagttgcaaataaagttcagagaaactccactattcttttcaacacttttgacgaacttgagggtgatgttatgattgctctatcttctatgttcccttctctttatccaattggtcctttccctttacttttaaatcaaagtccacaaaaccacttggcatctttaggttccaatctttggaaggaagatccagagtgtcttgaatggcttgaatccaaggaatctggatccgttgtttatgtgaattttggcagcatcacagttatgtctgcagaacaactcttggagtttgcttggggtttggccaacagcgagaagccctttttgtggatcatcaggcctgaccttgtcattggagtactgaaccatccttcaatttgtggattcttgactcattgtggatggaactcaactactgaaagtgtttgtgctggagttccaatgtggtgttggccatttaatggtgatcagccaaagaactgtaaatatatttgcagtgagtggggaattgggattgaaatcgataccaatgtgaagagagaagaggtggagaagctggtgaatgagttgatggtgggggagaagggaaagaagatgagagaaaagaccatggagttgaagaagaaggcagaggaggccaccaggccccgtggtaattcgtatatgaacttggacaaagtaagtaaggaggtgttgcttaattgggcaacattagaatattag

SEQ ID NO: 3476 - DNA, 1575 bp, Glycine max
  Peptide Sequence Number=SeqID_95161
atggccatgggattgacctcacaactcctcctttctttgttcatcagtacccttcttcttcttcttccctcttccctttcacaatctaaccagttttgtgacgctggaacttcatccaagctgttgatcaagggcggcaccgttgtgaatgctcaccaccaacaggttgccgatgtctatgtcgaagatggtatcattgttgccatcaatcccactattacggttggagatgaggtgacggtcatagatgccactggcaagtttgtcatgccagggggcattgaccctcacacccacctagagtttgagtttatggatacggaaactgtagatgacttcttcagtggtcaggctgcagcattagctggtgggacaacaatgcacattgactttgttataccacataaaggaagtttaacggctggttttgaagcctatgaaaagaaggcaaagaagtcttgcatggattatggtttccatatggctattaccaaatgggatgaaactgtgtcaagagaaatggagctcatggtcaaggagaaaggcatcaactcttttaagtttttcatggcatacaaaggagctcttatgatcaatgatgagcttcttctggaaggatttaaaaagtgcaagtctcttggtgccttagctatggtccatgcagaaaatggagatgctgtgtacgaaggtcaggaaaaaatgatagaacttggaataactggtcctgagggacatgctctttcacggcctgcagtgttggaaggagaggcaactgcccgtgctattcgtttagctgattttgtgaacactcctttatatgtggttcatgtaatgagcattgatgcaatggaagaaattgctaaggcccggaaatcaggacaaagggtaattggagagcccgttgcctctgggttagcccttgatgaatcttggctttggcatcctgactttgagactgctgcaaagtatgtcatgagtccccctattaggaaacgaggacatgataaggcccttcaagctgccctttcaacaggagttttgcagctggtaggaactgatcattgtgcctttaattccacccagaaagctcttggaattgatgacttccggaaaattcctaatggtgtcaatggtattgaagaaaggatgcatttggtatgggatatcatggtggaatctggccaaatatctgtcactgactatgtccggttgacaagcactgaatgtgctagaatcttcaatatatatccaaggaaaggagctattcttccaggatctgatgcagatattatcatcctcaatccaaattcaacctttgagataactgcaaagtcccaccactccaaactggacacaaatgtctatgagggaaggagtggaaagggaaaaatcgaagtgactattgcaggaggaagagttgtttgggaaaataatgaactgaaggttgctcctggtactggcagatatataaaaatgccaccctttagttatctgtttaacggaattgacaaaaaggatgccttttatctaaattccctccaagccccagtaaagcgagccaaatctaacacttaa

SEQ ID NO: 3477 - DNA, 1158 bp, Glycine max
  Peptide Sequence Number=SeqID_95162
atgggtctgcatcatcacagaaagttgatgccattgccagaaatctgcgggtcaatttgccatgtgaagaagtctgagctttgttcatcagattgcaaagtttgcctcaagatctgcctaaccaattattctcctccaacgctaccaccacaagttcctccttttcaatcatatgatgatggtgcagcagatcaagcatacaaccacaaaatctccacctatttgttccttgcacttgctcttctaactgctgctttctttgtcgtttgttgtcgtgccatctataccaggtttagctcaaggaggagggtatcatcaacatcaaggcgccaaaaccaaacacaccatgatgatgatgattttgttgatgaagagaatggccctatggtggaccaccccatatggtatatccgcacccttggccttcagcaatcgattatcaatgccatcacagtttgtaagtataagaaaggagagggcttgattgaaggaacggattgtgctgtttgcttgagtgagtttcaagaggacgagaatctcagacttttgccaaaatgtcaccatgcttttcatcttccttgtatcgatacctggcttaggtctcataccaattgtcctatgtgccgggctccaattgttgctgaccttgcaactgcaaggatggagtctagttttgttgattcaagttccttggaaaacagccacatggaagttttggaaaatagtgctcctgattctgaattgatgaataatagggcagaggaggaagaaggccaattggaagttgaagatggagtgagggtttgtgaaactgaaaccccagttgaagatgtggcaagcactcttcctagaagttcggtttctctggattctttttcttttgcaaatttcaatcttgctcttgcaacagtagagtctaatggtaactcaaaaagagtgctgggaggtgtggatgatgatcctactgcttcaaagggggttattggaaacgatttggcaactagttccaaaggtagctcctctttcaggttagcgagatatctgcagggtgttcctagttcttcagtgaaaaggtcacagtcctttaatgggaaataccttctatcctggtatggctgcagtcagaagaagccaaatgctcctctgagaagcttttga

SEQ ID NO: 3478 - DNA, 3522 bp, Glycine max
  Peptide Sequence Number=SeqID_95163
atggagaaggagaaggagaactgggagatgccaatggccacctttctcatagaccaccattccgaccagctccgctccatctcttcttctccggatcccaaccttcacttccctcttttcatcgattacgctgagttgatggaggataatcctcgcattgcacgtctcctctttgcccaacccaaaacctacttgccagtattcgatgatgctgccctttgggcccataaaatcgtattgcgagaaatgccggatgacaagaagggggttgagaaaaaattcattcatgttcgtattaacatcagtggctcaccccttgaatgccctgaaacttttccaagcatagggcgtgttcgagtgcaccaccgtggaattcttctcactctcaaggggatagttatcaggtcaggagcaatcaagatgcatgaaggggagaggaagtatatttgccaaaaatgcaaaaacagcttcccagtttatcccgaggtggaagctcgaaactccatatcactaccttcaatttgcccaattcagcagtccaagccctgtggtggcacaaaattccagtatgaagagaatactatagtatgccatgattatcaggagataaagattcaagaaagtacacaggtgctaggtgttggggcaattcctcgttcaattcttgtcatcttaaaggatgaccttgtggatgttgttaaagctggagatgatgtgattgtcactggtctcttaacagcaaaatggtctccagagttgaaagatgtgcgctgtgaccttgatcctgtattaattgccaacaatataaggagaatcaatgaactgaagtcagaaattgatatttctgatgatatggttaagaaattcgagcagttttgggttcacttcaaagattcacctctaaaaggtgggaggaatgctattctacgagcaatttgcccacaagtatttggccttttcactgtcaagctggctgttgcattaacacttatcggaggtgtgcaacatgttgatgcttctggaactagggtaagaggggagtcccacttactcttggttggtgatcctggtatgcaatccattgctttaactatttctactgccgccactggcaccggaaaatctcagtttcttaaatttgctgcaaaattgagcaaccgttctgttattaccactgggttgggaagcacaagtgcaggattgactgttactgcagtgaaggatggaggccaatttgtggaatctttaggggaatggatgttagaagctggggctcttgttttagcagatggaggcttgtgttgcattgatgaatttgatagacctggactagatctacatttgattggttatacttgtgcattaccaggaagcttggataaccttaagttggttgaggcactagatgctttcatgaaacttgacagttcatatttaatggaaattctggcaggactttatatttttattttgcatcctggcattgggtatgtaactaaacattattttggcagtatgagggaacatgatagagcaactatacatgaagccatggagcagcagacaataagtgttgccaaggctggtcttgtaacaacactaagcactagaacaactgtatttggcgccacaaatcccaaaggacagtatgatcctgatcaactattacttcagttcaattactattgcttcagttcaatacttgttagacttaacccaaggtttgatattgtccttgttctcttggatacaaaaaatcctgattgggatgcagtagtttcatctcatattctttctgaggcagaactggatagaaccaccaatgatgaagatctggtaaacagctggccacttcctacactcaagaggaggtacaacaataaaccaagaggacgtcataatttgacaacgcagaagaagcaagagattaaggaagcctttgagttatttgatactgatggctcaggtactattgatgccaaggagctgaatgttgctatgagggcccttggatttgagatgacagaagagcaaatcaatcaaatgatagcagatgtggacaaggatggaagtggagcaattgattatgaagaatttgagtacatgatgacagccaaaataggagaaagggacactaaagaggagctcatgaaagctttccatattattgatcatgataaaaatggaaagatatccgcattagacatcaagcgcattgcaaaagagctaggtcaaaatttcactgacagagagattcaggagatggttgaggaagcagaccaagataaaattcccaatctggcacacattttggctattcgaagaggaaaagaacctggtcggtcgttagaaatggttgatggaaacctcaagcaagagtttttgccctacgacgttataatcaacattctcaaaagacttcctgtgaaatccctcatccgattcaaatgcgtctccaaagattggttcaacctcttccaaaacacccctaattttttcacccaacaacaccttaaccactccgctcacactaacgcctttctcctcctccaacgaatccctcgccaaccccgtcccctccccttctccacctgtctcatcggacccgacatcaactttgtccatcccccccaattcttcgacatcgcatcacccgccgccaaaattgtcgcctcctgcaacggcatcttgtgtctccgagacaagaccgcgctttccctcttcaaccccgcctccagacagatcaaacaggtgcccggcacaaccctcttcggtttatactacgttggattcggtttcagccccgtcgctaatgattacaagatcgttagaatctccatgggcgtgttcgacgaggagcatcaggtcgtggttctcgacaacgttagggttgatcgagcggaagtgtattcgttgaccaccgggtcttggaggcaaattgatgccaccaagttgcgacctttgtgtctcgtctctagttccgtcgctaccactgaaaccatattttggcttgcaaccatgacttctgactctgacactgactctgaaattgtggtttcgtttgacattggaagggaaatgtttacgctgttgaatggccctccgcttccaccttcgcccactcgttcctatgacaatgtgcttgcggagtgtaacgataagcttgccgtgtttcgccactacattattggggactatgagtcttgttcttttgatttgtgggtcttggaagatgttcataatcatacatcttctggggagagttggattaagatgtatagtgtggggccattttcgagggttttgtatccattaagtatttggagagatctaattgtgtgcagggaagagttgtctagacgtggcaacaattacagaatagtggaaactgttctgtcgctcttcaatcctttgagtaatgaattgaagaaactgccagctaatagagatgagttttgttatgtgcccttcacttatgttgagagtcttgttccagttggccacattcaccatgaacagtag

SEQ ID NO: 3479 - DNA, 138 bp, Glycine max
  Peptide Sequence Number=SeqID_95164
atggcagacaagacttgtgagctgaggaagttgaatggggaagagctgctaggattaaaaattcgggaattacaaaagctagagaaactaataaggaaagttgaaggagatctccttggtcaatgtttattggaatga

SEQ ID NO: 3480 - DNA, 1485 bp, Glycine max
  Peptide Sequence Number=SeqID_95165
atggaggtcgaaaggatgagacagttgatgctgatgtggtgtagaatacgaagcaaccgtgtcgctcttgtgggtggaaaccataccgctgccagcacgatgaagaataagcatttgcacgatggaagaacaattgctgctctcaaccccgaaagtttcctcgttatcaggattcccgatgcgcttgttttgcgcattctgtctcgctcattgttcgtggccatggttcttgctgccttgcctttcttgggaactgttctcaaaggattctatttctcttccagttttgttcccaatgtcgaaactgcagccgcatctgggtctctcgatgtgggactattgaattcgattctacatgatttcgctcatgagggtctcctcagagagaacgataaggcactcgttctgaactctccccttcctaatgtcttcagggaaaagattgatgttgtcatggattctgattgggaaagtaagagcttgtttgctgatgtgtcttatgattttgtgttcacctctggtgatattgatgctgagtttattgatcgcattctgaaaattgatggcattgtggctctcccgttggggtctaaaccgtctaattctgctttcaaagaacaaaataattatagagttgtttcccttaagcgatatggaactgctgttgttgttgcattgaagaaaactgggccagccgttaggttggtagattctgattcttcgccaaagaggaagcttttggcgacaaagacagaggccaagagtgtggcattgaagggtcttgaagatgttctcttggagcctccgagaaaggctttggttaaatcaaggaagtacttgaacaagatcaagtatttacctgacttggtgggtgattctcttgaaggttacaaaagaagagtcttcattggtgtaggattgcctgaggagaacaagggtgtgatgcaatggtttaaggagaactatcccaagaagaatactaagtttgagactcacagcgtcgcggttgtgccggaagaccatttcgccgtttctgcttggttgtctaagaatgtgaaggaggaagagtacgttgtgatgaaggcagaagcaggggtggtggaggagatgatgaagacgaggacaataaggttggtggatgaactcttcttagagtgtaagaatgagtggtggcagagggggaagacaatgaagaagaacgaaagaacttattgggagtgcttggctttgtatggaagggtgagggatgaaggagttgcgggtggaagtgtgcgaattaagggtgaaggcaacctatactctggccagtctgttactggtgggaatggaggaaaaatcacgcgaggaggagaattgttcatattgggcaatgtgggtgccagaagttttctactggcttggacattgccaatggataaaagtgacaaagcaatgaagaaaaatgataggagaagcacacggaaggaggccattttagtagtatga

SEQ ID NO: 3481 - DNA, 1998 bp, Glycine max
  Peptide Sequence Number=SeqID_95166
atgggaagcaactttctctctccaccagctaagcgctccgcacccgacccgtatccgtttcatccaaacggaccttcaaagcgctccaggcaatccaagcctccgcctccgctgtccgtgccgcccggccacgtggccttccgcctcctctgcaacgcctcccgaatcggcggcgtaatcggcaagtccggctccgtcatcaaaactctccagcaatccacgggcgccaagatccgaatcgaggatgcgccacaggagttgccggaccgcatcatcctggtaattgctgacgccgcactcagcggcaagattctgctgagaaacgaagaggtcattgaggtgtcgaaggcgcaggaagcgctgctgaaggtgttcgataggatcctcgaagtggcggcggagaccgaaggcgtcgacgttggggacagggtgatgtcttgccggctcgtggcggacgcggcgcaggccggctctgtcatcggcaagggagggaaggtggtggagaggatcaagaaggaaaccgggtgtaaaattagggtattaactgatgatttgccactttgtgcctccgcttccgatgaaatcattgaggtatttttgcttcctgctcttcttcgctttagcatttgtcattcaacatttagaatattgcttcgtgatgtcagatgtcagaaaacatacttggatattttagaagttgaaaagatagaaggcagagtgtcatccgtaaagaaggcacttgttgcggtctcccaacgtcttcaagattgtcatcctgttgatagaacaaagatgatggggagcaaaccttatgaaatagttcagtatgaagctttagatgcacttcctcgtgcaacttcaactgcagctccacgtgtgactttaactgcagctccgcgtgggactttaactgctgtacaacatgagactgtagatcatcttttgctgaggagctctgcactgtctactttatccagttcctctaacagctatgccaccagaattcattcactgccaacagaagttaatagagtctcatccttggaaccaaaagcacttaagcaggaagtcaccttcagaatactttgttcaaatgatagagttggaggagttattggaaagggaggcaatattgttagagctcttcagagtgagacaggggctacaataagtattggtcctgcagtagctgagtgcgaggatcgattaattactattgctgcttcagagaatcctgagtcaagatattcccctgcacaaaaggctgctgtgcttgttttctccaggtccattgaggttggttttgagaaggggctagactctggattaaataaggggtcaattgttactgtacgtcttgtagtcccatcaagccaagttggttgtttgataggaaaaggtggagtaatagtttcagaaatgcgaaaggcaactggggctaacataagaataattgggactgatcaggtgccaaaatgtgcatcagataatgatcaagtcgtacagatatcaggagagttttcaagtgtgcaagatgcattatataatgcaatgggtagactgcgagataatctttttgtcagcacacagaatagtgctggaacaaggagcctttcttctctacgagttgataccagtccctatgggagacagcaggatgttgttcctcttggaagtcaactgcccccagccacttctcatagtctgagtagacatacttttgctcaaggcattgatcatcttggtctttctagaaatttagatcatccttcttcaccagggttatggactagaaatttagaccgtccttcttcaccagggttatggactagaaatttagatcgtccttcttcaccggggttatggactagaaatttagatcgtccttcttcaccggggttatggactagaaatttagatcgtccttcttcaccagggttatgggcgccaccagtatatctctctctctgtgctggtcaactttaccttgacaagtga

SEQ ID NO: 3482 - DNA, 2859 bp, Glycine max
  Peptide Sequence Number=SeqID_95167
atggacaatgtgtatactgagttggactctgccaaagcagaagtggagaaactcaaggctgaatgccgactcaaaacacaacttttcgacggtttgaagagagatcgtgccgaagaatttctcaaatttcaagaaactaagaagctggctgaggtacaggcacgtgagctcgatctcaagtctgaggagatccatgaactgaagaaaattctagaagatctcaagtctagtttgcacgaaaaggaagcacacgttgcacatttgagttcggagaataaaaagatccaagcaagttctactgataggttgctcgaattggagggaagtaatagagagctggtgttggctttagttgaagtgagagcaacaaatggttctctggagcagaatgcttgtgccagcagtaacgaaatttcgagccttaaggaactcttgttggctgcagagaaaaagtgttcagatgcagaggaaaaagcacagcaagctacaatgctgaaacgaagagatgacgtgattctgcaactggaggaagagaatatcagcatgaaagataagattaaatggaggaatgaacagtttaaacatcttgaggaagctcatgaaaagcttcaagttgagttccgattgagcaaggaggagtggaacaaggagagatctttgttgcttgaggaaatgtcttccttgcaaattagcttggattctcaaacaagaaatgtggagggacttcagtcacgtttggagatgtgtaaccatgcattggctcatgaagagagcagaaggaaactcctggaggttgaattttctgaattcaagtctagctttgagaatgttttcactcaatatgaggaaaagaagtcagagatacaactattgacaattctgagaaatgacaaaatagcacagatgagaaactcactaggagagaaagagatggtggtgagagaactggaacgtaaaattgttcaacttgaacaagataataaggaattgggagatttacttaaagaactcagggaagctcagatcaataatggtggagcaaattcagtgacatcaaagctccgcaacaagcttagacggttggaagaggtgcataaaaactgcgcctcaattctcaagtctaaagaatctcaacggggtgatcaagtggcaaagatggaagcagatattgttacttataagtctacactgaccaacaaagaacaagaaataagggagcttgagatggaattggaaaattgttattatgccattgaagagaatcgcttgggactcttgatctttaaatctgaacttgctgaggcttactccaaatcattcaggggcagggcagaccctgataaagcatttgatatcaaagagaatgaagacatggttctaatttctgcagagcaattgagagtgaaagacaagtctctaaaaactatggcacaagctgcacaacaacactctctgttggaggaagagcttaaacaacaaaagaaaaagctcgaggaatcatctgagggtcaactaatcttggaagagcaactgctgcagatggaatacaccctacaatatgaaagaagtgcggcatttgaggctctagaagtgctggaacatgaaatagccagtaaaaatgatgaaatatctcgattagattgtgaagtacaggtttggaagtctactgctgaaacccttaaagtttcttatgaagaaattcagggaacaagtaaaaagatgaaagcttcccttctatcacatattgagactgagcaagcccttaagcaggccaatgaaaaccttctctgtattgtcaaggatcaggaaagaaaaaccgaagatcttctactgcagattggtttattggaaaggtgcaatgcagagaaaatgaaggaagcagaaagatgtaagcaagagaatgagggtcttattcaaatagtagaggagagggaatgctgcataaaggatcttcataaagatatagccatcagctgcttgaagcaagaatccatggaaaaagaattagaagatgcaattcatgcccagctggatgcagagaaagccctcaagcaggagaaagaaattcttttgaagattaaagatgtgaaagatcgaactattgagcaccttcaggggctagctacagcatcagagcaagatttgttaggtgcgctgtgtttttctttctcaaaacaagtggaaaagtggattgaggtcagtgtgcttagggacgcgttgaaaaatgcagaatacctggcaaagctagaaattgaagaaaagaacacgagaatagtgaaatcagaagaatcaatcttccatttaaaacaagaagcagagcagcttcaagcgtcactggaagccttgaagtttgaaaatgaaaaattgacggataaacagcaggccatggaattcatgataacggagctcaagtttgagaacggaaatttactgcaagacatcatgaacctatcgacagaaagggaagatatgctggtacattttgaagtcatctttggcagaattggagagttgtctagtggggatatgcaattgatggagatgttggggaatgtgttgaatacttctgaagatgaaaatgaaatagcaatgggttcagtagtttgtgacaagccacatgagtctgctagagatagaatgtgtaatcttgctgatggaaacgccagaaaggtacaggttcagaataatatcctcttcacattggcatgtttaattgtttatgacattaaatgcacaggtttagctttgcatttgggttgcagtgacacgttacaagactcattaaacggacaacgtagaagacagctcagtgatgcatttgtgaaactcgattttggaggctcacaaccggatgcttaa

SEQ ID NO: 3483 - DNA, 546 bp, Glycine max
  Peptide Sequence Number=SeqID_95168
atgggggaagaacttatgggtttgggtattaaagaactacaaagtctggaaaaccaactggagatgagtttaaagggtgtccgcatgaaaaaggaccaaattttaactaatgagatcgaagaactacgccaaaagggaaatctcattcatcaagaaaatgttgaactctatcaaaagatggagcagatccaaaaagaaaatgcagagctacagaagaaggtttatgaagcaaggagtacaaatgaagaaaatgtggcatccaatccttcttataaggtcagaaatggatatgatttacatgcacctattagtctccaactaagtcagccacagcctcaatacagtgaaccatcagccaaagcaataaaactcgggtatccactcaaactgatatatcaagcctggaagtgcttttgtaaaaacatctgcaacttgatgttggctcttgacatggacaagcttgattactttggactgaacatattctcggatgaaatgatgatcaatgtcaatgtgcttggatcgttcatgatgagcaagggttga

SEQ ID NO: 3484 - DNA, 1299 bp, Glycine max
  Peptide Sequence Number=SeqID_95169
atggcaaattctcatttatcaacaccttctgagctattttcaagacaacataagccccctagggttccaaatcttattgggggcagttttctggactcaaaatcgttaactttcattgatgttatcaaccctgcaacacaagaggttgtttcacaagttccttgcaccacagatgaagagtttaaagctgcggtatctgcagcaaagaaggcatttccatcatggcgaaaaactccaatcacaaaacgccaacgtgttatgttgaagttccaggagcttatacgcagagatatggataaacttgccctgaatgtgaccactgaacaaggaaagacgttaaaggatgcacaaggagatgttttccgtggtttaggttggtctttctatggaattgatacttacagcattagagaaccacttggtgtatgtgctggtatttgtccattcaattttcctgcaatgattcccttgtggatgttcccagtggcagttacatgtggcaacacctttattctaaaaccatcagagaaagttccaggtgcctctgtaatgcttgcagaattggcaatggaagctggtttgcctgagggtgtcttaaatatagttcatggaacccatgatattgtgaatgctatttgtgacgatgatgacatcaaagccatatcttttgttggttcaaatgttgctggaatgcacatatatgctagagctgcagctaaagggaaacgtgttcaggctaatatgggggccaaaaatcatgcagttgtaatgcctgatgctagtgttgatgctactgtaaatgctttagttgctgcaggttttggtgctgctggacaaagggaaagtaaacttgtggagcatgccaaagctcttaaagtaaatgttggaactgaacctgatgcagaccttggtccagtcattagcaaacaggtcccaggatatgaatctggcaattttattggcccaaccatcttatcagatgtcaccgccaacatggagtgctacaaggaggagatctttggaccagttcttcttctcacggaggctgataacttggaagaggccataaacattatcaatgaaaacaagtatggaaacggtgcttctatatttaccacatctggtgtggctgcaaggaaatttcagaccgagattgaggcggggcaggaagtacacgcgctaagcgcagagtgtcacgctaagcgcgcctacgaaggcccaaagcccacttcagcagctataaatagagagtcagtccaagggacagaacacacaccaccacagaaccccctctcctag

SEQ ID NO: 3485 - DNA, 4173 bp, Glycine max
  Peptide Sequence Number=SeqID_95170
atgggtagtagcagtaagaaaaggagctccgctaccgaggaacaaaccctcgccgccgccgatgctcccaaaccgctcattaagaaaccgaagaacaccactaccgacgatgatagtcaacaacaacaacaaccttccgtcaagcccatggagaggaagaagaagcgtaaagccttggacaaagagaggcgccgaaccacatcccaacccgaacccgaacatgcagcttcggagcccaaacctgcgcctccgtccacggattcacctagctctagcggcggtgttatgccggagttccacattggagtgttcaaggacctcgcggcggcatccgagtcggcgagggaagccgccgcgaagcaaatggtgacggagttgaaggcggttcagaatgcttatgattcgcgcgaggagaaggagagtggtgagggtggattgaagttggaagcagagaaagacgatggattggataactgtgcttcgtctgtgagatacgctgttcgtaggctcattcgcggtgtttcttcatccagagagtgtgcacgacaaggttttgctttaggtttaactgttttagctggcacggttcataacattaaggttgattcattccttaaacttgtagtcaatttgctggaagtaacttcatcaatgaagggccaggaagcaaaagattgtctgttggggcgcttatttgcttatggtgctctggctcgatcaggaagactcacacaggagtggaatatggagaaaagcactccatacattagagaatttatcagtgtgcttatctctcttgcaaataaaaagcggtacttgcaagagcctgctgtctcaataattttagacttggttgaaaagattgtctacagccattgcttgtatcctggtacatctagttgtgagaatgattggattgctagtacattttctatgtcagatccctgtatgcatatgtccatgtgcatagatcctcataggcacctgcaaacaactacttgcatcattgaaagtgtctatgctatgagtggatcactttctcataggttacctgttgaagcattggtgaatcatgttcttgaagctcctgggctgcaggagtggtttgaagctgctatagaagtaggaaatcctgatgctttgctcctcgctttaaaagttagagaaaagatttctattgatagctctgtatttggtaaacttctgccaaatccattcagctctagccagcttttctctgctgatcacctgtcctccctgagtaattgcttgaaggaatcaactttttgtcagcctcgtgttcatagtgtctggccagttttgataaatattctgttaccaaatactattttgcaattagaagatgctgcatcagcttcaaactcattaaagaaacacaaaaagagtcgaaaatctagctcctctgatgaagaaattgcgaagaatcttcagaatttttgtgaaataattattgaaggttcccttctcatctcatctcatgaccgtaagcacttggcttttgatgttctgtttcttcttctccaaaagctgccggcatctttagttccagtggttctgtcaaacaaagttgttcagtgcctggtggatgtactatcgacaaaaaacacatggctgtttaaagtagcacagcattttctgaaacagctgtctgattgggtgggggacgatgatgtcagaagagtttctgttatagtggctatccagaagcacagcaatggaaaatttgatcgtataacacggacaaaacatgttaaagatttcatgtcacagttcaaaactgaacctggttgcatgcttttcattcagaacttaatgaacctctttgtggatgaaggtaatgcccttgaggaaccttcagatcagagtcaaactacagatgaaaattctgaaatagggtctattgaggataaggattctcctaggaccaatggaaattctgattttttgaagagttgggttatagaatcccttcccagtattttaaaattcttgaagctggatcatgaagagaagttcagagtacagaaagaaatcatgaagtttctggctgttcagggtctcttcactgcatcacttggctctgaggtgacttcgtttgagttacaggagaaattcaggtggccaaaatctcccacatcgaatgctctttgtaagatgtgtatagaccagctgcaattgttgttagcaaatgctcagaaaggggagggcagttgtcctttggccaacagcgttgagccaaatgatcttggttcatacttcatgaaattctttggcaccttatgcaacattccttcagtttccctcttccggtctttagatgatgtggatcaaaaggcagtaaaaaaattgcaggcaatggaaactagattatcgagagaggaaaggagccgtgactgtagcactgatgctaatagattgcatgcactgagatacttgcttatccagctgcttctgcaagtgcttcttcatccaggggagttctcagaagctgcatctgaactcgtcatttgctgtaagaaggccttttcaacttctgatcttcctgagtcctctggagaagatgatgtggaggttgatgatgcccctgaattgatggacgttcttgtggatacattactgtctctgcttccacagtcatcagctcctatgcggtcttccattgaacaggactggtcagatttcacatattctattaaaaatgaaaaagatgagttacctggatttaatggatggtatgaacatgctatccaaaaatggatgcaacctgtgacttacctggctatggtatttaaatatttttgtggtgatatcactaatgatggactgatgcggatgttgcgggtcattaagaaaaatttaaaacctgcaaggcatccagatgcagcaaatgcagatgatgatgatgatgaagatgatgactttatcgatattgaagaagaagaaattgatcaagctgagacaggtgaaacaggtgagagtgatgggcagacagatgactctgagtcagtagttgaggtggaggagactgatcatggccattccgaagcttctgatgattctgatagtgggatggatgatgatgcaatgttcaggattgatacatatcttgctcagatatttaaagagaagaaaaatcaagctggaggtgaaactgctcattcccagctagtgctgttcaaacttagaatcctttcgttgttggaaatcttccttcatgaaaatccaggcaattcaaaattgccatgcatagaacgtggagtcttacatatgactcttgaatttgcacaaatcgggagccaaaagaatggtaagcctcaggttcttatggtttactcaaatttggctcaggcttttgttaaccctcatacagcagaagttagtgagcagcttggacaacgtatatggggaatattacaaaagcaaatatttaaagcaaaggattatcccaggggtgatggagtccagttatccaatcttgaatctctgttggaaaaaagtttgaaactagcttcaaaaccattcaaaagacagaagtctgcatctaacctttcaaagcaatcagctgcctggaaccgacaaaaaatgatttcttcccttgcccaaacttcgaccttctggattttgaaaattattgattcaagaaattttgcagagtctgaactggagaggattgttctaattttccgtgaagtattggtggggtattttgacaagaagtctcaaatcaaatctggatttttgaaagaaataattcgaagacgaccatggattggacatgctatatttggctttattttagagagatgtggaagtgccaagtcagactttcgacgagtggaagcacttgaattggtaatggaaatattgaagtcactgtcaacagggaatagtgatgaacagaatgcatcgaaaaagattcttaagaacagtttggataaactttctcatctgttgaaagaattagtgactaatatgccaagtaaaccagcaaggcggacagaggtacagaagttttgtgttaaggccttggagattttgtctaagcttaacctcaccaagaattttgtgaaaactttggcacctgatactcaagctgcccttgaggcgcaacttggtgagcaattcattagtttgaagaagctggaaaaataa

SEQ ID NO: 3486 - DNA, 72 bp, Glycine max
  Peptide Sequence Number=SeqID_95171
atggagaacgaggaagccaaaaacacaaacggatctgccaaggaactatacaggggagagagtaatatttga

SEQ ID NO: 3487 - DNA, 2241 bp, Glycine max
  Peptide Sequence Number=SeqID_95172
atgagctctgatccagaaaagcgggtgacaagcgaggtggtggaagacgatgaactctctcccatcgaggaggttcgtctcaccgtaaccaacaccgacgacccgacccgaccggtatggaccttccgtatgtggttcctgggtcttctctcctgctccctcctctcctttctcaaccagttcttcgcttaccgcacggagcctctcatcatcacacaaatcacagttcaggtcgctactctccctatcggccacttcatggccgcgtttctgcccacaaccacgttcagcatccccggattcgggtccaagagcttctccttcaacccgggcccgtttaacatgaaggagcacgtgctcattaccatattcgccaatgccggaagcgcattcggatccgggtcaccctatgcggtgggtatcgttaacattatcaaagccttttacggacgcagcatctcctttgctgcttcttggcttctcatcattacaacgcaggtgctaggatatggatgggccgggttacttagaaaatacgtggtggaaccggcccatatgtggtggcccagtaccctcgtccaagtctcacttttccgagctttgcatgagaaagatgaccaccgactttcacgggcaaagttcttctttattgcactagtgtgcagtttttcgtggtatgttgtccctggatacttgttcacaacgctcacaaacatttcatgggtgtgttggatattctccaagtcagttacagctcagcagatagggtcaggcatgaggggccttggagttggtgccctcacacttgattgggctgccgtggcatcattcttgttcagccctctaatctcacccttctttgccattgtcaatgtttttgtgggctatgcattaattgtctacgtggtcattcctgtatcatactggggcctcaatgtgtacaatgccaataggtttcccattttctcctcacacttgttcaccgcccaaggtcaaaaatacaacatacctaagattgtagacaaccattttgagctaaatgttgcagagtatgaaaagcaaggtagaattcatctcagtgtgtttttcgctctcacttacggctttggatttgccaccatagcatccaccctcacacatgttgtctgcttctatggaagggagattatggagcggtatcgtgcttcttccaaaggcaaagaagatatccacacaaaattgatgagaagatacaaagacataccttcttggtggtttcattcattgctgctcgtgacacttctggtttctctcgcactatgtatctttctaaaggaccaggttcagatgccctggtggggacttctctttgctggagtgctagcttttggatttacccttcccattagcattatcactgccaccacaaaccagacaccaggattgaatatcatcactgagtatgtctttggtctcatttaccctggaagaccaatagcaaacgtatgtttcaaaacatatggttacattagcatggcgcaagctgtttctttcctcagtgatttcaaacttgggcattacatgaaaatccctccaaggtcaatgttcttagttcagttcataggtacaatgcttgctggaaccattaacattggggtagcatggtggttgctgaactctatcaagaacatatgtcatgacgatctccttccagaaggcagtccctggacatgcccgggtgaccgtgtattctttgatgcatcagttatttggggtctggtgggaccaaagcgtatctttggttctcaaggaaactacagtgcaatgaattggtttttccttggaggtgcagtaggacccataattgtttggctattgcacaaagcatttcccaaacagtcatggattccactaatcaacctcccagttctattgggagcaactggaatgatgccaccagcaacaccattgaactacaatgcctggattttcgttggaacgattttcaacttctttatcttccgttacagaaagaaatggtggcagaggtacaactatgttctgtcagcagcacttgatagtggggttgcttttatgactgtcttgctctacttcgcactgggtttggaaaacaagagtctaaattggtggggaaatgatggtgaacattgtccactggcagtttgcccaacagcaaagggcgtaatagttgacggagctggtcaagcagcctgttatctcttcgaagaagagaacacatga

SEQ ID NO: 3488 - DNA, 498 bp, Glycine max
  Peptide Sequence Number=SeqID_95173
atggcgatagggttccctggaacaggagagtatgacaagttctatgaagagggagtttacaactgtgctggttgtgggactccactctacagtcttgcagcaccttttattgatgacaatgccccagttacccaggtttgtttctttccgaaggatgatatcctcagcattcttcttgcatggcttgcaatattttacatgcatataccatcgggatatgcacttggctatgtctacggttgtttggttggaagtcatttgggttggcgttatgcattctgggtagagtctttgctgatgattccatttgctatttcaggactttttatgaagcctctgcaattgagaggtcttgttcctgctgattcaaaaaaggcactgacacctgagacagttgcgtcaggagttcaagttatggaggcttcaaatggaagagatgagtcactgtccttgaaggcagagcttagggataaaagctcaaatgatcattccaagtga

SEQ ID NO: 3489 - DNA, 1038 bp, Glycine max
  Peptide Sequence Number=SeqID_95174
atggagatttcatcaatcagagggctacctgaactggggataatagaggatcctaacttcctccatcagtggcagttaaactctattgatacaactagcttaaaaggtgctgcttttggagatattttgcaaaagcactcattctctgataactcaaacttcaaccccaaaacatccatggaaacatcacaaactggaattgaaagatatgcaaaacagctcggtgataacagctggaatcacaacaaaagtcaacaacagacaccagagacacaatttgcttcatgctcaaatcttctttcatttgttaatacgaattacacaagtgaattgggactagtgaagcctaaggtggagatggcgtgtcctaaaattgacaacaatgctcttgcagacatgttgatctctcaaggaaccttaggaaatcaaaactatattttcaaggctagccaagagaccaaaaagattaaaacacgtcctaaactttctcaacctcaagaccacataatagctgaaaggaagcgaagagagaagctcagccaacggttcattgctctatctgctcttgttccgggcctaaagaagatggacaaagcttcggttcttggagaagctataaagtatttgaagcaaatgcaagagaaagtgagtgctcttgaggaggaacagaacaggaagagaactgtggaatctgtggtaattgtgaagaaatctcagctatctagtgatgccgaagactcttcttcagagactggtggtacatttgtcgaggcactacctgaaattgaagcaagattttgggaaagaaatgtcctcataagaatacattgtgagaagaataaaggagtcatagagaaaacaatcagcgaaattgagaaactccatctaaaagtcatcaatagcagtgccttgacatttgggagtttcatcctggatataaccattattgctcaggtaatttctgcacctattccattggctgaaaccttagttcacacaaaccaagtccaatctatctatgtatctgtatcgaactaa

SEQ ID NO: 3490 - DNA, 213 bp, Glycine max
  Peptide Sequence Number=SeqID_95175
atgcagttcaactcttatcatcactttcaaagaaggcttccaatcaagttgagggtaagagatacaacgacacatgacgggaatgttggagttgttaaagggaaggctggcgtgccggcagtcgaagttggagaccttgaggttgtcagcgacatcgaggaggaggttttgcggcttgaggttgcagtgggaaacattgcggcagtgacataa

SEQ ID NO: 3491 - DNA, 390 bp, Glycine max
  Peptide Sequence Number=SeqID_95176
atggcgttctcatcctctctatggtcttccctctccgttgcgaacccaaacagaacttacttcaacaactccgacggcgacaaggaggtggtgagggagtacttcaacaacaccgacgaggttgggccacgccaagatggtagagaacacgctgagcatgttgaaggacgaaggttcccttcaaggcgttatgatttgcgacgctgggtgtggtaccggttctctcttcctctggccaaagagggcggagaggttttcgagctcgagcgcgatgttgtcgacgagctcggatctgggcggataagaagttgccacagaggtggaggtgaaggtggcaaaggaggggcatggcggggatggaaagaatactcccttgaagatagaatttga

SEQ ID NO: 3492 - DNA, 2445 bp, Glycine max
  Peptide Sequence Number=SeqID_95177
atggcggtggagtaccagtgttgtgaaactcagtttttcatacgcttattgataattttgctgcttgtgttgtttgctggattgatgtcagggctcactttaggactcatgtccttgagtcttgttgatcttgaggttctcgctaagtctggcacccctcagggtcgcaaacatgctgcgaagatattgcctgttgtcagaaatcaacatttgttgctttgcacccttctaatttgtaatgctgcagccatggaggcacttcctatctttcttgatggtcttgttgtggcatggggtgctgtcttgatttcagtaacattaattcttctgtttggtgagattataccacaatcaatttgttctcggtatggtttagcaattggtgcaacagtggctccatttgttcgggttcttgtatggatatgctttcctgttgcttatccaattagcaagttgttggattatttgctggggcatcgacatgaagcccttttccgcagagctgagttgaaaacacttgtaaatctgcatggcaacgaggctggaaaaggtggagaactgacacatgatgaaaccacaatcattgctggagcgcttgaactttctgagaagacagccagtgatgccatgacccccataactgaaatattttctgttgatattaatgcaaagcttgatagggatttgatgagtctaatattggagaaagggcatagcagagttcctgtctattacgagcagcctacaaatatttttggacttgtcctggcaaagaatttattgacaattgacccagaagaagaaatacccgtgaaaagtgtgaccatccgcaggattccaagggttccagaaacgttgccactttatgatattttgaatgagttccagaagggccatagccacatggctgttgttgtcagacattttgagaagacaaggcaacagtcttccaacaataatgccgatgtgagagatgtaaaggtagatattgatggggagaagactccccaagggaatattttgaagaccaagaggaaatggtcaaaaaatatgtactcgtatattctagaaatagatggaaattcacttccaagtttgcccgaaaaagaagaagctgttggaataattacaatgaaagatgtcattgaagagcttttacagtctaggtttttaaaactgttcgggtcatcgggtttcaacaaaatcagtaggtttggccggaccatcttgggtcacatgcataagcggtccaatagcgaaatcggtctgattatgccaccagattctgtggtttcaatgggggtggagtatacgtgctgtgacatggagttttacaaacgcatactaataattgtgctgcttgtgatgttcgctggattgatgtcagggctcactttaggactcatgtcattgagtatcgttgatcttgaggtccttgctaagtctggaacccctcaggatcgcaacaatgccgcaaagatattgcctgttgtcaggaatcaacatttattgctttgcaccctcctaatttgcaatgctatagccatggaggcacttccaatttttcttgatagtcttgttgtggcgtggggtgctatcctgatttcagtgaccttaattcttctgtttggtgagataataccccaatcaatttgttctcggtatggtttagcaattggtgcaacagtggctccagttgtccgtgttctggtatgggtatgttttcctgttgcatatccaatcagtaagttgttggactttttgttggggcatcgacataaagcacttttccacagagctgagttgaaaacactagtaaatctgcatggccatgaggctggaaaaggtggggaactgacacatcatgaaacaacaatcattgctggagcactggaacttgctgagaagacagccggtgatgccatgacccccataactgaagcattttgtattgacattaattctaagcttgacatgtatctgatgaatctgatattggagaatgggcatagcagggtccctgtcttttatgatcagcctacaaatattattggacttatcctgggccatagccacatggctattgttgtcaaacactgtgacaagacaggttatcaatcttccaataataatgcctatgcgagagatgtgaaggtggatattgatggtgagaagcctccccgagagaaaaatttgaaaaccaagatgtcatgccataaacgtaaaagctttccaaacgcaaacaacttaaacaagggtagtcctcagagcagaaaatggtcaaagaatatgtactcagatattttggaaatagatggaaattcaattccaaagctaccagaaaaagaagctgctgttggaataattactatggaggatgtcattgaagagcttttacagggagagatctttgatgagacggatcatgattttgaagtctcgtga

SEQ ID NO: 3493 - DNA, 537 bp, Glycine max
  Peptide Sequence Number=SeqID_95178
atgctcaagattcagcatgtggatgcacacaacgctgcacgatcagaggtgggtgttccagatttggcttgggatgactcggttgctgcttatgcagagaactatgctaatcaacgtaaaggtgactgtgcactgattcactctggtggtgaatacggggagaatattgcaatgagcactggtgaactaagtggcacagatgcagtgaaaatgtgggttgatgagaaagccaactatgaccacgattccaactcctgtgttggaggagagtgcctgcactacactcaggtcgtttggagagactcagtgcgtcttggatgtgccaaagtaacatgtgataatggaggcactttcatcacttgcaactatgaccccctcccaccaaaccagtctcagaaaaacgacgatcttgaatccgttcaccgttggatcgtcgtgaaatttgagtatcatgttcgcaacacaattccgagcattctcaccgttgggaatttcgatatcatgtctgaaatgagagaaaaacccttcgcattgtag

SEQ ID NO: 3494 - DNA, 528 bp, Glycine max
  Peptide Sequence Number=SeqID_95179
atgaccaaaaactatggcttccttatctgcatacttgtcattgtcttggatattgttgctggaatacttggaattgaggcagaaatagctcaaaacaaggagaagcacatgtgggtgtggatatttgagtgtaggtacccaagctatcaagctttcaagctaggattggcagctgccacattcttggcacttgctcatgtaattgctaacttgcttggcggatgcatttgtgtttggtctaaagaacaatacctatccgccacagcaaataggaaattagcagtggcttttctaattttctcgtgggtggtgttagccgttgcattgtccatgctcatgataggcacattagcaaactcaagatccagaaaatcttgtggcatgtttagccgtcatttcctatccataggaggcattctgtgtttcatccacggattgttcactgttccctattacgtttctgccacagctaccaaaagggatgaaaagaggcctgaaaatgccagccacacacttgatcatctctag

SEQ ID NO: 3495 - DNA, 789 bp, Glycine max
  Peptide Sequence Number=SeqID_95180
atggagacagggagacaagacagagcagtacaggttactaccaatggctaccaaggtttatattgtattattactcttataattctattgagtatttgtagattgatgaattgggtaggagtgtttggggagaagagggatttgggtttggcaagggcaattggtgaattccatcctacattttcccaaaatgaaaaaagttattattctacatatggacatgttgagaagctagctagagagatagaaaaaggggctgcttcggtggagggagtagaagcaaaactgtggcaggtacctgaaaccttgcctgaagaggtccttgctaagttgggagcacctccaaagagtgatgctccaattattactcccaatgagcttcctgaggctgatggttttttgtttggttttcccacgagatttggttctatggctgctcaatttaaagcatttttcgatgcaactggaggcctatggcgtacacagtcactagcaggaaagcctgcaggcttcttctatagcacaagttctcaaggaggtggtcaagaaactaccccgttgacatctattactcagcttgttcaccatggattgatctttgtccccattggctacacatttggtggtggcatgtttgagatggaaaaggtgaaaggtggctccccatatggtgcaggaacttatgctggagatggctcaaggcagcctagtgagttagaattggctcaagcttttcatcagggtaaatactttgccggcattgcaaaaaagctcaagggatctcaatga

SEQ ID NO: 3496 - DNA, 657 bp, Glycine max
  Peptide Sequence Number=SeqID_95181
atggagtatcaagatgaggatcatttatgttttactatggaagagtttgctcttgctactgaaaatgttagtagcaggcaaaggatgagtaggaagaggaactatgatgatgacacaagagtgtacaaatcaaagaaccttgagattgaaaggagaaggagggagaaactcagtacaaggcttttgatgctgcggtctataaaccctatcatcacaaatatgaatagaggaacaattattgtagatgctatcacctacattgagaagctgcaacacgaagtccagcgtctgagccaagagcttcaccaattggaagcaacttcagagaaaacagcagaggcaaaagtagatgaaattgatgctgtggaggatatgaagcattgggggatacaggctgaggtcagagtggcacagatagatgagaataaactctgggtcaagatcatcattgagaagaagaggggaagattcagcaaattaatggaggccctcaataattttggcattgagctaattgacaccaattttacaaccacaaaaggtgcatttctgattacaagctgcatacaggttaaggatggtgaaagacttgaaattcatcaaagcaagagtttgttgcaagagattatcaatgacatatcaagcaagtccgaatag

SEQ ID NO: 3497 - DNA, 1107 bp, Glycine max
  Peptide Sequence Number=SeqID_95182
atggcggctgaggctcagcttcctgaccacttcaagtgtccgatttccctgcaaatcatgtccgaccccgtcatcctctcttccggccacaccttcgaccgctcctccatccagcgctggctggacgccggccaccgcacttgcccaattaccaaactgcccctccctgcacactcctccctcatccccaaccacgccctccgaagcctaatctccaactacgcccccatcaaccctcaacaacaccaccacccccaaaccctaatctcctccctcacctctctctcctcccctctcccctccaaacttgacgcgctccaccacctcacgcgcctctctcactccgactccctcttccgccgccgcctcttcaattcccccgccctcgtccccgccctcttaacctgcctccaacacatctccgccgacctccgccatcgcgccctctccctcctcctccacctctccctcgacgacgacgccaaggtcggcctcgtcgccgagggcctcctctcccctctcatcactctactcctctccgccgccccctccgactgccgcgccctctccgccacccttctcaccagcctcgccgtcctccacgtcaacaaggccaccatcggagccttccccggctccatccacgccctcgtcacactcctccgggacggtaaaggcagagaaagaaaagaagccgccaccgcgctctacgccctctgctccttccccgacaaccgccgtagagcggtagagtgcagcgccgttcctgttctgcttcgaagcgccgattccgggcttgagaggagcgttgaggttattggggttttggcgaagtgtaaagaggggagggaacacatggaacggtttcgcgggtgtgtgcagattcttactcgcgtgttgaggaatggaagctccagaggagttcagtatgctcttatggctctctattctctctgttgtcacagtgaagaaactgttgtcgaggctttacgaaatggggttttggatatttgtcaaggcttggtcgaggatgataatgccaaggtcaagaggaattcgtcctgtttggttcagcttctccgtgggaacacccatcgcttgagttag

SEQ ID NO: 3498 - DNA, 609 bp, Glycine max
  Peptide Sequence Number=SeqID_95183
atgaatgaagtgactgtaattttaaaacttcaacaccgcaatctcgtaagactcctaggttgctgtattgaaggggaggaaaagatgttgatctttgagtacatgcccaataagagcttagatttctatctatttgatccagtcaaaaaggtagtcttagattggcaaaaacgacttaatgtaattgaaggaatctctagagaattgaatccaaaaatattggtacggccaaaatctttggaggcagcaaagatgaggccaatactagaagggttgtgtgaacataagaaatcagatgtctttagctttggagttttgctgttggagataattagtggtagagaaaactcaagttttcgtaatcacgagctgttattgagcctcttaggatacgcatggcaactatggaatgaagaggagattgtatctctgattgatccagaaatattcaatccagataatgtcaatcacatattgagatgcatacacatcggacttctatgtgtgcaagaattagcaaaggagacgcctactatggctactgtggtttcaatgcttaatagtgaggttgtgaattttcctcctccacgacaaccctcgttcatctaa

SEQ ID NO: 3499 - DNA, 597 bp, Glycine max
  Peptide Sequence Number=SeqID_95184
atgtggaggttaaagatagcagatggagggaatgatccctatatatttagcacaaataattttgtggggaggcaaacatgggagtttgattctgaggcaggtaccgctgaggaacgagctcaaattgaagcagctcgtcaaaacttttatgaaaatcgcttcatggtcaaggcttgtggtgatcgactttggcggtttcaggggagggaggcgaagagtggttggggaaaaagattcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 3500 - DNA, 1011 bp, Glycine max
  Peptide Sequence Number=SeqID_95185
atgcaccctgcaggcatcaggagaagagttgcgaaaaatcttcactgggcaacacgagggcccaattgtgtacgtgggggttcacatgccacaaccatatggaccaagttccttcaacttaaggaggaagacaaactgtatcacctgagggagatagtgcaacaagaagaaggaaaggaagaagaggaatttgttgatgaagaagagcaacagacaagttggtcctggaggaagatcttggaatctgtatttgaggatgaggtcaagaacacaagggagaaggttactaaaacatcccctctctcttgcaacctctatgacagaaagccagatttcaagaactgctatggttggagcgttgatcaagatggctctgagtattctccactcaaaagttctggcgtcggcatttatcatgtcaatctctcggcggatggcaccccatgtgaatccaagggcaaaagagtatggcatagggctgaaagggtcaggcagaatccaaatagtgtttccaaacggaagtactttgctttctgccaaatagcatcaaagaacgaaccacttgagttctttggcttcaccacctcggctcagaagaacaggccacaatttctggtcggtgccacgtcactcatgaggaccatggtgggacccgagcttgctgctgcatttggtgtgagcgaggagaccatgaggcgcatggctagggcacaacatgaagctgtgattctaccaactccatggactgcacatgcacatgatcacaaagtggtggtggatagggttcaaaagcttacaaagaatgagatgagcgttggacgtggacccgtcacgatgcttgttcaaattgtgatggtgacgaagttagtgctaacgaggatctggtgtgactttggtaaagttgatgaggttgtggatctggggggagatatatttgtgcaaatagaaaagggaaggtttggggtgtggatctatgcgaatactgagagatttgtgggagggataatctag

SEQ ID NO: 3501 - DNA, 603 bp, Glycine max
  Peptide Sequence Number=SeqID_95186
atgcctatggacctgacaaagtgctttacagtttacacagattggagctatgtctatagaaaaatttctactgagaggaagaatttggaaatatttttggcatattgttcttctgtttgtcttggtgaaactgaattattccttgagcagctggaatctgttattcaagggaaagagacttccataagtcatgaagagcttgttcttagaagccgagatcagtcaatatctgattatgtcgttatgttcttcagatttgttacctctgctgaaatacaaaagcgtgcagaattttttgaaccattcatactgggcttaactaatacaacagtcgagcagttttgcaaatcatctgttgaaccaatgggtgaagagagcgaccacatgcacattactgccctttcggacgcattgggcattccaatccgtgttgtgtaccttgaccgcagctcatgtgatactggcggtgtcagtgtaaatcatcatgatttcatgccagtggctggtgatctcccaaatgctagttgcagctctgaaaagaacattcctttcatcacgctgctatatcgtcctggtcactatgatatcctctatacaaaatga

SEQ ID NO: 3502 - DNA, 261 bp, Glycine max
  Peptide Sequence Number=SeqID_95187
atgaagctagctggttttggttcttgctacattcaggctatagtttattttctccttgctatcggtgcctttgttactttcattgcctatactatcacgaggactcactacttcctatacccagcagttgcactcatcattgttgttggagcatatctaggattctaccgaactcgtatgcgaaagaaattcaacatcaaggatgtgtcagacatgaatgttaaaattgatacggcacatggcatggtcggggtgacataa

SEQ ID NO: 3503 - DNA, 222 bp, Glycine max
  Peptide Sequence Number=SeqID_95188
atggcagagctcagagattcggaagcgtcgccggagataatggatatgaagcagaagaagaaaggtttcagaagcaaggaagaagaagggtttttggaagaagctgaaggggtttttgtttggagtcctggcgctatttatggagttatgcttttaaaaggggaaaaacaatataataagaatcaagggtcagaaatcaatcacatcagagttcctttttga

SEQ ID NO: 3504 - DNA, 1119 bp, Glycine max
  Peptide Sequence Number=SeqID_95189
atggcgatggatatcctgcgttcacctgtctccgccgtccgattatttaacggtggcgcaactcgtagtcgtcgcttcaacgtaagggcgaccctgccatttccgcagcaaaacgcaaagcattacaaagagcttcaagccgctattgacgttgttcagagggcttgccgtctctgtcttaatgtcaaatcatccttgttctcaactgatggaaaggttcttgagaaaaatgaccagactcctgttactgtggcagattttggagttcaagcactcataagtttcgagttaaataagctgttcccttctatacctttggtggctgaagaggactctgctttcttgcgaacaagaaacttggcagatgtttgttcacattgcattcctggagatgagaaaatggtggtgcttgacccaattgatggcacacgtggttttctaaaggctggcaaagccttatatgtggttggtttggctcttgtggttgaaggagagattgtaattggtgttatgggctgccctaactggaaggaagatttatctgagaaatcctctgttgagattgaggagggttgggattctcttggtggatcaggaactgtaatgattgctcataaaggctgtggaacatggatgaaaagtttgaatagccaactcaaatcatctggtgtatggaccagatgttttgttgatggatctgacataatacataaagcacgcttctgtattccagatagtcaaacatgggaatcactgcccctgacttctttatttaatgccacaagcaatgctgacaatgtagggagcaaccaaattcttcttttgggggcatgttgtggaagtttatgcaagtatttgatggtggcctctggtagagcatctattttcattctccgagcaaaagagaagactattataaaggcatgggaccatgctgttggcattatatgtgttcatgaagctggtgggaaggtaacagactggaaaggcagcgacatagatcttgcagcggatcatgttggccggcggattatatttccctctggcggtgtccttgttgccaacggcaatttacataataagattttgcagattatcaatcagacttcaagagtttga

SEQ ID NO: 3505 - DNA, 681 bp, Glycine max
  Peptide Sequence Number=SeqID_95190
atggttgaggagggtgtggtttccacgtttgtgagtcttgtgaggtctaaggatgaagcagttcaggtgagttctgttgagttgattcagaacattgcctctggtgatgagttggttaggcagatggtgattaaagaaggagggattcgtgttcttttgcgtgttttggatcctaagtggtcttgttcgtcaaaaacaagagaggttgtgatgagggttattgataatttgtgtttttcttcgcgtagttgtgttagtgttttgctgagttatggctttgtggatcaattgatgtattatgtgagaaatggggaggctttgattcaggagttggcactgaaggtggcgtttagattctgtgaaacatcggaggaggctaagaaggcgttgggtgatgcctgcttcatggctgagcttgtgaagtttctgaatgcgaaatcgtttgaagttcgggaaatggcagcagaggcactctctagcatggttatggtggcgaaaaataggaagaggtttgtgcaggatgaccgaaacatttctcttcttctgcaattgctggatccaggggagggcaattcagagaggcttgcagaagctgaggtttcttctgatgccaagaggcttgtgaggaagctatccacaaaccgattccgcagtatgttgagtggaatctggcactcttga

SEQ ID NO: 3506 - DNA, 2538 bp, Glycine max
  Peptide Sequence Number=SeqID_95191
atggcttcggcttcgtcttcgtcctccaagctatgcttcaattccgactgcaaagagttgaagtccgaaagacctaagaaagggtggagactccgcagcggagaactagccgagctttgtgatcgatgcggctctgcttttgaagaagggaggttctgtgaaatttttcactcaaatgcttctggttggaggagttgtgagacttgtcgaaagccatctaacctgccttggccacagtcctttccccttcaaaatcgtttatcggatagacttagagacctatctggcaaaggttggagtcagctagctggatcaggtcctgtaccatggaagcaagcacccagtctgttcaattctgcttcttcatctgacatgatcccagaagtgccttctttagttgaactatccaatagctttgacaaaatgtattgcaatgaaaggttacctgtctcagccttggaaaagaaaaatgaggacttgtctggaatgtcagttaattggaacatcaagcttggctcgcgggagatgatgcttatgaatggaatgaggaatgaggataaatcaagttcatgtttaaatatgtgtcaacagccttcttctctgaaggaagagtcatctcctcaaccatttggtttgcctgtgcctaattcatgccaaaatgaaagaaatggtaaacttggggtaactggaagtcatccacaacaaactccacctccaggaaagcaatttaatggcactatgcatttagcacctgattcatcaggtgaggctcaggttcgcaatgggcggcctcgagcagatgcccgaggaagaaatcagttattgccacggtactggccaaggtgtacagatctggagctacagcaaatttctattgagtatccttcaaatcacatgatcgtagtgctgaaaaccttgagtgctagtgatgctgggcgaattgggcgtttagtgctacccaagaagtgtgctgagacctacttcccaccaatttctcagcctgaaggattgccacttaaaatccttgatgcaaaaggcaaggaatggatatttcaatttcgcttctggccaaacaataacagcagaatgtatgttttagagggtgtcactccatgcatacagtccatgcagttgcaggctggtgatactgtaacatttagccggttggagccagagggaaggttggttatgggatttagaaaggcttcaagtgctgtgccatccgatcaggacaatgagaccaagactggaaatggattttctgcacatggtgaagttgaattggctgatcctaattcatggtctaaagttgataagtcaggatacatagcaaaagaagcactggggagcaaatcattaatctctagaaaaagaaagagcaacatattgggctcaaagagtaaacgtctgagaattgaaaatgaggatttaatagagctgaagattacatggcaagaagctcaaggtctgctccggccccctcctagccacattccaagcattgtggtgattgaaggttttgaatttgaggaatatgaggaagctccagtgcttgggaagccaacaatttttaccagtgatagtgtgggtgaaaagatccagtgggctcaatgtgaagattgtttcaagtggcgcaaattgccagcaagtgcgcttcttccatcaaaatggacgtgttctgataattcgtgggatccagaaagatcttcttgttcagctgcgcaagagctgacagcagagcaacttgagaatttgctacctccttgtagttcagctgttcccaagaaaatgaaggctgccaaacaggatcctgataatgctgaagctttggagggacttgacacccttgcaaatctagctatcctgggagagggtgaggcactcccagcatccgcgcaggccacaactaagcatccacgtcacagacctggctgctcttgcatcgtttgcattcaacctcccagtggaaagggccccaagcataagcagacatgcacatgtaatgtatgcttaacagtgaagcgacgtttccgtacccttatgttacggcgtgagaagaaacaatcagaaaaagaagcagagacaactcgtaaaaagcaacagcaacaacatcctcaaccgttaccttcatctgaaattttgcttgatgaagattccttgccctgtagtaacacaggtgatagtagcccaaaccagaacaaagagggtaatgatggttctgatgatgatcctaaccgaataaaatcatcagctttgccattcaaaggtcaaattgacctcaatatccagccagagcgagaagaagaactatctcctggttcagattctggcggcatgatgaagttgctccatgatgctactgagcggtatctcaaacagcagactgtgaactctggtactggagattcatcaggcagtcaatcacggctggtaggagatgcaatgagggaagataaacttagcaatggtgttgcccatggcagtggtagtcataatactgataaggaacatgcccaatctttgtctatgaatgtgtga

SEQ ID NO: 3507 - DNA, 132 bp, Glycine max
  Peptide Sequence Number=SeqID_95192
atggctccccctgctggtgctgccacctgttactactccacaacgattcagaagaagaagaagaagaagaagaagaaagagattcttcggtgggtgaagatggaaatccgaagcggaaggttacaatattaa

SEQ ID NO: 3508 - DNA, 1278 bp, Glycine max
  Peptide Sequence Number=SeqID_95193
atgggaacggaggtgatggggaggtggggcacctgggaggagctcctccttggtggggccgttctccgctacggaacccggaattggaacgtcgtcgccgccgagctccgggcacgaacagcttgtccctacaccattactcctgaggtctgtaaagccaaatatgaagacttgcaacagcggtacactgggaacaaggcttggtttgaggaacttaggaagactagagtagcagagctgaaaagagctctggagctgtctgaagattcaattgggtctctcgaatctaaactcgaaagcctcgaggctggaaagaatgagaaaaaagatgattgtcatgttgacaaaggatcagctggtccaaagttacatgtagcttcacagaaattggaaagagttgaatcttccactaaagagacatcaaaggatgggctatccgctgggagtttcacacatgaaaccaggacaaactggtctcctgaatgtccagttcccgcagggtttgcagaagatatggagactaagcccgaggtttcacactccactgagcaggccaaagttttgaatgtagatgagttgacacgtactatatatgaaggacaaggaggaagttttaaaaaacggagagggaagaggaagaggaaggactgtggcagaaatatgaaggaagcaagtgttggggaaagtgacttgttagattcggctgatgttgtgtcatggtgtaaagaaagttctaccagcaactgtggtgaagttgccaaatcatgtggtgtagatgatcaaaataggaacttgaaaaaggatagggtggaagacatgatggagattttggattttatttttgaaactaaaggtgcttcggctttccaacgcagacttgatagtcagagcactcgcgaatacaaaactgctctactgcttagaggcattgtcaccaaaaaaatgagggaaagtttgaagggtacgagcaacaaagccaccactcaagctactaattttcctattaaattacttgtgcataatcctcatgtgaaaccaagaagtgtacggccaggcaacagaaaaatagttgcaaaggcagttggtggcaagaactctgcatctggggagtcacatggaactaagaaacctagtaaagttgattctccatcctcagtggaatccttaactatgaagaaaaaaggttttggtagaccaaaaaaggttggacgtggggctgctgcaggtcaaaggcctgcaatgccaatgaagggaaagaaaagagttaggactaagtga

SEQ ID NO: 3509 - DNA, 204 bp, Glycine max
  Peptide Sequence Number=SeqID_95194
atgaaaattcttctaaatctttcacatcaatccatgaagagtaatggtgtagggacaagctgttcgtgcccggagctcggcggcgacgacgttccaattccgggttccgtagcggagaacggccccaccaaggaggagctcctcccaggtgccccacctccccatcacctccgttcccatcaccgtacacgtgtacgcctctga

SEQ ID NO: 3510 - DNA, 156 bp, Glycine max
  Peptide Sequence Number=SeqID_95195
atggcctcgcagaagacgaaaacagagaagacaaaaggggagaagctgcggaagaaggggaatgagcaagaagatgcggaagaaggtagtgacaatggattaaggcctgtgagtgggcacagaatcaccaagaggaaactggggaatcacacctaa

SEQ ID NO: 3511 - DNA, 3816 bp, Glycine max
  Peptide Sequence Number=SeqID_95196
atgtgtagttgcgcttttacagtagacccttgcctacttactagtgcctcagggaattctgtccttgaatgtgaacatgaaaaccagggaccttcatcacagactttttcatccccaaatgctcttgctggtggtttcagggactcctccatgcttgaaagtgatgaattttgcttcacagaaatgacaggagtttctaattgtgagacacctgcttacattgcagacagaaggttccctgttcctgaggcgaattcaagcagcgtagctgtctgtggagataatttgaacctgcctctgtggaagtgtgaaaatgacagccaaatcaagcatataggatatgatgcacaatctgaacatgcttcacatggttctatcattgaaaatattgacttaaattttggagattatgaaacctatatggaagacattattggactttctggtaaacaggaaaatgactcgtgtacatcttttgaaatgtcgtttgtggatgctgatagatcttcacgtgttgcaacttcaactgattcttctatttgtcaaggttccaatgttcccaatgattttagtgactattatccatctttgaattgttaccaaggtatggatgatagacctgttgttgccaacagttctggttgtttgcctaatggtgtttatcctcatgtgcggaaaaatgaagaaatggtgaggaacatgaaggttgctaaaatggagttatttgccgatacaagtagtggcatgcattccagcattaatggtggaatatcttttcaagatagtcaatttaggtttgcagatagtaaatatgcatcatcttttcctggtaatgttctatttgaagacaacgcgtcagtggaactttcaacttgtggttcatatatttcaagagaaggccaatcacttactgtcaaagccgaaagagatgaactgattatgccttaccaaaactctgttcacagtaatgatgctgagttcaatgtaggtcaagagatgaaacaactacctggtattttccctgctgttggatgtcagggtaatgatttctttaagtgcagggataaggttacaattgtaacaagtcagaaagccaaatattatcaagatggtattgatggagctgccaataactttcaagcaaacatgggaaatttgaatttaaaaccattagacaaatctttgtataatgcccagatatctattgccagtgggaagcagtataattgtgttatgagtgaaggagagggcaaagcaattgaacatagaagtattgattctcagctttcaaaaggaagcattgagagatccattattgaggatgattctgatgtttgcattattgaagacatcagtcaccctgcacctataagtcgatcaacagtgcttgggaattcccttattacatcacaatcttctagaggtggttatacacattcttatatggtgggaagtatggggcccaaggcgcgtgacgagcagtacatattacgagttgcattgcaggatctatcccaaccgaagtcagaggttagtccaccagatggtctgctggcagttcctcttttacgacatcagagaattgctttatcatggatggttcagaaggaaacatcaagtttatactgttctgggggaattcttgcagatgatcagggtcttgggaaaacagtgtcgaccattggtttaatattaaaggaaagacctccattgctgaataagtgcaacaatgcccaaaaaagtgaattagaaactttgaatctggatgcagatgatgatcagcttcctgagaatggcatagtgaagaacgaatctaatatgtgtcaggtgtctagtagaaatccaaaccagaacatgaatttgttattgcatgcgaagggaaggccatctgcaggaacccttattgtttgtccaactagtgtcctgcggcaatgggctgaggagttgcacaataaggtaacctgcaaagcaaaactctctgtcctagtatatcatggaagcaatcgaaccaaaaatcctcatgagcttgccaagtatgatgttgttctgacgacttattcaattgtcagcatggaggttcctaagcagcctctagttgacaaagatgatgaagaaaaaggaacttatgatgatcatgcagtatcaagtaagaaaaggaaatgccctcctagttctaaaagtggaaagaagggattggacagtgcgatgcttgaggctgttgctcgtcctcttgcaaaagtggcttggtttagagttgtcctggatgaggcccagagtataaagaatcacagaactcaagttgcaagggcctgttggggtcttcgagccaagcgtagatggtgcttgtcagggactcctatccagaatgcaattgatgatctctacagttactttagatttttaagatacgatccttatgctgtgtacacatcattctgttccacaattaagatccctatcagcagaagtccatcaaaaggatacagaaagctacaagctgttttaaagacaataatgttacgtcggacaaaagccacacttcttgatggggagcctatcatttccttgccacctaaatctgtggagttgaaaaaagtggaattttcaccggaggaacgagatttctattccagactagaggctgattcgcgagcacagtttcaggaatatgctgatgctggaactgtgaagcaaaactatgttaacattttgttgatgcttttgcgccttagacaagcatgtgatcatcctctccttgtcaagcgttacaattctaactctctctggaaatcctcagttgagatggcaaagaagcttcctcaggaaaaacgattatgtcttttaaaatgtttagaggcatcattggccctctgtggtatctgtaatgaccctcctgaagatgctgttgtttcagtttgtggtcatgttttttgtaaccagtgcatttgtgaatatcttactggtgatgacaatcagtgccctgctccaaactgcaaaactcgactaagcacgccttcagtgttttccaaagtcacactgaatagttctttttctgatcagccttgtgataatttgcctgattactctggttgtgaagtggaggaatctgagttttgttctcaggctcagccatatgattcttcaaaaattaaggctgcacttgaggtgttgcagtcgttgtctaaaccacaatgctttgcttcccaaaacaattctgtgcagagcacttctggggaaagtaccgatggccttggtagctcctctagtgctgacagaatgaaatccttgaatgaaattcctgagagtcaaaatgtgcttgaggagagaagctctaataattcagttggtgtaggggagaaagctatagtgttttctcagtggacaaggatgctagatatacttgaagcatgtcttaagaattcgtcgatccagtatagaagactggatggaacaatgtcagtcactgcaagagataaagctgttaaagattttaacactctccctgaggtttcagttatgattatgtctttaaaggctgctagtcttggtctgaatatggttgctgcctgccatgttcttatgctagatctatggtggaatcctacaactgaagatcaggcaatagaccgagcacatcgaattggacaaactcgtcctgtcacagttttacggttaactgttagagatacagttgaagaccgtattttagctctgcaggtgtcagtgggttgttctttttggtggaagcagaagaaacagggtgctgaaaattttgtagcatggcctctgttgacactcgacatgaagattatatga

SEQ ID NO: 3512 - DNA, 2823 bp, Glycine max
  Peptide Sequence Number=SeqID_95197
atggattccaattccaaggccattttggattatgctttgtttcaactcactccaaccagaactagatgtgagttgttagtctttcgtggaggtgttcatcagaaaatagcttctgggttgtttgagcctttcgtttctcatctcaaattcctcaaagatgagatctccaaaggtggatactcaattaagcttctgcctcccaaccacggtggcttctggttcaccagagccacgtttgagagatttgtgcgctttgtcagcacaccggctattctggagaggtttgttagccttgaaaatgaaattcttcagatcagaagttcatttcaagctaatgctttttcaatgtccgttgcaactccagatgaaggatctgtgccacaagccaatggcatcacaaggaggttaagtgattctacaaagttaaatgatgtacttgaaggagttgacaataaagaggaaaactcaaaggtttccctgcatcgtctgttagagtctcgaatagcactactccggaaggagcaagcaatggcttatacacgtggtcttgttgctggatttgaaattgacagcattgatgatctcatatactttgcaaatgcatttggagcagcccgtttaagcgaagcctgcatgaattttaaggaattatggaagaaaaagcatgcagatgatctttggataaaagaagtagctgctatgcagtcaagcttaccaccagcactctcattgtctggatcatcaggaattatattggcaaatgatataaccacccataatagctctagggacagcattgcttctggtgacgaaaatgtatctctggaaacattgaattctgctttaaacaaaaaagaaggaatgccatgtgcagatgtgaacctgcctacagcagatcataaactttcacatacagcaaatgttaatatgccaatgccctggccttacaatgtacctccatatatgtataatcttcaaaatccgcaaatgccttcataccaaggatatcctatgactaatatgcagtctgttcctccttaccttgtaccaaatatgcaatggtctcctgacctgggagtgaatcagaaaccatcagaaaccaaaagggataaatctcacaagaaaagagcagaagaataccaagaccagcagacagagtccagtgaccctgattctgggagtgaatctgattcagataaacagaatcactccagtcattcttcgaaggatgatctgaagaggaaaaagcacagaagaaagtcatctagaacagttgtaattcgtaatatcaactacatcactccaaaaaggagaaataatgaggggggagtctctgatgagtctttagaagatgatgatggcatcgatgaagaaaccatcaaacaaaaggttggtgttgcacttgagtctttgcaaaaggtccataaagttgaaaaacgtgctaagggaaaaaaagcagcagcctggcacaatgtaactaaatcaagtgatgcgactgaggaagatctcacttataacttgagtgatgcgtccgaaggaggaaagaaaaatgacaactgggatgcattccagaaccttttgaagatagatgaggggaccggaactgatggaccagaaaggatgcagtcaattgatatccaggatgaacattttgtgttgagaagctcagaattaagaatgccaaatggtgctagttcatctccaaacttggatttcaaagaagttctgaagaatcctaaagttccaaatgactgctttattgtgtctcagagagatggaggaaatgaaggtggctctaagctggatgagtatgtagacaactgtggtccagttacaaagagcagggataatattggtgaagaaatgctgttatcacatagatcaaaggaaccaggaagaaatgaactcggtgatccattatctacttttgctgctgattcattacaaacaaagggaagagcagcagatgattggtttattgtagataatttggaaaagatgaggagccctgacccaaccattgtgcctgcagtgtttgatggtgattacacttcatcagtgaatgatcgctcccaatctgagaaaagaagtgagcgaactcttattgatgattccttcatgattcagggtcaattagtagataatgatctttctgactcgcaatggaagacggacttaagtatggttgcagatctaactgctgccaacaagcttgaaagtgatgcagctgcttcaaatgagaagcatgcattatcaaagaaccaggagccaagtgacctctttgtagttctacaacgggattctggattggactctgttgaggcctcgcggacaatggactatgaaattgacttttccttctcagaaactaatagaagatcctccatggatgattctcacgccaaggtgaatgacaaccttcctgttagtcctgtgaaaaccaatgtgagaaaaagccaagtttctggaacaagaagttctggaaaagatgaaaagtcaaaagtgttgcgtgattactctgggaagagcaagcctgaaatcatgtcgagggccagaaagccagctctccctaaaaagcctatagttcagaagagcaaaagggaacaggaagatgagattagacagaagatggaagaattgcggaatgaacgtcagaggagaattgctgaaagaactgcatcctctggcattgctcgagctgcgacaaggaaagaccaaattgaaggtaaaacagcaaggatttctgctaagagtgacaagaataaggctcaaccggtaaaagagacaagcagaatcagttctgtcaaggtcaggggaatttag

SEQ ID NO: 3513 - DNA, 144 bp, Glycine max
  Peptide Sequence Number=SeqID_95198
atggtggaggatgggatcacacatgaggtggtggataaaggtggggtcacacgcgatggtggtagacgaggttggggaactgagaaatttacggggaaggggaagggaaaggggtgtaaggatttggtatataatatctactaa

SEQ ID NO: 3514 - DNA, 777 bp, Glycine max
  Peptide Sequence Number=SeqID_95199
atggccgaatattttgtctttgatattgccgaatccctgctagggaaacttgcttcttatgtatatgaacaagcttcacgagcctgtgatctttatgaggatgtgcaagggatcatagacactttgtcaattgtgaaaggtgtgctgttggatgctgaggagaagcacgggttgcttgaatggctcaggcagattcaaaacatatgcttcgatgttgaagatgtgttggatggatatgagtgccaaagtttgcgaaagcacgttgtcaaagcttcatgcagcaccaagatgaagaggattgatattgatcacagacttgtgcaaaggagagaaattacttattcccacgttaatgcttcaggtgtgataggaatggatggcgacaaggatgaaattatcaagcttttgatgcaacctcaccctcatcatggtgatggtgatggagataaaattggaagtggaaaggtagagaatattgcaagacaatatatagatgaaagatcattacttgaggattttgaggactatggccacctttaccatttcaaagtacatgatttggtacatgatcttgcattgtatgttgcgaaagaggagctactagtggtaaattcccagactcgcaacatacctgagcaagtaaggcatttttccgtggttgaaaatgattcactaagtcatgctttgttccccaagtccacaagtgtgagaactatattagttcgcatcgaaggaatgggtgttaacaatgaaactcttttggatatatggatataa

SEQ ID NO: 3515 - DNA, 780 bp, Glycine max
  Peptide Sequence Number=SeqID_95200
atggctgctatcttagctcggaaatcactccttgctcttcgtgcgcgccaattggctgtaagcggtcaagggctgcacagctcccaaaactatggccttcgattaagtgcacactcctactctaccaaaagagaggatgaagaaagggagcaactcgcaaaggaaatttcaaaggattggagttctgtttttgaacgtagcatcaacactctctttctcactgaaatggttcgaggtctaatgctgactctgaaatacttctttgaaacaaaagttacaatcaattatccatttgagaaaggccctttgagcccccgtttccggggtgaacatgcactccgacgatatccaacaggagaggaacgctgcattgcttgcaaactttgtgaagctttgtgtctagatgttaccaagtgtagcatgtcattggttaatgtagaaacaaatgtgcagctgttcttgtattggaataacactacacaaagtgtaaggcttagacccttgatatgtcctgcacaagcaatcacaattgaggctgaggagcgagaagatggaagccgcaggacaactcggtatgatattgacatgaccaagtgcatttattgtggattttgtcaagaggcatgccctgttgatgcgattgttgaagggccaaactttgaatttgctacagagactcatgaggagcttttatatgacaaggagaagctgcttgaaaatggggaccgatgggagactgaaattgcagagaacctgagatctgaaagcctttaccgctga

SEQ ID NO: 3516 - DNA, 288 bp, Glycine max
  Peptide Sequence Number=SeqID_95201
atgggtaagacttcagttaataaaaatctgaatcaaatgcttaatccaattggctactcttccatcacgctggcaccaagtataaaagtcacagaagaacaattgcagcatgtgggattgaaccggagtcagcttttccagacaaccggcattgcattgcctgggaggaccaacacatctccaaatatttgtccagtatctaactccacttcagagaggactgggtatcttaaattggtacaaaaagtgggtgttctacttggaattggatttggaccaaaagactga

SEQ ID NO: 3517 - DNA, 1887 bp, Glycine max
  Peptide Sequence Number=SeqID_95202
atggaagatagtggaaggtttgatgagaagtccttttcaaatggggatgtctacataggtatgatcaagggcatagtgcctcatgacaagggaaagtacacatggtcagatggaacggtatatgagggcgattgggaaggcgagaaaatgacaggaaagggactgattgtgtggtcatcaggagcacaatatgagggtgaaatctctggaggttacctacatggttatggaacacttacaacatctgctgggtgcatttatagaggaggatggaggatgaatgctcagcatgggattggacggaagcagtattccaattctgatgtttttgagggtttatggaaagaaggagttcctgaagggagtggcaggtatacttggaataatggaaatatgtatgttgggaattggaaaaacgggaaaatatatggtcgaggggttatgaagtgggttaatggtgatacttttgatggtttatggttaaatgggcttatgcatggaacaggagtttatagatttggagatgggggcctttatattgggacatggaataaaggcttaaaggatggaaaaggagtattctatcctgcaggtagtaaacatccatccttaaaaaagttgcatagccctcgtgatagtgatcataacggtttcttgttgaatgtagaaaaacaagaggctccaaaagccagagttaagcgtagcctttctgaaaacatgccggtcattagtagattcaaaagtttccgtcaaatatctcacaggacttcatcattgaaaataaatttgatccgtagtgattctgctcaagattgtgtatgtcatgattcttctcttacattatccaatgcgttggatggagatcaatctgaggcatcgggtgaaagtactttggtttatgaaagggaatatgtacaaggagttctaattatggagagaatttgtgagtgctctgagtcatcacgtgaaaagaaacagcaaaataagtttagtgtgaagcaagtaaagaagagttcatgtttggacatttttgaaggccggcgaagctattatcttaagcttaatttgcagcttggcatcaggtataccgttggcaaaattacaccagtgcctgcacgcgaagttcgatcatctgattttggggatcgagcaagaataaggatgtacttcccaagggctggttcaaagcttactcctccgcatagttcaataaacttctactggaaagattattgccctatggtcttcaggaatttgagagagatgttcaagttagatgctgcagagtacatgatgtccatttgtggagatagtggtctaagggacttgtcttctcccggaaaaagtggcagcattttctatctttctaaagatgatagatttgtgataaagactgtgaataaatctgaactaaaggttctgctcagtatgcttcctaaatattaccgtcatgtaggagatcatgaaaatactcttataacaaaattcttcgggctccatcggataacattaagaggtggaaaaaaggtgcgttttgtggtcatggggaatgtgttttgcacagaactacaaatccaccgccgatatgatctgaaagggtctaaacaaggaagatatacaaacaatgataaaatcaattgcaacacaacattgaaagatcttgatctaaaatatgagtttcacatggataaaaaattgcgagaatccctactcaagcaaatttccctagattgcaagttcttggagtctcagcatataattgattacagccttctgttgggattacatttccgagctccagagaatatgaaggccttcgtggaacatcatgaatcagtgcagcgtcaggagagtttaccttctggagatggtaaatacctccactga

SEQ ID NO: 3518 - DNA, 1314 bp, Glycine max
  Peptide Sequence Number=SeqID_95203
atgggagatcacccacgttctcaaccattggatttgcaccacctctttaagattaaaaataaatccttgaaagacgttagcaaggcttacaaatcgcttgtatccaaaagacaccaccatgacaagaaaaaccccgaggagccaataacacccccaaggtttgaggaaaatgataataaaagagtggatgaagacatttggagtcctaaatttttgtcaagggctgcaagtagaagatctaaaacaccaacactaaaatcaaggcctatgtcaaggcatggaagcaggcgatgcacaacaccaacctctctatcaagaagttcttctagttctggtcgaaggagtgccaccgaaattgctgcatcatctctcaaaaggattatgagcagaaggggttccccggcttctttgtcaagtaagttgaacatctctgaacctaagttaaccaaccatgtagcgtctccaacaaaagatgcagatgcatgcttaaagaccacccgaaagcctgaatacatccctgcagtctctctgtcaagcaatctgagttgtaggttaacaacacctatcatattttcacagacaacagctagaaggaaacccccagaagttgagagaaagctgcattgcacgctcgagaatttatgctttggatgcataaaaaagattaaagttactagagatgtcatcaaatatcccggggtaattatccaagaagaggagattttgaaaattgaggtgaagccgggatggagaaaaggaacaaagattacatttgaaggagtaggtgatgagaaacctggatacctcccttctgatatagtattcttgattgatgaaaaaaagcaccctttgtttaggagagaaggcaatgatttggaaatatgtgttgagattcctctagtagatgcactaacaggctgcttcatatcaatccctctattaggaggggagaatatgggtttgtcattcgagaataatgtcatatacccaggatatgagaaggttatcaaaggtcaaggaatgccaaaccccaaaaataacgggataagaggtgatcttcatgtcaaattcttcattgaattccccacagaattaagtgaagaacaacggaaagaagctgctaggctgttgaaaaagaaagggaacttccatcagtgctcccttgatgttgtcttcgacaaatggaagatctttggattgctttcttccagaccgaatatgtatcttgtcaacttgcctagctacaagcacagtttgcaccattcaaggccaaagccgggatacagaatgcaacatctacattattatcactag

SEQ ID NO: 3519 - DNA, 303 bp, Glycine max
  Peptide Sequence Number=SeqID_95204
atggcgaaggagatgcagctgttgatctttgtgtttattctaatgataactttgagtttcatttttcctttagatgcttttcagcagcaggcagtggaatatggtgctgctggtttgcaatcgcaaagttcatttcaaacaacaatctactttggaatgttgcctaggggactggttcctccatctgggccttctacaccaatcaacacgagactcacctctgctactgcatgcttggcaactatgaagttcaaagctactttatgcattgcattaattatgtttttactccttttaaattag

SEQ ID NO: 3520 - DNA, 2166 bp, Glycine max
  Peptide Sequence Number=SeqID_95205
atgagaaaacgcagcatttacgcatggctagtagcacttgtttgcttcctcctactcatgatcgtcaccccagccattccccagtcacaagaataccatgatttcgccgaccaccgcaccttcctcggtattcccaatgcacttaacgtgatatccaatttcccttttctggttattggcctcgttggacttgtactctgtcatcatggaaattactttaggctcagcttgcaaggtgaactatggggctggacatgcttctatgttggcgtggctgcagttgcagttggatcttcatactatcatctcaagccagacgatgctcgccttgtgtgggatcgcttgcccatgaccgtcgcttttacatcaatcatggcaatattcatcattgagcggattgatgagaggaagggaacggtttctattatacctctagttttggcggggtcttatcttctagctaaggtgctagaggctactgatgatgtgatctatgaatgggcgcaacatattgtcagtggtcacacacttaagcatctggttgcagcaatggttcctgtcttcttaacattcatgcttgctaagaggagtgttgaacctgagaggattttggttagggtttacgaggagaagaagataacagaaccaaagggtttgggaagatgggaagaagtaacggtcgaagctcttaattccaccgcaaagcttaatcacgctcgcacacccaagcactgcaaaaacgacgatgacgacgacgaaggaaaggctcaaagcgcgtctcgaaagcggcggaagaaaatcgataggagtgaggagacattgcagaggatggaagcgttgcacgtccgaaggaaggtgcagggatcttcctcatcgtcctctgcttcggagtgcgacgatgaagatgaagagggaaccgtgtcgacttcggaggacacaatttacggggagaaggtggagcccgagtttgatttgatgaagacaacgctgcgaaagtcgtatacgccgaagaaggttgccacggaggaaaagaacgttgaattggaggtggggaatagcagtaaggacactcttgtgaatgaggaaatggggaatagcagtaaaggaactagtactcttgtgaacgaagaatggaaagaagtgaagggttcgtgttggggttcggtttcgaatgggaaggatggaccgaggtttaaggatttgggtgggatgaaggaggttttggaggaaccgaagaatgaagtgattgtgcctttgttccatccccaattgcctaggcagttgggagtgaggccaatggctggcattttgttgcatggaccacctggctgtgggaagactaaacttgctcatgctatagcaaatgagactggtcttcctttctatcatatatcagatcctcttgatacaaagtcaggatttttgctttatggacctcctggttgtggtaaaacactgattgccaaagctgttgtcaatgaggcaggggctaattttattcatattaagggacctgaacttttaaataaatatgttggagaaagtgagcttcaaattgacactttgacaaccaaacgtggtaaagaaggtggttgggttattgaacgactattgaaccagttgcttgttgggttagatggcgcagaggaacgaagagatgtttttgtggttggtgctacaaataggcctgaggtgatggatcgtgctgtactactacggcctggtaggtttggtaaacttctttatgttccacttccaagcccagatgaacgagttttgatattaaaggctcttgcaaggaaggaggctgttgatgcctctgtggatttgagtgacatagccaaaatggaagcttgtgaaaacctaagtggcgctgatcttgctgcattgtactacaactacaaaggttggactatagaaaaagtggtagtcagtttgagagagatactgattttatggactatacagatgaatgaagcagcaatggctgctcttgttgagaatttggactcaattgagacaacttgtgatacattgaccatcaagagtccaatcaagagacaccattttgaggtagcactgagtatagtctctccgtctgtatcagacaggatatggcttattctgctatatctctttcacatgaaatatgatgccttgtggtga

SEQ ID NO: 3521 - DNA, 2409 bp, Glycine max
  Peptide Sequence Number=SeqID_95206
atgtctaaccctgctccattctcaaccggaaatccaccattttggatccctatacatattgtgatcccagagaggccgactgaatgtgcagtattcaatgtcattgcagatactgatatcagtgtactatcaacacctgtgggtggatttacaatgaaagattctcctcgtgattctgtccagttcattgaatggtcccccacctgctgtccccatgcattattgatagcaaatttccatgggagagtaactatttgggctcaaccttctcaaatatgtttttcttgtttatttgtttctgatttcttgtccattccggggcaagctaatcttgcacttgatgctagctgctggctgcgagagcatgagtggcagcaagatattgcagttgttacaaagtggctatcagggtataggtggctttcatctaaaccaagtgctcctgccaattcaaggtcaacatttgaagaaaagtttctttcacgacaatgtcaaacttcaggatcggttcaacttcattggtcccagtggcctcctcagaatgcaacaacacccaaatggttttgcactagtaaaggaccattgggttgtggcccctgtggcattatggccggtgatgctatcattacagacagtggtaccatgcttgtgacaggtgtgccaattgttaatccatccaccattgttgtttgggagacaaaccaaaacctcggtgattctataccacttaactgttcaccggtttcaaatttttcggcatatgtgagtcctgaaactgcagctcaatctgctgcaaccactacatggggttctggtgtaacagcagtagcctttgatccaacttgtggtggttccgtgatagctgttgtgatagttgagggacagtacatgtccccttatgatccagatgagggcccatcaatcacggggtggagagtgcaacgctgggaatcatctttacagcatgatgtcctccatccaatatttgggaatcctacttccagtatgggtggacagcctcctatgcaaactgtttggcagaccaaagtggagctgagcattccaccaacaaatgatttcaaaaatcatcaagctcctgcagttggaatgaacacagatatgcaaaagattagtgttggatctgcaattgctgctcctgctttttcttcaacaagctgctgttcagcatctgtttggcatgacacaagcaaggatcagacaattttgaaaattatccgggttcttcctcatgctattccgactagtcaagtaaaggccaactcatcaaactgggaacgtgcaattgctgaaaggaaaagtaggttttggtggagccttttggttggagttaattggtgggatgctgtgggctgtacacagagtgctgctgaggatggtattgtttcactcaacagtgttattgcagtcttggatgcagatttccattctcttccttctgctcagcacagacaacattattgtcctatccttagtcaactagtgcctgcgtcaaaaggaggtgaagaaccatccctagggcgttcgagaattggtactggaaatgctggccaaggatatacatatggagagagattaactgttaacttatggtcttactacactggtaatgctggcttgcaacacccattgccagtttctcaggtggggagtaataacattcaggttcggctgcattatattgatgggaactacactgtactgcccgaggttgtggaagcagcccttggcccccatatgcagatggctatgcagaacatgccccgtcctagaggtgctgatgctgctggtcttctactatgtgagctagaactccatcctccagccgaagagtggcatagacggaatatgtttgggggaccttggtctgatccagatgttttggattctgcaaatgatgcactaaaacttgttagtttaaatcctcttgattccagctcattggaaaattgtgatgtctactatggagccaatggcttatggccaaggaagcgcaggatgtctgaacgagatgcagcttttgggttgaacacttatgtgggcctgggagcataccttggtataatgggatctcgaagagatgctgttactgcattgtggaaaactggcattgaagggatctggtacaagtgtatgagatgtctacggcagacttgtgcttttgcctcaccagcttccactaatcttcctagtcaaaatgaccgggagatttggtggatcagcagctgggcttatggctgtccaatgtgtggtggaacatgggagaagagacatgtagattacctgacaggctctttatcaatcaaaatcgtgtatgtatcagagaaggcagagctagttgaaggcatggatgaagaattggtcacactgagaatgagaagaaatgattga

SEQ ID NO: 3522 - DNA, 129 bp, Glycine max
  Peptide Sequence Number=SeqID_95207
atgtccattcgatcaacttcagatgatattgataaattaagtcttgatgaagatgatgatgatgtgccacaaccatcagataacaccatggaagatgttaatccaaatgaaagcaatattggtgaatag

SEQ ID NO: 3523 - DNA, 2595 bp, Glycine max
  Peptide Sequence Number=SeqID_95208
atggatttgaaagaatttctcgcgtctaaccgactcgccagaaattggcagatcacacaagaacatgtgtggaccgttatatctgcttacttcgaagagaaaggcttcgtttgtcaacaacttgattccttccaccacttcatcatccagaccatcatgcaagaaatcgtcgacgattctgcgtacattgaaattcgacccaagaatcagcacaatcccgctcacaaatccgatcccgttgaggctgcttacaaattcagattcggcaagatttacttgagtgagccaatgatgacggagtctgacggcaaaactgccaggatgtatcccatgcctgctaggttagggaatgttaatgtctacaaggcagtcatcaagaagggccacgatggtgaagtgttcactgagactaaagatctccccaaaattttcattggcaaggttcctataatgcttgggtctagttatttctcgtcgtcaaagaattcggagagcggtttcaataagattcgagagtgtccgtttgatcaaggagggtatttcattattaatgggagtgagaaggttctgattgcacaggacaggagaggaagagcactaatcatgtctatgtgttcaagaagaaccaatctagcaagtaagcctaggtggctgaagtttgtgcgcatgctctctcggactagttccagagggggttcatcggggcaatatatatgcgccactcttccttacattcgaactgaaattcccatcgttattgtatttcgagcgttggggattgttcctgacaaacacatacttgaacatataagctatgacttctcggatactcaaatggtggagttgcttcgtccttccctgggagaagcatttgttattcaaaatcagcaggttgcacttgactatattgggaaaagaggagcaactgtagcaagggtttacacttgtatcataactgcattctgtaggtatttaatgaagatccttcagaaggagatgctccctcatgttggcgttggagaatattgtgagaccaagaaagattactatgggcaagtttatgttggtttagatcttgatgatagggatcattacggcaataagaggcgggagctggctggtcccttagttggcgtacggacacttcagtcccttgccgtgtccggtgtccgttacgcgcccgtgtcaatgtcctacaccgacacgacacccgtactatgttctatattttggacattacaggtgtccacgagtccgtatctgtgtcgtgttcagtgtccgtgtcggtgtcggtgcttcatacttaaatactcacttgctactggtaattgggggcaaccgaatgcggcagggactcaagctggagtttcacaggtactaaatcgtttaacttatgcatccactttatctcacttgcgaagactgaattccccaataggaagtgaagagaagttggccaaaccaagacaactgcataattcgcaatggggaatgatatgtccagcagaaacacctgaaggacaattggttcagctgaaaatcctattctggagtattttgggaaaattgggcattgagaatttcgaggaaatttctcctgcagttattccccaagccacaaaagtttttgtgaatggttgctggatgggtatccatcgtgaccctgataaattggtgacaacattgagagagctgagacgtcggttcatgttaatactgaagttgggattgtcagagatatccgtcttaaagagttgcgcatatgtacagattatggagggccgtgtccagttcaaggaataccctgaagagggtggatggtatgctctgatgtccaagggccttatagaatatattgacacggaagaagagactacgatgatttccatgacaattagtgatcttgtacaagctaggatcaatccagaagaagcattttctgatacttacactcattgtgaaatccacccgtcgctgattttgggtgtatgtgcttccaatataccatttcctgatcacaatcagtctgcaatgagaaagcaagcaatggaaatatatgctaccaactaccagcttcgaatgccactgatcagcccaagagccatggagtatcttcatttccgtcaactctctgctggaattaatgccattgtggccattgcctgttattctggttataatcaagaagattctgtcatcatgaaccaatcgtcaatagaccgtggttcatatagttctattttgcatgacatgaaagatggttcttatgataagctggatgatgatggtcttgtgccaccaggcacaagagtgtccggtgacgatgttatcattggaaagactacccctatatcccagggtcaagtattacgttacacaaggcgtgatcacagcataagcttacgtcatagtgaaaccggaattgttgatcgaattggtgacaaattcagtagtagacatggtcagaaggggatagttggtatgacttatacagaagaagacatgccctggactgtggaaggcatcacccctgatattattatcaatccgaatgctattccttctcgaatgacaattggtcagcttattgaataa

SEQ ID NO: 3524 - DNA, 489 bp, Glycine max
  Peptide Sequence Number=SeqID_95209
caaactgctgaaattatatggcaaggaagggaaaagccattggtttatcttgattcccttaaagagatatctctctatcaccttgaaggcatgaaaaatggtgagactgcctctgctcgactcgaaaattctgaacaagcagcggatgctaagcaaatatatcccaaagagtatacaatctggagagaagatccagccaattttatcatgaatggtagatatcctgtacgagatctctggaaagctgcaaaagattgttggaaggaaatgctgttgtcacctggagaaagctttctggttgtgactcacaaatctatactgagggcattaacttgcactgctttaggcctaggcccagagaggtttcgatctattgatattaacaatggtgggatatgtgtattcaacttcaatgtcagaggagaagcaatgcttgacgctttaaatacgacggctcatatgtacagtgatcatgtctatcctggctag

SEQ ID NO: 3525 - DNA, 2121 bp, Glycine max
  Peptide Sequence Number=SeqID_95210
atggctgggaatgaaaaggataatggttgtggaggtggatctgatggggagggtttgtcccttggaaactttagccaaggtgcctgcactacttttcttggacacacggataggtttgaattggaatatgggagtcactgtggtaatggtagttgcaatcctgttggtggtaatggagaattgcctaattttatgctttttcacgccactcgatgtgtggagaggcagaaggttcagattctggtgggtttccctgattccggctaccaggatgctgtgtttccatttcatccgaatacgacgttggtttctgaggggatgtgggatgagaaggagaatcgactatgtgcggttgcatgccggatcttgaacttcacggaatctttggttaatccttatgttggagattgcaagactaggctcagtttaaggtttcctgcagttttatctttgaggaacaggagtacggttttggggcagatttggagtgacaaagtggttggtgaatccgggtacttcagtaaagttggatttcagggttcgtcaagggtatcaaaaagcctccaaggtttcctatacaagtatgctgatactgagagggtgagaaaatcttgtgcggaaaagatgaatgctaaagggaagggaaatacatatccggatggatattcttctgatatggcatttagcatgttagtgacaaacagcagagggcaagtggctcaaggttactcatcaccactatctgtctgtgatcaaatttatagtggacagtcgtatggggctccatttgtgttgacaacgggaaagccaaaagcacatgctactcaatcagataagtacagcaatttgttgaatgtcagctatacgataagccttaatccccctcctgatttcaagtttggcagaggagtctcatcaaccaaagtcaaaattggggctgaaggaatttacaataggaatactggtgttttgtgtatgataggatgtcagcatttgagatcaacagacaaaatactgataaagaatgagactctggactgtgaaatcatggttaatgtccagtttcctccattgaatgcaaaaggaggtgaatctcttacaggaactatagaaagcacacgacaaaagtcagacccttattattttgatccgcttcagttgtcttcatattccatttacagaaaccaagctgatgcttccatttggagaatggattttgagttaattatggtattggtgtcaaacacactggcctgtgtgtttgtaggattgcaacttctccatgtgaaaaagcacccggatgtccttccttacatttctgttgtgatgcttgcagttattactctaggtcacatgattcccttgatattgaacttcgaagctttattcatggcaaaccacagtgtgcagaatacttttcttgggagtggaggttggcttgaagtgaatgaggtagttgtgaggatggtgacaatggtagcctttcttctagagttgcgccttgtacaattgacctggtcctcaagacagggtgagggaagccatcccggtctgtgggattctgaaaaaaaagctctttatatcactctaccattgtacattggtggtggattgactgcttggttggtgcacatatcgaagacttctcatcaaaaaagatttagaccatttcggctttcacgccacaagtttagtcttcctcgtgaacatttttaccgacctccttccctctgggaagactttaaatcttatgctggtttgctcctggatggttttctgctccctcagattctgcttaacataatatttaactcagaaacgaaagctctagcatcttccttttatgttgggacaaccattgttcgtatactgccccatgcatatgatctttatagagcgcacagttctgcatggtaccttgatttatcatatatatatgcaaatcatagaatggatttttattccacagcctgggacatcataatccctagtggtggtattttgtttgctctccttgtatactttcagcagagatttggcagtcggtgcattcttccaaagaggttcagagaaagtactgcttatgagaaagtaccggttattggcaatgacgatttatga

SEQ ID NO: 3526 - DNA, 78 bp, Glycine max
  Peptide Sequence Number=SeqID_95211
atggcaacattcctcatagaccagaccagacctgttgtgttcagcttcatcgtgggcaaatctcctttggcagtatag

SEQ ID NO: 3527 - DNA, 3555 bp, Glycine max
  Peptide Sequence Number=SeqID_95212
atggccaatctagctttgactagcatactagaaaagatgactgggaaggacaaagattacagatatatggccacatctgatttgctcaatgagttgagcaaagcaacgtttaaggccgatgctgatctggaggtcaaattgacaaacatcatcatacaacaacttgatgatgcagctggtgatgtttctggacttgctgtcaaatgtcttgctccgttagtgaggaaggtgagtgaggtaagggttgtggaaatgaccagtaaactatgtgacaaattgctaaatgggaaggatcagcatcgcgacattgctagcatagctttgaagacagttgttgcagaagtttctactcagtctcttgcacaatctattctccagactctcacgccgcaattgataagaggaattactggtcctggaatgggttccgagattaaatgtgaatctctggatattttatgtgatgtccttcataaatttgggaatctaatggcagcggatcatgaactattattaagttccttgctttctcagttgagttctaatcaagctagtgtgcgcaagaagactgtggcatgcattgcatctctctcttcaagcctgtcagatgatttgttggcaaaggcaactgttgaagttgttactaacttgaaaaataaagttgccaagtccgaaatgatccgtacaaatatacagatgatcggtgctttgagtcgagctgttggctaccgatttgggccccatcttggagacactgttccagtgctaattaattattgtactaatgcctcagaaaatgatgaagagcttcgtgagtacagcttgcaggcactggaaagctttctccttaggtgtccaagggatatttctgtttactgtgatgaaattcttcatttgacactagaatatctaagttatgatccaaatttcactgacaacatggaggaggatactgatgacgaaggtcttgaagaggaggaggatgatgagagtgcaaatgaatatacagatgatgaagatgtaagctggaaagttcggagagcagcagctaaatgtttagcagcattgattgtttctcgtcctgagatcttgtcaaagctgtatgatgaggcttgtccaaaactaatagacagattcaaagagagggaagaaaatgtcaagatggatgtatttaatactttcattgagctcttgcgtcaaactggaaatgtcacaaaagggcagacagatgcagatatgaggcaacaagaagtgtcgaagattgtcaaatctataaataggcagttgcgtgagaaatctatcaagacaaaggttggagccttttctgttttgaaagaacttgtggttgtattgcccaactgtcttgcagaccatattgggtcactcattccaggaattgaaaaagcattaaatgacaaatcatctacctcaaatttgaagattgaagccctaacatttacaagattggtattatcttcacattctcctgatgtttttcacccttacatcaaggctctttctgcccctgttctgtcagctgttggtgagcgttattacaaggtcactgcagaggccttgagagtatgtggagaacttgtccgtgttgtgcggccaaacattgaggggtctggttttgatttcagaccatatgttcatcccatatataacggcattatgtcacgcttaataaaccaagatcaggatcaggaggttaaggagtgtgctatctcctgcatgggcctcattgtgtcaacatttggcgatcatcttaatgcagaattacctgcatgccttcctgtgcttgttgatcgaatgggaaatgagataacccgacttactgctgtcaaggcatttgctgtcattgctgcttctccacttcgggtggatctatcatgtgttctagagcatgtggtagcagagttgactgcattccttcgaaaagctaatcgtgctctaaggcaggctaccttgggaaccttaaattcacttatagttgcttatggtgataagattgttttgtctgcttatgaagttattatcgtagaactgtcgggactaattagtgattctgacttgcatatgacagctcttgccctggaactctgctgcacattaatgggtgacaagaggtcaaatcaaagtattggtttggccgttagaaacaaagttcttcctcaagctttaacattaattaaaagctcattgttgcaggggcaagcactttcggctttgcaaaacttttttgctgctttagtctattctgcaaatactagttttgattctctgctggagtcactacttgcctgtgctaagccttctccacagtctggtggcattgctaaacaagctctgcattcgatagctcagtgtgttgctgttctatgccttgctgctggtgatcagaagtgttcatctacagtgaaaatgctcactgacattctcaaggatgacagcagttctaactccgctaagcagcaccttgcacttttatgtttgggggagattggtagaaggaaggatctaagtacacatgcacacatagaaaatattgttattgaatctttccagtccccttttgaagagataaagtctgctgcctcatatgctcttggtaacattgctgttggtaatcttccaaaatacttgccatttatcttggatcagattgataatcagcagaagaaacaatatctcttgcttcattctttgaaagaggtaattgtgagacaatctgtagataaagcagagtttcaagagtccagtgtggagaaaatacttaatttactcttcaaccactgtgaaagtgaggaagagggagtgcgcaatgtagtggcggagtgtttgggcaaaattgctcttattgagcctgttaaactcatccctgcactcaaggtaagaagaaccagcccagctgcatttactcgagctactgttgtcattgctgtgaagtactccatagttgagcgtccagagaagatagatgagatcatataccctgaaatatcttcatttctgatgcttatcaaggataacgataggcatgttaggcgagctgctgttttggctataagcacatttgcacacaataagccgaatctcatcaaggggcttcttcctgatctgctgcctcttctatatgatcaaactattgttaagcaagagctcataaggacagttgatcttggtccttttaagcatattgtggatgatggacttgaattgaggaaggcggcttttgaatgtgtagacacattgctggatagttgccttgatcaagtgaacccgtcatcattcattgttccttatcttaaatctggtttggatgatcattatgatgttaaaatgccatgccacctgatactctccaaactagctgacaagtgtccttctgcagtcttggcagtgttagattcattggttgatcctctccagaagactattaattttaagccaaagcaagacgctgtcaagcaagaagtagatcgcaatgaagacatgattcgaagtgcactccgagctattgcatccttgaaccgcataaggtttgtaatttga

SEQ ID NO: 3528 - DNA, 1590 bp, Glycine max
  Peptide Sequence Number=SeqID_95213
atgagccgaatccggaggcttgtctatgttcatctcattccacctgtgactgagaggggattttctagcctgagtgtggtcactgcacctcttgattttactgaaattcaaattagtcgccttcccactgtcgtcattctagggcgacctaatgtagggaaatctgcattgttcaaccgtcttattcggaggagggaggctctggtatataacacccccgatgaccatgttacccgtgacatacgagaaggacttgccaagttggccgacttacgattcagggtcttggactctgctggcttggaagctgaagccacttccgcttctatcctccacagaacagcttctatcactgcacacgtcttagcaaagtcacactttgcgctcttcctcactgatgcaagagctggacttcatccacttgatctccaggttggaaaatggttacggaaacatgcacctcaaatcaagcctattgttgccatgaataaatccgaatcactctttgatgccactggctctctggcttcagctgcaaacgaaatgtgccgcttgggatttggggatcctattgccatatctgctgagactggactcggtatgcatgacttatatatgtctcttaagcctctcctcgaggactatatgcttcgtgtcttcactgaagaaggtgctcgcgaaaatagccacaacgaggtcgaggacagcagcgaccttgatgttgacaaaagtaagctgccattgcagttagccattgtaggacgccctaatgttggtaaatcaactttattgaatgcattgttgcaagaagaccgtgttcttgtgggtcctgaagctggtctgacaagagattcaatcagaacccagtttgaatttcaaggaagaacaatttatctggttgatactgctggttggttgcagaggacgaagcaggagaaaggagcagcatccttgagcattatgcaatcaaggaagagtctactccgggctcatataattgctttagtactagatgcagaagagattataaatgcaagacgaagtatgaaacatgctgaagtagttatagccagacgggcagtggaagaaggacgtgggctggttgtgattgtgaacaagatggaccttctaagaggcaaacacaaatcgtcatcctatgagaaggttatggaagttgttccacaagaaattcagacaattatacctcaggtaacagggatcccagttgtattcatttcagcattggagggaaggggccggaccactgtcttgaatcaggttatgagcaggcattcttggaaagaccaagcagcacagcctaaggttaagtatttcactcaggtcaaggcccggccacctacatttgttgcgtttgtgcgtgggaagactcagctttctgatacagacattaggttcttaaccaagtccttgaaggaggacttcgatttgggtggaattcctatacggatcatgcaacgttctgtcactaagaaagatgccagtggaagtggaaatagcaagaatagccattcggtatgcagagtggttgaaaggactgtctctgacaagagaagtatcgtagatgaataa

SEQ ID NO: 3529 - DNA, 996 bp, Glycine max
  Peptide Sequence Number=SeqID_95214
atggaaggagtaccgcacccaatacccagaactgtcgaagaggttttcaccgattttaagggcagacgcgctggtttgattaaggccctcactactgacgttgaaaagttttaccagcagtgcgatcccgagaaggagaatttgtgtctatatgggtttccaaatgaaacatgggaagtgaatttgcctgttgaggaagtgcctcctgaacttcctgagccagcattaggtataaactttgccagggacggcatgcaagagaaggactggctatcactggttgcagttcacagtgactcatggctgcttgctgttgctttctattttggtgcccgctttggatttggtaagaatgaaaggatctctacaatggcagagcatcggttggcagtgggggcatgggcttgttggtggtatacttggacggtggaaacaattatgtgcaaagtgggtttgcagttgagtcaaattggttttctggtggtgacggagaaggaagaggtagaagattttaataaaagtgctatggtcagggtgcaaagtggctttggattttggctatggagatctgactactgccatgatgagtctgggaggaaaaggctttttcagatgataaatgatctgccgacaatcttcgaacttgtgacaggaagtgctaagcaattaaaggatcaaccagctgctcacaacaatggtagcaaatgcaaatcaagtggaaaggtgtcccatcagtctgagtctcaggccaaggggatgaagatgtctgcaccacccaaagaagaggatgagagtggagaagaagaagaagatgatgaacagggtgcaacatgtggtgcttgcggtgataattatggcactgatgaattctggatctgttgtgatatgtgtgaaagatggttccatggtaaatgtgttaaaattactcctgctaaggctgagcacatcaagcaatacaagtgccctagctgcagtaacaagagggttagagtttga

SEQ ID NO: 3530 - DNA, 270 bp, Glycine max
  Peptide Sequence Number=SeqID_95215
atgctgacgataagagttgcattgcattgcacgactacgtcaatgctacactccaatgagttaatggcagtctccaccaggcaccagctatctaactgtgaatggaagaaggagaaacagctgatggagattttcgtagaactaagctttagtaagttcaaaaccagaagcactggacctgctttaaaaaagtttgtcagtattaattatttcttctgctcatcttcagagcaatcaaaagttatacaactctgcataagatctcagtga

SEQ ID NO: 3531 - DNA, 426 bp, Glycine max
  Peptide Sequence Number=SeqID_95216
atgccattcgaaaaactcagagtgggagagacagaaatttggatatttcagatggagaatactatgcctgataagctgtcaaaaaatgtattactgattggcggttcaacgggcaccatgctggaagctttagaagttgtaggtagtgacagtcctgtcgagagtcctttggcttcggttagtaccagaacgaattttgagggaaacaatgtgtatatttctcctgatgatgaagaaccgtcatcagggaacaaaatcaagatgaagctacaagaattccaaaggagtgctgcatcttttacagcaatagataaaaactacctcaccccattcttcactagtcaaaatggagatgaagaagatgaagctgtgcctttgactttgaagaacgtgggattggatgaccacgaccactattcgtcatga

SEQ ID NO: 3532 - DNA, 1191 bp, Glycine max
  Peptide Sequence Number=SeqID_95217
atggcaacaactatggaaatgatagagatcccctccacaaaccacaaaaaccacagaaatgagatggctctgatgccatgtcaaagatcaagtggtatcatgataaaactaaagaaaggttttagggaaaaaactgtatgcttctctggcctttatctcattaaatatacagatccaatcctttataaatacgcgggagattacaggaattttgtcctaaagtctagcctggagactattctgtcagatacaatctattcatgcttggcctcagtagctggtgttacatgtcagctgatcatcaatcgcaggatcaatgaagctgtccataaatcaactagaacagaaaggatgaggacccttaggtctacaagttctaccagaaaggtcaacactgccagccttcaggaacacttacctgtgctgtatccagaagttgttctatctgtagaggtttaccataatgttcgaaagggtaccaagatccaagagttgttagttcttggaggtcagaccttaactgctctgagggacaagattttttgctcaacggaccaggtgatgcacaaagctgggcagcatgatccttctggttattttctcatcgaagtatgcttaattacttacactcacaatgctaaggtggatgtattctgtcccgatttgagggatccgtctgctattgatctcacaagacctatactggattggctcagagactccaaggaggaggcccaaaagaaatgggaatatattataactggggaactgcagaagaaacaaaaggcaatcatgggtgagaaatctgcatcacaattgcctcattttagatccattgagatgcataagatacgtttttgtgacttaagctttcaacttggtgctggatacctctattgtcatcagggtgactgcacccataccttagtgatacgagatatgaggttaattcaccctgaagacgttcataatcgagctgtttatccaataatcacgtttcagttgaagttgcgttttcagaaatgcaatgtttgcaaaatattcagagctacaaaggtcacggtggatgacaaatggacaccagaaaacccttgttatttctgtgatgaatgtttttccctacttcaccaagcagatgatggcactctattatatactgactttgtagagtatgattacaaccatgattaa

SEQ ID NO: 3533 - DNA, 1470 bp, Glycine max
  Peptide Sequence Number=SeqID_95218
atggattctgttcctgttccatccctgtcagcctcctcgacccttacggaagaagtacaagtgactgcattgcagatgattgaactgctaacatctaccactgatgaacatggtggtgttattgtggaaatggacaagcctatggattctgcaacttttgtgtccatcctcagagcttcaatttcacactggaaacaactcggcaatatgggtgtttggataaaatcgcctattcatctagtcagtctagttgaagctctagttaaggaagagggggttcaacatatcttacgtaaaggcaaagttgataaacaaattaacacaaagatgatgatgagctacttttgcggctggcacgcccttgccatcttggtgctaattgcatctccggcagcaggagagaacaaccaccctttgttggagttattatcaagtagagatgaagtggtgcaaattgctggctatggagaggagaagctatcgacagtcctcattacaggctcagttaattgtgaggcaccacatcagcctcaacctcaacctcatgcatggccagtacaaggagcttctgttgctgtgaactgccagagccatgggaggaagtggaaggggaagtcaatggtagcaaggggtgtaactgatgaatttggagactttatgatcgacctcccttcccaccttcatgcaattcctaacttggaaagaccaccccttaatgtgaacgtgactcgtgaagaagaagcaactgtagctgatgagaacgccatgcctcagtctcctcccaccacccctacgactacccattcccccctcttattcgctcctcaggttcccgtggttccgctacaaagacctgatgacattcatgttccaagttgttcctggatggagacaacttcagggtatgaagatatgtacactcaagtaggaatcccaacaatgattacttggagttatgatggaaaggaagtagctgtcgagggatcgtgggataattggaaaacaaggtttagatacaatgcccctgcagagatcagggaaggactttgccttaatgaggtacttccgtctggtgtttaccagtacagatttattgtggatggacgcaagaagtacactccagattcgccttgggcccaagatgatgctgggaatgcttacaacatcttggacttacagcctcctcaatcaccagactcaagttatgataacttacatcttagttctgaagattatgctaaggagccaccattagttcctccactcttgcaaatgacactgctaaatgtgcctgcaacaaatatggaaatccaacctcctatgtcaagacctcgacatggagtgctgaatcatctttacacccagaaaggaaagagcagtccttcagtggctggccttggtacaactcatcggtttctagccaaatatgtcactgtggtactgtacaagtcgttgcaaagtaaaccataa

SEQ ID NO: 3534 - DNA, 2010 bp, Glycine max
  Peptide Sequence Number=SeqID_95219
atgggatcgcatgagcatggtgaaggagtcacagatgctgattttgatctagttacacaaattcatcatgagttcgttaaatcctatgtgggaagttctgagaaagcgaaagaagcaataatatactcttacactaggcacatcaatggctttgctgccatgctggaagagaaagaagctgctgatattgcaaaacatccagacgttgtgtcagttttcttaaacaaaggaagaaaactacacactactcattcgtgggaattcatggacctggaagggaatgatggggtgtatggccagaatctccgagctttagagatgaggggatgggacctataccatcaaggtggaaaggaacttgtcaacatgatcacaccggcttccgttgtaacagtccagttcgacgatgactactgtgatttgtttatgagagtgcttcacaagaagctgataggagcaaggtacttcaacaaaggttatatggcccatgctggagctgatgcaaaatttaaccgttcactgaacacagcacgagactatgagggtcatggatctcacacactatcaacaataggaggaacctttgttcctggggcaaatgtattcggcttgggaaatggaactgccgaaggtggttctcctagggcccgtgttgctacttacaaggtgtgctggccaccaattgatggcaatgagtgctttgatgctgatatcatggcagcctttgacatggccatacatgatggtgttgatgttctttccctctctcttggagggaatgctacggattactttgatgatggcctttcgatcggggcctttcatgctaacatgaaaggcatccctgtcatatgctctgcagggaattacggaccaacacctgcaactgtttttaatgttgcaccttggatactaacagttggtgcaagcaccttggacagacagtttgatagcgttgttgaactccacaatggacagcgcttcatgggagcaagcctttctaaagctatgccggaagacaagctttacccactcatcaatgctgcagatgcaaaagcggctaataaaccagttgaaaacgctactctctgtatgcgaggaacaattgaccctgagaaggcgaggggcaaaatattagtttgccttagaggtgtcactgcaagagtggaaaagagcctggttgctttggaggccggtgcagcagggatgattctttgtaatgatgagcttagtggcaatgagcttattgctgatcctcatctcctgcctgcatcacaaattaattataaagatggtcttgctgtctatgccttcatgaattcaaccaagaatccgttaggatatatttatccacccaagaccaagttgcagataaagcctgctccagccatggcagctttctcttctagagggcccaacacagtcacaccggagatcctcaagcctgatgtcattgctcctggtgtgaacattattgctgcctactcagaaggggttagcccaacaaatctgggatttgataagcgcagggttccttttatcaccatgtctggaacatccatgtcttgtcctcatgtggctggagttgttggccttctcaagactctccaccctgactggagtccagcagttattaaatctgcattaatgacaactgctaggacaagggacaacactggcaagccaatgcttgatggggggaatgatgctaaggcaacgccatttgcctatggatctggtcacatcagaccaaaccgtgccatggatcccggggtgaaaaatgttgggccaccaggcacttatactgcaagactcaaagtaccagcacgtctttccatatctgtggagcctaatgtgttgaaatttgacaacattggtgaagagaagagctttaagttgacagtggaagttacaagaccaggtgagactactgcatttggaggtataacttggtcagatggcaaacgtcaagtgaggagtccaattgtagttgggggggttagagggtag

SEQ ID NO: 3535 - DNA, 420 bp, Glycine max
  Peptide Sequence Number=SeqID_95220
atggagcagcagaagatgaagagagcgagagaaggagatgatgaaactcagaaggggtgttttgagaataacgagaacgcaaagaaaagagatgaggagggttgttcttcagaggcacttggggtatttgatttcccttggctgaaagatggtgtcacgactaaaccagaggactacttgatggatttggaagacaatttatcgtcattgctagaacaagaagactcttcgtttaaagctgcaactgcatgtattgatttctcgtcagaagcaaagttggaggatcttgcatggcagccatttgaaagtgatgtgttggagcttgaagcagatgatgtggattacatttggagctctctgctcaaacagcctctccgaccacatccagcagcaacaatattcagtataaatattgtttga

SEQ ID NO: 3536 - DNA, 129 bp, Glycine max
  Peptide Sequence Number=SeqID_95221
atggcaatccttgaaaagaaaaagaaaaaaacagaaatgaaattattcatgacatatgagatacagtattttatagatggtggtggcgtgagcctgggtcctctacgtgttggtcaatcaggaggttga

SEQ ID NO: 3537 - DNA, 2352 bp, Glycine max
  Peptide Sequence Number=SeqID_95222
atgcgtaaggacgaagccaaggcccccggcgccatgccgcagcagcagcgatcgcacatccagttcttcgtgcgaatgatgtctgccggaaacacgattgtgatgcaagccttccccgaagacacggtcaaatcgattcacgagcgtatccaaagcatgaagggaatcccattgttcgagcagaggttaatttatcgcgggaaacagctccagtgggaacagactcttgccgagtgtttcattcaaaacgacgccaaccttcaattagttggccgtatgcgcagtaccgaacaccctcaagcctggcaagttatcaacgacatggtttctctcgtttaccgtctttgccgcggcgagacggttcacgatgccttgaaaaccgtcaagggtttgatgaccagttacttgaacatgactcccagaattgacaacgactctgcctctggctactttcagattttcatgtcttcttctgcccccgctgtgcttgttatgctctatgtgtccccttacgcaggtaacaaggactgtgctgattcctctgttagacactttttgagttcctgtcgcaatattttgtccaaggcattgcacggccagtgtgcgcgtgtggtgttggagttttgtaaattgcttaggagagtggggtctcacgaccctttgtatctcttttgtcgtagtacttttgggtccttgttggaaactgctggagtttcctatggttccggttcggataatgttaaggggctggttttgattcaggatattttcccctttgtttgtgagcttgctaacagcttgttgagggatctggacttgagtattgtgtccccctcggccgcagggcctttgtcaaacgatgttggggatttttctgcattcttactgcctttgaggactggaattaaggagcaacaggctgtcaaggattctatggctcaagacaaacaccacaagctcacagaagagattgaatatcttcatggtttgtacgttcagttgttgaacaaaattgatcagtgccttcaaaaaatggaccagagtttggctggccaggaaatgatggagggggataatctttatcctgcctggtctcattatctttccatcttgaaggagttgtatcaaatttcaaagctttatgatggtgctgaagaaaagctttggggtgttttgacgcggcaaagaagtgtgctatgtctgctgatagttcgatatgcgaagagaactgatgagcatcagtggattctggagcataggtatgtaaccaattttgagtctagaaggcatttggccatgatgatgttcccagaggtaaaagaggactatgaggagttacatgagatgcttattgacaggtctcagttattgactgagtcttttgaatacatcgcacgtgctgagcctgactccctgcatgctggcctgtttatggaattcaaaaacgaggaagctactggcccaggtgtattaagggagtggtttcttctggtatgccaagcaatattcaatccacaaaatgctcttttcgtagcttgcccaaatgatcgaaggagatttttccctaatcctgtttttcttgaggaatcaaggggagtagtcaatcttaaactttggagacagacattgaaaacaaagggttttcacttaagtaggagtaagatggagtatatgcattcaattatagtaagagatgagaaatatgacttggaggtggtttggacatgtagaaaggaggcatcggaggaacattggaacttggaagtagattgcatgagtcttagtcctatgaagaggagaaggagaccaagaagaacattggaactcggaacatctaaggtacatcctctgcaccttgagtacttcagcttcgctggtcgagttattgcattagctttgatgcataaggtgcaagttggtattgcttttgatcgtgcgtttttcttgcaattggcgggaaactatattgctataaaagatataagggatgcagatccttatctgtatactagctgcaagcaaatattggatatggatgctgatttgattgattcagatgcattaggactgacatttgttagggaggtggaggaattaggacagaggaaagtggttgagctctgccctggtggaaaaaatcttgcagttaatagtaagaacagggacaagtatgttgatcttcttatacaggatcacttcgtaacatccatatctgagcaggtatcacattttgcgaaaggttttgcagatattctctcaaactcaaagctccagcagtacttcttccaaagtttagaccttgaagaccttgatacgatgttgcatgggagtgttgccatgttttcgttgtag

SEQ ID NO: 3538 - DNA, 240 bp, Glycine max
  Peptide Sequence Number=SeqID_95223
atggggggagggggggagtcaagcaagagcatacagatagaagcatttcatgttttcgagccgtttgctgctaaccaaaagaaagcagctgatatcatcagcatatttgttgcaaacagaagcaagcttcttagacttttgggtgacttaaaaatcgataaagaggatgaacagttcgaagctgataaagctcaagttataaaagaaattgctgctcttgaacctagggacatcgcttga

SEQ ID NO: 3539 - DNA, 606 bp, Glycine max
  Peptide Sequence Number=SeqID_95224
atgggtaataggctctgcgttctgctgtgttaccaaataccagatgacaacaacttgaagagagagaagatgcaaggaaggttttgcaagatattgaaaagaaagaaggagatggagacagaaaagaaggttccaaatcagactctagaagattggatattaccttctcctggtttgaagccagactacgttataagaccaggcgaattctcatcttcatgttcatctaagtctcagaaaaaggtgcacccttgtgtgagtaaagttcaagtccccggatcattgatagctgaagccaaagacagtttatgcttggacagacccatgaacatgaaccgtaatgaagaagctgaagaattgttaagttccacatcgattgggaaatcacagaagaaagtgagctttaaactctctcataatgtcatattttactcacctgatgagccttgttcgccagagccttattattataatagcagtgaaagtgaaggctcattctactcatcaatctgcagagaatattcatttgacccttctgcagacgaaacattgatcaaactcgcagtggatgttcttcctcatgtctctgtctcttccaaaatttga

SEQ ID NO: 3540 - DNA, 108 bp, Glycine max
  Peptide Sequence Number=SeqID_95225
atggggtactcaaagcttgatcaatctgcagccgataacaacacagagaaagagaaagagaaaatgtgtaaaaatgttaaaggcgtttcaacaaatgtggaagcatag

SEQ ID NO: 3541 - DNA, 234 bp, Glycine max
  Peptide Sequence Number=SeqID_95226
atggacacccgtctccgtgtgattggtgatcccatgaatggagttcaacggagcaagagcattggtgttcataaggttcggggatcctttcgctgcacacgatcggaaccaacgggttgtcgtatcttgggagaggagcgcaatcagaattttttacccgtgcagtgggggcgttttctctctaaggatagcgtttacgcgcttcaacccaggctatttaattctttcccttaa

SEQ ID NO: 3542 - DNA, 825 bp, Glycine max
  Peptide Sequence Number=SeqID_95227
atggagacgaaaagccactcaggaagtggaatcagccctagcgcctcaccggaattcgagttctggatggttcgaaacccctctttcccacaaccaaacattctctccgccgatcagctcattgtcaacggggtcctccttcccctccacctcctaaacaaacccgacccatctcctgctataaccgactcctcctcctcctcctcctccgccgccaccgcgtccaagcgctggaaggacattttcaaaaagagtgacaagaaaaacacagacgccaagaagctcaaagagaaaaaaagcggtgtcacaacttcagcggagctcaacatcaacatatggcccttttcccggagcaagtccgccgggaacgcggctacccgacccaaaccattcgttccggcgacccggaaagccaacagcgcgccgtgttcgcggagcaattcggcgggagagtccaagtccagaaaatggcccagcagcccggcccggcccggggtccatttaggaaggagcagcccagtctggcaggtccgccgtcccaagaatccagtaccggaacctctcaaccctgacatcaacaagtccaagcgagaaagtcaccggagcaaggtggtcggcgggagtggcagctcgaaaacgaaggttttgaatttgaatgttccaatgtgcattggttacagacatcacttcacctgcagaagcgacgagaacagtgccattcgtgtcagtaacccaaacccacctcatgctcatgccaatgttggtggtaaactttttactctgcgcagcctcttcaccaagaaaaacgttgtaacctctcactag

SEQ ID NO: 3543 - DNA, 471 bp, Glycine max
  Peptide Sequence Number=SeqID_95228
atgaacaactcaaagcaacagaagcagcagcatcagcttcaacaaagaggatgcaaggctttgtgttgcagttgcaggttcagtgtttcttcctctgaggaagcagaaagctcatcagcctctgacaggttcccttctgtttcaagccttgcacatgccatggtgcaagagagacttgaccaaatgattagagctaggcatgtagagagaagaaggcagcagagcagagaagggaccaagtttgttgtaatggtagcaatggagaagagctcttatgatccaagagaggattttagggagtccatgatggagatgattactgcaaaccgccttcaagacgccaaagatcttcgtagtctattgaactattatatctcaatgaactctgatgagtaccatagtcttatccttgaggtttttcatgaggtttgtactagtttgttcttatcatgtaaatgtcataattggtaa

SEQ ID NO: 3544 - DNA, 1638 bp, Glycine max
  Peptide Sequence Number=SeqID_95229
atggcgccgtctttcgcaatcaacggtggtttccccggcgccagagtcactcctccttccgtcaccggccgcttcgccgccgtctacagcgaggtccaaaacagccgcatcgaccacgaactccctctcccctccgttctcaaaaaccctttcatcatcgtcgacggtccccaaagctccgccgccggcaaccctggtctcgcttcctcccatttgcttcttcaattttccgttaacaattccagttattacctgcaagaccttgcagaaggaagcacattgtatggtttcaggggtggtccagctggcatcatgaagtgcaaatacgttgaacttacctcagactatatttatccttacagaaatcagggtggttttgacatgattcgcagtgggagggacaagattgaaactccagagcagtttaaacaagctgaagaaacagtgcagaagctaaacttggacggccttgttgttattggtggagatgactcaaacacaaatgcatgcctccttgctgagcatttcaggagtaaaaatatgaaaactcgtgtgattgggtgccctaaaaccattgatggtgatttgaaatgcaaagaagttcccacaagttttgggtttgatacagcatgcaagatatatgcagaaatgattggcaatgttatgatagatgctcgatcaactggaaaatattaccattttgttcggcttatgggacgtgcagcttcgcacattacactggaatgtgctttgcaaactcatccaaacattactattattggagaagaggttgctgccaagaagatgacactgaaggatgtcactgactacattgttaatatcatttctaaaagagctgaggataattataactatggggtcattcttatccctgaaggtctaattgattttattcctgaggtccaacaccttattgcagaactcaatgaaattctggcaaatgacgctgtggatgagggagggctatggaagaagaaactcaccgatcagtcattaaagctttttgaatttttacctaaagcaattcaagaacaattaatgcttgaaagagatccgcatggaaatgttcaggttgccaagatagaaacagagaaaatgcttattcaaatggttgaaactgagttggagaagagaaagcaacagggcacatataaaggaggatttagggggcagtcccactttttcgggtactccgtctattttagatatatcattcttggagttgtaagctatgaagggagatgtggcttgccaactaattttgattctacttactgctatgcattgggttatggtgctgcagccctccttcaaagtgggaagactggattaatatcatcggttggtaatttatgtgctcctgtagaagaatggactgttggtggaactgcactcacttcattgatggacgtggagaggagacatggtaaattcaagcctgtgatcaagaaggcaatggtggagcttgaaggggcacccttcaaaaagtttgcctccttgagggatgagtgggccctaaaaaattgctacattagtccaggtccaattcaattcactggcccaggatctgatgcaattaatcacactttactcttggagcttggtgcacaagcttaa

SEQ ID NO: 3545 - DNA, 1131 bp, Glycine max
  Peptide Sequence Number=SeqID_95230
atggaaatatcttttccttggattctggtggccacaatggtcatggcaatgcggccactttcatttcgcataaaagcaaaccaactttcttacgactactacaaattttcatgcccaaacttggaaagcatagtcaagagtgagttgctaagcttattcttgacagatgctactgcaccagctgcatttctcaggctcatgtttcatgactgccaagttcaaggatgtgatgcctcaattctgttggactccaactacctagctcacagtcacagctctgaaatgatatcttcaaggaactttggcatcagaaagcgcgaaacgatcggccaaatgaagtcaatattagaagaagaatgtccgggacaggtgtcttgtgcagatatcattgtattagctgctaaggaatcagtgtcgctctctggaggaccacatattgagatcccacttggaagaaaagactccagaacttgtagtttccatgaggccgatgctaagcttccttcaccaataataacggttgatgaatttatatccattttcatgtctataggaatgaacatcgaagagtctgtttccattttaggcgcacatacactagggattggacactgcttcaacattgttggtagattgtatgatccacggctaggggacaagatggattttgcgttggaagcctctctaagactagcatgcccaactgagattcctttgacaaacctcacatttgtgcctaacgacatgaccccagttatatttgacaaccagtattaccgggacattatgatggggagaggcttgtttggtattgactccagcatttctagagatccgcgaacagcaccctttgtcatgcggtttgctatggatcagaactacttcttcaaggctttctcatcggcatttgttaaactttcttctaccaatgttctcacagatgtgcagggtgatgtccgaaggcaatgcaaccaggcgaggggtccttcaaatttacgttccattaagatatcgacattagtacctatgttatgtccctcactctgttgggttgcgttttatatcaccatctactatctagcttgtaaaggaaagaaaagcgtcacgcttatgacaaagcttcaaagttga

SEQ ID NO: 3546 - DNA, 981 bp, Glycine max
  Peptide Sequence Number=SeqID_95231
atggtatccgcttccgaaccagatcgatgctcgccaacttcgaggactccgaggcgcctctcaagctcccgtagatcccaatcccaatcttcttcgtcatggtatccaaggaaacgaaccaaactgcttctcgcgcttattgcgtttctcgctttcgttttcttcctcaattggtttatgcttctccgcttacagcatcagcacgatgcacccgatcctattcccaaacctacactccgttcctcctccgtttcactttcccttcaggggaaatggaacaagcctgcaaataagaaaaaatcacaaaaggggaattatgcaaggatgctggcattggctgcacatgccttggcagagaataaacgcgaaccgaaagatttgtggcaagaacccttcgttcctgcttcttcttggagaccttgtgctgatcagcggaattgggaacccaatgaggggggaaatggatacattttggttactgcaaatggtgggatcaatcaacaacgagtagctgtttgtaatgctgtcgttgtggcccgtttactcaattcaactttagttatccccaaatttatgtacagtagtgtatggagagatgtgagtcaattcagcgatatctatcaggaggagcattttattaactacttgactcctgatattcggatagtgaggcagcttcctaaggagctacaatctttggacttggaggccattggtagtgttgtgacagatgttgacatggagaaggaggccaagccaagtttttacttgaaacacatcttacctattatacttaaaaatcaagttgttcactttgttggatttggtaatcgcctggcttttgatccaatagcatttgagctgcagccttactatgctcttcctaattggggaacttcatatagagatttcgttgcagatgtaattttcatgccctgcaatttgttcccagaatacaagaaaccggtgctctgcttctaa

SEQ ID NO: 3547 - DNA, 957 bp, Glycine max
  Peptide Sequence Number=SeqID_95232
atgttattactaattctcattcactcattgttgttgagtctcacaacaagagctcaatccacgccatgcagaacttcttgtggtgacattcccatcgaatacccttttggcattgacgatgggtgtggaagcccatactaccgttacatcctggtttgttctgactcaggaaaactccaagtcagaaccccttctgggagataccacgttcacaacgttagctatgctgatccacacattctggtcactgatccattcatgtggaactgtgacgatggtgagaattaccgtcccacaaggcctttcagtttggacaccagcacacgcttcaagctttcccctcagaatgagtacctcttcttcaattgcagtgaggatcatgtgatcgttaagccaaagcctattttctgtgagcgcttccccgagcgttgcgattcttcgtgtgacagtggtagctatctctgcaggcacatgccagggtgctcctttgctatgactggtagctcttgctgctcttactctccaagatccattgaatcgttgaggttgatgctcaagtattgtactagttatactagtgtttattggagaaacgttggtgctcctcagcctcacgatcaagttcctgaatacgggatcagaattgattttgatatccccgtcactacgcgctgccttcagtgccaggatccttccaaaggaggtggaacttgtggatttgacactcagactcagagtttcatgtgcctttgcaaggaaggaaatttcactacccattgtaaagattatgatgctgcacggcacaacagaaaggtccatgtgattgcagggacagtgagcggtgtttcagctgcaggggcatttggaattggagctggtatttggtacttgaagaaagtgagagctaaagcgccagtaacatgtggagttcaaagcaacgagaatagacttttctga

SEQ ID NO: 3548 - DNA, 255 bp, Glycine max
  Peptide Sequence Number=SeqID_95233
atggaaagtgggaaaagcttggaaacatgtggcgagcttgtggttgagcaaccccactgcgatggctcaacagcatccctatggaatcaatggatgagcacatgtgattctgtcattctggttcactacatgtatccattatgctatgtgctcacgaagctcatgacccttttaactcatacgagttttcacatgttgaaatcaataacaacgctactggttatattcttcgcctgttttgtacctctcgtctag

SEQ ID NO: 3549 - DNA, 249 bp, Glycine max
  Peptide Sequence Number=SeqID_95234
atgacacaatgtcatgaaaccttggggtcatccatgatgaattcctatatgttctacatctggtgcattcttgacaaagctattgaagtagaggagaggcttcatgctgactttttgaggctgaaccacattgagggatacctagaactatcagctaagacaaagatctacttttcaattgctgttgccttgtgggatgcagaattttatgtcaaagttgacgatgttcatgtgaatttaggtgaatag

SEQ ID NO: 3550 - DNA, 1344 bp, Glycine max
  Peptide Sequence Number=SeqID_95235
atgaacactcgcaaacacccaattccttcaggccgcaacttcccttccgtcaatttccgccgcacctcccccaaaactcacctttccgccaggaagcttgcagcgcgcttatggcacttgcgctttttcaagcccaagcttcaatcttctccgccacgtgtcaagcttacagagcaagagggtaccaaacgcgccaacactcctatccggaagcttcttagagaaaccaaattaataggtggtgactctgttctcctctcagaactccttcgtgctcaaacctgcattaacaagctcaaagctgaacacaagttctccaagaaaaagcttgaggatgaaaagcttctctggaagcgtcgagaattcatcaagaatcaagcgctgctagaggacttgaaggataagttagccagggaaaggacaagtagagagagaatggaatctgtgaatgccaaattgatacatgagcttgccgaagcaaaactatatgccaaacaatttatggttaactacaaggaggaaaagaggaaaagaggaataattgagcaagtgtgcaacgaattggcgatgcaaatgggagaagacaaggctaggctggagggaattcgcgtggaaatggaggaagagaggaacatgtttcgcatagcatggctgttgcgtgaagagagcatccaaatgaagctgctcgacgcgaaacttgccctggaagataagtataatcacatgatccatttgattgcgcatctgcaaagtttcttgagctcaaggggtcatgaactgggcgccatggacgctcagttggtcaaacaggcagctgaatcactcaatcttgaactttcatatgacttggccaagtcaaatgatgtttttgatgagatcaaaattaaggagagtgtgtttaaagttgaaccctactacccttccaatctcattggcccctcatccaccgtccacattgtgagtcttgacgaagatcattgcctcaacaataatgctaaccaaaacattcatggattagaatgttgtgaaaatgcagaggatggttgttacgagcactctgattctgtgccacaacaaaagtcacaagattcaaaaattggtaagcgtaaagggagactcgcaagaaatgcagttaagagcggtgggaaaggttcgggtgaaagtggtttcagacaatgggaattattgggacaacctgtgaatccgcacataactcgtgggatgaaaggatgcatcgaatggccacgaggcattcccaagatcaattccaaggtcatcatccctttggaagaaagagtgcgaaaacagaaatctcagttacaacatatacttaagcctcattaa

SEQ ID NO: 3551 - DNA, 1524 bp, Glycine max
  Peptide Sequence Number=SeqID_95236
atggagaagaacactccattgttgacattgagaagagaagagaagcaggagaatgcaatgggggctttgtacatgtcagttatggagatactcttgttcctcttcatattcatatgctctctcacaccaatctcacagtcacagggattacatcaatctcccccttttctctttggcacttcttcttcttcgtaccagtatgaaggagcttatttgagtgatggcaaagggataagcaactgggatgtcttcactcacaaaccaggtagtatatctgacgaaagcaacggtgatgttgctgttgatcaataccaccggtatctggaggatattgatctaatggaagctataaaagtcaatagctaccggttttcaatatcatgggcaagaattctaccaaaaggaagatttggagaagtaaacttggcgggtatcaactactataacagacttatagaagcattgctactcaaagggatccaaccatttgtaacattattccactttgacatccctcaagaacttgaggacagatacggaggttggcttagtccccaatcacaagtaaagtactgggtaaccttcaatgagccaaattatctagtcccacttgcgtaccgtttaggtatattcccaccattgcgctgctccagcaaatttgggaattgcagtgagggagattcagagaaagagccctttgtggcagcccataatatgatcctatcacatgcagctgcagttgatctttatagaaacaaataccagactgagcaggggggggaaatcggcattgtcctacactgtgactcatttgagccgttgagcaattccacagcagataaattggctactgaaagagcacaatcattcagcattaattggatcttggatccaatcttatttggtaagtacccaaaagagatggagatgattctaggaaccaccttacctaaattttccagtaatgacaaagcaaaactgaggcaaggactggatttcattggcataaatcactatgcaagttattatactccgtttgattggctcagtgtttacccactaggcatgaagagtattcttatgtatctaaaagacagatataataacactccaatgttcattaccgaaaatggatatggcaatttgtatgatccagatcttaccgaggaagaatatcttaatgattttaagagaatagagttcatgtctggtcacttagataatctaatggctgcaataagggaaggagcagatgtgagaggttactttgcctggtctttgctcgacaactttgagtggctatatgggttttcagtgagatttggacttcaccacgtagatttttccacgctgaagagaactccaaaattatcagcaatttggtacgagcatttcattgaaaactataaactaactgatagcattgtgcccgaacatggcagagaaaagggaatctggaacaagccaactacccaactcagaaccttagtaagtccagagcctagaatgaataacttggattaa

SEQ ID NO: 3552 - DNA, 627 bp, Glycine max
  Peptide Sequence Number=SeqID_95237
atggcccaacgtactttaactaacagatcctttgctgtcaaggatgaggtgttctgcttgtttgagggagcccttgacaatttgggaaacttgagacaacaatatggactggccaagtcagtcaatgaagtattgttggtcattgaggcttacaaagctttgcgtgaccgagcaccctaccctgctaatcatgttgttggccatctcagtgggagctttgcttttatagtttttgacaaatctacttctaccctctttgtggcatctgatcaatatggtaaggtacctctgtattggggaataactgctgatggctacgtagcatttgctgatgatgcagaattgcttaatggtgcttgtggcaagtcacttgcttctttccctcaaggatgtttctactctacagctgttggaggattgatgtgctatgagaatcctaaaaataagattactgcagttcctgctaatgaggaggaaatctggggagccactttcaaggtgacaaaatgtaacctaggattcccatcttgtgatgtcacggttcataaattctcaaagtcttttaaagttaaccttagaactcatttgaacgaaatttcactgaaccaaatggtagttgtcctatag

SEQ ID NO: 3553 - DNA, 435 bp, Glycine max
  Peptide Sequence Number=SeqID_95238
atgtcacagtcgcacgaagcactgattctcatccaaaagatggtgaaagtgcctccaccaaaagcactcttgttgttcaacaccgcaacctatcaaggccttcaccacactccccactccatctccttcatcttaaaccttctcctttcctctgacatgctactccaagctcaatctctcatcctacgcctaatctctgcaattttcaatgcttatgttcattccctcacttttctacaccacatgattcactggggtcatgttcctagatcaaacactgatagggatagtactgcaggaagcaaaggatctacaagaagcaagaagtataaggccaaaacggaaggcaacaacctcagcccaatatggttagctgtgacccatgcattcatgcatcagtacatagaaagcgcaaaccagcaaaccttaggctag

SEQ ID NO: 3554 - DNA, 747 bp, Glycine max
  Peptide Sequence Number=SeqID_95239
atggctttttcttttggccatgagttgccttatttgaaaagctcatcgacatcagagaacgcttcctatggttcgagtgcagcaaccactccaactcctcaacgcaccaccctttccgatgtgggactaacaaatgcatgcaagcaagccaagggcactgcttgcattacctgcaccaaccacactcttaaaacaggatgcacaaacaacacgtgtggtgtcgatccattcaaccccttgggcgcgttcttcgtaagtggagacgtggatgaagacatctatcttgtcctccgtccactttacacgtgccacgcttcatttctgcatgtgttggggttgatggctttctgcaagacctcgccaagtataacaatctttgatgatgatccttccagtgagtactttattgacgacaagtcaatcaaggttgacggcaaaattgtcaaccttaacacctgcctgctttctattgacaaacagggaaatgggggcagcaaacttagtaccgtagttccttacaccaaaaccatcggcaagaccgttacaggaccgaatgtgtcaacgattgatctggttctcaaggggggatttcaatggagaatctatggggccaattcgatggtcaaggttgctaaaaatgtgctatgccttgcatttgtggatggaggttttggagccatgaagttccattgcaacttcgattgtcattggtgggtatcagatggaggacaatcttttggagtttga

SEQ ID NO: 3555 - DNA, 315 bp, Glycine max
  Peptide Sequence Number=SeqID_95240
atggcaacgagtgacaggtttttgcctgatgcgaagctgaatttcatggggtttaaaaatttagaacgtctgatattaagttcctttgatgaaatagttggcttatctcatgagtgtgacgtagggagtataaagaaaaaagaaaagattctaggtgttggattattgttcttcttttcactatcaagaagaagaaaaaggtcaaataatattgccatacaagaaggagactggactcttaacttcatgttctccaaattttcatcacaaatacctagaatgaacggaaatcctgcagcgggccagatacaatag

SEQ ID NO: 3556 - DNA, 1710 bp, Glycine max
  Peptide Sequence Number=SeqID_95241
atgccagagaaagttgtgatttcgccccaatgggctctatggtccattccaatgcttcattggcgtgttgggttgctcactgctttggttatggttggaatggttgtggtttggagcattgatgggtgcacagtcaagaacatcattcaagcctggaggtatcaacaagattatcttgctgtaaagtctcatactcctaatttaacttttgtctctccatatagtcctgtgaacttcactgtgtatggcaaaaagccccttctagttaaggggcatgcaagttgggtttcaagtgagttagaacccaacttgacttcaaatctcatagctagatggtcagctcgtggaggtgagccttgtaaagattccaaggctgtggagattgcaattcctgggttggatggtggggaagtgattgagctatcagctggagatgtgcatgaatttggttttcaagcactggatgattcagggaagcctctttgtgtaggtggggactactttgagactgatctttcaggggactcatggaaatctaggcctttggtgaaagatttcagcaatggttcttacttaatttcattgcaggttcacccagattttgatggggtttacaatctcactataatcctgctctatagacactttgaaggtttgaagtttaccccatggaggttttcttatgaccaaatgctgcgaagtgttgcaatcagattctacaaaagcagtgttcggctaccagaactgcagggttgcaaggcttctgattttgacagggatgtgtggattggaaggtggacaaggcatggcaagaatgatgactgcactataggaaatgatggtaggtaccggtgcctagcaccggattttccttgccaagcaccttggtgcgatggttccttgggaattttggagagtaatggttgggtgtattcaactcattgctcattcaagttgtattcagctgagtctgcttggaattgcttgaagaacagatggattttcttctggggtgattcaaaccatgttgacacaataaggaatttgctcaactttgttttagacttgcctgaaataccttctgtccccagaagatttgacatgaacttttccaacccaagagacccttctcaaacagttaggattacaagcatcttcaatgggcattggaatgaaacacaaaactatctggggttggattctctgagagatgaagggtttcaagatttgctaaagaagtacttctcagaagacacaattcctgacactgtgatcatgaactctggcttgcacgatggcgtccactggcgcaacataagagcattctctgttggagcagactatgcagcatccttttggggagatgttatgaagacagtgaagcaaagggggttggcatggccaagagtgtttttccggaatacagttgcaactggtggatatgcaaggtcactagcattcaatcctaacaagatggaggtgttcaatggtgtgttgttggagaaattgaagcaatcaggagttgtttctggtgtgattgataactttgatatgacatttccatggcattttgataaccggtgtaatgatggagttcactatggaagagctccagcaaagatgaagtggagagatggccaaattggacatcaatatttcgtggaccttatgttagctcatgttcttctcaatgcgctatgtgcaagatag

SEQ ID NO: 3557 - DNA, 1011 bp, Glycine max
  Peptide Sequence Number=SeqID_95242
atgatgaacatgctttcggtgtcagcagcgctgtgcaagcccgtagcgagtttcaacccggcatcacattcactgaggaatatgaactcgctgtccctcttcatgaacaagaaggaaaaagtagtggtaatcatgggcgcaacggggacaggaaagtcaaaactggccatagagttggccacgcaattcccaccagcggagatagtcaactccgacaaaatgcaagtgtacgaaggcctaaacatcaccacaaacaaagtcaccgaagaagagcgtcgcggggtcccacaccatctcctaggcacggtgaatcccaacaccagtttcactgcacaagacttttgcgaccaggccactctcgccgttgggtccatattgggccgtgacggtttacccatcattgcgggtgggtccaactccttcctcgacgcgttggtcaaccatcacaccgagtttcggttacgctacgactgctgcttcctctgggtcgatgtctcactccccgtcctccattcctctctctccgcacgtgtggatcgcatgatccactctggccagctccacgaggttcgacagagttttcaataccacaaccaggattataccttagggatacgaaaggccattggcgtacccgagtttcatgattttttcagagccgaagccgacggagccgatcagaggaccaaacagcgcctcctccaggctgccattgcttccctcaaaaccaacaactgcaccctcgccaagcggcagctccagaagattcaccgcctttatagcatgtggaaacggaacatgcaccgcctcgacgccaccgaggttttcctcaagaccactcgccaggaggcagaggaggcctgggaggatcacgtcttgtccaagaccagaaggattctccataagttcctgtatgaggacacgcatgttgttcccgcaggtattgcgtctgttgttattgcttcttcgccgccgcccatgcctgccaccgccgccgccgcaactcactag

SEQ ID NO: 3558 - DNA, 93 bp, Glycine max
  Peptide Sequence Number=SeqID_95243
atggattggaccccacgaaaagacaacattattacgtttaatgcaggtgcaccgcatcctatcggcacggaagattcagtaagagttaattaa

SEQ ID NO: 3559 - DNA, 1530 bp, Glycine max
  Peptide Sequence Number=SeqID_95244
atggggcagtggtggctggatacaataggaagggcgttagaagaaggaaaagcttttgagcgtatgggttctaggcagcttgctggcttgcttgtatctctttgggtaagaaagaatcttagaacacatgttggggacattgatgctggggccgtcccgtgtggttttggacgtgcaattggtaataagggaggagtgggtttgagaatcagagtgtatgacaggataatttgctttgtgaattgtcacttggccgcacacttggaagcagttaatcggcggaatgctgattttgatcacatttatcgaaatatggtgttcacccgaacgtccagcctacttaatactgcagctggtatggtaccatacctgttcttgctttgctctcttgccttctccacatatttattttggctactttactcttctggcttgccattggtcctctctgttacagctggtgtctctactgctgttcatgtgcttcgtggtgccaatgctacaggtgtcagctctgaagaaccaaaagctgatttatctgaagcagatatggtggtatttttcggtgatttcaactatcgcctttttggtatatcttatgatgaagccagggactttgtttctcaaagatgctttgattggcttagagaaaaggatcagctcagggaggagatgaaagctggaaaagttttccagggaatgcgggaggcacttatcaaatttcctccaacatataaatttgagaggcacaaaccaggtttaggagggtatgattctggagagaaaaagcgaattccggcctggtgtgacagaataatataccgcgatactcggtcagctccagtttctgagtgcaatttagactgccctgttgtgtcatcaattttacagtatgatgcttgcatggatgtgactgatagtgatcacaaacctgtccggtgtaaattcaatgtaaaaatttctcatgttgatagatcaataaggagaaaggagtttggggtagtaatgacatcaaatgagaaaatcagatctattcttgaagatttatgtgatgttccagaagccacagtcagcccaaacagtttagtccttcaaaatctggacacttcattgttgcttattacaaacagaagtacaaaggataaggctatatataaaatcacttgtgaaggccagtctatagtaaaaaatgatggacaggcacctgattatagcccaagaggtggctttggctttcctagatggcttgaggttactccagctgcgggcataattaaacctgagcaaagtgtagaggtttcagttcgtctcgaagatcttcatacctcagaagaatctgcaaatggcataccacagaattggtggagtgaagacacccgagataaggaagtgattctggttgttcatgtacaaggcagttcttccgtccaaacttcatgtcaacaaatccatgtgcgccactgcatgtcagcaaagacagttcgaattgactcaaaatccaacagtgctagaagaaatcaaataagctaa

SEQ ID NO: 3560 - DNA, 2604 bp, Glycine max
  Peptide Sequence Number=SeqID_95245
atggcgcctctgatcctgcatggtggaaaaaccaacaaaaattcttacaagacactcattgcggcggagtatgccggcgtccaagttgactttgccccaaattttgagatgggtgtctccaataaaactcctgaatttctcaagatcaatcctattggcaaggttcctgtgttggaaacacctgatggtccagtattcgagagcaatgccattgctcgctatgttacccagctgaaaggtgataacactttgtatggatcttctttgattgaacatgcccacattgaacaatggattgatttttcatcattggagattgatgctaatattatcaagtggtatgccccaagagttggacgaggaccatatcttcctccagctgaggaggctgcaatttctgcactaaagagagctttggctgctttgaacactcaccttgcttccaatacttacctggttgggcattctgtgaccctggctgacatcataatgacatgcaatttatatttgggttttgcaaacatcctggttaagtgctttacctctgagtttcctcatgttgagagatacttttggaccttggtcaatcagccaaacttccgaaaaataattgggcaggtcaagcaggctgaaactattcctcctgttcaatctgcaaagaagccttcccagccaaaagaatccaagcccaaggtaaaaaatgaaccaaagaaagaggcaaacaaggagccagaaaagcccaaagaagaagcagaagaggaggctcccaagcctaaagccaagaatccccttgatcttctccctccaagtccgatgatactggatgagtggaaaagactctactcaaacactaaaaccaacttcagggaggttgctatcaaaggattttgggacatgtatgatcccgagggatactctctctggttttgtgattacaaatacaatcaggagaatactgtttcttttgtgacattgaacaaggttggtggatttcttcagcggatggatttggctcgcaagtatgcatttggaaagatgcttgtgattggatcagatccaccatttaaggtgaaggggctgtggcttttccgtgggcaagaaatccctcaatttgtgattgatgaatgctatgacatggagctctacgaatggactaaggttgacatctctgacgaacctcaaaaggagcgtgtcaatcagatgattgaagattgtgaaccttttgagggcgaggctcttttggatgccaagtgcttcaaacagctggagacaggctggaggcaacataatctttgcctttggattctcatttctcatttctccgcttccttccctcctagatccattctctcatccgtagttagacacccaataaaatcaagtaatcttttaggttgccatgtggtggaatctgtaattcgggtaatgcccctgtcgagatttgctgccgattattcggttaagtctgctaaggcgcggccttcacttgcagtggcaatggcaggaggaaagtatatgcaaatgactggcggcattatcaatacaaaatggaatgtgaagacggccggatacattctgctttactgcttcccactttttgttcttcaactgtttgttatttttgttggaggagagttcaagtcatcatcatcatcgtcatgtacttaccctttactaagcactcttctccttggcctttttgcccttattctgacctcgtacctcttctggcttggaagccggattttgaaattagttattaataagggtttgcagaagagggtatacacattggtactctcagtctcaggcttccttccattaagggttgttttccttggtttgtccgtattatctggacctgaggattttatgtttgaggcctttgctttcttggctttccttgcccttgcgtcttgtgctggggtgtgcatgtgcatgcttgtgtaccgtccacttgcagattgtttagcgctcgatattaatgataccacgtctcttataaaaggagatagggatgccacgtttcttcaactaagcctcttctctcccactccaaaccgatttctttcttttctgagctcggttaaattcatgtcacctgtgaaaccgactccttggaagccttgcaactggaggagaaccagttcagtgcttgcaaaccaatgtgctgacttcttagctcgcttgggttcctcctcatccgagactcttcgtactgtggctttgcctcttcctgagatgaaacctttgcttctagcagatgcttcgagagattctatgtttgatacagcgaagatggtagaaaatggttttgttcaagatgatatcacaccaccgcccaagtcttgtagcaacaagaagatggttgaaccagggaaacctgctggacttacctggcagcgaaaattaaacaacaatggaaatgcttcatcacaaatctccttatctttgaaggagatcattcatctggctccaattggttatcggctatggcgtcattgtcgggaagaagctgccaaaggaagggggggaatgattgatccttttgccaagcgccacgtaacattttgtcatggtgttcctttgggaggtattgggtag

SEQ ID NO: 3561 - DNA, 4101 bp, Glycine max
  Peptide Sequence Number=SeqID_95246
atggaggcaatcgaagatttggttcagctctccgattctatgcgccaagccgccgccgtcctcgccgacgaagatgtcgacaactacaagcgcccttccactttcctcaatgtcgttgcgctcggcaatgtcggtgctggaaaatctgcttccttgaatagcctcattggacatcctgttttgccaactggtgagaatggtgctaccagggctcccattagcattgaattgaatagagacacctctttaagcagcaagtcaatcatcctgcaaattgacaataaaactcaacaggtttctgcaagcgcccttcggcattctctacaggatagactaagcaaaggttcatctggtaggagtcgtgatgaaatatatctcaaactacgtaccagtacagcacctccattgaaattgattgacttgcctggattggaccagcggatagtggatgacaaaatggtgagtaggtatatgttatcttgtcctaagtttaaattcagcatgaggatcagtgaatatgttgagcacaatgatgctattttgctgctagtagtccctgctgctcaggcgccagaaatttcaacatcacgagcccttagagtagcaaaggagtatgacgcagaatccaccagaactgttggcgttatcagtaaaattgatcaagcttcttcggaaccaaaagcccttgcagcggtgcaggctctcctattgaaccagggaccgcctaaaacctctgatattccatgggttgctttgatagggcaatctgtttctatagcttctgcacagtctgggagtggagcatccgagaattcattggagactgcttggcgtgctgaaactgaaagtttgaaatcaatattgactggagcccctcaaagcaagctaggtagaattgctttggttgagtctcttgctggacagattcgcaatcgtatgaagcttaggcttccaactctcctcactggtcttcagggaaagtctcaaattgttcaggaagagttagtgaagtttggtgaacaaatggttagtagttctgaaggtacaagagctctagccttgcagttgtgccgtgaatttgaggacaaatttcttcaacatcttactggaggcgagagattggagctatttctcatgtgccatattggggattttaggatgagtaaagatgacgagggtaatggttggaaagttgttgctagttttgaagggaattttcctaacagaatcaagcaacttcctatcgacagacactttgacataaacaatgtcaagaggattgtccttgaagcagatggatatcaaccttatcttatctctccagagaaaggtttgagatccttaattaaaggcgttcttgaactggcaaaggagccatcacgactgtgtgttgatgaggtgcatcgtgtgcttgtggatcttgtttcttcttctgcaaatgcaacgcctggtcttggaaggtatcctccattcaagagagagattgtggcaattgcaagttcagccctagaggcatttaaaaatgaatccaaaaaaatggtggttgcactagttgatatggagcgtgcatttgttcctccccaacactttattcgtttagtgcagaggcgaatggaaaggcaacgccgagaagaagagctaaagaaccggccatccaaaaaggcacttgatgcagaacagtcaattctaaatagggcaactagtcctcaaacaagtcaacaaagtggggggaacttaaaatcgatgaaagagaaatccagtcagcaagacaaggatacacaagagggatctggcttgaagactgcagggcctgaaggggagataactgcaggtttttattattcatcccaaaatttgtattacaggtctaatatcaccaaggaatgcaatattgacgagatttctgatgatgatgaagcctccacaaagagttccaaggataaaaagtcaaatggacctgattctggaaaagcatcaaaccttattttcaagattacaagcaaggtcccttacaagactgttatgaaagctcaaagtgcagttttgttaaaggctgagagtatggcagataaggttgagtggatcaacaagttaagaagtgttgcacaggctaaaggaggtcaagccattggtgaacctagttttcctatgcgacaaagcctttctgatggttctcttgatacgatggccagaaaacctgcagatccagaagaggagctcagatggatgtctcaagaagtgcgtggttatgttgaagctgttcttaacagcctcgctgcaaatgttccaaaagcagttgttctttgccaagtagagaaagccaaagaagacatgctcaaccagctatacagttccatcagcgctcaaagctctgcaaaaattgaggagctgctccaggaagaccacgatgtcaagaacaaaagggagagagttcagaaacagtcttcccttctttcaaaactcactaggcagcttggtgtccatgacaacagagcgtctgcagcatccaattggtctgataaagggagtgcagcagaaagcagcccaggaagctctggaccctcatcagttgatgattggaggtctgcatttgattctgctgccaatggtccaagcgacttgccgtctaggtatggttctggtggtcatagtagacgatacagtgacccatcccaaaatggtgatgtgagctcaggctcaaattctaacagtcgtcggacgccgactcggttgccccctgctcccccgcattctgagagcgagtggatgtggtgttccggagaagttggaatggcagcggttagtgttagtgttactgtgagagtgaggtggtgcactcgaaaaccacccactccaactccaaccagattcagcgttaatgctctgtttggtgattggggatttgggaatagaacaaggaactcccttcagcagcaattcacgttcactcttgctgatagtaaagtgataagcgtgtcggttgtttcttcgatctcagatgttgcatcgagcgaatgggacgcttgtgctttggatgcgactggccctgacaacttcaatccattcctttcgcatgcctttttgtcgaccttagagcactctgcttccgctgtcagggaaactggttggatcccacaccacatcgttgccaaagccaacaacaacagcaacaacaacgttgtagccgttgtcccactctatcttaaaacccactcctacggcgaatttgtttttgatcattcttgggctaatgcttaccattcttatggctacaattattaccccaagttacaatcttgtgtccccttcacacctgtaactggtccaaggatcttacttcgtaacacctccttcaaacatcaagttttcgacattattgtctccgcaatgaaggaactcgctctcaccgtaatacactcccagctttcatcattacatgttacttttccctctgaaaatgagtggcacaagctcactgagaaaggcttcctccccaggattggaatgcagtaccactggaaaaaccgtaactacaaaaattttgatgacttcttgatggacatgaagcaaagtaaaagaaaaaatatacgtcaagagcgcaaaaaggctaggcactgggattccttctactctttttacaggaacacaactgataacaaatggggcactcctcacctgacaagggaattttttcatgagctgggagcaaaaatgggagataatgtgctacttgtggtggctgaagaaggggatgaactagttgctggagccctaaatcttatcggaggagataccttgtttgggcgcctatggggatgtcagccacgaagttactacccaagtttgcattttgaagcgtgttattaccaggcaattgaagcagctattgaactcaatcttaaaactgtagaggcaggagctcagggtgaacacaagattcagcggggatatcttcctgtgacaacttatagctgccattaccttattgatgaagaatttagagaagctatacaagattttttaatacgtgaagctgctcaggtgaagctagttataaaactcttgcatgattctggtccttttaaggaaggtatcctttag

SEQ ID NO: 3562 - DNA, 441 bp, Glycine max
  Peptide Sequence Number=SeqID_95247
atggcgaaatggtgcggaatgaccataatttgtcttcacatgtcatcgagctcgccgcctctagatgacaaaagggcgcagaatgacgataatttgtctttgcgtgccatcagacacgatcgggcctggatggaaaggcgcagaatgaccataatttgtctctgcgtgccatcgaacacgagcgagcctggatggaaagcgcaaaatgaccataatttgtctctgcgtgccatcggacacgatcgcctctggatggcgaaaaagtgcggaatgaccataatttgtctccacatgtcatcgggctcgccgcctctggatgacaaaagggtgcagaatgaccataatttgtctatgcgtgccatcggacacgatcgggcctggatggaaaggcgtagaatgaccaatttgtctctgcgtgccatcgaacacgatcccctctag

SEQ ID NO: 3563 - DNA, 318 bp, Glycine max
  Peptide Sequence Number=SeqID_95248
atggataagccaaagtgtccatctccaagggagaaaataagcggagtcgccaccaacgtttattcaaggaaaatgttagaaaaaccaaaaagaggtctacgaatattgaaaagaagggttcgggagttgtttatgcataaggaaggcaaagggtcactttggggaagttgcagctcacccaggcgagctagtttcttcaccatgaagctatttggtggcccaggcgagctagaggctagccttggcgagctagggtccaggaaaaccaaggaaaagacccttttgtccctttttttttggtatttctcgcattcttga

SEQ ID NO: 3564 - DNA, 636 bp, Glycine max
  Peptide Sequence Number=SeqID_95249
atggtcattgaccaatccctcttctatgatttgacccaattgtctagtgacggtgtaccatttgaaggtgcactaaatgatgattggaagtttgatttttctctgtatgatgcctgccggttagtttgcaccaaccaagcggatatgaccagaaggctgcttgccagttcattggctcttgaaagccgcatcctccattatctaattgtctgtatcttactccacaaatcttcaaaccttgcacaggcattgcgattaaatgctcctttgccctatccttacttagttaccttgttccttcaacattttaacatccctcttgattctgaaccatatgttccaatcaagagatctttcttgatcggtgctgttgtggttgcctcctttggttactgcaaagagcgtgatgactcttggcgcacccgtgagcctcgcctttgctcgcccgcaaaagggcacgttgcgacagacaggtttgatggacttcaaacctatgttggtgagaggtttgactccttggaacgtcaagtggacacaagattcgaggagatgaactcaaggattgcaaaggttgaagaagatgtcaccattatttgcgacttctttgatttacctccaccaccaccatcaatttag

SEQ ID NO: 3565 - DNA, 129 bp, Glycine max
  Peptide Sequence Number=SeqID_95250
atgcagtgcaacatctttgagtgtgatggtgcactcaccctatggcaggtgaaagcctacgcatgcatgatttcagagatgcggaacaatgttgtacctaaccctgacatgcaccgagaaccccattaa

SEQ ID NO: 3566 - DNA, 849 bp, Glycine max
  Peptide Sequence Number=SeqID_95251
atggctagtttgttgtattgtcacgagggatcagggattaggctagactatcatgaggaatcaggcattctctcattcttaaacctggccccgatctctcatacttcatacatcactcttgacagggctaggatgatatatggcatcatccagaggatggatatgaatgttggctatatgatctcagctcatatttccatgatagctcaacatgactcttctaggctgggtttccctgcacttatcactgctttgtgcaaggccagaggagtcccttcagattcacttacttttaagagtttcagtccagccattaatgtagcttatgtgaaaaaaaactgttggaatcttgatgatctaactgtgactttcagagggccttgcaaggccaaggggaagaggtcagaggctctcccatcttttgagatcccctttctgcagctccttcatcttctgatattcctcctataccagcttcagctcccactcccttaccaactccgtcagttccagctcctcctacaggaccatcctccttcacatctgagacattattttgcatgctgtaaagccttcataaaggccagtgtggatgagtttctttctcaggtggcttggccaggagtccagccttctccttctggagggggtaaggccaccgcagcccaagagcctatgccagcagaggagcctgtgctagtagcagaggatgagcttgttcctcctgagccgtttatctttgagactgatctagttgctcaggaggaagcagtagctcaggagcctacttctccagcaaccattcttgatgatccggagccatctgcaccagcatcggatccagagtag

SEQ ID NO: 3567 - DNA, 162 bp, Glycine max
  Peptide Sequence Number=SeqID_95252
atgtgcttagctaaaggaagctcagcctcgcttagccacaggcacctcagcaagaggatgagtgttcatcctcaaaagatgaactcacttagcgcggtaagagcactgatcgaggccgtacccgaatcaaataaacatgaaaatgcagtaactaggaagtga

SEQ ID NO: 3568 - DNA, 315 bp, Glycine max
  Peptide Sequence Number=SeqID_95253
atgaagtctttgctcctggagacagtgaggatgattgtagttgctgctagtaacaaagaggaacagggtattagcatgagattcattgacaaaaggagatggatttgggccctttggggacaaagaatttgggatcaactttgggttcaattggtactagagagttcacaggttggtctcaaatgtcatcaagtaacctacaagatgattaatgaaaacttagtaaagcttgcaatcaattataatcgttcctttcataagattgtcaatgaaaacctagtgaacaacagcgaatggcaccgcatagatgaatag

SEQ ID NO: 3569 - DNA, 2080 bp, Glycine max
  Peptide Sequence Number=SeqID_95254
tgcaaaggatcctcgagtcgaagccaacgacatttcgagactcaagaaacgcaaattccctcctccatttcctcttcctcactgttctcaatggaaaaacaacagatacggtgtaccatttgaaggttcactgaatgatgattggaagtttgatttctctgtgcatgatgcccaccggtttgtttgcaccaaccaagcagatatgaccagaaggcttcttgccggttcattggcttttgaaagccgcatccttcattatctcattgtgcgtattttgcttccaagatcttcaaaccttgcacaggtttctaaggaagatcttattgtcatgtgggcttttcataaaggccgacaaattgattgggcatacttagttcgatatcgcatgcataatgtattgcgattaaatgctccattgccatatccacacctagtcactctcttccttcaacacttgagcatccctcttgattctgaaccttatgttccaatcaagagatccttcttaatcggtgccgctggtgctcaacccattgatgaagaaggacacttaccagttggagaagatttctctcttcttcaaaggattttggataggtttgatggtcttcaaacctttgttggtgaaaggtttgatgctttggagttacaagtggacatgcgattcgatgagatggattcaaggatcaccaagggtacattctttgtggtacaagtagagggtacatctatatgggttgttctaactgagaacaagagaaggtacatctcttatggatcagttcaagtggagggattttacaaggttgaaaagaaatctcaaggaccgcaggtcgcttggggattggatacccctgaagttctatctggaaatcgcaatgaacacgctaagtgcacccgtgcgcttagcttgttcatcacaactgttaaaattttagatttccagatgaacgggctaagcggaccatgtcgcgctaaacgcatgacatctaagaaaaggaagacaccctctacacctaggaagattttacctgaaaggaatgtcattctccatcactctgaggtcgatgaatttactaaagaactcaagtgtagaaactggcataaggatttgacaaactttgtggatggcactattgatgtggccatcgtgaaggtgagaggtcgtttagtgaaattcgatgcagacaccttgaacttattcttgaagaccccagtgatacttgaggagggggagaactttctagtttactccaggttctgtcattcgaagccagaaccacgggaactggtagctcgattatgcatccctggaaggggattcaagttaaatgctgatggactgccattaaagatcttacggaagaatctgaccatgcttgctaaaatttctctgatcgcccaacatgactcttctaggcttgggtttctagccttaatcactgctttgtgcaaggccaagggagtcgtttctgattcattgacattggagagccttggtccagctattaatgtggcttatgtaaagaaaaactgttggaacctagatgacctctcagttaccttcagagggccgcacaaggccaaggggaagaagtatgaggctcccccatcttttgaggtttccctttcctcagctccagctgccccatttgcatctacatatgttcttctagttcctttatttgtaggaccaaattttatttttacaccacagatgatgcactccatgctccagagcatccacagggtgcagtccattatcatgcagagccttcagggcttgggcttgccatccatcatgagcatggatgagtttgatgcgcaggtggcctggccaggagcccagccttccccttctagtgggggtggggcctctgtagcccaagagcttgcttctgaggagccagcaacagcaacagcagagggggatgatgagcccacccctcctgagcctttttattttgatgcagaccagatcccagagccatccccagcacccacacctgatgatgccacacgatctgcactagcacctgagttagagcagcctatctctcaggattcactagatgctcaa

SEQ ID NO: 3570 - DNA, 225 bp, Glycine max
  Peptide Sequence Number=SeqID_95255
atgccactgaagggcaagcagttggtggtatacccttgcaaaacacttggagggcccttagtttcgcccccaaccacaaccttgcattccacagcagaacatgtgcaaaaaagggcacgaatctttcaaagaatatgcccaaagatagagagacctagcagctcaagtggcacgaatctttcaaagaatatgcccaaagatggagagacctggcagctcaagtag

SEQ ID NO: 3571 - DNA, 522 bp, Glycine max
  Peptide Sequence Number=SeqID_95256
atggccatcaccgaattggaacgagaaaccaagagggcccgaaagaaagaacacgaccagaacagtgagcttaagctccgaagagccgaaagggatcggtcgtgggtcgaaggcatgatcttgaaagatgagttaaaagcttgccataggtcaaaaagaagtttgtccaagcagctgagcaagactgaaggaaatatgtgggccatcatcgaccagtacaaggaaaagctaagcctagcagcgactcatgagcaaaggctagaggacgagtacgccaaggtatcaaccctacaagcggaaagggaggcaagggaaagggtgatcgattcattgcacagagaagcaatgatgcggatggacagtttcacctttactttgaatgggagtcaagagcttccccgactactagccaaggccaaggcaatggcggatgtgtactcgtctcccaaggaggttcacgggctcctcaattattgccaacaaatgattgatctgatggcccacacgattaggagccgctaa

SEQ ID NO: 3572 - DNA, 326 bp, Glycine max
  Peptide Sequence Number=SeqID_95257
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggggcgatcggtgcgggcctcttcgctattacgccagctggcgaaagggggatgtgctgcaaggcgattaagttgggtaacgccagggttttcccagtcacgacgtt

SEQ ID NO: 3573 - DNA, 270 bp, Glycine max
  Peptide Sequence Number=SeqID_95258
atgaagcatggctccaaactccctggtggaggatacatgaacataatcgcaattcatagggctccgaaaaagggtagagaatggagaattgcacaaagcaatcactacgcatggctccaaactcggtcctcactagtcaatcatgaagcatgggtccaaactctttggtggaggatgcatgaacgaaaacgcaattcatgggtgtcataccctaatttcgtccggggacctttgcttgatgacatgcgacctttctttggtccttgtgag

SEQ ID NO: 3574 - DNA, 438 bp, Glycine max
  Peptide Sequence Number=SeqID_95259
gtacattgagcaactgactgaaatgctcaaaatgttctttacgatgccattgggatatatcaacggtgttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatattctgaaggcctttcctcattctttagaaggagtggcaaaggactggctatattaccttgctccatg

SEQ ID NO: 3575 - DNA, 255 bp, Glycine max
  Peptide Sequence Number=SeqID_95260
atggcatcagaatggagaaggaagagagagaggagacaccacttcaagaagaagatgagtctagaagaagctcaccaccataggaggccatggataagagcttggaggaagaaagagatgaatgaagggagaggaagagaagagcacgaaattttgtgctcgaaaagagctttgaaatctgaaccaactatccaagatcaagtccaagattctccactaagtatgcttaggtgtcatgaggcatgtaaagcatga

SEQ ID NO: 3576 - DNA, 252 bp, Glycine max
  Peptide Sequence Number=SeqID_95261
ttgttactcgcatggaacaatgctttaaaatatcttgatgatgttccacagcctaaatcaaaggctcctgctaggtggattgtcgtcaaaagtaatagacaaaaaggaagtactgagtgcgactactatgtcatgcactggatgtccaccatcattttaggaagttttagcaataacttggaagcgtattttaacgatcctaaaccattagagccaaagagattaaaggtgttgcagatccagtgggcatag

SEQ ID NO: 3577 - DNA, 237 bp, Glycine max
  Peptide Sequence Number=SeqID_95262
atgaaaatgagaacaaactcagcctcattgcattctcaggcacaccgacaatcttggttgtattgcaaatctcaatgtatgtggccaagtgtgcatatgggtcttcgttcggcaagccatgaaatagatttccttgaattaactgtatcaaggagtgaggccattatgtcaaccctagatgcacctatttctgattctcttggctctggaaaaatagaagacgactcaaatgattga

SEQ ID NO: 3578 - DNA, 193 bp, Glycine max
  Peptide Sequence Number=SeqID_95263
atggtgaaatcagtgggagtacagttctacgagatgtggaaattaaagaagttagagttttcattttcacaagctgtaagctatgataattccgagaagtggttaaatgccatgaaagaagagataaattccatggaacataatggtgtttgggaccttgtagaattgccaaaaggttgtaagagagtttgtt

SEQ ID NO: 3579 - DNA, 397 bp, Glycine max
  Peptide Sequence Number=SeqID_95264
ggattgcgaccacaaggcacccagtggacccggaggagcccaacagggccctggggtttccagctctggttacaggcctctgtcagccctacagggtgcccgtccaccccagaaagggatcgcgcccgtaagacacccagtggactcggagaagtccaacagggtcttggggtttccagctctggaattacgggcctcggtcagttctacgaagtgcctgccgcccccagcaaggtcatcaggcccccctactaaccaagctttcatcaagaagtactgcgcccctaggcaggcacagggcgatacaccacaacagcctggggatggccggcagcgggcaacaggcgcaccgccaccacctctagagttcacctcagctcatccacaaaaaggttag

SEQ ID NO: 3580 - DNA, 297 bp, Glycine max
  Peptide Sequence Number=SeqID_95265
atggctacaccacccagctctcctcctcctcctcctactggtgcagcatcgcattcgccgtctaccttgaagcggacaagaaaggtcagacgcctaagatcattggcgactagactagttggggcagagagacccttggtccatgtggatcctgctatcgggaaagcggatagtccccatagaaagaagttaagaacatatttggggatcgtcactcgtgataaggtggatgtgacatacgagaattggaaaaaagtccctgctactcataaggatttgatatgggaggatatttag

SEQ ID NO: 3581 - DNA, 417 bp, Glycine max
  Peptide Sequence Number=SeqID_95266
atgaagcttgcttctacagtctattggtcaaccttcccattcttctgttttgcagggttccagcaaggtccctacaatcagcaagggcaatggagatcacaccctggcaatcaattaattaaggaccagggtggacgttccaacaggccacctcaacaagggccaaatatttttcagaggaccaccaaaaaggaggagacactaactcagtttatgcaagtgaccatgtccaaccataagagtactgagtcagccctaaaaaaccatgagatccagatgggtcaactggctatgcagttagctgagaagttgtccagcagctttggagcaaatactcggaagaatcccaaagaagagtgcaaagttgttatgacaagaagcaggaagcttgttgttcgctttcggtgtgtaaactaa

SEQ ID NO: 3582 - DNA, 117 bp, Glycine max
  Peptide Sequence Number=SeqID_95267
atgccagttttggccgaaacaaaaggaaatgttcgatcggcatcatccggtgaaacttcttctttagacctcgatcgatcatctttccttcccgacgtcgactgtcattttttctga

SEQ ID NO: 3583 - DNA, 456 bp, Glycine max
  Peptide Sequence Number=SeqID_95268
atgggtgaagcagattttcaaagaatgccaagagaagactgctcaaggccccccaaaaatagagaaaagagcaattatggccacaatgatgaacatgtgagtttacatgaagaagtaatggacagccaagttattacagattgccgctattacgctgtcgcaatgaacatgctcccatcaatggtccaaagcaaattgaatcatcctctaggacgactgagaaaactggggcaaatgaagagggtgagagagggagaaacccatgctgtgactgccattcctatacggcacgccttcccatcaagtttcccaccaacccaacaatgtcattactcagccaataacaaatcctcctccttaccccatccacccagttatccacaaagtaacctcccaatcagcacaaagtctctaccatgggggagacacaatgacgaattccccaccacaatctag

SEQ ID NO: 3584 - DNA, 290 bp, Glycine max
  Peptide Sequence Number=SeqID_95269
atgatgacaaaggtaatgacaaaaagctcaaagatcaatcaaagaacaactcaagtaaatcaagaacaattcaagagttcaaagataagaatcaagaagaattcaagactcaagaagaaagttaagagtcaagaatcaagattcaaggttcaagatctcaaaaatcaagatcaagattcaagacttaagaagaaagttaagagtcaagaatcaagattcaaggttcaagatctcaaaaatcaagatcaagattcaagactcaagattcaagaatcaagagaaggcttaat

SEQ ID NO: 3585 - DNA, 171 bp, Glycine max
  Peptide Sequence Number=SeqID_95270
atgggacaccttaggtttgtcatactttttggtaggaataatcaacatgaaaatacagaaaaaggtgttgaggataaaagcccaaagtttcaagaacctcgggatttgaggtcaaatccttttcaagggggagagaatgatgcaatcctatcccgcaagagcattggatag

SEQ ID NO: 3586 - DNA, 402 bp, Glycine max
  Peptide Sequence Number=SeqID_95271
atggatgaagagccaagaagagttactctggaagactactcaagctcaagtgtgccacaattctttactagtattgcacgactggaagttcaagcacaaaatataacctatccacattcattaattcagttgatacagaacaatttgtttcatggtctgcccaacgaggacccgtatgcacatctagccacttatattgagatttgcaacactgttagattggctggaaataatgttaagacttgggatgaagtagttgagaaattcttgaagaagtatttcccagagtctaagacagctgaagggaaagctgccatttcatccttccatcaatttccaaacgaatctttgaggggaaagatcaaattgaagaccctagaagaagctatggaattaatatag

SEQ ID NO: 3587 - DNA, 342 bp, Glycine max
  Peptide Sequence Number=SeqID_95272
atggtgtctcttacaagggcggcggcggtgcatctgcagctggctactactagtcctcctctggctattgcgatgcctgaccctgtacctgcctgggcatgtaaattggcacaggcctgtgatcaaagcaggaaaccccagggccctgttggacctctccgggtccactgggtgtcaaggggggagaatgttgctaagcagcaacatcatccaaatctgtgtgagggtggtcatgctggtgcgcatgattcgcacccgtctccccgctacgctcgagcaaaatcctacctcgaaacgcatagcaactggctgatagccttctcatcgaagcttgaggcctaa

SEQ ID NO: 3588 - DNA, 315 bp, Glycine max
  Peptide Sequence Number=SeqID_95273
atgaagttcagttttatcgcaatgagccgatcaataactgaaagcaataacatcaaaccgtgcgactctgcctcctcaagtgaagaaatccagcacgtcggccatatcgtcatcctcctaagctcctctattgtccccaagggccctttcgggtcttgcccgtgtctcaaaattggcctcatctctgagccaagcaacggtggccccaaactgcacgagggtagaccaagggaagggactggggtcctgactctgccggtgcatattgtacccgatagaatgtctcgtttagctgcacctggcccctgtgattag

SEQ ID NO: 3589 - DNA, 483 bp, Glycine max
  Peptide Sequence Number=SeqID_95274
atggcaataaagaacccatctcactcctctacctcagatagtgaaaacattccctcaccctcaccttctacccataaacataaagggaaaggaaaggcaatagaaggtgttgcgataagttcaccaaagaagaagagctctatgaaagtaaagaagtctggacaaaagagaaggaggccacaatatgaggttgctgccttgttcaaagataggaagttgttggagaagtttgatatcagatggaggtggatgagggtctttgatgtccatgaacctaaccacccgaggctggttagagccttctttgctgctattgtggtcgacagtagtaacttcacagtgaagactactttgaaggtgtcataccccaattttgtccggggattactacttgataacatgcaacctttgattggccgcttcgagatacctgacaacctttgttgcacaatatgtgaagtccagagacgcatcggaaattaa

SEQ ID NO: 3590 - DNA, 387 bp, Glycine max
  Peptide Sequence Number=SeqID_95275
atgcatgagaacgaatggcacagagtgtgtttgctccatgcccctaattgggaacctataggacaatatttaggggcgagcgaaggcgaggctcacgggtgcactttccaaaggaggaaagatgcgcggagtcgccaccaacgtttatttgtggaaaacgtcggaaaaaccgaaggaaaccggtcaaaaatgaaaattataagttcgggagttgtatttacgtttgaggaaggtattagcacctctcacgtcgacaaaagcggggctcttgctcctacgtaccctccatcgaagaggaaatcagacctacgtagttctttctttaagagtgaatcaagtgattctttttacttgaaaggcgatcattttaaggcgttggacctttaa

SEQ ID NO: 3591 - DNA, 135 bp, Glycine max
  Peptide Sequence Number=SeqID_95276
atgtttttcccagtgatgcaatcctaccccgcaagggcattggatagaagactccaagaagattgggccagagatgcaagagaaggccctggggttctcatgagccttagggtagattttgagcccatgggctaa

SEQ ID NO: 3592 - DNA, 288 bp, Glycine max
  Peptide Sequence Number=SeqID_95277
atggctggtgtcggaggagctgggttggatgatgaaggaatgtcatcggttcttgcccttgttcttgatgccatctacaagaaagggatccaaacaactacaaaaatcaagttgaaacctatggaagctcggcttagcgtgcggttatcaacacaaatattgactaagttacctgggcttagtgaatcagcctcgcttagccacaggtactgtatcaagaggatgaatattcatcctcaaaagataaactcgcttagcgcgataaacgtgcttaacgagttcttctga

SEQ ID NO: 3593 - DNA, 240 bp, Glycine max
  Peptide Sequence Number=SeqID_95278
atgaatgaagtcccgagacgtgtcaaaaatcaaaaggaagccaggcttgcgcaatccgtgaaattccgtaatgtggcggaagacgaaaagagattgtttttgcgcaatccgcccacttgggccttccagaagcttcctccaataggctgttgcttctggaggaagcaacctggctcgcctgggcgagctgagctcgcctgggcgagctgggcggcaagcatctcccctattttgctataa

SEQ ID NO: 3594 - DNA, 259 bp, Glycine max
  Peptide Sequence Number=SeqID_95279
atggcacgcagagacaaattatggtcattctgcgcccttttgtcatccagaggcggtgggcccgatgacatgcggatgacaaattatggcattccgcacaccgttttgccttcatacacgttgtgtccgatggcacgcatgacgggcggaaatactgagactgacaatggtcttcctgcaacctttttgttcgacagtgcccgggaacaacaagtcattctgcatgcggagatttcatggtcacccaaggcgactctcg

SEQ ID NO: 3595 - DNA, 363 bp, Glycine max
  Peptide Sequence Number=SeqID_95280
atgccggccatcctcaggctgctgtggtgtttcaccctgcgcctgcctggggacgcagtacttcttgatgaaagctcgattagtaggggtcctctgaaggcgaggacgtggagtcctttgaaggcgagggcaagtagccctctaaaggcgagggcgtgcagccctctgaaggtaagggcatgtagtcctctaaaggtgaaggcgtgcagccctctcaaggtgaggacgtgtagtcctctaaaggcgaggacgcgtagttctctaaaggcaagggcgtggatccctctgaaggtgagggcatgtagtcctctgaaggcgagggcgtgcagccctcttaaggcaaggacatgtagtcttctgaag

SEQ ID NO: 3596 - DNA, 561 bp, Glycine max
  Peptide Sequence Number=SeqID_95281
atgccaaaggatcaaagtgcttctaagttttattcaagacaagaatccaagaatccaagaaaatcaagatatatgatcaagttgatctctagaatcttaggaagaagtttccaaattgaaaaagtgaaaggtttggccaaagaattctatctaaatcattttaaattgagatttactctcagtttattgagcgttgtaatcgattacacaagtcttgtaatcgcttaccagaggagattttcagaaaataatttccaagagtcacatctatccaaatggtttatgaatggccatcaaagaggattcctgaacacaagcgaagggttgtccttgtgtggttcagactttgtaaaaggagttttacaaagagagtggaaaatctcaagattcacaagcgattctcctcaaatttcagccagcccgcagcaattagactttgcaccttacgcttcagggtcatacaatgctcaatggaatgccctggggttcctccatgataagcacacattgcgttcgagtcgtatcctcggaaaaatggaggttgagggtgggatcctctag

SEQ ID NO: 3597 - DNA, 177 bp, Glycine max
  Peptide Sequence Number=SeqID_95282
atgtggtaccatggagaccagtcagagtcacagtattttgcgagaatgctccaaccatgtgggatcgacacaggcttaaaggagcactcaaaccgggtgacccccaaggcctacagtccgaagagtccgtcagagcctctccctcctgattcaggtccaacccagaaaattttttag

SEQ ID NO: 3598 - DNA, 1272 bp, Glycine max
  Peptide Sequence Number=SeqID_95283
atggcgcgcctggatgatgctgatcgccatcgtcgtcctgtcgctcggtctggtctatatcagcgtgcagatcaaccagtggaatcaggtgttctacgatgcgctgcagaacaagaactacccggtattcaaggcgcagctgtggcgctttacctatctggcgctgatcttcatcgtgctggcggtctacaagatctacctgactcaggggctgcagatgcgctggcggcgctggatgacggaaaacagcagatcgtcgataaccccgatcagcgtattgccgaagatctcaacgtattgacccaatataccctgtcgctgtcgctcgggctgctctccagcctggtgacgctgttttcctttatcgacatcctatggcacgtcagcgggccgatgaccttcgcgctcggccagcacgccatcacgctgcccggttatatggtgtggttcgcgctgctgtatgcggtgctgggatcgctgctgatctggtgggtcggcaaaccgctggtcatactgggcttcaaccaggaacggtatgaggcaaacttccgtttcggcctgatccgcatccgcgaaaacaacgacgccatcgcgctgtaccacggcgaaccgcgcgaggcgcagcagctgggcgaccgttttgacaccattcgcagcaactggtgggctattatgcgcatcacccggcggctgaacatcgccaccaacttctacggccagttcgccatcgtatttcccctgctggtggcggcgccgcgctacttctccggcgccattcagatgggcggcctgatgcagatcgcctcggccttcggccaggtacagggtgcgctgtcatggtttatcgacgcatttaacgatttggcgacctggaaagcctgcgtcaaccgtttggccggcttcaacgccgccgtcgatcaggttcatcatcagccgcgcggcattcagctgcgggaagagaccgcccatccgttgacgctggataacctcagcctgaacttgcccgacggccagccgctgctggccggcgccgagatgacgctgcaacgcggcgatcgcctgctgatcgtcggcccttccggctgcggcaagtcgacgctgctgcgggccatcgccggtatctggccttacggcgcgggcgccatcggggtagcggccaatgccaacacgttgttcctgccgcagcgcagctacattccgatcggcacgctgcgcgaagcgttgagctacccgagcctagcgtcggaatacagcgatccgcagctgatgcgg

SEQ ID NO: 3599 - DNA, 1161 bp, Glycine max
  Peptide Sequence Number=SeqID_95284
atgcacgccgatcagtctcaggccgtagcggcgaattttctccaccgcctgcggcaggtcggcataccagataccgtgcttgctgttctcgccgccggtgttggttttctggctgtggccgtggccaaaacccgggttaatgcgcagccacaccgggtgccctgcggaaacctggccgagctgatccagcatgtcgatggaaccggcgttgaccgggatcttcaattcgctgacgcgcgccagcgtggcgtgatccaacacgtccgcggtaaacacgatttcgctcggttcgccgcccggctgaaaaccggcttgcagcgcccgctcgatctcgcccagcgacaccgaatccaccttcacgccctgctcgcgcatcaagcgcaaaatatgaatgttcgaacaggccttctgtgcgaagcggatagtgtcgaagtggcgcagctgagcaatgcgctggctgatgatgtccgcatcataggcccaaaccgggcagccgaaacgctgcggcaaggccaacaggttagcggcgttcaacgcagtggaggtgtcgtgcaacgggcgtggcatggcgatattcccaattcaaaaatgacggcagataacgccatagtgccgcacgctgaatcgggtggaaaatatctatttagccgtagtctattcatttatgatatagctttccccttaatcgagcgccctcgccatgcacagcatctctttgcggcagatcgaaatctttcgggcggtgatgaccaccggcaacctgaccgaggcggcggccctgctgcagacctcgcaaccgaccctgttcgatcgggtgcgcgggcgcttgtcccctaccgtgcagggcctacggttgttcgaagaggtgcagcgctcctattacggcctcgatcgcatcgtcaacgccgccgccggcatccgccagtttcagcaggcgcagctgtcgatcgtgtgcctgccggtattttcccaatcgctgctgccggcggtgtgccggccctttatcgaacgttacccggaagtcagcttcagcgttatcccgcaagagtcgccgctgctggaagagtggttgtcggcccagcgccacgatctcgggctgacggaaaccaccctgacgccggcgggcaccgagcgggtgacgctgatgacgttgaacgaagt

SEQ ID NO: 3600 - DNA, 484 bp, Glycine max
  Peptide Sequence Number=SeqID_95285
tttgggcaagaacaacagtggcagaaccagcctggtatgcaccagaggaaatcacgggaagtttgggttaggctataaacccacgcaagctaacataaggaaaagtatcgcgaaaaggaagaacagaggccaaggctcacggttaggacaacaagccgaaggggccccgccctgccacatcagtagaacctttataagttcgggtctaagacacgaaggccaagtcgctgcgatatgcgaggatgaccccccgaggggatcagttttggtacggccatgtcctcctggtttccgactaggaaattggcgagtggaggagtgcccggacgtttacgcgacaagcataatattcgacgatgagtccctcgaaggtactaatacccgggacccgaccatcgatttcgagcaagaagcgggtcggatggagagtgaagaggatgaggatgagggacttcccccagagttggagaggataatcgcttag

SEQ ID NO: 3601 - DNA, 234 bp, Glycine max
  Peptide Sequence Number=SeqID_95286
atgcccttttgcgagcgtgcgaggcaaggctcacgggtgcgctttccaagggaggaaagatgcacggagtcgccaccaacgtttgtttgtggaaaatgtcgaaaaaaccgaaggaaaccggtcataaagaatattccaagttcacgagttgtatttacgcttgaggaaggtcgacaaaagcggggctcttgctcctacgtaccctccatcgaagaggaaatcagacctacgtag

SEQ ID NO: 3602 - DNA, 111 bp, Glycine max
  Peptide Sequence Number=SeqID_95287
atgggtgttaaaaattttgaggtggtcaagcgaaagttgcatgctaacaaacaatggtccccggacgaaattaggatattcataatcaaacatggccttcatcatccttaa

SEQ ID NO: 3603 - DNA, 252 bp, Glycine max
  Peptide Sequence Number=SeqID_95288
atgtcgatctccccctgcggaagtatcagttgggatcgtgcccacaaggcacccagtggacccgaaggagccctacagggccctggggtttccagctttggttacgggcctttgtcatttctacagggtgcccgtcccccccagcaaaagggggaggagcttgccacccagctcgcgcaggcgagccaggttgcttcctccaaaagcaacagccttctggaggaagaatctcgaaggcccaagtgggcctga

SEQ ID NO: 3604 - DNA, 581 bp, Glycine max
  Peptide Sequence Number=SeqID_95289
aaactgccggaaatggtcgtggtattcactccagagcgatgaaaacgtttcagtttgctcatggaaaacggtgtaacaagggtgaacattatcccatatcaccagctcaccgtctttcattgccatacgaaattccggatgagcattcatcaggcgggcaagaatctgaacggtctggttataggtacattgagcaactgactgaaatgcctcaaaatgttctttacgatgccattgggatatatcaacggtggtatatccattggaacctcttacgtgccgacaacgtctcattttcgccaaaagttggcccagggcttcccggtatcaacagggacaccaggatttatttattctgcgaagtgatcttccgtcacagctgtccctcctgttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 3605 - DNA, 894 bp, Glycine max
  Peptide Sequence Number=SeqID_95290
agcacgatttccgaagagaccttccagacgctgctggtcagcaaggcgctggaaaaactgggttacgacgtgaaagaaccgcgtgaagtggattacaacgtcgcctacacctcgatcgcctccggcgacgcgacctttatcgcggtcaactgggatccgctgcacgccgatcagtacaaggccgcaggcggcgaggccaagttctaccgcgaaggcgtctacgtcaacggcgccgcgcagggctacctgatcgacaagaagaccgccgagcaataccacatcaccaacgtcgagcagctcaaggatcccaagatcgccaagctgttcgacaccaacggcgacggcaaggccgatctgaccggctgcaccccgggctggggctgcgaagcggtgatcaaccaccacatcaaggcctacggcctgagcaacaccgtcgagcacaaccagggcaactacgcggcgatgatcgccgacaccatcacccgctacaaagagggcaaaccggtgctgtattacacctggacgccgtactgggtcagcgatgtgatggtgccgggccgcgacgtggtctggctgcaggtgccgttctcctccctgccgggcgagcagaagaacgtcgacaccaagctgcctaacggcgccaactacggcttcccggtcaacaccatgcgcatcgccgccaacaagcagtgggccgaagccaatccggcggccgccaagctgttcgccatcatgaagctgccgatcgccgacatcaacgcgcaaaacctgcgtatgcatgaaggccaggcttcggaagccgacatccagaaccacgtcaacggctggatcaaggcgcatcaggcgaccttcgacggctgggtgaaaaccgccgccgaggcggcgaagccgtaa

SEQ ID NO: 3606 - DNA, 267 bp, Glycine max
  Peptide Sequence Number=SeqID_95291
atggggtttagaataggtagcaaaatacctttggcaatttacactttgggtgtggtagcaaaatacttggatatagccaagattcggctgcccatcacccgggcttttattgagaagtactgcacccagagacaagctcagggggatgctccacaggccgcgggcgcgccaccaccacctcatcaggctggcccgactgggtcattcgacatggagcagtatttacatcatttggttcgccagcaggcagccaaccaccgggcacat

SEQ ID NO: 3607 - DNA, 72 bp, Glycine max
  Peptide Sequence Number=SeqID_95292
ctatttgcttacctaaagaggaaggtggtttggggattaaagaaatatctaaatttaatgaagctttgctgg

SEQ ID NO: 3608 - DNA, 228 bp, Glycine max
  Peptide Sequence Number=SeqID_95293
atgggccatatagcaaagatatgttggtgggtgtccaagaaaccaactcaatctgatgatatacctcaagcacttgcagcccttaccttagacaacacaattgctgaaacaaaatggagctttgacaccggggcctctaatcacatgacaggtacagactctgtgcttattggtgatggttcttgtggcgtccctaaattaatgactggtttaatagaaataatttaa

SEQ ID NO: 3609 - DNA, 489 bp, Glycine max
  Peptide Sequence Number=SeqID_95294
atggtggtggttgtggtgatgaccaggatagttgtgatgaaaatcgatcatgacggtggttgtggtggtagtggtcatggtggtgataagtttgggatagtttatgataacgccaccacctacggaggaaacctcgagtttggatgcctcgagagaaacctctcagtaagcttgtgccctaatagtgtcaggttgctagtgttcgttggtggaggacgtttgtttgtgggcgacatgatcatccttttgtctcagggtgtcagaatattgtttgccaagggacggctcttactatatggtaggtcatccttagggttgtattgcttcatgtgtctttgtcttgtttgtctgtatgtattgagttggcctcccagggatggaggacgactgcccactgtccctcaagtgctatggtgcaagcactttagtcatgagttggctttccaaggagggatgcgtccctctagttctaaggatgttaagacgtaa

SEQ ID NO: 3610 - DNA, 403 bp, Glycine max
  Peptide Sequence Number=SeqID_95295
tgatgaaacaattgtgggtgctcaaagctcaaagctttctacgctgccagttaacaagttgattgtgctttacgtggttttcaagcttgacgagagttacacgccaagcaaagtttccatccgtgccggtgatggttttcacaacttgaaggagattaagactgtggaacttgtgaagccaactgggtgggtttatccatccttgtctggagttgatcctagtgtggatgagaccaatttgaggtccatgcttgtttcatcaaagaggttcaatagcacattgaaggtagatgatgatgggaaatttaagtcttggagttttggccctgctggctttgcattgagcttgttgtggtcagagattggtggagagcctattgtggtgttgcacttttggagatag

SEQ ID NO: 3611 - DNA, 459 bp, Glycine max
  Peptide Sequence Number=SeqID_95296
atggaaacaactaaatcaactcaacgagcactccaaagtgtagaaatccaagttggtgagctggtagaagtagtgactcaatttatggtcagacaagaaaaatcctttgtagaggttgaagctcaaaagaaaagccttgtacaagagcatgagtcaagagaaaaagatgaggagaaagatgaggaacaagcacaacaacaatgggagaagtactcaacggtagaaaaccaacaagaaaatattctccaaagcaataaccttcctcatcagctgattgacaagaagggaaggcaaggagagcatgaggaaaccttaagtgccattctttctttaataactaacacctttcttgaaatgatttggaatttccttccagattatatgaagttcatgaaatttctagctaaaaggcgaaacttcatggaagatgtgttctttgtgactttcatgccaccttaa

SEQ ID NO: 3612 - DNA, 483 bp, Glycine max
  Peptide Sequence Number=SeqID_95297
atgtgggcctttcataaaggtttacaaattgattgggcacaccttgttagatatcgcatgcataaggcattgcgattgaatgcctcattgccttgtcctcatcttgttacccttttccttcaacacttcaacatccctcttgattctgaaccttatgttccaatcaagagatcattccttataggtgcttcagtcatagcatcctttggttatataaaggagcatgatggctcttgggtgaagaagggtgctagaaatgttggtgaagaaggaaatgaaggagaagattcatctctttttttaaagattatggaaaggtttgatggttttcaaacctttattggtgagaggtttgatactttggaactgcaagtggatatgcgcttcaatgaaatggagtcaagaatgactaaggttgaagaagatgtatcttatatccggtcaagctttgatcttccaccaccgccaccaccatcatcttag

SEQ ID NO: 3613 - DNA, 369 bp, Glycine max
  Peptide Sequence Number=SeqID_95298
atgaaaggtcagattaggagtttcattctctaccgcaaccacgagccaagttggaagattccgctccaatcgacgggttcctctcattgtggagtttcaacgaagaacaacaacgttttgcggtggctaatggtggctgtgggtgatggagaaagtgcttgggacattagaaatggctttggaagaaggaaaggagaagaaatggcatttttcctaagctacacgaaagcaaaggctgaaaccaaatttcgagaagatccaacggttaacgaaggttgggcagcgtttttaccgaggcagtttcatgtagctttctctagaagcttcattaaaaggcttcctccagaagcttcatcgtggcttctttga

SEQ ID NO: 3614 - DNA, 366 bp, Glycine max
  Peptide Sequence Number=SeqID_95299
atgtttcttcatgtcggactcagccaacaagttgtgattgcgaagcataaaggttatgtgagtggtagcttgtcggatgaggggaaggttgaacttggaggagattctggtaaatcagaaagttctttggagaaaggcttagttgatcgcagtgacgcttcagatgttgatgctaaagtagataacatggcgaggtgtttcagaaccaaccagaggatactggtattgtcagcagccaaagttgccaaaaagatgaagctaaaatttactaaagaatggattgcatatcttagattgcctcttccaattgatgtttacaaagagctgaagcattatattctgaaacatggtgcgaatgtcatgtaa

SEQ ID NO: 3615 - DNA, 81 bp, Glycine max
  Peptide Sequence Number=SeqID_95300
atggcatatgccttctctcatcaggtatatgccatttttcttgtagtgattctcaaagccactaaaatcctttatcattag

SEQ ID NO: 3616 - DNA, 471 bp, Glycine max
  Peptide Sequence Number=SeqID_95301
atgcaatcacagagacttgcactgcctccgaagcatgaggttggtccctcaggtcctcgtgtcagcacaaaggagagttatgttgatcccttagggaacgatccaaagacgggtgactcagacatatgtgggctatacattgaagcaaatccttcccacccgattgccttaggaagagtttatgagggatccacagcggttcacaacatccctttgtcgcatggccaagtgaaggttggtgttgaggatgttaaagatgtagaggctctcgttcctgtacccactgatgaggttaccttagtggggcaggcacttaacaccttccttgcttggctggcacatctcgtgaagttatcagaacaggtagctgtgtctccagcaaaacctccagaaaggtcaaatcctgaggtcgatgatccgttgtatctgatgacattgaccatcccaaagctatttttgaagcctttgcag

SEQ ID NO: 3617 - DNA, 827 bp, Glycine max
  Peptide Sequence Number=SeqID_95302
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatagcacgtaggctcgacaaaacagtcgccatgatcgaacaggggttggcaggagggacctgtctcaatgtaggatgcgttccttcaaagacgttgcttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 3618 - DNA, 90 bp, Glycine max
  Peptide Sequence Number=SeqID_95303
atggaggtgttcatgattcaagccaagatagaagaggatgaaaaggaaattgttgaaattgagatttgcttcccaaaacaatccgagtag

SEQ ID NO: 3619 - DNA, 323 bp, Glycine max
  Peptide Sequence Number=SeqID_95304
atggtgaaagttggaacctcttacgtgccgatcaacgtctcatttaatctaaaccaaatatttggcccagggcttcccgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 3620 - DNA, 132 bp, Glycine max
  Peptide Sequence Number=SeqID_95305
atggctaccaaaggttggagctttgttggagcttcaatggtggaggaagaagaagagaatggcaacgtgagagagagaaggaaaaggcttctgaaatttttggggctgactatgccacatgtctccatttga

SEQ ID NO: 3621 - DNA, 180 bp, Glycine max
  Peptide Sequence Number=SeqID_95306
acttatcaaggtaatccttgtggcgtctaccctgacttatcttccttcaccaaaagtggcatctaccctgacttatcttccttcactggaagtggcgtcatccaaatctccgtagcctgtatcaagcgatccgctcctagtcaggttcacatcatctggtatcagagcttcagctcttga

SEQ ID NO: 3622 - DNA, 294 bp, Glycine max
  Peptide Sequence Number=SeqID_95307
atgagcaactactttattggttattctgaaagatccaggagctataaattttatgatcccaaattaaagacaatttttgagacaggaaccactacattctttgaggatattgagtttggggggaggaataaggttagagactttgtcttagaggaagaatcagtaacaattccagaaccaattcatatagttgcatttgataaagcaaattcgaaacctctacaagatattgttattgaatcccccactcaagataatttggtcgttcatgaagaacaaactcaagatccttaa

SEQ ID NO: 3623 - DNA, 303 bp, Glycine max
  Peptide Sequence Number=SeqID_95308
atggtaatatcgaatgtccttctgtttttgctacctaaaaatcccaaattggaaatgcgaaccctaaggcaatctcgtgtgtgtgaggtgtcgctgttgattgttgatggtagtgttcgtgtgtgtgaggtgttgctgttgattgtcgtagggagatggaagtaccttttgtttgcaagttttgggatccacgaggtgattagtgctttttttttgttgtggtggtcccttatgtctttgttggtggagtggtcccgattttgtcttccacgaggccaaccgaagaacaaacaaggaggttaa

SEQ ID NO: 3624 - DNA, 240 bp, Glycine max
  Peptide Sequence Number=SeqID_95309
atgttaggattcacaagcgattctcctcaaattttagccatcccgcatcaattagactttgcaccttatgcttcagggccatacaatgctcaatggaatgccccggaactcctccacgataagcaccgtttgcgtttgagttggatggcctttgtggataactgggtggtgggtaaggagaagggttgctattggttgagtaatgacattgttgggttggtgggaaacttggccgtatag

SEQ ID NO: 3625 - DNA, 225 bp, Glycine max
  Peptide Sequence Number=SeqID_95310
atgagtgtggcgtggtgcgcagtggtgccactcatttgtttccatgttgtagagtggcaccaacccgatagagtgttgcgacaatttggaatgcaacaacctatttcggaatctccttcgcaaccacataatatccatgggctaacgctgaaaggcaaacaagatgaaaattggcgaaaaacaaagatgtttgtcgaccaaaacaatgcaaagacatctacattg

SEQ ID NO: 3626 - DNA, 486 bp, Glycine max
  Peptide Sequence Number=SeqID_95311
atgggacacaatcggacatccgaagcttcttttctgaatttcgagcgtctcgatacactacgggacataatcggacattcgagtaaaaagttattgtcgtttgattttgctcagagcttcaattctgaatttcaagcgtctcgatataatactggacacaatcggacatccgacatctcgatacacttcgggacacaatcggacatccgagtaaaaagttattgtcgtttgattttgctcagagcttctgttctgaatttggagcatctcgatatactacgggacacaatcagacatccgagtaaaaagctattgtcgtttattttgctcagagcttcaattctgaatttcgagcgtctcgatatattacgggattcattcggacatccaagtaaaaagttattgtcattttatatagctcagaacttctgttctgaatttcgagcttctcgatacactacgggattcaatcggacatccgagtaa

SEQ ID NO: 3627 - DNA, 534 bp, Glycine max
  Peptide Sequence Number=SeqID_95312
atgtcttccaagcaaagaaagagtggcggttcaaagcccaccactcaatatgatacaagaagattccactcttttgaggcttggaccagatacgatgataatgtcatgggaagacatatattagctgagaggaaagtggaaatatatcatacagagctggatgaatttaaggctgaattggagaggcgtaactttcataagtgcctcaccaatttagatgacagtagcattgacctggcattggtgaaggagttctacgccagcctctacagtcctgaggggccttcaccaaaacaagtcagaatacgaggccacttgataaggattgatgcagatagcctcaatgcctttttagaaacacctgtggtgctttctgagggtgaatctttacccgcttactcaagatactgcaggatgcctactgacatcaaggaaattgaggttgctctatgcatacccggccgagggttgattttaaatgctgaaggtcaccctagaaagatcatcagaaaagatctaaccacttttgcttag

SEQ ID NO: 3628 - DNA, 210 bp, Glycine max
  Peptide Sequence Number=SeqID_95313
gataagcctgaagagagttcttccacgccaacacacgctcagtgcatatgcagctcgctaagcgaggcgattgtctcttctgtgctaagcacaagattggtgctaagccaaatatcacttactcgtgctaagcgcgccttcgagatttatgagtttttgagtgattctgaggttcctagaggtggaggagacatccccactcctttgtaa

SEQ ID NO: 3629 - DNA, 138 bp, Glycine max
  Peptide Sequence Number=SeqID_95314
atgaaagctatgccaagcaagcccataagaaaaggaaggaagtggctaaaggcccaagtggagaaggacgaaggcctaagtggagaaggacaaagcccccgagtggagaaggatgaaggcccaagtggagaaggatga

SEQ ID NO: 3630 - DNA, 1026 bp, Glycine max
  Peptide Sequence Number=SeqID_95315
atgaaaagagaaaaacatgcctccgatagtagtcataactattgcaagagcctaagtgaagaacttcgtgactattacgaaggaaggcataggtcacatcttagacctcactcccatagaagagaaaaggaaagaaagcctcaagaggctaacattaacctctcatacttccatgggaaggacaatgtagaggctaacttagattgggaaataagggtagagcaacaacttaaaaagaagtctacttcaaaatcttatggctctcactcttatccaaagaaagaccaaggtcaaggcatcttaggggtgacaccttctaagcccaaagatgataaggggaaggcaatagaaaagcaagcccctaaggctaccaagatagaggctactacttcaccttcctctagtgaaagtgaagaagcaaaaggggaagaatctagtgaagaaatctacccccaagaagatggacaaccattagtggttaaagagaagtgtaaggaggtaagtgtctcctccaagaggttagctaagaaggaaactcattttacaataaagacaaacattaaagaaactttccctcttagacaacctccacattttctcttttgtaaaaagacacttgctagcattgccacacctcttgggcttgagtttattcctcaagtgaagaagttgttggatgagggtttggttcgcaagagcttaaatccttgtgctttgttggtacccaaaataggtattattaggcaccaaattcctaaaataggtggtatgatgaatgttttgagtggtgcaaccctcttttgtaaaatcacttgtgcacctaacatcctcatgtttcaatccaaactcagtgatcaaggggttcccatgaaccctaaaagaataaaggtcattcctgagtggcccactccaccaacaccactcattgagttggtgaggaaccatgttccttcatgggaagatgcccaggaaatgggttttcagaccttaccctactctaacatacccaacaccactaatacatat

SEQ ID NO: 3631 - DNA, 498 bp, Glycine max
  Peptide Sequence Number=SeqID_95316
atggctccaaagaaacttacctctaagagagctaggaagaccactgaaggaaaaggatctagcatagctccacctgtagagtttgaatttgatggacaccgcttttttagtgaggaacatcaatgccgctttgaagagaccaaagattggtctttcctcaaggaaagaagggtccaattagctgagggtgaacattttgaattccaaacaaagatttctaggaggcactggacacaacctgcaaagcccatgcctaaatatgaccctgaagttgtcctggaattctatgcaaatgattgccctactgaggaaggtgttttggataagcgctccaaagtgtggggccaatggattccttatgacatagatgccatcaaccaatttttagggaatccattgatcttggaggaggggcaacaatgtgaatacactacaaggagaggtcaaactacaaagagaagctctatgcgtgattctacaatcgattaccacacgtga

SEQ ID NO: 3632 - DNA, 279 bp, Glycine max
  Peptide Sequence Number=SeqID_95317
atgacacctgtggaagcaatgccttccaaagattattttgatgatgccaaagaatcaagagttaagcaaattccaaagattcaagaatcaaatttcaagaaacaagattcaagattcaagaatcatgtttcaagaatcaagatcaagattcaagaatcaagagaagactcaatcaagataagtactaaaaaaagtttttcgataacattgagtagcacaagaagttttcacaaaatcattaccaaagagttttactgtctagtaatcgattaccagaag

SEQ ID NO: 3633 - DNA, 237 bp, Glycine max
  Peptide Sequence Number=SeqID_95318
atggcacaccctccaccccgtgagaggactctaagggaattggctgcacctgatttcacctacgaaagcttgtgcatccaataccctgatgaggatgtcccatatgttcttaaaactggactgatccatttgcttccaaagtttcatggccttgcaggcctttcctcattctttagagggagtggcgaaggactggctatattaccttgctccatggtccatcacgagctgggatga

SEQ ID NO: 3634 - DNA, 85 bp, Glycine max
  Peptide Sequence Number=SeqID_95319
atgaatgttcctgtaaatattctggtggaaaaatttgaggatgaaggattacctacaggaaaggtggttgttgttctcaacaatg

SEQ ID NO: 3635 - DNA, 503 bp, Glycine max
  Peptide Sequence Number=SeqID_95320
atgtcacaatgcccctcctccgcaccgtacgtagaagcggcggaagaatcattggaaacggctttccaatcctttgaggtggtgagctgcgcctctgtggaaccaagtccgtcgctaccttctctctccaaagcggccataatggtggcgcgtgttatgcttaggaacggatttgagcccggaatgggtataggaaaggactgcctcgggaatgccgacgtggtcgatatcaagggaaatccatacaagtatggattagggtatgaacccgggatgccggggaggaggaacgtgccgtcaagatttcgggcggatagggtatggcccggctgtattagccagtgtttcaccagcactggaatggtgtccgaggaggaggtgaccgcaatagaagaggagttccctcaagacccaccaagttttgtgcaagcatgccaccccaattcccaagtggggaactggcgcgtgataagccagtcagaagtctatatcgctgattcaat

SEQ ID NO: 3636 - DNA, 390 bp, Glycine max
  Peptide Sequence Number=SeqID_95321
atgagtgcatcccctccaggttgcttagtgatgaattttcctgagcacaccgtctactttgatgagtacacccccttcagattgcttagtgaagagaactttgcggattacatgtcgatgggtgttaagcgtctcaaactgatcaaccaaggtccgcatgccaacaacgattgtccccggatgaaattaggggactctggtagcctaaaaacaacgaaagcaagtgccatcggacttgccatctctggacgacgtggtgcagataaccgtaagggtgtagatgaccacattggtctctgcttgtcatcggacttggggtctccgaatgacgagctgttgataactgtaaggtgtctctgcatgccaccagactctcgggtcgctggatag

SEQ ID NO: 3637 - DNA, 270 bp, Glycine max
  Peptide Sequence Number=SeqID_95322
atgcaaagaagatctcctataggtgatttgatccccatcgatttggagattaacgctacttgcaggaggcacaacatagagagaattagcaaatttttgcaggacttagaagcagcagcaactccagaagaagaacctcaatcttccgaggtgtcttctagctttcctattcgaaggcaatcgcatacaaatttaattgaagaagttatcatggctaaagagccaaggagagtaaccccagaagattactcaagttcaagtgtgccgtaa

SEQ ID NO: 3638 - DNA, 1002 bp, Glycine max
  Peptide Sequence Number=SeqID_95323
atgtggctgaaagggttgaagacccctgtgtttctatttggaaatcgcgatgaacatgatcgcactaagcccgaccatgtcgcgctaagcacgttcattcttctgatgagtttcaatgacgaatctgctaagtgcgtctgtgcgctaagcgggcctacctgggaaaggtacactgacattattgttcctaggaagctgctgctagagagaaatgtggtaatctaccacactgaatttgatgaattcaaggaagaattggagagaagaagatgggatgaagaattgaccagcttttatgctaacctctatgatccagaggacaaatcaccaaagcaggtgagggtcataggtcatttgataaaatttggtgaagacgccctcaacacattcctgaagacccttgtgatcattgaggagagggagacattattagcttattctaggtttgcactcttaagatctgatcctcaagagttagctgctaagctctgcatcctagggaggggatttgagctgaatgctgatggtcagcctctgaagatcctcataaagatggacatgaatcagggctacctcatctcccatcagatttctattacccagcatgactcctctcggcttggatttccagccttaatcacaactttgtgtaaagctagaggggtcacatcagattctgaatccttggagagccttagccctgccattaacttggcatatataaagaagaattgtagggatctagatgatccaacagtgacattcagagggccaaggaaggctaagggtaagagatctgaggctccccctacttcagcagcaccagatgcctctgctccttcttcatctactttaccagaccctacttcagcaacaccttcttcttctactccagccactcctgcttccataccagctcaatttccaattcagctcccagcttcttctgctcctgcatcagattttgtgcttactctagagatgcttcactctatgatgtag

SEQ ID NO: 3639 - DNA, 159 bp, Glycine max
  Peptide Sequence Number=SeqID_95324
atgtcgcggaacttcacggattgcctaacgatgggtttcaagtacctcgaagcgatcaagcgaaggtcgcatcccaccaaacagatggtccccgaacgaaagtgggcaccgaacgaccaacatcatcctgataccatcgaattcgttcccctcggttga

SEQ ID NO: 3640 - DNA, 489 bp, Glycine max
  Peptide Sequence Number=SeqID_95325
atgtttctgaaaatcaagattggaatgctcgtttatttgcccaggattggtttcgagaatcacaagaggggttcagcaaatcagacttgccaagtcaatgcacttatagatataaggtgtacattgaaggttctgcttggtcagtcagtcaaaaatacattctgtcatgtgactctaccactctacgtgtacgactacatgtttcatctcctgaattcatatgctaaactcttcagatacaaaccctccataagtgctaatgctacagaactatgtgtggagtcaatggtttgtggagcagaaggatcagtaaagaaatttatgatggaatcattggtcaaggttcctgcaaataccgacccttgcaccatgcctgccccttttgaccctccaactttgtatgcaacattacagagaaaggaaagctcaattcaacaagttgaatcatgggagaaaagttgttgggataatcaaaccataacatcttaa

SEQ ID NO: 3641 - DNA, 1184 bp, Glycine max
  Peptide Sequence Number=SeqID_95326
gtaaaggcgagtcggccccgttcatagacattctcgcactgttgatcttcggaggagtcctctttccgaatgtggatgggttggtggacctagcaacgatcgacgcttttctcgcctatcataaccacaaggaaagcccggttgtcgctatgctagccgacctatatgacaccttcgaccgaagatgtgaaaagagcaatacaaggattgtttgctgtactccagctctttatgtatggttagtttcacacctttttcgccaagaggtgaggcatgcttgcccggtagaaaaccaccgttcgtgcacagagaaaggaggggcaaattgggaccaactcttagcaagcaaagaaggagcatctgtcaactggttccttcaatggagggaaggaagaaccagagttcttatttcatgcagaggatttccaaatgttcccttgatagggatgaggggttgcatcagctgcaatcccgttcttgctataagacaacttggctaccctatgataggggcactactagaggaagagcccgcgcctgccatttcacgaggtttcaataaaactgacgtggaaacacttcagaaggtccgccaggcatgggaggtggtgcaaaagaaggacaaagaactcaggggtagtaacaatgggcccatcggtggctaccgtaagtggttgaaagcccacgtgcaaggtttggattggctcccgagtttgagaaccgttaaaagggaggaagtggaggcatcggaggaagacgaagaggtgcaggcccttagggcaaaactcgagcaagcccaaatagtcaaagagaggttcaaattagcagctctgaagatccgaaaggagaatgccgaactgagagatataaatgaagctaccaccaaagccttggaacaagaaacgaagaggactcgtaaggaagagcatggccgagacaaattccgtggagctttatggagcagcaacagtgagctcaagcttcgaagggaagagagagaccaatcacgagcacatggcatggtcttgaaagaggagttagctgcttgctcagggtccaaaagaagcttgtctcaacatttatgcgagacagagaccaacatgttagccatcgtcagcaaataccaagaagagctaaatctagccacggcctatgagcataaagtggcggacgaatatgcccga

SEQ ID NO: 3642 - DNA, 1545 bp, Glycine max
  Peptide Sequence Number=SeqID_95327
ttcaaagggctgcacaccctcgccttcagtgggctacacgtccttaccttcagaggactacacgtgctcaccttcagaggactacacatcctcgcgttcaaagggctgcacgccctcgccttcagaaaagtgcacgtcctcgccttcagagggttgcatgcccttgacttcagaggactacatgtcctcaccttcagaggactacacatcctcgtcttcaaagggctacatgccctctccttgaaaggactacacgggctcacctccagagggctacgcgccctcaccttgggaggtccacacgtcctccccttcagagggctacacgcccccgcctttagaggactacacgtcctccactttagaggactgcacgtcctcgacgtcagaggactacgtgtcctcaccttcatacggctacacgccctcaccttcaaaggactacacgtcctcgccttgaggactacaggtcctcaccttcagacgactacacgtcctcgtcttcagagggctacaagccctcgccttcagagaactacacgtcctcaccttcagaggactacacgtcctagccttcagagggctgctcaccccttccttcagagaactacaagtcctcgccttctgaaggctacaggctctcaccttcagtggactacatgtcctcgcattaaggactacgtgtcctcatcttcagagggctacacactctcaccttcagaggactacagactgctgcacgccctcgccttcaaaggactacacgccctcaccatcaaaggactacacgccctctccttcagagggctacaagccctcaccttcagaggactacaagccctcaccttcagaggactacaagtcctctccttcagaggactacacgtcctcgccttcagaggactacacgtcctcaccttcagtcggctacacgccctcaaattcagaggactacaccttctccgcatcagagggcaacaagtcctcacctttagagagctacaagccctcgtcttcagaggactacacgtcctccccttcagaggactacaagtcctcgccttcagaggacaacacgtcctcaccttcagagtactacacgtcctcaccttcagacggctacacgcccgcaacttgagcggactacacctcctcgccatcagagggcagcaatggactacgcgcctgccctttagaggactacacgtcctccccttcaaagggctgcacgctcttcccgtcctcaccttcagaggactacatgtcctcaccttcagaggactacacgtccccgccttcatagggttgcacggcctttcctttggaggactacgcgtgctcaccttcagagggctacacgcccttaccttgagaagactacacgtcctcaccttcagagggctaaactccccctgccttaagaggactacaggtcctctccttcagaggactacacgtcctcacctccaaagggctgcatgcccttgcccgacctcaccttcagaggactacacgtcctcgcgtttagaggactactcgtcctag

SEQ ID NO: 3643 - DNA, 426 bp, Glycine max
  Peptide Sequence Number=SeqID_95328
atgcctcaaaatgttctttacgatgccattgggatatatcaacggtgtggaacctcttacgtgccgatcaacgtctcatttcgccaaaagttggcccagggcttcccggtatcaacagggacaccaggattatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 3644 - DNA, 240 bp, Glycine max
  Peptide Sequence Number=SeqID_95329
atgaattcctttttcttcttggatgaaaaagtggaagaagggtgggcactaagagcatctggatttttcttccatgcttgttatgcggtgctattaattgaaacaaaggatcaagaaggtcaatctcaagttctatcagcagctcttgagattgccgaggatgaaaatgttgaagtcgaccccaaatttcgtgctttagttgctgttggatcactggtatttctaagtttctatctctag

SEQ ID NO: 3645 - DNA, 214 bp, Glycine max
  Peptide Sequence Number=SeqID_95330
ggcgggatctaaaagttctccaacgtgttgcggagccttcggccgtgagaggccacgtgatgattcaagattcgtggtaggcgtaggagctgggcgaagcggtagcgaagctcaggtggtgatgcaagtgcgcggtgagcgtagtagccccctcgggcatgctctttgtacaaccaagcgaagagctagtgagggccggaaatatcgtatgtag

SEQ ID NO: 3646 - DNA, 501 bp, Glycine max
  Peptide Sequence Number=SeqID_95331
atggatgaatactttagagtctcaaattgtaagaatgcaaaagaaatgtggggtacattgcaagtagcccatgaaggaacaactgatgtaaagagatctagaataaacaccctaacacgtgaatatgaactttttagaatgaatccaaatgaaatcatacaggatatgaacaagaaagcaaagaaagcttacatcacttgggaagataacgatatagattcatcaggagattcaaaaaatgaagtcgtgaatctgagtctcatggccaaaaactatgacagcgaagaagaggatttcttgaagaaaagctggtacattgatagtggatgctataaacacatgacgggagatgcatcaaaatttactcatatatttcccaagaaaagtggacatgtgacttatggagacaacaacaaagataaaacatcaaatcatgctcaatgtttttttttggtaaagatgatgattcttggttatggcatagaagaattgctcatataa

SEQ ID NO: 3647 - DNA, 208 bp, Glycine max
  Peptide Sequence Number=SeqID_95332
atggaatataaagatcctgagtttgagctgctgagcagcctggaacagatcatttttaaagatgtaccgcagacgattaccctgcaacaaaaatccaatccctttacagaatatgagcaattgcgcaaagggacaggactgaaaaccgaagaattcgccagagcgatgggtgtcagcgtggctatggtgcaggagtgggagtcaaaac

SEQ ID NO: 3648 - DNA, 372 bp, Glycine max
  Peptide Sequence Number=SeqID_95333
atgaggacgcgtagccctctaaaggcgagggcgtgcagccctctgcaggcaaggatgtgcagtcctctgatggtgaggacatatagtcctctaaaggtgataggtactagtacccaagggtccacctttatgagaaagcaagagatcgactcatcgagagggccggtcatccaacaagattggacacgagatctgggaacctattgggtgaaaacttctaatcgggccctaggttcgcttgaggttttttacatggttcctttcattgcccccagtgtaaggcttagagaagcaagatgttttgatgtcttgatgatgctaaaggatcaagtgcttctaagttttattcaagacaagaatccaagaaaataa

SEQ ID NO: 3649 - DNA, 270 bp, Glycine max
  Peptide Sequence Number=SeqID_95334
atgtcttttccagtttttccgacgttttcctcaaataaacattggtggcgactccgcgcgtattcttttcttggaaggcgttcccatgagtctcgcgtcgccctcccgccgaagggtaggttgcgacagttggcgactccactggggacttacatattgtcgtactatgtacatccccgtattgtgcctttcgcatatgcatcatgcacgggttctgtcttgatcccctctcttgggaaaaccaacggagggtccgtgccaccttgttaa

SEQ ID NO: 3650 - DNA, 232 bp, Glycine max
  Peptide Sequence Number=SeqID_95335
atgggggtgcaaatagcacccaggcccatttgggccctcagagatcctccaaaggcggttgcttctggaggaagcaacctgctcgctgggcgactgactcgcctgggcgactgggcggaacactcccctattgctataaatagggagaatgcagaaggaatgaatctcgcaaaggtttcaaccgttcttcgacgtcttcatccgttcttcatcgttcttcgatcttcaacgg

SEQ ID NO: 3651 - DNA, 300 bp, Glycine max
  Peptide Sequence Number=SeqID_95336
atgaccaaagtgaacaaagagccatttctaggagttttctgcctttgccctgttttgcttggtttgttagtttgtgatgatttggatgatgaattacctggatgttggggaagcttgggaggattgatggggacccgggttgagaaaaacgaggatatgggctacgtgggagtacgtgagctcagttggaggtgggcaacaggggatggtgggtttatgcgtgatttgtggatgtggaaaacttgttgtgcaccatcgcccgaccgccacctagtaccacatgtgatgggtaccccataa

SEQ ID NO: 3652 - DNA, 625 bp, Glycine max
  Peptide Sequence Number=SeqID_95337
atgggtttaccttggtatcgtgttcatactgttgtattaaatgatccaggccgtttgctttctgttcatataatgcacacagctctggttgctggttgggccggttcgatggctctatatgaattagcagtttttgatccctctgaccctgttcttgacccaatgtggagacagggggtggcttgttttggttttggcgcatttcatgtaacaggattgtatggtcctggaatatgggtgtccgatccttatggactaactggaaggatacaatccgtaaatcccgcgtggggcgtggaaggttttgatccttttgttccggggggggtagcttctcatcatattgcagcaggaacgttgggcatattagcaggtcttttccatcttagtgtgcgtccaccccaacgtctatataaaggattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaa

SEQ ID NO: 3653 - DNA, 525 bp, Glycine max
  Peptide Sequence Number=SeqID_95338
atgggtaaagtggaggaggtacaagagaagatgaaggccgacatggaggccatgaaagagcaaatggccacgatgatggaggccatgatgagcatgaggaagataatggaagccaatgcagttgcagttgccgctaccagcactgttgctaaggtgaacccgatgcccccatctggcctcaaccaaatgaatcatccaacctcagctatgacacatgaaattcgccaccacaatctaaccaacttcgagccttgcctcagatatgccactgaagggcaagcagttggcggtttacccatgcaaaacactgtggagagccctcagtatcacccacaagtacacctcttacattccacaacaagtgaaaaccctcatgctatggcagaaataggaaagttggatcatctagaggaaaggctcagggccattgaaggaggtgaagattatgcctttgctaacctacaagagttgttcctagtacccaatatcatcacccctcccaaagttcaaggtgtaggagtttga

SEQ ID NO: 3654 - DNA, 258 bp, Glycine max
  Peptide Sequence Number=SeqID_95339
atgacaacgatagagaagccgaggcaagcaagggagaggtcaaagctggcggtggtggtggtcttgcccacgctgcccttgttggaggtgatgacagcgatggttttggagaggaggaggagaataggagtggaggaggaatgcggagttgagggcactggtagtgctaaggataaagtggtagtgctaattattaaatatgctgcaggtagtacaatgcagaatgcagtggctacagctaaagagagattgtggtaa

SEQ ID NO: 3655 - DNA, 195 bp, Glycine max
  Peptide Sequence Number=SeqID_95340
atgggcgaggaagagaaaaaaccagaggaaaacaaagtgcaggagaaaaaagcagaggaagaagaaaagaaagaagaagagaaaaaaccagaggaatcaaaagatgacaaggaatctaaggagaaatctgcaccgccagaaatcgtgcaagacacaacctttgcaatgcatgaacactttaagcacgatatctga

SEQ ID NO: 3656 - DNA, 350 bp, Glycine max
  Peptide Sequence Number=SeqID_95341
atgggaaaccatcccagagttcgaatctctgttcctccgccatataagagaagcccgcagcgatgcgggcttttcgcttttctgctttccatccttctgaaaaacatcctgaagcttttcaatctgctgccgcaagctgggcacaatgatcaagaaactgagtctttgcgcgctgtcagtgatcgcggcgctgccgatgggtatgagcgcttacgccgcggatggcgacatgcaactgcagcaggtcctgatgctgagtcgtcacaacctgcgtgccccgctggccaacaacggcagcgtgctggagcaggcgacgaaaaaaagctggccgcaatgggatgtgcccggcg

SEQ ID NO: 3657 - DNA, 1092 bp, Glycine max
  Peptide Sequence Number=SeqID_95342
atggaactaaaagcaacatccatgggcaaacggctggcacagcatccctataaccgggtgcgactgctggctgccggtgtggaagtcagcggcgatcgccacgagtacctgatcccgtttaatcagctgatcggtattacctgcaaacgcggcctggtgtggggcgagctggagttcttattaccggaagagaaagtggtgcggttgcacggcaccgagtggcaggaaacccagcgtttttaccattacctgcagcatgcgtggcagcagtggagccttgagatgagcgaaatcagcgcgcaggtgctgagcgcgctgcagcaggagatcgtcgcgtttaccggccaggatcgctggctgaagcgcagcgaactggccgcggtaaaagagaccatcacgcgccagttttccgccttaccgctgccgctggcacggctggaggagtttgataactgccgcacgctgtggcgcttttgccagcagtggctcgagcagggcgagagcgcgattcggcagcgcaaccgcgagtggagcgcgcgggtgatcagcgataatcacgccttcttctccaccgtcgaaaccacgccgctcaatccatcgcagtgtgaggcggtggtcaacggtgaagacgcgctgctggtgctggccggcgcgggcagcggtaaaacctcggtgctggtggcgcgcgccggctggctgttacagcgcaaactggcgcagccggagcaaatcctgctgctggcttttggtcgccaggcggcggaagagatgaacgatcggatccagacgcggctgggtgagagcgcgattcaggcgcgtacgttccacgcgctggcgctacacatcattcgtgaaggcagcaataagcagccggtcatcagccggctggaaagtgacagcagcgcgcgacgtcagttgctgatcgaaaactggcgcgagcagtgcaacagtaaaaaggcgcaggccagcggctggcgacagtggttgcaggaagagctggcgtgggacgtgccggaagcgtcttgccgtgcggctggagcgctggctcggcctgatgcgcatgcacggcggcgcgcaggcggcgatgattga

SEQ ID NO: 3658 - DNA, 195 bp, Glycine max
  Peptide Sequence Number=SeqID_95343
atgtctgcttacaaccctttcgctaagcggcagctttgtgctaagcgcatctttggtcatgcgctaagtcgagagtctcaagcgcttagcccccaacccttggatctgaggctgatttggtccgccaagctggccaaggatgagctaagccaacttcaattcgatctaaattttttgttgatagccgcgcgctaa

SEQ ID NO: 3659 - DNA, 552 bp, Glycine max
  Peptide Sequence Number=SeqID_95344
atgggtgaagtagaggagatacaagagaagatgaaggccgacatggaggccattaaagagaaaacggccacaatgatggaggccatgatgagcgtgaagaagataatggaagccaatgcggttgcaattgccgctaccagcgttgttgctaaggtgaacctgatgtccccatccggcatcaaccaaatgaatcatccaacctcagatatggtaggcaaagatttgggaagtacgggcagcccccataatgtacaaattcaaaacgagcacgccttcccgccatatggcttgcctcccaactatacaccacccaatgtggcatacactctcagtgaaaatctcaataactccactccggcacatatctctcaaaccatgggaaagacacatgaaattccccacctcaatctagctgacttcgagccttggctcggatatgccactgaagggcaagcagttggtggtgtaccctttgaaaacactttggagagccctcagtttcgcccacaaccacaaccattgcatttttgcggtgggaagagcccctcatga

SEQ ID NO: 3660 - DNA, 678 bp, Glycine max
  Peptide Sequence Number=SeqID_95345
atgaattgcgttttcgttcatgcgtcctccaccttcgagtttggagccatgcgtagtgattgcttagtgcaattctccattctcgaccctttttcggagcccatgaattgcgttttcgttcatgtgtcctccaccttcgagtttggagccatgcgtagtgattgcttagtgcaattctccattctcaaccctttttcggagcccatgaattgcgtttttgttcatgcgtcctcatccttcgagtttggagccatgcgtagtgattgcttagtgcaattctcaattctcaaccctttttcggagcccatgaattgcgttttcgttcatgcatcctccaccttcgagtttggagccatgcgtagtgattgcttagtgcaattctccattctcaaccctttttcggagcccatgaattgcattttcgttcatgtgtcctccaccttcgagtttggagccatgcgtagtgattgcttagtgcaattctccattctcaaccctttttcggagcccatgaattgcgttttcattcatgtgtcctccaccttcgagtttggagtcatgcgtagtgattgctcagtgcaattctccattctcaaccctttttcggagcccatgaattgtgttttcgttcatgcgtcctccaccttcgagtttggagccatgcgtagttattgctta

SEQ ID NO: 3661 - DNA, 114 bp, Glycine max
  Peptide Sequence Number=SeqID_95346
atgaaggagatgcttgccacccagctcgcccaggcaagcacagctcgcccaagcgagctaggttgcttcctccagaagcaaccaccttctggaggaacatcctggaaggcccaa

SEQ ID NO: 3662 - DNA, 543 bp, Glycine max
  Peptide Sequence Number=SeqID_95347
gtagctgtgtctccgccaaaaccacctccgaagcccgatccggaggttatatgggatgccaccgtgttcggggtcgttaatccagatttccccctgtacataaagcacaaagacctctccgaaatcgcacacggtggtcaatgtctcagcatatcagtgttacagttgtggattctgcatctcactgaaacatgtatgcgagcggggaattctgatatctatggattcctcgagcctcagtccattcagaggtctgggcaatcgcagtttgaatctgaaagttacataaagagttggatgcagagttcacaacgcgatgtgtatcttggagcctacctaaatgggctagacaattaccttaaggggattattaatagtgctatcaagggtcttgatgatgctccacagcctaaatcaaaggctcctgctaggtggattgtcgtcaagtgtaatagacaaaaaggaactactgagtgcggctactatgtcatgcactggatgtccaccatcattttaggaagttttagaaataattgggaagcg

SEQ ID NO: 3663 - DNA, 503 bp, Glycine max
  Peptide Sequence Number=SeqID_95348
atgcagcgcaactggattggccgctccgaaggcgtggaaatcaccttcgacgtggcggacagcgaagagaagctgacggtttacaccacccgtcccgacaccttcatgggcgccacctacgtggcggtcgccgcgggccacccgctggcgcaacagggcgcgcgcaacaacccggcgctgaccgacttcatcgacgaatgccgcaacaccaaagttgccgaagccgaaatggcgacgatggagaagaaaggcatgccgaccggcctgttcgttgtccacccgctgagcggcgagaagctgccggtgtgggtcgccaacttcgtgctgatggaatacggcaccggcgccgtgatggcggtaccggcgcacgaccagcgcgactgggaattcgccaccaaatacgatttgccgatcaaaccggtgatcctgaacctcgacggcagccagcctgacgtgagcgccgaagcgatgaccgacaaaggcgcgctgttcaactccggcga

SEQ ID NO: 3664 - DNA, 202 bp, Glycine max
  Peptide Sequence Number=SeqID_95349
agggctatccaaagagcacaaggacctagaaacacttcatgagttgaaggggccaataacaaggtctagagtcaagcttctacaagaagagatggccaagaggatcaaggatggactactcataaaaagaacggaaggagaaaatcacaaggagctgaattggagcacgttgaagattgttgaacaacacgcctgggcttag

SEQ ID NO: 3665 - DNA, 234 bp, Glycine max
  Peptide Sequence Number=SeqID_95350
atgaaggacagaaaggaattgatgagattgaatcaacatgaggagaatgttaagaaaaagaaaggaattgctcttaaagcttctcatctactcaagaaggaaaaaagaataggaaatctgaaaagaaactcttcaatgaaaaagaaggtagaggcctacttacatgggatgacaatgatatggattcttatgaggaatcagagaagaagttgtaaacctgagtctaatgactaa

SEQ ID NO: 3666 - DNA, 360 bp, Glycine max
  Peptide Sequence Number=SeqID_95351
atgggtgaaggagagaaggtgcaagagcagatgaaggccgacacggaggccatgaaaagagcaaatggccacaatgatggaggccaagatgggcatgaaggagataatggaggtcaatgcggctgcattgctgaggtgaacccgatgcccccatctggcctcaaccaaatgaatcatccaacctcaaatatggtaggcaaagatttgggaagtagggacggcccccatgatgtgcaaattcaaaacaagcacgccttcccgccatatggcctgcctcccaactatacaccacccaatgtggcgtacactcccagtgagaatgtcaataactccactcctatacccattgagagccaataa

SEQ ID NO: 3667 - DNA, 252 bp, Glycine max
  Peptide Sequence Number=SeqID_95352
aagcaaacttcattgcttcatgatgatgaatcaagattgattcaaggtgattcaaggtgttttgatcaaaacaaagatgatgacaaaaagcccatgagaaagattcaagagaagtttcaagtttcaagttttcaagaatcaagaatcaagaataatcaagaactagattcaagactcaagattcaagaatcaagaaaagactcaatcaagataagtactgaaaagtttttcaaaacattgagtagcacataa

SEQ ID NO: 3668 - DNA, 308 bp, Glycine max
  Peptide Sequence Number=SeqID_95353
gattttcaaactttcaccggaattgggtgcaagccattggtctatttgctcaagcgacctgtgctcctgagtttggacttccaagaccattcaatcaaagattactcgtcttgcatgttggtggggctgccgtaagacaacaaggacaacccttcccttgtgttcaagaatcctctacaacaagagacccacggtctcttaatcccttttcagaaataagaagaagagaagaagagatctctcttaaaagagatagattgtacaatgaagatcaatcaaaatttcttattgaatatgcaagtggttga

SEQ ID NO: 3669 - DNA, 261 bp, Glycine max
  Peptide Sequence Number=SeqID_95354
atggagcttgcatcagttggttccttagttgtggttctttcttgttgggggtttgaaaaaaaggtaaaagatagggttccaaaagaactcaagataagcgtgatattacttcttagtccaatagctcttaaggtggttggcccgttgcttcttgactcaaattcttcaatggatggcaccaatcctcctttccaatttcctatgtggcaactcacaaacaacgaaacaaagagagaagcaataaccaaagaccaaaaatga

SEQ ID NO: 3670 - DNA, 600 bp, Glycine max
  Peptide Sequence Number=SeqID_95355
atgggtgaccaagaggagatacaggaacaaatgaaagccgacatgtcgactttgaaagagcaaatggattccatgatggatgccatgttaggaatgagacaacttatggagaataacgtggccatcgctgccactgttagttcggctaccgaagcagacccaactctcccagctactgcgcatcatcctctcccaaacgcggtaggacgagaaaggagcacactggggcacatcagcaaccaccatttgggatacaaccgggtggcttacccttatggattaccacctaattacatgccaccagtcatgcatgatgacgcgggtcatgtcccttccctcgtccttgaaggggagcccgtcgaggatcatagagagtatgcccaagtagacgtcgatttctaccccgcggtccccgttgagggtccggcacccaacatactgcctcagcccaacctcccagcacaaccaatattcttgtccacagaaggaccacccccggcggcggaagaaagaaggaaactcgatctcatcgaagagagattgagagctgttgaaagctttggcgactatctgttcacggacatggcagatcttgcttgg

SEQ ID NO: 3671 - DNA, 447 bp, Glycine max
  Peptide Sequence Number=SeqID_95356
atgcttccttttgatttccgccatgttacggaacttcacgtattgtgcaacaatgggtgccaagtacctctaagcggtgaagcaaaggttgaaccgattaggaaaataacaaaaaaaccgtattttcccctcaccggaggctccgtacttgataacggaggacgcatgaacagcgctaggcaatcaattcgtggggctctggactcgaatggtggaggatgcatgaatgacaatcaattcatggggctcctgaataagatttggtggaggacgcatgaatggcaatcaattcatggggctccggacttgatggtggaggacgcacgaacagcgctaggtaatcaattcgtggggcttccgagactcgatggtggaggatgcatgaatgacaatcaattcatgggctccgaactaagatttgatggtaggatgcacgaacagcgctag

SEQ ID NO: 3672 - DNA, 411 bp, Glycine max
  Peptide Sequence Number=SeqID_95357
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatgtgctgactggaaccctggtcctctgagcaaaactttgatggcatctatgcctagcctggactga

SEQ ID NO: 3673 - DNA, 639 bp, Glycine max
  Peptide Sequence Number=SeqID_95358
atgagggttttcctgagctttgacaagtttcttccccaacatgctccattcattagtcgagaagttggcccggcctggttcactgactatttccctactgtcgacccggacaatgaagaagaggtgaacgaaatatggtcattttacttgaatccacagatcctgtcttgtcgtacaggtgttcaatcgaactatttaggcctggttggataccagcctaatttggtttcaagacaatttggcctctcgcaaattcgtcctaaaagcttgttcgaagatcctcaagacgtcataagaggggccaatctttcggaaaagaccttcaagaagtttttgaagatttctcttgatgaaaactataacctgcatccttttgagttcaaccattcccacttctgcaccatggggcttgagagtggttttgcgcaaccaacgatcgagaatattcgctcaagccttcaagctcgaggcaaagcacccatgacgaagaggagtgctgaaacgtctcgagccgacgtgagacccaagaaacccactggggtgaaagtccaagaagggaaacaagaagagaaggaagaagaggagagacctctcataagaaaaagaaagttacctacgacttcaaccaaaatctgctga

SEQ ID NO: 3674 - DNA, 246 bp, Glycine max
  Peptide Sequence Number=SeqID_95359
atgatggcacatcaacctgtcaagcttcattctacacctaaaaaagaggatgagctagctgaacaaaagagaaagcttcctgatcatgagggagttaacaaaacttttcatgcaggtggaccttcttctagtagttctgacatgcagtggcctcctatccctctttcgtttccacctagagcaattctaaacaaaaagatggaagaagtggataaggagatcttagagactttcaggaaagtagag

SEQ ID NO: 3675 - DNA, 249 bp, Glycine max
  Peptide Sequence Number=SeqID_95360
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggtgcgtaacggcaaaagcaccgccggacatcagcgctggcaaagtgtaagcggtcacgctgcgcgtaaccaccacacccgccgcgcttaa

SEQ ID NO: 3676 - DNA, 850 bp, Glycine max
  Peptide Sequence Number=SeqID_95361
atgtattatggatttgatattggcggcaccaagattgcgctcggcgtgtttgataaagatctcaaactgcagtgggaaacccgcgttcccacgccgcgcgacagctacgacgaatttttaaccgccattgccgcgctggtggcccaggccgatgaacgctttggcgtgaaaggcagcgttggcattggtattccggggatgcccgaaaccgacgacggcacgctgtatgccgccaatgtgcctgctgccagcggcaaaccgctgcgcgccgatctctccgctctccttgaacgcgacgtgcgtttagacaacgatgccaactgctttgcgctctctgaagcctgggatgatgaattccgtcgctatccgctggtgatggggctgatcctcggtaccggcgtgggcggggggattgtcatcaatgggaagcccatcactggccgcagttacatcaccggcgagtttggtcatatccgcctgccggtggacgcgctggaggtggtgggccgtgattttccgctaacccgctgcggctgcggtcagcacggctgtattgagaactacctgtcaggtcgcgggtttgcatggctttacgaacacttctatcatcagaaacttgaagcccctcaaatcattagcctgtgggagcaaggggatgcgcaggcgcgtgagcacgtcgagcgctatctggatctgctggcggtatgtctgggaaatattctcaccatcgtcgacccggatctgctggtgattgggggagggctttcaaactttaccgcgattacggaacggttgtccgggcgtttgccccgacatttattgccggttgcccgcgtgccgcgtatcgaac

SEQ ID NO: 3677 - DNA, 372 bp, Glycine max
  Peptide Sequence Number=SeqID_95362
atggtgaaagttggaacctcttacgtgccgatcaacgtctcattttcgccaaaagttggcccagggcttcccggtatcaacagggacaccaggatttatttattctgcgaagtgatcttccgtcacagctgtcctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 3678 - DNA, 270 bp, Glycine max
  Peptide Sequence Number=SeqID_95363
atggtgaaagttggaacctcttacgtgccgatcaacgtctcatttcgccaaaagttggcccagggcttccggtatcacagggacaccagatttattattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 3679 - DNA, 249 bp, Glycine max
  Peptide Sequence Number=SeqID_95364
atgacgaacgaacgaagaacgtcgaagaacggctggagatcttcgcgaaaatccccacgaaaacattacggaagcgcctcggctcggattttcttcacggaaccaatttttttccctaatttcaacaaaatgggggagatgcttgccacccagctcgcccaggtgagcaaggtgacttactccaagtgggcctggtttctatttgcacccccatttttgctaaatacaccccctaccttttttttgtga

SEQ ID NO: 3680 - DNA, 396 bp, Glycine max
  Peptide Sequence Number=SeqID_95365
atgagtcaagagcttccaaggttgtttgcagggggtagccatgaaatgtgtgaattcaatacttcagcgacttatcattgccatgcattcacgtttatccaattgttgcattactcattgcattctatttttagcagtcattgtcgttatcaaaaagtaaccatagtaaccaaaaagaaagaacacgctttacgacaaccttaccgaacccgtgccaaggctaaaatcatgagcgagatagaggaagttcatgaacagatgaaggatcattcctctgaagttcaaggtagtactagtataattccaacatggccccggatagaatgcagttgcaaaacatgtgcaaaagggagcatgagtccttcaaggaatacggctagaggtggagggatttga

SEQ ID NO: 3681 - DNA, 1051 bp, Glycine max
  Peptide Sequence Number=SeqID_95366
atggaagttactcctctctcttccccttctccaatccatggtctccatctccgtcacaaagaagcgagattcttggcggtggcttctaccctctacgtaattcttcatcattctttcttggaattcgatctctccctttgcccttcaccactaagtcaaccttataacccatctcctcaatgtagcttgcgagcaatctccaagaagcatgaaaatgtggcgtggttatctgttagtcctaaattgcatgttcagaataaattccccagagatgtagttgtaagatctgaacttactgctgctgggtctgctggagatggctatttcctacctgagctgaaagtggaatctaaagtcaggggagtttgtttttatgttgtcactgccttttgtgccatatttctttttatgatgatgctggttgggcatccatcagtgctcctgtttgatcgctaccgaagaaagttccatcattttattgccaaagtatgggctacgctgactgtagcgccattttacaaaatcaaatttgagggattggagaatctgccacctccagatactcctgctcaagactgggatattcctctttccaataattgggtgggcgatgtttcttttgggcatcattcctttgaagcgcatggacagccgaagtcagctggtagccttgttgcaaggtttggagggagaaatgttgaaaatccttatgtaaagatgaaagatttgaagcaaacagggactgttgatgactacttgttacaacttaacattaaacggaaactgcataccttgaaacctcaatctcagcttcagggcatgcaatttccctgggatatagagccgaatatttcagatctgcctgcatttgttggtagttatgggtggcaaaatggtgatagcattttcagcactacaatgaggccattgaagagcagcatcagcatgggaggaagcaaactgggacctactattgtttcaagttctgtaactgtctcatctaagagagcagcaatttggatggaggaaaaaattcagaaatttgaactgg

SEQ ID NO: 3682 - DNA, 468 bp, Glycine max
  Peptide Sequence Number=SeqID_95367
atggtggaattattttggaccaataccacaaatattcccagaagaagtccaacagggatttcaacagttcaacaaattattcaacagccaggaatcaagaattccagccgatttaaagtacttttccagctttgctttgttatggatcttttcatggcaatacaggctgctccagatcaagtcaagaactggttcgagagccaccctgaattcctcaaacctgctgatccaaagacatcattatttctgaatcagaaatctcaactcgcgacattcttggcaagctcaaaatccaaagaaagtcttgcccagaacctcaaggaagttctccagctgcttcaacaagaagaagatgaagaaccttcaaataaggaggccgaatcgtcagaggacattgatgaccaagatgatgatcctttctatcaaaatgaggatgattgttttggtatctcactagaagatgattaa

SEQ ID NO: 3683 - DNA, 537 bp, Glycine max
  Peptide Sequence Number=SeqID_95368
atgaagttcgttttatgcattttttctggaaaacgcgatgaactcgctaagcgcgcctgctgcgctaagcgaatggcctctaggaaacgcaagagtatcggttcaagacccacaactcaatatgatacaagtagatttcactccttagatgcatggaaccggtacacggataatgtattggggagaaacatcttgccagagaggaaggaggagctctaccacactgagtttgatgattttaagactaagttggagaggcgtactctccataaacgcctcactaatttggttgatgggagcatagatttggctttggtgaaagagttctatgcaaacttatacaactctgatggtccttcaccaaagcaagccagggtcagaggccacctagtgaagatcaatgctgacagcctcaacacattcctagagacacccgtggtgttggtagagggtgagactttgcccacatactccagatactgcaagttgcctttagatcctagggagtgttggatcaaatggcctcagaataattaa

SEQ ID NO: 3684 - DNA, 336 bp, Glycine max
  Peptide Sequence Number=SeqID_95369
acaaaacttcttcaagctattcttcaagcttcgaggctaagtcttcatgttgctccccttatctctaacatcatggacaaaaacaatgtcaccaacttcacttggaattttcttgtcaagttcacttttgatgaattggtggcgcaccatagtaggttggtcatcaaaatcaagatggcagaggctaatagtggagtcgtcatgaagttaccatcacgtgttggtatgaacttcgaggtcttgcacaagagagggaaaggatcttatgcttctttcgatgttgtttttgttagggttggtcaacttgccaatgacgctaatgatgtttatagctag

SEQ ID NO: 3685 - DNA, 123 bp, Glycine max
  Peptide Sequence Number=SeqID_95370
atgaataacaaattaatggcagcggaatggagatggaagaatgatgattggagatgccacttcaaggagaagatgagtcaagaagaagctcaccaccatagcaagccagggataagagcttga

SEQ ID NO: 3686 - DNA, 915 bp, Glycine max
  Peptide Sequence Number=SeqID_95371
gtgttcttctgcaactcgggcgccgaagccaacgaagcggcgctgaaactggcgcgcaagcatgcgcacgaccagcacggcgccggtaaagatcagattgtggcgttcaacaacgcgttccacggccgcacgctgtttaccgtgtccgccggcggccagccaaaatactcgcaggactttgcgccgctgccgggcggcatcacccatacgccgtacaacgatctggccgcggcggccgagcttatcaacgatcgcacctgcgcggtgatcgtcgagccgatccagggcgagggcggcgtgctgccggcggaagccagtttcctgcaggggctgcgtgagctgtgcgatcgccataatgcgctgctgatcttcgacgaagtgcagaccggcgtcggccgcaccggccacctgtatgcctacatgcagtacggcgtggtgccggacgtgctgaccaccgccaaagcgctgggcggcggcttcccgatcggcgccatgctgaccaccgatgcgctggcgaaaacgctgggcgtcggtacccacggcaccacctacggcggcaacccgctggcgacggcggtggcggggacggtgttctccatcatcaacaccccggaagtgctggagggcgtcaaacagcgtcaccagtggtttatcgacgggttgaacgacatcaaccgccagtacccgatcttcgccgacattcgcggcggcggtttgctgatcggctgccaattgacgaaagactatgccggcaaagcgaagcagatcacccaactggccaacgaagaaggcgttatcgcgctgatcgccggcccggacgtggtgcgtttcacgccgtcgctgatcatccctgagcaggatgtgaaagaggggctggcgcgattcgcgcgcgccgtggcgcgcatttgcagctaa

SEQ ID NO: 3687 - DNA, 231 bp, Glycine max
  Peptide Sequence Number=SeqID_95372
atgaagtatcaaggcaaatttagtcagtttaagatctcttataactgtgtgcaagaagaggaaagactgaagcaagaaaggactgaaagtgctcatgttctgagtacttctaaagacaagggcaaaagaaaaagagttgaggagcccaagaatgaagcgttaagggtccatcacaaaagaaacaaaatcaaggtgacaactgtttcttttgccgtaagcctagacatgtaa

SEQ ID NO: 3688 - DNA, 165 bp, Glycine max
  Peptide Sequence Number=SeqID_95373
atgcatattgttgtggaacggatgcaagtggggatgaagtcacgatcaactgatcgttgccccttctctgcgctaaacaagcagagaacgtcgctgcaagacagccccgtatcctttgtattcgcagttttcttttactatttgtttgtcttaaaaagaaaataa

SEQ ID NO: 3689 - DNA, 366 bp, Glycine max
  Peptide Sequence Number=SeqID_95374
atgagttatgtccccgaatcggatatccgtctgaattgttatgaccattcgaatttctcgagaccttccgttgttcaatttcgagcgtctggatatattttgtccccgaaatcggacatccgagtgaaatgttatgaccattcgaatttctcgagagcttccattgttcaatttcgagcgtctagattagttatatcagacttatcaagtggcgtctaccctgacttatcttccttcaccggaagtggcgtctaccctgacttatcttccttcaccggaagtggcgtctaccctgacttatcttccttcacgggaagtggcgtcatccaaacctccgtagcctgtatcaaacgatccgccccgtaa

SEQ ID NO: 3690 - DNA, 138 bp, Glycine max
  Peptide Sequence Number=SeqID_95375
atgcgggggtccggggaatttgtccccttcttagatacgacgtctagggtagggatcaagacagaacccatatgccatgcctatgcaaaagacacaatgcgggaatgtgcacagtatgacaatatttaccaaacataa

SEQ ID NO: 3691 - DNA, 840 bp, Glycine max
  Peptide Sequence Number=SeqID_95376
atggctcaacctccaccttatgagaggactcttagggagatggttgcacctgatttcacttatgaaagcttgtgcattcaatatcctgatgagggtgttccatatgttcaaaagactggactaatacatttgctacctaagtttcatggtcttgcagagggagtggcaaaagattggttgtactaccttgctcccagcaacaacgagaggaatatgattgatgctgccagtggtggagcccttggtgatatgactcctgctgaggctaggaatttaattgagaagatggcttccaactcccaacaattcagtgcaagaaatgatgctattgtccttacaggagtccatgaagtggccacagattcattttcatctactgaaaataaaaagcttgaaggacaacttgatgccttggccaacctagtaactcagcttgccatgaatcagaaatctacatctgcacctgttgcaagagtctgtggtccatgttcttctgtagatcactatactaatctatgtccttctttgcagcaatctggagtcaatgagcaacctgaagcttatgttgcaaacatttataatagacctcttcagcagcaaaaccaacaacagcagaataattatgacctttcaagcaacagatacaatccaggttggaggaatcatccaattctaagatggacaagtcctccacaacaacaacagcgtgtccctcctttccaaaatgctactagtccaagcaagccatatgttcctcctccaatgcagcaacagcagcagcagtcacaacaaagacaacaagcaaatgaggcaaatgaccatcagaatatgcaattttag

SEQ ID NO: 3692 - DNA, 636 bp, Glycine max
  Peptide Sequence Number=SeqID_95377
gtcgactctagaggatcccccacctttccgatttttctgacgttttcctcgaataaatgttggtggcgactccgtgtgccttcctcccttggaagacgtgcccgtgagtctcgcatcaccctctcgccgaagggtaggttgcgacacagtgttactgcctcttatggaagaacgggatatccgtatgggccatatggattgccaatccctacaccttttcatgtacctcttcttctacgacaacgaaaacgaaccaaaatccatcgtgtactcctcacgatcgaacgtacgccaccggagaacaaatacgcttccaatcggccattaacgaaagcaacatacactcacttacggaaatttttcgaaagcaacatacaaatacgcttacatcatgaggtaagctccattggagcttgtaggcctaggatcttcttcatcaatggattcctttgcttcttggaagatgaatggcagcggaatgaagaaaggaagagagagaggagacgccatttcaaggagaagatgagtctagaagaagctcaccaccataggaggccatggataagagcttggaggaagaaggagatgaatgaagggagaggaagagaagagcacgaaattttgtgctctaaatga

SEQ ID NO: 3693 - DNA, 227 bp, Glycine max
  Peptide Sequence Number=SeqID_95378
ttgactatgtttcaaaatgggtggaagccaagcccactagaactaatgatgctaaagttgttgcagactttgtcaggattcacgatgtcggatacaatgtccaggacatcctgcccgagaatactggaattgctaaaagcattgaagctgcaggatccacgatgtcggatacaatgtccaggacatcctgcccgagaatactggagttgctgtacaatggaagataa

SEQ ID NO: 3694 - DNA, 765 bp, Glycine max
  Peptide Sequence Number=SeqID_95379
atggggacaaatcaaaacatcaaaaggttttatcaagtcaaggttaaaggtctagatgtcactagcctcaaggaattgggacgattgatgggacccctccaaaggaaagccttccgcaaagtttacgggaagattctagatttgaccgtagcggaggtatttacggaagccgtcgtatccctcgcccaatactatgaccagccattgaggtgtttcacgtttggggacttccaaatggtgccaactattgaggagtttgaagagatattaggatgccctctcgggggggagaaaaccgtatcttttcttcggctttcttccttccttgagcaaggttgcgactgtgattggagattcagcaaaagagttggatcgcataaagcaaattcggaacggcatagtgggcctgcctcggaaaatacttggaagacaaggcaagggatatggcgagccaagagaagtggggccccactcgccataagacagctagggtatcccatgaggggagcgccaaccgaagaaagtctctcgcctttccttgtgaggaatctaggcgcgcaaagtctcaaggcgatacaaagagtccacaaggcgtggagaagtccgttgaggaaagacaaggagcttaggggcatccgtaatggcgtcatcagaggttatcatggatggctaagaattcacacgcgggggttagattggctctccaagttgaaagttatcgatgaggaggacttcgaagctccggaggaagatgaagaagtctga

SEQ ID NO: 3695 - DNA, 333 bp, Glycine max
  Peptide Sequence Number=SeqID_95380
atggttgaagcagagagttcgcaaaatttacaaagcacccaagattctactgattggacaaatgatatatattcaaaagtcaaaggacctgaaaaaagaggacgtgtgcgttgtcttggcaagcttccacatcaagcaagttcatctcaaagctcttatacaaacaatagaattcaaaagttggagaatttgcttggaaatcttgtagttgtgcttaaagtacgatttgcagaagatccacaaattaatcaagtcttagaagctatagatcaagaggtacctacaaatgattctaccagtaaagatcatcaaactacaaacaatcttaactag

SEQ ID NO: 3696 - DNA, 222 bp, Glycine max
  Peptide Sequence Number=SeqID_95381
atgcaaggatcatgcatgagcgaacatgaaaacaaaaggcgagaaaacggcttaaacgatcggttaaagctcgttaaaaacgcaagaaaagaaaccgaaaatttggaaacttacccgttgaagaacgaagaacggatgaagaatggtgaagaacagaggacaaccttcactgaattgcttacggaaacatctcggaagcgttacggaagcgcatcggcttag

SEQ ID NO: 3697 - DNA, 195 bp, Glycine max
  Peptide Sequence Number=SeqID_95382
atgaagaaacaacaatggaagagaagcggaaaacaaaggagaagaggtaagaggcggcgtcatccactagggaataagccatggaagaaggagcttcaccaccaagatgagccttggataagaagcttggagaggatgcttcaatggaggaaaagaaaaagggagagaaagagagaggggggagcacgaaattga

SEQ ID NO: 3698 - DNA, 534 bp, Glycine max
  Peptide Sequence Number=SeqID_95383
atggccgaatcatccaagaagcgcaagggttcatccacctccgctgcgacaactagaacaccacgtcccggagccaccggagcatccccggcaccaattccaccatccttgtcatcctctacactattttcatctgatgaacaacctatccgaattctgatgcctcgttcttctaatctcgctcaagcctctgaggaggacttgattctgatgtgggctttcttaaccggtcgtccaatcgactgggcccatttgatttgttactgcatgcataaggcattgtggtctggtgcacctctcccttaccctcagcttgtgactttatttcttcgacattttgaaattcctttggatttggagccttttctgctagttaaacgctcctttgctattggtgccggtgcagtaacctcctttggctaccgtaaggacatggatgggcaatggttgaagaaggacgcgcaacctccgcaagacgaatgtactccctctcctccgcctcaacgagatgattcctcagccctcatgaatgaa

SEQ ID NO: 3699 - DNA, 309 bp, Glycine max
  Peptide Sequence Number=SeqID_95384
atgaagattcttccactatacaaaatgatagtagggttacaaggatgtgtttacaaaattgactcactctatggtggttcactcaagcttgaggatagagacttcccaagctatttatcttatctctcaaagaggctttttctcactctaagaagtggatttactctttgtcttgaatggagtctctacactcttctactcccttccatactctttcataaggttccagaaggttccacacatctccagaatatttcagaggtttccacattcttccacaagcttctagagagttctacactactctag

SEQ ID NO: 3700 - DNA, 180 bp, Glycine max
  Peptide Sequence Number=SeqID_95385
atgtggtaccattttccagtgaaaaacctcgtcggacacctaagagtacatgacaagacacaccacacaatgagtatgtcaggcttaaaggagcactcaaaccaggtgacccccaaggcctacactccgaagagtccgtcagggcctctccctcctgattcaggtaagcatatattataa

SEQ ID NO: 3701 - DNA, 132 bp, Glycine max
  Peptide Sequence Number=SeqID_95386
atgaagaccgatatggaggccatgaaggaacaaatgacaatgatgatgcaaccaatgatgagcatgaggatgatgatggaggataactgtcacaacctacccttcggtgggagggcgacgcgagactcacgg

SEQ ID NO: 3702 - DNA, 186 bp, Glycine max
  Peptide Sequence Number=SeqID_95387
atggctaaattcgatccagagatagtcatggagttctatgctaatgtctggcctactgaggagggggtccatgatatgcactcctggctttacaagacacttttacacgatctgaccgttgggatctttgagaagatgtatggagtgtgcgcgaaacttccattcccgagagcatttctcatttga

SEQ ID NO: 3703 - DNA, 230 bp, Glycine max
  Peptide Sequence Number=SeqID_95388
ttgggaaacctaggtcatttcaaagaggaaagattgccgggtgttcaaagcgaaagatacaaggctggtccaagtgtgagtaccctaatgatcctgagttataagacaaacaagcaacaagccatgtgtgcaaagatcgtcgttggttcaaggaatttagggactctcttgaatcagtatgatggctctattgtgaagatgggctcaatgttgcaactgaacattcctag

SEQ ID NO: 3704 - DNA, 147 bp, Glycine max
  Peptide Sequence Number=SeqID_95389
atggaagtctccgtggaagccatcgcctcccttactcagtattatgaccagtccctaagaaatcctgggatgtccgctcggaagaagaaagccatatctcttctcggggttccatccctccatggcaagagtagcaaaggtagttaa

SEQ ID NO: 3705 - DNA, 141 bp, Glycine max
  Peptide Sequence Number=SeqID_95390
atggagtcgccaactgtcgcaacctacccttcgatgggagggcgatgcagggctcacgggtgcatcttccaagaaaggataatgcgcggagtcgccaccaacgtttattcgaggaaaacgtcagaaaaaccggaaagatag

SEQ ID NO: 3706 - DNA, 447 bp, Glycine max
  Peptide Sequence Number=SeqID_95391
atggagctcatcacccgggaagagaacatggcgctgctgatgcaggacttaggggaaggtttgctggatgcggcgttcattcgtctgccgtgtgagagcagtaaggcgtttaacctgaaagtgatcgccacggaggagatgaaagtggcgctgccagccagccatgcgctgagccagcagcaaagtgttgcgctaacgcagctggccgaagaatcactgattattttcccgcgcgaggctccgcagattacctcctcgctcggcatggtgggcgcaggctgcgggattgcgctggtgccggcttcgctgtgctgcgtcaacaatccacagttggtatttcgtgacattaaaaacaatacgctgttcaccgacattgcctttgcctggcggcgtaatcatccggccaaaacggtgttacacctgctgagtttgcttaacggggaataa

SEQ ID NO: 3707 - DNA, 539 bp, Glycine max
  Peptide Sequence Number=SeqID_95392
atggggacaaatcaaaacggcaaaaggttttatcaagtcaaggttaaaagtctagatgtcactagcctcaaggaattgggacgattgatgggacgtctccaaaggcaagccttccgcaaagtgtacgggaggattctagatttgaccgcagcggaggtatttacggaagctgtcgtatccctcgcccaatactatgaccagccgttgagtaagattgcagctgtgattggagattcagcaaaagatttggatcgcatgaaacaaactcgcaatggcgtagtgggcctgccacggaaatacttggaaggcaaggcaagggatatggcgagccaagagaagtggggccccccgccattgatgctttccttcgccatatccaccatagcaaggaaagtccagtggtggcttatcttggcagatttttttgacacctttgaccggagcgcaatcaattggtttcctcgttggaaggaaggcaaggaaggagttcttttctcgtgtggggactaccctaatgttccattgatagggactagggg

SEQ ID NO: 3708 - DNA, 375 bp, Glycine max
  Peptide Sequence Number=SeqID_95393
atgagggaggtgaagagcagcacagacgcagctccccaaacgccccaatacccctcggtagttaaacctcttccgtttccataccaaaacagccacgcagttctgtggaggtatgcgcctccaagcgaaaggaaggaagaagccaccgacatcaactcgttgtcggccagggtaaccaatatcacgagactgagcggcgtgacccgcagcggtcgcgtgttcgcgccccctgacttgctgacacaacccgtaaacgttaaagggaaggcgaagatagcggaagaacaaaatgacaaagtgaagcaccttggtggattattcggctcagcagcctctcaacgactatcaacccatgcatcccgagttcccggatga

SEQ ID NO: 3709 - DNA, 288 bp, Glycine max
  Peptide Sequence Number=SeqID_95394
atgtcaaaaatcccaacggtggaagtgtgcgcatttgaatttcgaacaacatatctaactttcatgaaaatccaacggctacaatgcgaaaggttttcctctaagctcagacataatatggaaattcccaacggtgagaatgctcggaattgggttgcgaacatggtgttcaaatttcacgacgatccaatggtgaacgagtccgagatcatcgtttttctaagacaggtttggtgggatgcgggaaaaagaaaggttttgagaggagaaagggaaaaacgaaaatga

SEQ ID NO: 3710 - DNA, 243 bp, Glycine max
  Peptide Sequence Number=SeqID_95395
atggctaaagacgaaaagttggatcatctagaggaaaggctcagggccattgaaggaggcagagattatgcctttgttgacatggcagaattgtgcctagtgcctgatgtcatcatccctctgaaaaagcctgtagaattcaccccaattccgatgtcctatgctgacttgctcccatatctactcgattattcaatggatgccataaccccagccaaggttcctcaacctccatttttctga

SEQ ID NO: 3711 - DNA, 465 bp, Glycine max
  Peptide Sequence Number=SeqID_95396
atgtggtatgatgagaggattaacaaagataaacagacaaaaaatccaaagttttcattatgttgtggtgatggtaaaatacaactgccaatactacatgatgctccgcaacccttgtggcagctactctttgacagcagagactcacaagtaaagaaattccaacaaaacatacgtttatacaacctaatgtttgcattcacatctctcggtgtcaaagtagacacatcctataatactggaagaggtcctcctacattgcgcatacatggtcaatcgcatcaccttattggaagcctcctacctataccggataactcaccaaagtttgcacaactatatatttatgacacggagaacgaagtcaacaataggctttcacaatacccacattataattggtatcaagaatatgctagatacccacaatccatatgcacaaaaattcagaatggcaagggataa

SEQ ID NO: 3712 - DNA, 345 bp, Glycine max
  Peptide Sequence Number=SeqID_95397
atggagaaaggacaagggcggtcttgcttggcgcaaaggctgctgaacttcgattcgcccggccagcaggcgggcggcgtgcttatcttgtgtgacaacactacagagcgagtggctcttctaggcgggcagctgtgtgacaacactacagagaaagcggcgctttcgtttaacatgctatggtctcaacgcccttacgagatagtgatgagtttcacgcgctctaagcccggcccgcgcgcggttaggaagattggccgcaatctgagcggtaccacccaccctaccctaccacctataggcggccgtccgttctacagccgcccgaaaaaggaactgcagtga

SEQ ID NO: 3713 - DNA, 261 bp, Glycine max
  Peptide Sequence Number=SeqID_95398
atgaagacaaggatgatcaagatgacacagcacaagaaaatgataatcttcccaaagaatggaaaacttcaagaaatcatcctcttcacaacatcatcggtgatatctcaaaaggggaactgggatcgtagagtgcaggcacaagatgaagacaaggatgatcaagatgacacagcacaagaaaatgataatcttcccaaagaatggaaaacttcaagaaatcatcctcttcacaacatcatcggtgatatctcaaaaggg

SEQ ID NO: 3714 - DNA, 526 bp, Glycine max
  Peptide Sequence Number=SeqID_95399
ggttcctacttcaaggaccttcttctcacgtctcctctcctccattacatgcaccttcagacagacgttttggtcaggaggacccttgtcttcatgaaacaaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 3715 - DNA, 1122 bp, Glycine max
  Peptide Sequence Number=SeqID_95400
atgccgccgagcacctttggcgctatctgtgaaggcctgggcgccgctaaactcaacgccaaaccggcgcgcgtggtgatggagaagccgctcggcgccgcgctggagacctcgcaggagatcaacgacagcgtcggtaaattcttcgatgaaagccaggtgttccgtattgaccattatcttggtaaagagacggtgctcaacctgctggcgctgcgttttgccaactcgattttcgtcaataactgggacaaccgcaccatcgaccacgtgcagatcaccgtggcggaagaggtgggtatcgaaggccgctggggttacttcgataaagccggccagatgcgtgacatgatccagaaccacctgctgcagatcctgaccatgatcgccatgtcgccgccgtccgatctcagtgctgacgcgattcgtgatgagaaggtgaaagtgctgcgctcgctgcgtcgcatcgaccagaccaacgtgcgcgagaaaaccgtacgcggtcagtacactgccggttttgtgcagggcaaaaaagtgccgggctacctggaagaagagggagctaacaagcagagcagcaccgaaaccttcgtcgccatccgcgtggatatcgataactggcgctgggcgggcgtgcctttctacctgcgcaccggtaagcgtctgccgaccaagtgctcagaagtggtggtgtacttcaaaaacccggagatgaacctgtttaaggactcttacgccgaactgccgcagaacaagttgacgattcgtctgcagccggacgaaggcgtggatattgagatcctcaacaaggtgccaggtctcgatcacaagcataagctgcagaccaccaagctggatctgagctactccgaaaccttcaatcagtcgcatctggcggatgcctacgagcgtctgctgctggaaaccatgcgcggcattcaggcactgtttgtgcgccgcgatgaggttgaagcggcatggacctatgtcgattcgattattgaagcgtggaatgcggatggcgacgcctccaaaccgtatcaggccggcacctggggcccggtcgcctcggtggcgatgatcacccgcgacggccgttcgtggaacgagtttgaataa

SEQ ID NO: 3716 - DNA, 637 bp, Glycine max
  Peptide Sequence Number=SeqID_95401
atggttatggataaggccacaccgtctgtcccccgacctgctccaacaatagaacaaatcaaacaagataactccggtaaggtagaaataaccttcaataggagaaattctttttcatcaaggatagaagcctctaggtctgaatatgagtcaaccagaaggtctttttcagttagaaccctttcaattccagtaggattaactagatctgagtcacgcaaccagttccctactgtaaacctccaaggattatataccacttctagtatacctagaacaacttacaaccaagaacaggaggacgaccaaaagtcgatccaatcccaacttattcttctatggaaccttatgatgttatctgacaactttagcattgataaggaaacccttaggaaagacttttactctccagaaaatgaacctcaacggagatggtttttccaacaatataagagtacaaatagaaaacatatccaagacaagttctatgaatttgtcgagagagtcaaaattaatgtccttttctttgattggtttcttgcttataccatcagaaaggatatagattacccatggaaacaagacatcataggtgatccaacaacaaatgtcataacaaactggcaaatgaaggacg

SEQ ID NO: 3717 - DNA, 519 bp, Glycine max
  Peptide Sequence Number=SeqID_95402
atgccttatgtggaagccgcagaggagtcattagaaaccgctttccagtcttttgaggtggtaagcatttcctccgtggactccttctctgggcaagcttgcctgtccgatgcagaagtaatgatggcccgagttatgttggggaacggttacgaacccggaatgggtttaggcaaagacaacggtggcataactagcctgataaatgccaaaggaaatcgtgggaagtatggtttaggctataagcccactcaggcagatgtaaagagaagcatcgcgggaaggaagggcggtggtcaaagctcgcggttgagacaagaaagtgaaggaagcccgccctgccacataagtagaagctttataagcgcgggtctgggagacgaaggtcaagtggtcgcaatatacgaagatgatgttccgagtacattggatttggtacgaccttgccctcctgatttccagttggggaattggcgagtggaggagcgccccgacatttacgcagcgagcataatgtaa

SEQ ID NO: 3718 - DNA, 1182 bp, Glycine max
  Peptide Sequence Number=SeqID_95403
atgcctcactcgtttattccgccgttattgtccgccgacgaaccctctgccgccgccgttgaaatcccgcgcggcaaagcgccctttttgctgctgtgcgatcacgccggcaaggcgatcccgcaatccctcggcgacctcggtttgccgccgggggagatcgaacgccacatcggctgggacatcggcgcgctgagcgtgtcgcgccatctgagccgccaattggacgccacgctgatccaccagcgttactcacggctggtgatcgactgcaaccgggcgcccggcatcgccagctcgatcccgcatttgtccgagctgacgccgatccccggcaatatcggtatcgacgccgagcacgcgctggcgcgcgagcgcgaggtgtttttgccgtatcaccacgccatcgacgatcatctggggcaacgccaactgcgcgaactgccgacggcggtgatcgccatgcacagtttcacgccggtgttcaaaggggcatcgcgcccctggcaggtggggctgctgtttaaccgttacccggaatttgcccatctgctggccgagctgctgcgcgaagagggagatttgcaggtggggatcaacgaaccctatgcgatgaccgatgccaccgactacacgttgccggtccatgcggaacgccgcggtttgccttatgtcggcatcgaaatccgccaggatctgatcgccgacgaacgtgggcaacaggccgtcgggccggacaatatcgtgtttagcggtgaggaagcggaaaacgccatcgacggcgcctgcaccatcgtgattgaaagcaacgacgccaaaatcgagttttccgtcggccaggcggaactgaccgaacatcagggcgtccaggcctgctcgacccggctgccgcaggagttggtttacatccagcgccgccgccagttccgcatcaccacgccgcactggcgccaattcttctgtaccggcgaatacccgaacggcacgccttatgagctgcggatccacgatctgtccgccggcggcgtcggtttgcgtttcgacggcccgctgccggatttcttccagccgggcctgcagttcaagaaagcggagttggatttgggcagctacggcagcttcaaggtcaacatggagctggtggtggtcaacgacgatcaggaaaccgacgataacgatcag

SEQ ID NO: 3719 - DNA, 561 bp, Glycine max
  Peptide Sequence Number=SeqID_95404
atgaccactttagctcagacatggagcgttctttccttctctaacttgattcctacctcccacacatctgatgtcacattagacagggccaagttaatctatgacatcattatgaagatggatatgaatgtggggtacctcatctcccaccagatctctattactgcacaacacaattcctccagacttggattctcagccttgatcacagctctgtgcaaggctagaggagtccaattagattataaacccctggagagcctgagccctaccattaacttagcatacattaagaagaattgttggaatctagatgatccaacagtgacatttagagggccaaggaaggccaggggtaagagatcagaggtccccactacttcagcagcaccagagacaacaactccttcttcttccacagctcaagcacctcccatttcgactccagcacagactccagccattcctgctccatctgctcagataccacttccagctccattatctattggaccctcagattttttatttacaccacaaatacttcattccatgctctag

SEQ ID NO: 3720 - DNA, 975 bp, Glycine max
  Peptide Sequence Number=SeqID_95405
atgccgcgagataacagcgggacaatgcgtttgtcgcaccactttaagataaaaaaacccggtgcctcgagcgaggtcaccgggttatcaccgcgaagccgggcgttaccagtagataccgcctgccgcttccgattgcgccagccagactggtttgataactgtagaagcgcgcgcgatcctggcgtaacagcatcactggcagcgccagtacgccaatcaataccaccagcacacggcgcagcacaattttggcgagtggatatgcctgatacatcaatgcctcctcgtggagtcagcgtgacgaccatcttgattgtcgaagatgaaaaggagattcgccgtttcgtgcgcctggcgctggagagcgaaggcctgaagattgtggaagcggagcagctgcagcgcggcctgattgaagcggctacgcgcaaaccggatttggtgattctcgatctcggtttaccggacggcgatggcaatgccttcatccgcgaagtgcggcagtggagcagcatgccggtaattgtgctgtcagcacgcagtgacgagcaggataaaatagaggcgctggatgccggcgctgacgactatctcactaagccgtttggcatcggcgaactgctggcgcgcgtgcgcgtggcgctgcgtcgtcatcagcgcagccagccggagccgctggtgcagtttggcgaagtgagcgttgatctcgccgcgcggcgcgtgctgcgcagcggcgaagaggtgcatctgacaccgaccgaatttcgcctgctcagcctgctgctgaataacgctggcaaagtgctgacccagcgccagttgcttaaccaggtgtgggggcccaacgccgtggaacacagccattatctgcgcatctatatgggacacctgcggcaaaagctggaagccaatcccacccagccgacgcacctgctgacagaaaccggcatcggctatcgcttcatgccataa

SEQ ID NO: 3721 - DNA, 1032 bp, Glycine max
  Peptide Sequence Number=SeqID_95406
atggctgcgcccgatccggcactgctgccggacctgcgcccggcgatgctggccgggctggcgtcaccgcagctgaatagctatcagcgtgaggcgatttcgccacagctgcaggcggccattgcgccgcgctggccctgtccggcggaggcgtggctggcgaccgatggcggcttcgatgccatgaacctgatagtgcagacgctgctgtcacccggcgatcgggtagtgattgaagatccgaccgcgacgcgtctgctggatatgctcgacaacatcggtgccgagatcctgccgctgcccggtgatgagcagggaccgctgcccgcggtgctggcgacacacttacagaaagcgccagcgatgttcatttatcagccacgcacccactcggcgaccggctacagcgtcagccagcagcgcagcgaagcgctggcgcaggtgctggcgcagagtgccaccctgattgtcgaggatgatggcatcggcgatttgtcgcgctggccggtatggagtctcggccgccactatccgcagcgcacgctgcacgtgcactccttttccaaagcctacggcccggatctgcggctggcggtggtatccggcacggcagaactggtgaaacggctgcaatcgtggcgtaacttcggggtcagctggaccagccgtattttgcaggatgcggtggcctggatgctgagcgatgcgcccacccagcagcgcatacagcaggctaaagccacgtatgccgcgcgccgtcagcagttgctggccgcactggcgcggcgcgggctggtacaggaagatcgcgacggcctgagcgtgatgctgccggtggcgtcagagcagtatgccatgatcaccctcgccgcccggggcatcaccgtgctgccaggcgaacgctgcagcatcaacagcggacagttcattcgcgtcagcattgcgcggctgccggccgatcagctcgacagcatcgccgatgcgttagtgattgcctgcggacgcgagcttagtatcagcccagatctttga

SEQ ID NO: 3722 - DNA, 267 bp, Glycine max
  Peptide Sequence Number=SeqID_95407
atgccacgagcgcgtacagcgcgcgcgccacgatggcgccagtcgcacccggctctgctggcaatcagctggttaattttacctcactgcgcgaacggagtcgaaacggcaaataaacaaaacgcagaggtacccggcaaggaaaaggtcgacgatcccgatcatcacggcgcctgttgcgccgcgtgcggcaagccgatcagcctgcgcgatgtgatcccgctgtcatccctgcactcggcttctgccgcccgtcacgttgaataa

SEQ ID NO: 3723 - DNA, 915 bp, Glycine max
  Peptide Sequence Number=SeqID_95408
atggcctcgctgacgcagggctttctccagctcaatcagcacgtcagcatcgaaaaagacgctggcgcggtcctcacccttaatggccagaaaggctttggccaggtggccgcgtacgaggccatgcagcacggcattgagcgggcgaacaggtttggccttgcggcggtcggcctgcatcattcgcaccacattggccgtatcggtcactgggcggagcagtgtgccgcagcgggctttgtctcctttcacttcgttaatgtgatgggcgatccaatggtggcgccgtttaacggcagcgatcgccgcttcggcaccaatccgttctgcgcggtgtttccgcgtcgcgacggcgaaccgctgctgctggactttgctaccagcggcatcgcctttggtaaaacgcgtgtggcgtataacaaaggtcagccggtcgcgccgggctatttgcttgatgcgcagggccagccgaccaccgatccgggtgtgatgcatcagtcgccgtatggcgcgttgaccgccttcggcctgcacaaaggctatgcgctggcgacgatgtgcgaaatccttggcggcgcgctgtccggcggtcgcactacgcatgacgccacgctgctcaccggcactgacgccatctttaacggcatgaccaccattatcctgaacccagacgcgtttgacgcaccggcgatgcagcaggaagccgaagaatttctcgcgtgggtcaggcgttcaccgcaaagtggtgaggcggagattctggtgccgggcgaatgggaaacgcgcaatcgggcagcacgtgaacgcgagggcattccgctggacagcaacagctggcagcagatttgcgcagcggcacgccaggctggcatgccggaggacgaactggcggccttccgcgccttagcgcagtaa

SEQ ID NO: 3724 - DNA, 345 bp, Glycine max
  Peptide Sequence Number=SeqID_95409
atgccattactctatgtggcaattggcgtggcgttactgctgctgctgatgattcgcttcaaacttaacggcttcatcgcgctgattctggtggcactggcggtgggcatgatgcagggcatgccggtcaataaagtgattggatcgatcaaaaccggcgtcggcggtaccctgggcagcctggcgctgatcatgggctttggcgcgatgctggggaaactgctggccgactgcggcggtgcgcagcgtatcgccaccacgctgatcgaaaaattcggccagaagtcacattcagtgggcgttggtactcaccggcttcaccgtgggcttcgcgctgttttatga

SEQ ID NO: 3725 - DNA, 610 bp, Glycine max
  Peptide Sequence Number=SeqID_95410
gaaaaacggtatcggtggacaaatgagaaacaacgggctgccgccttgtcacaataccggactagccggttacttcagtcaggtcaccgatccccgccagattgcgctactgggacgcatcaccgttgaaattttgcgtcaggaacgtcggctgacgcgcaccgcgatctgcctcaaacttatcgggcacatcaatgacacggacgatgacgtcgaagcggaacaggcacgcccgtatccattgccacatgccgcgttgccgaaaatcattaatacgaggtttgatggtggtgaagacgtcatccctgacagttttctccggccggtacacgctaacgcgcgtccgatgaggcctgcaagcgtctgcaggtacggcacatggatcgcggcctgctcaggctcatcaaagcttctgagccagccgatcgcctctgaaatcgcggacaggcgtgtgtcgctgccgccagcgcgtttcatacaaatttacttcctccatttcacgttgatgagaacctcacgtcacactgtagaccctattgagcgaaccggtgcaggcgctggcgcaacctgccgcagcatgacgacgattcagcctgatgacgcggcttga

SEQ ID NO: 3726 - DNA, 1843 bp, Glycine max
  Peptide Sequence Number=SeqID_95411
ggtgcttatgccccagtgagctggcgtttcgccttgtcatgctgttctctgacatcagcacagagatgggcggatgggagagcatcgaaatggttcagcgttatgctcacctggcgcctaatcatctgaccgagcatgcgaggcaaattgacgcgatttttggcagtcgtgtcccaaatctgtcccacggtgaaattttgaaggctgaaggagccatgagaatgaccagccgtaaaaaagagatactgagcttctttgatcctgaacaccgcgaatgggtaactggtacgattggtgcgccgccgtttgatgtatccggggtcgcatatcttctcagtggcatgaactcattcaaatcacggcatcacatggaatcagccaggagaacgctggaggcgatggttaacgatgggctgctggagaagatcaccagctatgagcagcggcaggacagcacgcagtctggggcaggtaaaggtgtctggtgtaactgttcccgatacgggctcatcggtcagtgtctggtaatgcgtgatcgtgatggcagtgataattatattgaagatgaatacaaaaaccccataaggcgtgaatcggtgcgccgatctctggagctgatggtatcttttgggctactgacaaagtcctctcaccgagaggtcaggaatggcatgacgtgcgttatgagaaaatccctgtccgttaccttccgtgtgcctgctgaattaagcgaggcttttattggcgctgtgaatgctgctgatggagataaaaccgcctggctggtcgatgccatccggcagaaactgagcctgccagagagtaatccggacgctcgcatgatggctctggtagagcgaatggagttggctgccgcagctctgattggcgggaagcaaggcatcccacctttgccatacaatgaggaagcagtgatccgcattgcttcggaaaccatccgtcagggttttgataatggtcgtatcattgcagaacgccttaatgaagccggatatcagactaaagcgggaaaagcttgggataaagatatctatagtgcatggaaacgtcaggcagaccataaagcgaaaggagcttgctcacaccatggcggcgtaggaagcggaggagggatatcgcttattagtgccttggctctggctggctatagcttttacagattagacaaagcggaagcccatgaaaaatgcatgatctatgaatcatcgaagcaaaatgtatggtttgagttttctctaacatctgcaccctttaatccacaagaacactattcaattaagggaaacgccctctcatatacttacctttccagtatcaactctaagcccgaatgcttaactgtggccatcagcgatgcagaatctaccaaaatcgagaaattggcacgtacattagcatcgcatagcaatgctccgaatatgccggtcctcgatggtctggacgtttcgttaactattaatatcggtgatacggcaacttttcatgcacagcaggcggtgacgctctttggccagcagggcttgcgctacgtcggtgcggatagtttctcacccttcctttttacagtgaacgctcaggcattctttatgcgaaatgctgctggtggcatcgaattcttcacgtacaccactgatcatctgtcaggttctgataaaaatgagccagcctcagttgtcatggctaacccagcatcggtttattgtcaaaaggttggtggggcgttagaaatagtcaaaaacgaaactggcgagagcgcgatcattgtggctggtattgccctcttaatttggttcatagctagcggagcctacgctcctggcgg

SEQ ID NO: 3727 - DNA, 684 bp, Glycine max
  Peptide Sequence Number=SeqID_95412
accatgacaacactgagcattaaacgtaagcctaaagggctttatgggaagccagagcagcaatcaaagcaacctgaaacagaggccaccagcaacgacaaacccgcgcagaagcccgcaggcgcagccagaaagcagagcgcagcagctaagcgtaatcaccgccgtctggagaagctgtccagcctgtttcccgcagtgataaaccttaccgaaccaaagccgctgaaggtgggcattctggaagacatgagccagagcctgaaagcacgtggcgaaacctttggcgaaggccagattaaaaatgcgctggcgcgttatacccgtaactggcgctatcagacggcgctggcagctggtggatcacgctataacatcgaggggcagccagagggccaagtgactgccgaacagcaacagaaagccgctgagatgttggctcagcttaaaggtggcgctgatgataaagccgcttcacgctggctggaagtgttcgacaaatgcgaaactgaagccggtagagagtggctcaggaaccggcgcaatgaatgcctggcaaagcgagtgcgccccgctgtgttggtagatacctttggcgatgtcaccagagcagcctctgatacacaacggcgcatgggattagctaaacccggcggcgaggctttccggcttaaagcaaaataa

SEQ ID NO: 3728 - DNA, 816 bp, Glycine max
  Peptide Sequence Number=SeqID_95413
atgctgcaggtcgactctagaggatcccccatcagcgatatttcaggaaacgactttgccactattgtcccggttatttccggccaaatcggtgggcgtgaaaccaatattgtaagtgcaaaagctctgcataaagcattaggcgtgggtaatgacttctctacctgggtaaaactccgcattgatgaatatgggtttaccctcggagctgattacgtggtttttgattcctcagatttcaggaatcaaagtgcaaatattgagcaggccgaacgcggatgggtcacgaagcgcggcggtgatcgtcgcagtaaggattacggcctttcgcttgggatggcaaaagaagtggctatggttgagcgcaatgaacagggccgtgccatacgccgctacttcatccagtgtgaagaggcactacagcgcagcgtgcctgagattgccgcacagtatcgccgccagcttaaagcccgcctgagtgccgccaacatgtttaagccgatgtgcgccgctctggatgttgcccgtgcagaacaggggaaacagactttatcccgtcactacagcaacgagagcaacatgatcgcccgtattgtcttgggtggcctcacggctaagcagtgggcgcaggtaaatggctttcagggcgaaccacgcgacggcatgaattcatctcagctggagcacctcacctatctcgaaagcaccaacatcacgctgattgatatgggcatggcctatgaccagcggaaagccgaactgatgcgtctgtctcagcggtggctggctaaacgcctagaggcagcccatgactaa

SEQ ID NO: 3729 - DNA, 867 bp, Glycine max
  Peptide Sequence Number=SeqID_95414
atggcagcaaaaattattgacggtaaaacgattgcgcagcaggtgcgctttgaggttgccgaaaaagtgcagcagcgtctcgctgccggtaaacgcgcccctggcctggccgtggtgctggtcggtgaaaacccggcatcgcagatctatgtcgctaacaaacgccgcgcctgcgaagaggtcggttttgtatcgcgcgcttataacctgcccgccagcaccagcgaagccgagctgctggaggtgatcgatgagctgaacaatgacgacgctatcgatggcattctggtgcagctgccgctgccggccgggatcgataatgtcaaagtgctggagcgcatcacgccggataaagacgttgatggcttccatccttataacgtcggtcgtttgtgccagcgcgcccctaagctgcgtccgtgtacgccacgcggcatcgtgacactgctggagcgctataacatcgatacttacggcctgaacgccgtggtggttggcgcatcgaatatcgttggtcgcccgatgagcatggagctgctgctggccggctgcaccaccaccgttactcaccgttttaccaaagatctgcgccatcacgttgagcatgccgacctgctggtagtggcggtcggtaagccgggctttatcccgggcgactggattaaaccgggtgcgattgtgattgatgtcggcattaaccggctggaaagcggcaaagtggtcggcgatgtggattttgcgtcagcctctgagcgcgcggcttacatcacgcctgtaccgggcggcgttggcccgatgacggtcgccacgctgattgagaacacgctgctggcgtgcgagcaatatcacgatgtggagcaggcataa

SEQ ID NO: 3730 - DNA, 1212 bp, Glycine max
  Peptide Sequence Number=SeqID_95415
atgctgtgggcgctgctggctggcgtggtgatgctggcactgctgctggcgctgctcggctggggcacgcttctgctgctgcgcagactggtggtgcgtaatctggcgctgcgcctggcgatcaaccgtctgctgcgtcagcccgccatgacgctcagccagctggcggcgttttcgctctcctttatgctgctggcgttattgctggtgatgcgcggcgatctgctcgatcgctggcagcagcaattaccggcggatgcgcccaactattttctgctcaatctgacccagcagcaggtgccgcaggtagacgagttcctgcggcagcatcaggttaacgccggaaccttctatccgatcgtgcgggcaaggctcactgagctgaacggcaagccagccgatcccaacatggataacgcgctgaatcgcgagcttaatctgacgtggcagacggagcgtccggaccataatccgctggtggccggcagctggccgccgaaagccggtgaagtctcgatggaggtcgagctggccgaccgtctgggcgtcaggctcggcgacaggctgacatttagcggcgatacgcagcagttcagtgcgacgatcaccagtctgcgcaaggtcgactgggagagcctgcggccaaacttcttctttatcttcccgccgggtgcgctcgatcagcagccacaaacctggctgaccagcttccgcatggcgaacgatcccgcgctgctggcgcagctcaaccgcgcgttcccgacgctgagcctgctggatgtcggcagcatgctgaagcagattggacaggtgctggcgcaggtgagccaggcgctggagatcatggtgattctggtgacggtttgcggtgtgttgctgctgctggcgcagatccaggtcggcatgcgccagcgccggcaggagctggtggtgtatcgcacgctcggtgccagccagcgcctgctgcgcggtacgctgtggtgtgagtttgcgctgcttggcgtggtcgcgggaatcgcggcggcgctgggggcggaagcggcactgtggggacttcagcgtaagatttttgatttcccgtggcagccggactggacgctgtggctggcgctgccgctgtgtggcgcggcattgctgtcgctgtgcggcggctggctgggtgtccgcttactgaaggggaaagcgctgttcaggcggtttgatgctgcctga

SEQ ID NO: 3731 - DNA, 1140 bp, Glycine max
  Peptide Sequence Number=SeqID_95416
atggagcccagcgccagcacgcaagccaccgccagcgttagcgccagccagacaatcaacagcgagggcgaacgccactcgcgccagaaccagcgccagatcatgcttcctcccacaacttgccgtcgcgcagccgcaggcgacgatcgcagccgtggtggcgaaatcgcggttgagcgaaaacagcagatcggcgatgcgatcgccggttttgcgatcgaggttaccggtcggctcatcggcaaacagcaggccgggacggccgctgaaggcgcgcgccagcgccacgcgctgctgttcgccgccggagagctgggccggcagatgcggctggcccagcagatgcacttcgccgctgctgccatcatccagtccggcgagaatgcccagcagggtggatttcccggatcccgactcgccgatcagcgccagcgtctcggctggtttgacaaccagctcaactccggtaaggatggtcagctgatgctctccctgaccgacggacttagtaagatgatgaactgcaacaatgttttccgctggcattattccttcctgttgttattgctgctgctggtgtcgcgcatcgccgccgccgataccctgctgattctcggcgatagcctgagtgccggctatcgcatgtccgccaccgccgcctggccgagcctgctcgacaaaacctggcaacagcagcccaaagtggttaacgccagcatcagcggtgataccgccggtcaggggctggcgcggttgccgggcctattaaaacagcatcagccgcagtgggtgttaatcgaattgggcggtaacgatgggctgcgcggcttcccgccgcaaaacatcgcgcaggatctgagtaaaattatcgatcaggtcaaagccgctaacgcccagccgctgctgatgcaaattcgtctgccggctaattatggccgacgctacaccgacgcgttcagcgcgctctatccgcgcctcgcgcagcagtatcatattccgctggtaccgttctttatggagcaggtttatctgaagccggagtggatgcagcaggacggtattcaccccaatccggatgcgcagccgttcatcgccaacctgatggctgaacaactggctccgctagttaagcatgattaa

SEQ ID NO: 3732 - DNA, 2844 bp, Glycine max
  Peptide Sequence Number=SeqID_95417
atggagctgattgcgcatccgcactggttctggctcacgctgggcggtttactgctggcagcggagatgctcggcaccaacggttacctgctgtggagcggtgtggcggcggtgctggtcgggatcattgagtggctgtttccgttctcgtggaccagccagggcatgttgttcgccgctctaacgctgctgtgcgtgtttttctggtatcgctggatgcgctttcgcgaaagtgcgcagcagccgaatacacttaatcagcgcggcagccagctgattggccagcacctgacgttagacagtgcgctaaaagacggcgtcggaagatttgccggcgggcacaccggtgatcgtgaccggcgtgtcaggcatcacgctgctgattcagccgcgtttgccgccctcctgattaccgcagcccgccaggtgattgatgatgggacattcggcaccgtcatcgcccgggcaggctgcagccagttccagcagacgcgcgcgcatcgcgtgcagctcttcaatatgcgccgcgatctcatccgccttctgcagggtgcgcgctttaacatcggcactgtggcgcgccgggttattaaacagcgcgaccagttcgcgacactcctcgagcgtgaagcccacctgccgcgcctggcgcagaaaattgagctcatccaggtggcgctggagcagcgcagcgatgtggaacaggccgaggtaacgcagcaggaagcgcgcgtcaccggcgcagccagcgccagcgatctgattgccactgttgagcaggctggttatcacgccacgctgaaaaatgaggcgtccagcccaaagcctgatccgttgccagctcaggagccgcagccggaggcgctgacaacggagtcgcagccggcagaagagaatcttgcggtgcaccatctgctgataggcgggatgagctgcgccagctgtgtcagtcgcgtcgagcaggcgttacagaaagtgcccggcgtgagccaggcgcgcgtcaatctgggtgagcgcagcgcgctggtgctgggcgatgccgtaccctcagcgctggtcagcgccgtagacgaggcaggttattctgcggaagtgatcgaagatgaacaaacccggcgcgagcgccagcaggtcagcgcacagcaggcgatgcgccgctttagctggcaggcggcgctggcgctgatcgtcggcgtgccgatgatggtctggggcatgctcggtgatcacatgatgctaaacgacagcaatcagacgctctggcgcgtgctcggtgccgtcacgctggcggtgatggcgctcgccggcggccacttctatcgcagcgcgtggcgcagcctgcgtcatgctaccgccaccatggacacgctggtggcgctcggtactggtgcggcctggatctactcaatgagcgtcgcgctgtggccggcatttttcccgccgcaggcgcgccacctttattttgaagccagcgtgatgatcatcggcctgattaacctcggccatgcgctggaacagcgcgcgcgccagcgcgcctcacaggcgctggagcggctgctggatttaaccccggcgcaggcctgcgtgatcactgccgaaggggaaaagccgctgccgctgagcgaaatcacaccgggcatgacgctcaaactggtcaccggcgatcgcgtaccggtggacggcgaagtcagccgcggcgaagcctggcttgatgaagcaatgctcaccggcgaagcgctgccgcagtcgcgccgtcctggcgataagatttatgccgggacgctggtgcaggacggatcgctacagttcaccgcccgcgccaccggcagccataccacgctggcccgtattatcaacttggtgcgtcaggcgcagagcagcaagccggaaatgggccggctggccgatcgcatctcggcggtgtttgtgccggtggtggtggcgattgccctgctcagcggagcggtctggtatgttgtcgggccgcagccgcagctggcctatacgctggtgattgtcactacggtgctgattatcgcctgcccatgtgcgctgggcttagccacgccgatgtcggtgatcgcgggcgtcggccgcgccgccgagctgggcgtgctggtgcgcgatgccgatgcgctgcagcgggccagtgaagttgacaccattgtgtttgataaaaccggcaccctgacccagggtacgccgcaggtcagcgaggtgctgctgtacagcgactgggatcgtcagcaggtactgcaggcggccgcccagctggagctgggatcggggcatcctctggcgaaggccatcgtcgccgccgcaccgaccgtcagtgacgcccgcgttgcgcaatttcgtacaatacgcggcaaaggcgtgagtgctactgtcgctgacagaacgctgctgctgggcaatgcggcgctgctggaagagcagcacatcaacctgcgcgccgcacagcaggatatcgcgcgactcgctgcgcagggtgccacgccggtgctgctggcggatcaacagcagctgctgggcctgatcgccctgcgtgaccagctgcgtccggagagccgtgcggcgctacagcggctgcatcagctgggctaccgtctgatcatgctgaccggtgaccatcagactactgccgaagccatcgctgccgaagcaggcattgatgaggtgatcgctggcgtgctgccggacggtaaagcgcaggcgattgcgcagcagcaacagcaggggcgcagcgtggtgatggtgggcgacgtcatcaacgacgccccggcgctggcgcagggcggatgtggggatcgccatgggcggcggcagcgatgtggcggttga

SEQ ID NO: 3733 - DNA, 480 bp, Glycine max
  Peptide Sequence Number=SeqID_95418
atgacacccgccgtaaaactgctggaaaaacaacaggtcgcttttaccctgcatccctacgagcatgacagccatgaaacccacttcggtgacgaggcggtgcgcaagctcaacctggatgcgcgccaggtgtttaaaaccctgctggtggcgcttaacggtgatggcaaagcgctggcagtggcggtgacgccggtctcctcacagctggatttgaaaaaagtcgccaaagcgctcggggcaaaaaaagccgacatggccgatccgcaactggcgcagcgcgtcaccggctatctggtgggtggcatcagtccgctggggcagaaaaagcggctgccgacggtgatcgatcagcaggccagcgaattcccgaccatctttatttccggcggcaagcgcgggctggatatcgaactggccgcgcaggatctggcaaggctgctggatgccacgctggctgacgtggcgcgccgcgattaa

SEQ ID NO: 3734 - DNA, 587 bp, Glycine max
  Peptide Sequence Number=SeqID_95419
atgatcgttggtgtgcaaaatgctgaagcgatagctgcgttccggctgccacgcctgcgccagcagcggcaacagcagcataatcagcgccagccagcgccctctgtgcgttcgccctttaactcaaggccaaaggcgaatacagtcatgcatgactctcgcgcatctgctgaacgatatgctgcaatcgctgttactggcgatctatccgctgctgcagaaagatttcagcctcagctttgtgcaaattggtttgattacgctgacgtatcaggttacggcctcattattacaaccgctgattggctattacaccgacaaatatccgaaaccctggtcactgccggtcgggatggggtttaccctgttcggtctggtgctgctgacctttgccagcacttatccgcaggtgctgctggccgcagcgctggttggctgcggctcatcggtgttccatccggaatcgtcgcgcgtggcgcgtatggcctccggcggccgccacgggctggctcagtcgctgtttcaggtgagccgctggtacagccaccagcagcgcgccacgcaggccagcgctgccagcaggccgc

SEQ ID NO: 3735 - DNA, 1202 bp, Glycine max
  Peptide Sequence Number=SeqID_95420
tcgatgacgacttcctgcagcgctatggcctgagcgccggtcattcgctggtcatcgacgatgcgaccgccgaagcgctatataacgagctgatgcgcgagcagctgatcagccaccagtttgccggcggcaccatcggtaatacgctgcacaactactcggtgctggccgatgaccgttcggtgctgctcggcgtgatgtgtaacaacatccagattggcggttacgcctatcgctacctgtgcaatacctccagccgcatggaccttaacttcctgcagggcgtcgatggcgccattggccgctgctttaccctgatcggcgagcagggcgagcgcacctttgccatcagccctggcctgatgaaccagctacaggccgccagtattccggaagaggtgattgccggtgcgtcggcgctggtgctgacatcctacctggtgcgctgtcagccgggcgaaccgatgccggaagcgacgctgcgggccattgagttcgccaaaaagcacaatgtaccggtggtgctgacgctcggtaccaaatatgtgattcaggataacccgcagttctggcgcgatttcctgcgcgaacacgtctcgattgtggcgatgaatgaagaggaagcgttcgcgctgaccggcgaagcggatccgctgctggcctctaacatggcgctcgactgggtcgatctggtgctgtgcaccgccggaccgaccgggctgtatatggccgggttcaccgaagaggcgtttaagcgcaaaaccaatcatccgctgttgccaggggcgattgccgagttcaaccagtttgagttcagccgcgccatgcgtcatcaggattgccagcagccgctgcggatcttctcgcatattgcgccttacatgggcggtccggagaagatcatgaacaccaatggtgccggtgatggcgcgctggcggcgctgctgcacgatattaccgccaacaatttccaccgtcagaaagtgccaaactccagcaaacacgcccgcgaatacctgacctactcgtcgctggcgcaggtgtgcaaatatgccaaccgcgtcagttatcaggtgctgaaccagcactcaccgcgtctgacgcgcgggctgccggagcgggaagacagtttagaagagtcttactgggacagccgtgatatggctttagtatgcgcaataaattgcgccgctacggtgtaa

SEQ ID NO: 3736 - DNA, 645 bp, Glycine max
  Peptide Sequence Number=SeqID_95421
atgcgtattattctgctcggggcaccgggcgcaggtaagggcactcaggctcaattcatcatggagaaatacggtattccgcagatctccacgggcgacatgttgcgtgcggctgtcaaagccggcaccgaattgggccagcaggcgaaagccatcatggatgccggtaaactggtaacggacgagctggtgattgcgctggttaaagagcgtatcgcgcaggaagactgcaaaaacggcttcctgctcgatggtttcccacgcaccatcccgcaggctgacgccatgaaagaggcgggcatcaaggtggattacgtgctcgagttcgccgtaccggacgaactgattgtcgatcgcattgtcggccgccgcgtgcatgcgccgtcaggccgcgtttaccacatcaaatacaatccgccaaaagtggaaggtaaagatgacgtgaccggcgaagagctgaccacgcgtaaagatgaccaggaagagaccgtgcgtaagcgtctggtggaataccatcagctaaccgcgccgctgattgcttactacagcaaagaagccgaagccggtaacaccgaataccacaaaatcgacggcacccgccaggtgaccgaagtgagtgcacagctggctgatatcctcggctaa

SEQ ID NO: 3737 - DNA, 1182 bp, Glycine max
  Peptide Sequence Number=SeqID_95422
gcgctgtggacgcgcaacaaaggcgaaatcagcgacgaagagtacaacgagttctacaaacacatcgcccatgatttcagcgatccggccatctggagccacaaccgcgtcgaaggcaagcaggagtacaccagcctgctgtacatcccgtcgcgtgcgccgttcgacatgtggaaccgcgacagcaagcacggtctgaaactgtacgtgcagcgcgtcttcatcatggatgacgcggaacagttcatgccgaactatctgcgctttgtgcgtggcctgattgattccagcgatctgccgctcaacgtctcccgtgagatcctgcaggacagccgcgtcacgcagagcctgcgcgccgcgctgaccaaacgcagcctgcagatgctggaaaaactggctaaagacgacgcagagaaatatcagcagttctggaaagagttcggtctggtgctgaaagagggcccggcggaagatcatgccaaccaggaggcgattgctaaactgctgcgtttcgccaccacccagagcgaaggcgcggcgcagaccgtttcgctggaagattacgtcagccgcatggttgaagggcaggagaagatttactacatcactgccgacagctatgccgccgcgaaaagcagcccgcatctggagctgttccgtaagaaaggcatcgaggtcctgctgctgtccgatcgtatcgacgagtggatgatgagctacctcactgagttcgatggcaaagcgttccagtcggtgagcaaagcggatgagtcgctgagcaagctggcggacgaagagacggaagcgcagaaggaagcggaaaaagcgctggagccgttcgtcgatcgcgtgaaaaccctgctgggcgagcgcgtcaaagaggtgcgcctgacccatcgcctcaccgacacgccggcgattgtcaccaccgacgccaacgaaatgaccacgcagatggcgaagctgttcgctgcagccggtcaggatgtgccggaagtgaagtacatctttgagatcaacccggagcatacgctggtgaaacgcgtggctgatacgcaggatgaagcgcgctttgcggagtgggttgaactgttgctggatcaggcgctgctggctgagcgcggcacgctggacgatcctaaccagtttatccgccgcatgaatcagttgctgacggcgtaa

SEQ ID NO: 3738 - DNA, 1523 bp, Glycine max
  Peptide Sequence Number=SeqID_95423
ccaatcagcgcgccgatcaccgccagcaccagcgtcggcaccagtccgccgggacggccgggaaacaccctccgcttcagccagccggcagccaggccaataataatccagatgataagggtcatgcttctcctcccgtcagcgctgtttccagtatagaggaaagcgaacggcttacggctgcgccgcgatctccagtttatgcagcgcggcgtggcagcgcgccagccgctcctgcagaatctccacctcgcgcatcagctgctgctgcacgctcagcgtttcagcttgcgccaggtgctgttcgcgctgctgcagcatggccagcaatcgcgttttccgaaacagctgcgcgtcaaagcgcggctgacggcagctaccgtccggctgctgcgcaatctgctggcgcagcgtgtcaatcattgcgtgcagacgctgttgggcgggcagttgaggcatcacttcgattccgcatctggcatgcagcgcattttactgttaagccttggctggctggcgattgtgctgggcacgctgggcattgtattacctttactaccgaccacgccattcgtgttgctggccgcctggtgttttgcccgctcgtcgccgcgctttcatcactggctgctgtggcgctcgccgtttggccgctatctgcgtcactggcagcagcatcgcgccatgccgcccggtgccaaaggccgggccatgttgctgattgtcatcacctttgcggtttcaatctggctggtgaagctgctgtggctgcgcatcctgctcggtgtgatgctggcgctattgttgctcatgctgtggcgcatcccggttgtagcagaaagtgcgaacccgcacgaaccgtagcatcagggttgcatttagccggctgtttgcttagatttgggcatcttcgtgcgtggcttccctttgagaaacgacttcgcttaacccggtttccgggcgtaacctttatgaccgcaactgcgcagcagcttgaactgatcaaaaacagcatcaaaagcattcctgactatccgaagccgggcatcctgttccgtgacgtcaccagtctgatggaagatccgcaggcgtatgccgcagcgatcgccattctggtggagcgttatcgtaataaaggcatcaccaaagtggtgggcaccgaagcgcgtggcttcctgttcggggcgccggttgcgctgggtctgggcgtgggatttgtgccggtgcgcaaaccgggcaaactgccgcgtgaaactttcagcgaaagctatgaactggagtacggttcagacgcgctggaactgcataaagacgccatcaaatccggcgatgtggtgctggtggtggacgatctgctggctaccggcggcacccttgaagccacggtgaaactgattcgtcgtgcgggcggtgaagttaaagacgccgcgttcgtgatcaacctgtttgatttaagcggcgaagcgcgcctgaacgcgctgggtatcgactgctatagcctggtcaatttccccggccactaa

SEQ ID NO: 3739 - DNA, 638 bp, Glycine max
  Peptide Sequence Number=SeqID_95424
atgaataaaaacagaggattagcgcctctggcggccgccgtgatgcttacaggcagctttttgttaacaggatgtgatgataataaatcccagcaagccgcccagcagcagcccccggaagtgggtgttgtcacgttaaaaaacgagcccctgaaaatcaccaccgaactgccaggccgtacttcggcgttccgcgtggctgaagtgcgtccgcaggtgtcaggtatcattctcaagcgtaattttgttgaaggcagtgatgttaaagccggcgattcgctgtaccagatcgatcccgccacctatcaggccgcatacgacagcgcaaaaggcgatttagcccaggctcaggccaacgcgcgcgttgcccagctgacggtgaatcgttacaagccgctgctgggtaccaaatatatcagccagcaggactacgataacgccgcggccaccgccgcgcagaccgccgcagccgtacaggcggcgcaggccaatgtggaaaccgcccgcattaacctggcgtacaccaaagtgacctcgccaatcagcggccgcattggtaaatcctcggtgacggaaggtgcgctggtgtcgaacggccagaccaccgcgctggcgaccgtgcagcaactcgatccgat

SEQ ID NO: 3740 - DNA, 1612 bp, Glycine max
  Peptide Sequence Number=SeqID_95425
atggctaagttctttatcgatcgccccatttttgcctgggtgcttgccatcattattatgctggcgggtgcgctatcgattatcaaactgccgatcgagcaatatcccaacgttgcgccgccggcagttgaaatccaggcatcttatccgggtgcagatgcgaaaacgctacaggattcggtaacgcaggttatcgaacagaatatgaacggcatcgacgggctgatgtatatgtcctcgagcagtgactcttctggtacgctgacgctgacgctgaccttccagtctggtactgacgccgacattgctcaggtgcaggtgcagaacaaactgcaactggcgatgccactgctgccgcaggaagtacagcagcaggggattcaggtgaaaaaatcctccagcagcttcctgatggtcgccggtttcgtcagcgaagatggcagcatgacgcagaacgacatctcagactacgtagcgtcgaacatcaaagatccgatcagccgtacgcctggcgtcggtgatactcaggtgtttggtgcgcagtatgcgatgcgtatctggctcgatccgcacaagcttaacaactaccagctgacgccggtggatgtgatcagcgcgctgcaaacccagaacacccaggtggctgccggtcagctgggcggtaccccaccggtgccaggtcagcagcttaacgcctcgatcattgcccagacgcgtctgacctcgaccgaagagttcggcaacatcatgctgaaggtcaatcaggacggctcacaggtgcgcctgcgcgatgtcgcgaagattgaactcggcggtgaaaactacgagatcattgcccgctataacggcaaaccagcctccggtatcggtgtcaaactggcgactggcgccaacgcactggataccgccgacgcggtgaaagcggaactggctaagctggaaccgttcttcccggctggcatgaaaaccgtttacccgtacgacaccacgccattcattaagatctccattttcaaagtggtgaaaacgctgttcgaagccatcgtgctggtgttcctggtaatgtatctgttcctgcacaacttccgcacgacgctcattcctaccatcgccgtgccggtggtgctgctgggcacctttgccatcatcagtgcctttggctactcgataaacaccctgacgatgttcggcatggtgctcgccatcggcctgctggtggatgacgccatcgtggtggtggaaaacgttgagcgcgtcatggcggaagaaggattaccgccgaaagaagccaccaaacgctcgatggaacagatccagggcgcgctggtgggcatcgcgctggtgctgtcagcggtatttatcccgatggcgttcttcggtggctcaaccggggtgatttatcttcagttctcgatcaccatcgtttcggcgatggcgctgtcggtgctggtggcgttgattctgacgcctgcgctgtgtgccaccatgctgaatcccatcaaaaaaggcaaacacggtaaaaccaccggtttcttcggctggtttaaccgcttgtttgacaagagcaccaaccattacttcgactgcgtcggtcacattgtgctcatcatcg

SEQ ID NO: 3741 - DNA, 506 bp, Glycine max
  Peptide Sequence Number=SeqID_95426
gctgtgccgatcacagtaaacccgtgccgacgccaactttaggcgccagcgtggccgggcagccgtcggcgattgcccagccgaacgtaagcggttccgtctatattcgccagcgtattgcgctgccgccggatgcggtgctgaccgtgacgctggccgatgcgtcactggcggatgcgccgtccaaagtgctgtcacagcgtgtggttcgcaccgagggcaaacaggcaccgttccagtttgtgctgccctttaacccggccgatatccagccgaacgcgcgcattttgctgagcgcagcgatcaccatcgacggcaagctggcgtttatcaccgatacggtgaaaccggtgattaatcagggtggaacgaaagcggaactgctgctggtaccggtgaccaatatggcgatgccaacccagccgggcgctgctaccactgtgccttcgacgtcgccaacccaggttacgccgtcagcctccgtgccggcaccaaccagtctgtaa

SEQ ID NO: 3742 - DNA, 1434 bp, Glycine max
  Peptide Sequence Number=SeqID_95427
tgggcgagcgcggtgtcatgctctctggcgggcagaaacagcgcatcgccattgcgcgtgcgctgttgctcaacgctgagattctgatcctcgacgatgcgctgtcggcggttgatggccgtaccgaacatgaaatcctgcataacctgcgccaggcgcagtggcacagcgcggcgatcacgatacgctggcggcgcagccgggctggtatcgcgatatgtatcgctatcagcagctggaagccgcgctggatgaggacgaggcagaacagggagccgaccatggctaaatcgcaacgcttatggccaacgctgaaacgcctgctggcctacggtaaaccgtggcgcaaatcgctgtggctggccgtcggcatgctgtggatcgctgccgctgccgaagtcaccggtccggtgctggtgagctattttatcgataacctggtggcaaaacaccggatgccgtggggcatcgtggccgggctgctggtgggctttgtgctgctgcagctgctggcagcgggtctgcactatttccaggcgctgctgtttaaccgcgcggcgattggtgtcgtgcagcagctgcgcgtcgatgtgatgaatgcggcgctgcgccagccgctcagtgccttcgacacccagccggtggggacagattatttcgcgcgtcaccaacgataccgaagtgatcaaagatctttacgtcacggtggtggccactgtgctgcgcagcgctgcgctgattggcgcgatgctggtggcgatgtttgcactcgactggcgtatggcgctggtggcgctggtgattttcccgctggtgttaacggtgatgctgatctatcagcgctacagcacgccgattgcgcgccgcgcgcgctttggcgagcgcatgggcgaagccagccgatcgcactatctggcgcggatggagacgctgcggctggacggctttttgctgcgtccgctgctcagcctgttttctgcactgatattgttggcgtgctttacgcctttatcacttatcttggccgccttaacgagccactgatcgagctcaccacgcagcagtcaatgctgcagcaggcggtggtatcgggcgagcgtatttttgaactgatggatgcggcgcagcagggctacggcagtgacgctcagccgctggcttccgggcgtatcaccctgcgcgatgtcagctttgcctaccgcgacaaccgcgacgtgctcagccatatcaacctcgaagtgccggcgcgcggcttcgtggcactggtcggccataccggcagcggaaaaagcaccttagccaatctgctgatgggctactatccgcgtggcgatggtgcaacaggatccggtggtactggccgatacgctgctggccaacgtgcgtttgggacgcgatatcagcgaagaggacgtgtggcgcgcgctggagaag

SEQ ID NO: 3743 - DNA, 822 bp, Glycine max
  Peptide Sequence Number=SeqID_95428
atggcccgcctcgcggcatttgatatggacggtacactgctgctgcctacccaccgtttaggtgcggagacgctgcagagcctcaacgccctacaccagcgtggcgttacactggcgtttgccacggggcgtcacctgctggatatgcaggcagtacgccagcagatcaccttgcccgcctggctgatcaccggtaacggcacgcgcattcacgatgtcgagggcaggcagctgtacggctgtgatttagcgccgtcggtggcggaagaggtattgcacagtcactggcaaactcccgcatcgatccacatctttaatgacgaaggctggtttaccgataaaccgctcccgggattgctggaagcgcacgcgatgagcgggtttcactatcagctgcgtgatttacgccgcatgccggcacatgaagtcaccaagatctgctttatcgcgccgtatgagatgctgctggcgcttaagattgaactgcaacaggcgctcggcgatcgcgccagcctgtgcttctccgccagggagtgtctggaagttttaccgttggattgccacaaaggcgccgcgctggcgcggctgtgccagcatctgtctctgtcgctggcggattgcatggcatttggcgatgcgatgaacgaccgcgaaatgcttgagcgcgtcgggcgtggttttatcatgggcaacgccatgcatcagctgaaaacctcgctgccccatttaccgatcattggccattgcgagacacaggcggtgtctcactacttaaatcactggatgaccacaccacacctcgattattcccccgaatgctga

SEQ ID NO: 3744 - DNA, 1632 bp, Glycine max
  Peptide Sequence Number=SeqID_95429
atggcgcagcactgctattgcagcgagcgccacgtgcgtaccctgttgcggcagtggcagcaggcgggctggctgcagtggcacggtgcggcgggacgcggtaaacagggcgaactgcgctttctgctctctcccgaacagctgcgtcagcaattgctcagccagcagctggcagccggtgaagcggtacaggcactgcaggtactggatgtcgcgcctgaacggctggtgaaaatgctgcgcccactgatgggcggccagtggcagaatcaggcgccggtgctgcgcattccctattatcgcgcgatggaggcgctggatccgctgcagctcaccggacgcgccgagcagcatctggtacgccagattttttccggcctgacgcgctttaacgcggatgatgtcgagggcgatctggcacatcactggcagcacgatgcgcagggccgcgaatggtatttctggctgcggccactcctcagctggcacaacgacgaaccagtgcaggcggcacagctggtccagcagctgcaacgtatcatgcagacgccgcagggcggccgtctgctggcggcggtggaacacatcgatgcgccacatccgctggcgctgcgtatccggctgcgcaccagcgattactggctgccgcagcggctggcgcatcagttttgcctgctgccgcatccggaacatgccgatatcggcagcggaccgtggcgcctgacgcactttacccgcgagctggtgcggctggagagccatgcgcgctggcaccatcagcgtccgctgattcaggtggtggaatactggattacgccgcagctgttcgatcgcgggctgggcaccagctgtcgccatccggtgcagatcgccattggcgatcccgacgagctggacacgctgcggccggtggatcgcagcatcagtctcggtttctgttacctggcgccgcgtttctcggctcgcttcagccaggcgcaggccaaaacgctgctcgcgctgattcagcacagcggcgtcattcagcagttgccgctggatgaaggcttaattacgccaaccgcagagctgctgcccggctggccgctgcccgccccacaccgcccggaaggcacattgcccgcaacgctgacgctgcattatcacctgcccatcgaactgcacgtcatggcccaggcgctggtgccgctgctggcggcacagggctgtaccctcacctgcgtatttcacgacgtcaaaagctggcgcgacgacatcgatctgagtgacgccgacatcatcatgggcgaccgtctgattggtgatgcgccgcagtttaccctggttaactggctggaaaatgatgcggcctggcaaccgctgcgtccggcggtactgcaggcaccgctgcacgctatcgcccgtcaggccagtccggcactgcgcagcgccgcgattcatcaactgtttcagcagttaatgcgcgacggccatctgctgccgctgtttaactatcgctaccaggtgtttgctccgccaggcgtcgaaggtattcagcttaacagcatgggctggttcgatttcacccgcgcctggatcccgccgcctgccgcaggcggtgctgttcagcccgcgccggagccagtaccatag

SEQ ID NO: 3745 - DNA, 2769 bp, Glycine max
  Peptide Sequence Number=SeqID_95430
atgccgcccgaccggcgtggatccggtaaaggcaattttagcgatgcgcttgctggtggccagcgcttcgccggcttcgcggccaaagccctgcactacattcagcacgcccggagggaacagatcgccaatcagctccatcagcagcgtaataccaagcggcgtctgctcagccggtttcagcaccacgcagttaccggcggccagcgccggtgccagcttccacgccgccatgagcagcgggaagttccacgggatgatctgtccgaccacgccgagcggctcgtggaagtgataggccaccgtggtttcgtcgatctcagcggtgctgccctcctgcgcgcgcaggcagccggcaaaatagcgaaaatggtcgaccgccagcggcagatcggcgttgagcgtctcgcgaatcggtttaccgttatcccagctctccgctaccgccagcttctcaagactggcttctatacgatcggccacctgcagcagcaggttggcgcgctgctgtacgctggttttgccccacgcatccgcagcctgatgcgcggcatccagcgccagatcgatatcgcgcgcgtcggagcgcgggaaccgggcaatatcgctgccgtctaccggcgaggtgttcataaagtactggccgctcagcggctcggtgaagttgccggcgatatagttgccgtaggtcgcctggaaagagaccagcgcgccgggcgtgccgggatgtgcataacgcatcgcaaactccttattatcaggtcagagggtctgaacaggcagcgcaactgcctgtgtcggtattgcagcgcgcgtgccagttttttctcatcaggcgcaaaagcgataaatgcattatttatcaatcaaataaattcattccccgccagctaccctgtcagtcctccacgacaaacactgtatctgtgttgcgtatcgcaacagtgcagaaacccgaacgctacaatgttgcaacacttacacgccgttctgaggtcactcatgcagggaaattcagccgcgtctgccgtgcacgccaacccgctgttaagcgactcctggttccgcagccagctgtatggattagagcgcagcgccgacgatttcccgcgcgtgcgtcagggcgagctggccgatgtgctggccagcaacgccgggctgcagcagtttgcgcagccggtcatccgccagctggcgcagcagatggcggagacgcagtcggtggtgatcctgtccgatgccagcgggctggtgctgaacacctttggcgatatgcaggcgctggagaaagcccagcggtttgccctggcacccggtaacctgtggagtgaatgcggacgcggcaccaatgcgattggcaccgcgctggcgattgatgacggctgtgaaattgatggccagcagcatttcctgacgcgcaatcagggtctgtactgcgccgcgatgccgttgcagatgcccaacggccagatagccggcgtgctggatatctcgggtccggcacactttccgcatccgcataccctgaaccgggtgaaagcagcggcaaagcagattgagtacctgtgggtgaagcagagcctgcatccgcagcagtggctgctcagtctgcatccgcagccgcagggcatcgacaccagtgatgaactgctgctggtattctctgacaatgtgctgaccgcagccaaccggctggcgatgcgcgaactggctctcagcgccgaccgctttgccagcctgacgtttcagcagctgtttccgcaactgcagcagcaggccaacagcgttcccgccgcggtcgacattggcgcgcagcgctactggttccgcctgcgcgcgccgcagcgcagccatgtcagcgtgccggacagtcgcacgcatgacttgccgcgcgtgctgggagctgacggcgcaaaaatgctgcggttgctggatgccggcgtttcgctgtgcatttatggtgaaaccggcagcggcaaggagtatgtcagccgcgcgctgcaccagcaaagccggtggcgcacgggcaagtttgtcgccatcaactgtgccgccatccccgaagcgctgattgaatccgaactgtttggctaccagcccggcgcatttactggcgccagtaaaaatggctacatcggcaaaattcgcgaagcggatggcggcgtgctgtttctggatgaaatcggtgacatgccgctgacgctgcagacccgtttgctgcgcgtgctgcaggaaaaagaggtggcgccactcggctccagtcgcagctggccggtgaattttgccgtgatttgcgccacgcatcgcgatctggcccagcgcgtgaccgccggcgaatttcgtgaagatttgctctatcgtctgcaggagttcgccctgacccttccgccgctgcgcgcctggccgaacgtcgccgggtttatccgcgatttatggcaggaactgggagccgcgcagcgtggcgtacagctgtctcaggcgctgctgacggcgctggcgcagcagccgtggccgggcaatgtgcgccagctacgtagtctgctgcgcgtgctgctggcgctcgccgatgagggcgaaacgctgacggaaagtcacttgccggcagagtatcgccgcccaccagccccgccgctgcgcgaacgccacgatgaacagctgatcagtgaaacgctgcagcgctatgacggcaatatcagtaaagcggcgcaggcgctgggggtcgcgcgcagcacgctgtatcgtcgtgcggcacgcgacagaggggattaa

SEQ ID NO: 3746 - DNA, 2589 bp, Glycine max
  Peptide Sequence Number=SeqID_95431
atgaccgatgcgcactacatggcgcgcgcgctggaactggcgcggcgcggacaatataccaccaccccgaatcctaacgtcggctgcgttatcgtgcgtgacggcgcgatcatgggcgaaggctggcatcagcgcgccggtgaaccgcacgcggaagtgcacgcgctgcgcatggcgggcgaccacgcacgcggtgcgaccgcatatgtcacgctggaaccctgcagccatcacggtcggacgccgccgtgctgcgatgcgctgattgctgccggcgtcagccgggtggtcgcggcgatgcaggatcctaatccgcaggtggccgggcgcggcttgtatcgtttacagcaggccggcatcgacgtgagtcacggcctgatgatgaacgaagcggaagcgctcaatcgtggttttctcaaacgcatgcgtaccggttttccgtggattcagctcaaactgggtgcctcgctggatggccgtaccgccatggccagcggcgaaagccagtggatcacttccgcagcggcaaggcgcgatgtgcaacgtttacgtgcccgcagttcagctatccttaccaccagtgccaccgtgctggcggacaatccgtcgctgacggtgcgctgggatgaactgagcgagaccgtgcgccagcagctggatgagagccagctgcgtcagccggtgcgggtggtgatcgacagccagcagcgcgtgacgccgcagcaccgtttgatcgcccagcccggcgaaacctggctgatgcgcacggaggctgatgcacaaagctggccgccgggcgtgagtcagatagaggtgccgccgcgcggtgagcagctcgatctggtggcgatgatgatgctgctcggtcagcgtcagatcaacagcgtgtgggttgaggccggtgccggtctggccggtgcgctgctgcaggccggcctggtggatgaactgatcgtttatctggcgccgaaactgctgggtaatgccgcgcgcggcctgtgtgcgctgccgggactggaaacgctggccgatgcgccagcgctgaattttagcgacgtgcgtcagcctgagcgcgttgccgaagagtatgatagaatccgcccccttctgcggggccataaaacaaacacccaaaggatatgtatgaaagttatcgaagctgctgttgccacgcctgatgccaatattgccatcgtaatcgcgcgttttaacaatttcatcaatgacagcctgctggacggtgcagttgacgcgctgaagcgtattggccaggtcaaagcggaaaacatcaccgtggtctgggtaccgggcgcttacgagctgccgctggcggcacgcgccctggcgaaaaccggcaagcacgacgcgatcgtcgcactgggcacggtgatccgtggcggtaccgcacacttcgaatacgtggcgggtgaagccagctccggcatcgctcatgtagcgatgaacagcgaaattccggtgaccttcggcgtcctgaccaccgaaaacatcgagcaggcgattgaacgcgccggcaccaaagcgggtaacaaaggcgccgaagcggccctgaccgcacttgaaatgattaacgcgctttactcctggcagttgtctaacaacgacattgccgatgtggaataccagtttctggcggaacaagacgtcaaagacgtcgatattagctatttccgcgaactgctggccggtgtggcgaccaacagcgcgttcctggacggcctgatgaagccttacctgtcgcgccagctggaagagctgggccaggtagaaaaagccatcctgcgcatttcgctctttgaactgagcaagcgtgacgatgtgccgtacaaagtggcgatcaacgaaggtatcgaactggctaaagtctcccgccgcgatgtggagaagggaattggtgacgactgcgcgttacttaacgtgccggaaaaacagacgctggccatcagcaccgatacgctggtggcgggcgtgcatttcttacgtgatatccatccggccgatctcggctacaaagcgctggctgttaacctgagcgacctggcggcgatgggggccgatccggcatggttaacgctggcgttgacgttgcctgaggttgatgaaccctggctggccgcgttcagcgacagcctgtttgagctgctggattattacgatatgcagctgatcggcggcgataccacgcgcgggccgctcagcctgacgctgggcattcatggcctggtgccggccggccgtgcgctgaagcgcgccggggccaaaccgggtgactggatttttgtcaccggcacgctgggcgacagcgctgctggtctgtcgctgctgcagcaccatcatcgcctgaacgatccggcggtgcatgaagtgctgatcaagcgtcatctgcgcccgatgccgcgcgtgctgcagggccaggcgctgcgtaatctggcgacatcagccatcgatctgtccgatggtctgatctccgatctcggccacattctcaccgccagccgcgtcggtgcccgcatcaatccggatgcgctgccgctgtcggccgcgttgcgcgatcactttgagccggagcag

SEQ ID NO: 3747 - DNA, 5348 bp, Glycine max
  Peptide Sequence Number=SeqID_95432
cgttcgcgccacattaccgcgttgagctcgataaaatcgcccggcgtgccgggcagctgcggcacaatgtcgcgctcggcagcggcgctaaaagcagacagcgactgcgccggatgcagctgatcccagtggcgcgccaggaagtggtcccagatcacgtcgaggggcaataccggccaccaccggctgcggccactgcgcctcaacgttgccgcgcacaaagtcggccagcagattacccagcagtgagctgtcggccagggttgcaaggtgaagccgattttgcctttgaattaccggaatctttgatcgcccactatccgcaggcgcagcgcagcggatgtcgtctgctgtcgctggatggcccgagcggggcgctgaaccatggcgtgtttactgatgtgctggataagctcaatccgggcgatctgctggtgttcaataatacccgggtgattccggcgcgcgtctatggccgtaaagccagcggcggcaaaattgagatgctggttgagcgcatgctggatgacaaacgcgtgctggcgcacgtgcgcgcctccaaagcgccgaagccgggtgccgaattactgctgggcgacgacgaaagcgtcaaagccaccatggtggcgcgccacgatgcgctgttcgaaatcgagtttgcggacgatcgcgcggtgctggatatcctgaacagcgtcggccatatgccgctgccgccgtacatcgatcgtccggatgaggaagctgaccgcgagctgtaccagacggtctacagcgcgcgccccggcgcggtggcagccccgaccgccggtctgcacttcgatgagccgctgctggcggcgctgaaggcgaaaggcgtggagatggcgtttgtgacgctgcacgtcggcgctggcactttccagccggtgcgcgtagagaacatcaacgatcacatcatgcactctgaatatgccgaagtgccgcaggacgtggtggacgcggtgctggcgtgcaaagcgcgcggtaacaaagtggtggcggtgggcaccacctcggtgcgatcgctggagagcgcagcgcaagcctgtcaggatgggctgatcgcgccgtttttcgatgacacgcagatctttatctatccgggctatcactaccaggtgattgatgcgctaatcaccaacttccacctgccggaatcgacgctgattatgctggtctcggcgtttgccggttatcaacacaccatggcggcttatcagagcgcggtggcggagcagtaccgtttctttagctacggggatgcgatgtacatcacccgtaatccacaggctcccgacgaaatcgtcaatgtgaaatttgaattagataccaccgacgggcgcgcgcgccgtggccgtctggtctttgatcgcggcgtcgtggaaaccccggcgtttatgccggtcggcacctacggcacggtcaaaggcatgacgccggaagaagtgaaagagaccggcgcgcagatcctgctgggcaacactttccacctgtggctacgcccggggcaggagatcatgaaactgcacggcgacctgcacgatttcatgcactggcagggaccgatcctgaccgactccggcggcttccaggtgttcagcctcggtgatatccgtaagatcactgaagccggcgtgcatttccgcaaccccatcaacggcgacccgattttcctcgacccggaaaaatcgatggagattcagtacgatctcggctccgatattgtgatgattttcgacgaatgtacgccgtatccggcggactgggattacgctaaacgctcgatggagatgtcactgcgctgggcgcagcgcagccgcgaccgctttgacgcgctcggtaacaaaaatgcgctgtttggcattattcagggcggggtttacgaagatttacgtgatgtctcggttaaaggtctggtagagattggctttgatgggtacgctgtgggcggcctggcggtgggtgaaccgaaagaggacatgcaccgcatcctggaacacgtctgtccgcaaattccgcaagacaaaccgcgttatttgatgggcgtcggcaaaccggaagatctggtggaaggcgttcgccgcggtatcgatatgtttgactgcgttatgccaacgcgtaacgcgcgcaacggccatctgttcgtcaccgatggcgtggtgaaaatccgcaatgcgaaatacaaagatgacaccgcgccgctggatgcggagtgtgattgttacacctgtcgcaattacacgcgtgcctacttgcatcatcttgatcgctgtaacgaaatactgggcgcacgtctgaacaccatccacaatctgcgctattaccagcgtctgatggcgggtttacgccaggccatcgaagagggtaaattagagcactttgttagcgagttctaccaacggacgggcaaagcggttccaccgttaaacggaagtccgtattctctggtgatcatgctggtggtttttggtctgattttctacttcatgatcctgcgtccacagcagaagcgcgccaaagatcacaaaaagctgatggattccatctccaaaggtgatgaagtgctgaccaacggtggcctggtgggccgcgtaacgaaagtggctgaaaccggctacatcgctatcgccctgaacgacaccactgaaggaactgccgtgttaaaccgttatcctttgtggaagtacatcatgctggtcgtcgtgattctcgtcggcctgctgtatgcgcttcctaacctttatggtgaggatccggccgttcagatcactggtgcgcgcggtggcgccgccagtgagcaaacgttggatcagatccagaccgtattaaaacaagacaatatccagagcaaatccctcgcgctggaaaatggtgccattctggcccgtttcgctaacacggatattcagctgcgcgcgcgtgaagccatcaccaatgcgctgggcgaagatttcgttgtggcccttaacctggcccctgccacaccgcgctggctgaccatgctggccgctgaaccgatgaaactcggcctcgatctgcgcggcggcgtgcacttcctgatggaagtcgacatggatactgccctcggcaagctgcaggagcagaatgctgatggcctgcgcagcgatctgcgcgaaaaaaatatcccttacaccaacgttagcaaaatcgctaactacggcaccgaaatacgcttccgcgacggcgccagccgtgatgcggccatcagctatctgacgccgcgccatcgcgacctggtgatcaccagcgctggcagcgacacgctgcgtgcggtgatgaccgatgcgcgtctgagtgaagcgcgcgaatatgcggtgcagcagaacattaacatcctgcgtaaccgtgtgaaccagctgggtgttgctgagccgctggtacagcgtcagggcgctgaccgcatcgtggttgagctgccgggtatccaggataccgcgcgtgctaaagagattctgggtgctaccgcaacgctggagttccgcctggtcaacacctcggtggatccgagcgcagccgccagcggccgcgtgccgggtgactcggaagtgaaaaagacgcgtgaaggtcagccggtggtgctgtacaagcgcgtgattctcaccggtgaccacatcaccgactcgacgtccagcatggatgagtacaaccagccgcaggtgaatatctcgcttgatggcgccggcggtaacatcatgtccaacttcaccaaggacaacatcggcaagccgatggcgaccctgtttgtggagtacaaggacagcggtaagaaagatgcgaacggtcgtgcgattctggtgaagcaggaagaagtgattaacgtggcgaacattcagtcgcgcctcggcaacagcttccgtattaccggtatcagcaacccgaacgaagcgcgtcagctgtcgctgctgctgcgtgccggtgcgctgattgcgccaatccagattgtggaagagcggaccatcggtccaaccatgggccagcagaacatcacgcagggtctcgaagcctgtctgtggggtctgattgcctccatcatctttatggtggtgttctacaagaagtttggtctgattgcgaccagcgcactgctgtgcaacctggtgctgattgtcggcatcatgtcactgttaccgggcgccacgctcaccatgccgggcattgccggtatcgtgctgacgctggcggtggcggtggatgctaacgtgttgattaacgaacgtattaaagaagaactgcgtaacggacgctcggtacagcaggcgattcatgaaggctacaaaggcgccttctccagtatcgtcgacgccaacgtcaccacgctgattaaagttatcattctttatgcggtcggtaccggctcgatcaaagggtttgcgattaccacggctatcggtatcgcgacttccatgttcaccgctatcgtcggcacccgtgccatcgttaacctggaatatagtattgaacagctgaaccatgggcgtaaagtcgtcgactttatgcgctgggacacgctggcctttatcatctccggcctgctgattgtggcgtccatcgccattatcggtgtgcgcggctttaactgggggctcgatttcaccggcgggacggtgattgagatcaacctcgagaagccggcggatctggatgcgctgcgtgacgggctggtgaaggcaggctttgaggagccgctggtacagaactttggcagcagccgtgatgtgatggtgcgtatgccaccgaccaccggcaatgcaggccaggagctgggcaacaaagtggttgcctcgatcaaccagacgacgcagcagaacgcgaccgtgaagcggattgagttcgtgggcccgagcgtgggcagcgatctggcgcaggccggggcgatggcgctgctgtcggcgctgattgcgattctgatctacatcggctttcgctttgagtggcgtctggcgctgggcaccgtgctggcgctggcgcacgacgtgatcatcacctgcggcattctgtcgctgttccacattgagatcgatctgacgattgtggcgtcgctgatgtcggtgattggttactcgctcaacgataagatcgtggtttccgaccgtattcgtgagaacttccgcaaaatccgtcgcgacgctgagccgtacgttgatcacctcgatcaccacgctggcgatgatcctgatcctgttcatctttggtggcgcgctgctgaaaggcttctcgctgaccatgctgatcggtgtcaccatcggtaccatttcgtcgatctacgtgtcgtccgcgctggcgctgaagctgggcatgaagcgtga

SEQ ID NO: 3748 - DNA, 390 bp, Glycine max
  Peptide Sequence Number=SeqID_95433
atgtctgtacctgtctcgctgcgctatcgtccggatatcgatggtctgcgcgctgtcgccattatattggttgtgctgttccactgcggcgtcagcgccgtgccgggcggctttattggcgtcgatatatttttcgttatttccggctttttaattggtgttttatttacgccgcatccggcgtattgcgcccgccctgttttttatgctgatggtattgctgctgctcggttatctgctgttatcaccgctggaattaagccagctggcaaaatacagcatggcggtgtttctctcggtgcccaatatgctgttactgaagagcggcgactatttcagcgcggatgccgatctcaatccgctgctgatgacctggtcgctgggcattga

SEQ ID NO: 3749 - DNA, 604 bp, Glycine max
  Peptide Sequence Number=SeqID_95434
ttttatttacgccgcatccggcgtattgcgcccgccctgttttttatgctgatggtattgctgctgctcggttatctgctgttatccccgctggaattaagccagctggcaaaatacagcatggcggagcagttctatatcgtgctgccgtttattctgctgctggccgcgcggctgcggcgcacaatgacgggcatggtgctactgctcagcctgctgtcgctggccggctgcctgtggttaacgcccctctccagcactcaggcgttttatctgctgccaacccgcgcctgggagctgggtgccggcgtgctgctggcgctgtggcaaccccgccccgtcaccggccggctggccagcctctgtcatctcgctggctggctgctgatcatcgcccgctcaatcaacggctgctggagaacgcgccgatgcgcttcatcggcgctgagcatctgtgccgtggcgctggtcatcgcctggctctcctggcgcttcatcgaacagccattccgtcgggcgcgcagcggtacgcgctggctgatccccggctactgcgcctcgtcgctgctggcagccggtgccatggtgctgctgtggcaaagcg

SEQ ID NO: 3750 - DNA, 1128 bp, Glycine max
  misc_feature (1017)..(1017): n is a, c, g, or t
  Peptide Sequence Number=SeqID_95435
atgacgccgcccaccgggcgcggcagctgggaaccgctgttttacggcctgtatcaaatgcagttgcgcaatcgccgccgccggcgcgagctgggcaatctgatcaaacgctttcgcagcggggccgagtcgctgccggacgcggtggtgctcaccaccgaagagggcaccattttctggtgtaacggtctggcccagcagcatctcgggctgcgctggccggaagataacggccagaatatcctcaacctgctgcgctaccctgaattctcccgctatatccgccagcgcgacttcaacaagccgctgacgctggtgctcaataatcagcatcacatggagttccgcgtcatgccttacagcgaagggcagtggctgatggtggcgcgtgacgtcacccagatgcaccagctggaaggggcgcggcgtaacttcttcgccaacgtcagccatgaactgcgtaccccgctgacggtgctgcagggctatctggagatgatggacgatgccgggatgaacgagcgcacccgcagcaaggcgctcaataccatgcaggagcagacgcgacgcatggacagcctggtgaagcagctgctgacgctgtcacgcatcgaagcggcccctgccattgatctgaaagagacggtggatgtgccgaccatgctgctgctgttacagcgcgaggcggaaaccctcagccagggccggcacagcatccatttccacaccgacccgcatctgaaggtgttcggcaatgatgaacagctgcgcagcgcgatttccaatctggtgtataacgcggtgaaccacacgccggatggcacgcgcatcgacatcagctggctgcgcaccaaacagggcgccgaatttaaagtgtgcgacaacgggcccggcatcagcgaggagcatctgccgcgtctgaccgaacgcttctaccgcgtggataaagcgcgctcgcgcgccaccggcggcagcgggctggggctggccattgttaagcatgcgctcggccaccanaccacgcggctggagatcagcagcgtgccgcatcaggaaacctgcttccgcttcgtgctgccaccgtgcttgattgtggcgaacggaatccgcgagaatgtggcgcagtaa

SEQ ID NO: 3751 - DNA, 815 bp, Glycine max
  Peptide Sequence Number=SeqID_95436
gcgtgctggccggctgtgcgccaaaaggaccggagccgatctactactggggtgattaccagcagcaggtctacagctattaccagaaagacagcgatccacagaagcagattgatgcgctgaatctggatatcgaaaaggccaaagcggtgaacaagccggtggcacccgctgtttccggaatcggccccgtacatggactttctgatgaagaaaaaaggagtgaaccaatgaaaaaattgattgccgtgtgcggcgtattcgcggcgctgctgctgaccggctgtgcccagaataagaaaccgtatgactacagcgccttccgtgccagtaagccggcgtcaattctggtgctgcctgccgataaccgtgcgccggatatcaacgcgtcgcacagcttcacctcgctggtgacccagccgctggcggaagcgggttactacgtgttcccggtggcggtggtggaagagaccttccagcaaaacggcctgagcaacgggcatgaaattcaggcggtgagcacgaagcgcttgcatgacatcttcaacgcagacagcgcactgtacatttcgattaccgattacggcagcagctatctggtggttgattcggtgaccacggtctcggccactgcccgtctggtcgatctgcgcagcggtaaagagctgtggcagggcatggccaccgccaatgattctgagaacagcaacaacagcaacggcggcatcattggcatgcgcccacgtctgttagcgcagaacgagcagggtggtctgctggccggtccgcgctacaaagcgccggttacgcgttaa

SEQ ID NO: 3752 - DNA, 1686 bp, Glycine max
  Peptide Sequence Number=SeqID_95437
gatgcgccgcatctcgatccggccgatcacggcattatcgcagcggcggtagagcgcgccgggcaggcgctggcggaatttggtaaagagcgcgatcgctacggcctgatccacgccgatctgcgtctgaccaatctgctgctgcacaaaggcgagacccgggtgatcgacttcgacgactgcggcatgggctggtatctgcacgatctggcggccgcgatcagcttcgtcgagcaccatccgcgtgcggcggagtgggtggataactggatcctcggctatgaacgcgtggcgcacatcagcgatgctgagatggcgctggtgccgacgctactgatccagcgtcgtattcagatgacggcgtggatgggcacgcacgccgataccgagatggcgctcagcctcaagccgcactgggccagccattcggtgcggctgtgccgtcgctatcttgagagcagtcagctgccgcgcgccagtcgtcacaggcgcgctgacaggcacgcggatcgccaccgggagcgcgccagcggcggccaggcggtgcattgccttgcaccgcgcgccgtcgggggacgctgcgcgtttgccacacccgccagcaaccgtggcgttctggccgcggcggcgaccggtctgagcgccttcattacggataaaggcggcgatgtcgatcgcatctttggcatcagcggtatcgattccgaactgctggccagcccgacactgagcctcgggctggtgaactattgccgcgtgatggaagaagcggcgcgccactccggctttgataacttcggtttgcattacggcaggcagttcaaaccgcagtcattagggttaattggctacatcggactgtgctcgccgacgctggagcaggcgctgcacaatgtggtgaacgcgtttccctggcaccagcacgatacgctgacgcggctggtggacaagggcgactgctggcggctcgattatcaggtgcgccacggggcgatcctggcacgccgtcaggatgcggagctgacgctcggcatgttcctcaacctgattcgccacgtggcgggcaaaaactgggcaccgcgcgaggtgcactttgaacatccgcgtccggagcagtggcacgagcactgcaaagtgtttgatgcgccggtctggttcgatcagccgtttaactcactgctgatcgcgaaacgcgacctgcagcgcgccatgccggagcaggatgcgatgctgctgatggtgatgcaggatgccattcgccgcctcaacagcagcgccagcgtgcagagcgtggtcgaacaggcgcgttcgcaggtcagcctgacgctcattcagggcgaaccggtactggaggagatcgccggcaaaatggggttgtcgagctggtcgctgcagcgacgcttgcgcgaagagggcatcagctttagcgcgctggtggataaggtgcgctgcgaaatggccacgcactacctgcagcaaagacagctgcccatctcggagatggcgctgctgctcggctattccgaggtcagcgcgttttcccgcgccttccgccgctggttcggcatcagcccgcgccagtggcgccaggatgggctggtgagtcaggccggtgcggcgcaaagccaaaccacgctggctggtcgcgctgcggcggaggcggtaagccgcgcgactgaccaataa

SEQ ID NO: 3753 - DNA, 933 bp, Glycine max
  Peptide Sequence Number=SeqID_95438
atggcgacggcagagcaccttatcagcaaccatctccccagcgtgaaacagcttcaatgctttcttgcggttgcgcacgagctgaactttcgccgggccgccgaacggctcagcatgactcagcctccgctaacccgacagattaagcgccttgaagccgtgctggagcagccattgtttagccgcagcacccatgacgtcagtctgacggacgctggccgggcgctggtaatcaaagcggagaagatccttcaggcgctgaatgaactcaagccaggcccgctttcttcagaaaagcgcctgcgtatcggcctcacccgcacgctgaattttgcactgattgcgcccattcaccagcaactgctgaaactggacgccgccgacgatgtggaaacgcccgatctgacgtctgcgcagttgctgcagtgtctggcaaaaaaccgcctcgacctggtactgacgggcgaaaaagcaaccggccacgaagataccgttcagtaccagtggatcggtcgtgagcctttgctggtagcaatgccggccagacatccggccagcctgaaagaaaaagtctcgctggaagcgatcggtgatttaccgctgttctggtttgccagaagcgcaaatccgtcattctacgataaatgtgaacgcttgttttcacagctccacaccccgcttaaaagagttaaagagcccgatgattcactggttatgctgacacacattgcccgaggaaaaggctttgccctgatgccgcagtcgaaatgtacctttcatcaggaaggattgtgctatcgcgcactggctgacgatgaagcgcaaaatctgcatatcgatatttatgccgccatccgactgaatgaaaaccggccagccgtgctgcatgcgcacgatatcgtgtgtcacgccggtcagttaagccaacactga

SEQ ID NO: 3754 - DNA, 2796 bp, Glycine max
  Peptide Sequence Number=SeqID_95439
atggcgcgcctggcggccagcagcggctgcatgggctatatctcagtgctggacggtgacgatgtgctggtgatgcgcatgtaccacggtcgcttctttacccagctggtgacgccgccgggtacacgggtgtcggttaccggcacgtcgaccggccgcgtgctgttagcgcagctgagcgatgacgaggtgcgcgcgcgcttcagcgataactggcaaaccgcgtcgatcaattcaccgctgaatatcgatgcactgtgcaaagagctggcgctgattcgtcagcagggctgggcactggcccgcaatgaaacgctgcctggcattagctcgcttgccgtagcggacaaccctaatttgatttcaaggcgtaatacttcgcgccacaccggggaaatagcaggggccatcattggggtacagctgatcacaactattggggtaacgcccaatacttccattatcggcgcgctatttgccatgctgctggcgcgcattccactgcagtggtttcgccgctaccgttcggttgaagtgcaaaaccttgcacagaccgccatctcttccgccaccttcggcgctgccaatagcctgctgatgccgattgccgtgccgtgggcgctgggtgagccgcagctggtgctgccgctgtttgttggcgtcagcgcggcaatgctgctggatgcgtggctgctgtatcgtctgttcgacacgcgcgtgttcccggccagcaatgcatggccaccgggcgtggcagcggcagaagcgattaaagccggtgataagggcggtcgccaggcgtggctgctggtggctggaatcgtgggcggcgtcgcgggctcaatgctgaaaatcccgatgtccgcctttggtacggcattcattggcaatatctgggcgctgactatgctcggcatcggcttcctgctgcgtgcctatgcgcaaccggttgctggtatcgatattaacgcgctgtacattccgcacggcgtaatggttggagccggtctggtggcgctgattcaggtggtgcaggtgattcgcagtcgccgtcacgacaacctcaacgtcagccgcagtgacaacgaagtcaaacgcgcgctcggcctgggaactgtcggctatatcgtgatctcggcactgctggcgctgggcggcggactgtggagcgaaatgggcctgccgatgctgctgctgtttattatctacgcggcctttgccgcctttgtgcatgagctgattgtcggcatcgccgccatgcactcgggctggttcccggccttcgcggtggcgctgatcaccctgatcctcggcatcctgctcggcttcccgccgctggcgttgtgcctgctgtgcggcttcaccgcggccaccggtccggccttcgctgatatgggctatgacctgaaggccggctttattctgcgcggtaacggggccgatgtgcagcaggagctgtggggccgccgcatccagctgatcgccgcgatgatcgctttcgtcatcgcaatcccggtggtgtggtatgcgcataatctattctttgtcgacaacctgctgccgccggtggcgcgcgtttacgccaaaaccattcaggccggcgcggagccgggcattgccggcagcctgctgatgtgggcgattccgggagcgattattcagctgatcggcgggcctaaacgccagctcggcgtgctgttagccaccggtctgttaatcaacaatgccgccgcaggctgggcggtgctggtcgggattgcgttacgtgtcctgatcctgcgcgtgtggggcgagcgtggacgttcaccgatggaggtgatggccgctggattcattgcgggcgacgcgctcgcctacgtggatggccagcaggtggtcgatctgttcgccgcctatcctggcgtgcaagccagctttaagcgcgtcagcgggccaaaagggcgcaccgattttgtgcgcatcgacattccgggcgcccagggcaaaagccggggcggcagcgcgccgacgctggggatcattggccgtctcggcggcatcggtgcgcgcccgacgcgcatcggcatggtgtccgacgccgacgatgcagaccaaaggcgacgtgctggccggcgacgtgatcgtaaccacgcatattgtccggatgcgccgacccggccgcacgagccggtggacttcatggattcgccgtgcgacgacatcaccatgaatgacaacgaagtggttgaaggcgtcgacgcgattctctctatcgataccactaaaggaaaccgcatcctcaaccataagggctatgcgctgtctcccacggtgaaagagggctacatcctgcgcgtgtcggaagatctgctgcgcatcatggagatgaccagcggtcagcctgcggtgacgttcccgatcactacgcaggacatcaccccttacggcaacggcgtgtatcaccttaacagcattctgcaaccgtccaccgccaccgatgtgccagtggtgggcgtcgcgatttgtgcgcaatccgtggtgcctggctgcggcaccggcgccagccatgaagtggacattgcggcgaccccacctgcgcagccggaaagcctgatgatgaaaccgtcgcttgtaaccttaaccattggccagtcaccgcgtagcgatattttgccgctgctgcaggagcatttgcccgccgacgccgtcgcgcatgccggtctgctggatggcctgacgctggctgaagtggagcagttatacgcgcctgcgccggccgataaagtgctggtttcgcgcatgagcagcggcgaacag

SEQ ID NO: 3755 - DNA, 444 bp, Glycine max
  Peptide Sequence Number=SeqID_95440
atgtcgatttgggtggatgccgatgcgtgtcccaatgtcatcaaagaggtgctgtatcgcgccgctgagcgcaccaaagtcaccgtgactttcgtcgctaaccagccgctgcgcgtaccgccgtcgccgtttctgaaaacgctgcaggtagcggccggctttgatgtggccgataacgagattgtgaaacgcgtacagccgggcgagctggtgattaccggcgatattccgctggcagcagaagtgctggagaaaggggcggcagcgctgaatccgcgcggggagcgctacagcagcgataccattcgccagcgtctgaccatgcgcgattttatggaaacgatgcgcgccagcggcattcagagcggcggcccgtcggcattaagcccacgagaccgccagcagtttgctaacgaattggataaatggttacgtcagcgttaa

SEQ ID NO: 3756 - DNA, 282 bp, Glycine max
  Peptide Sequence Number=SeqID_95441
atggcagcaggcctgctgctggctggcggtgcgggcgcggcggagaaaaccgcgcagcaggaaaaaatgacgctgtgtaatcagcatgcaggcgcgcaaaatctgaaaggcgatgcgcgtaaaagctttatgagcgaatgcctgaagaaagacagcaaaatgggcaatatgacgccgcagcagatgaaaatgaaaagctgtaatagcgaagcaggagagaaaaaactcagcggcgatgcgcgtaaaacctttatgagcagctgtctgaagaagagtgcttaa

SEQ ID NO: 3757 - DNA, 1890 bp, Glycine max
  Peptide Sequence Number=SeqID_95442
atggcgctgattccggtaaaaaccgtggtcaccgaacgccaggaaatcctgcgtaagccggagtggatgaagatcaagctgcctgcggattccagccgcattcagggcatcaaagcggcgatgcgtaaaaacggcctgcactcggtgtgtgaagaggcttcctgccctaacctcgccgaatgctttaaccacggcaccgccacctttatgatcctcggtgccatctgtacccgccgctgtccattctgcgatgtggcacacggtcggccaaacgcgccggacgccaacgagccgctgaagctggcacaaaccatcgccgatatggcgctgcgctatgtggtgatcacctcggtggaccgcgacgatctgcgtgacggcggtgcacagcactttgctgactgcatcagcgccatccgcgaaaaaagcccgagcattaaaattgaaacgctggtgccggacttccgcgggcgtatggatcgcgcgctggagatcctcacggctacgccgccggatgtgttcaaccataacctggaaaacgtaccgcgcgtctatcgtcaggtgcgtccgggcgctaactatgagtggtcgctgaagctgctggagcgttttaaagaggcgcatccggacgtgccaaccaaatccggtctgatggtcggtctcggggaaaccaatgtggaaatcatcgaggtgatgcgcgatctgcgtcgccacggtgtcaccatgctgaccctcggccagtacctgcagccaagccgtcaccacctgccggtacagcgttacgtcagcccggctgaatttgatgagatgaaagaggaagcgctggcgatgggctttacccacgccgcctgcggtcctttcgtccgctcgtcttatcacgctgatatgcaggcgaaaggcctggaaattatgcaatcatcctttcatatcgatgagctcgattttatgcgggcggcggatgtgtcaggtccatcctctggtagaccgcgaagcggcgcgtcgggcgaaagcctggatgcgctaaaagcgcgtaccacgcccatggatatcactaatccgttcgtgacgccccatgcgtcgtgcgaactggcgtttcttgcaaccgccatcagcatcgaccaccgctacgacgaaattcatctgcacctgccgcaaagcgcgcagcctgcgtctgcgcccgcgcccgcgcccgcactgccgttcaccgaactgcgcagcgtaacgccggatgaaacgccgttgctgccagcgctgctgccgctggagtcagcccagcaggccgccggcgagagcgtctggcatagcctgcctgaggttccggcgctcagcccggcgctgtcgctggtcagcgcgctgcctgcggcatggtatgcagcagaacaccagacgccccacccgtcgcctgtccccacgctcccagtccggcagccgctgagtctgccagaggtggctgtgctgcgcgacatacggcaacacgactatgcggtggattacgacgacagcggtgagccgaaaatgtttagcggcacgctggcggcgggcgctcaggtgcatatttatatcgataatgtgctgattgaagtggtaacgggcgacgcacagggtcactggcagttcgctcagcccgccgatttaagcgcggcacagcatgtattcaccgccgctattatcacgccaattgatgacagcgatctcagcgcgattgattgtgcactgatggaactggcgatgcagcaggatgatattgcgcccgctcttctgccgctgaccttcagcgaagcatggctggatgagtggcacagcgctgacagcacgctaaccgccagcggcgatcacggtggcaacctgccaggctgggatgaaccgctggaacatcacattgtctggcactaa

SEQ ID NO: 3758 - DNA, 105 bp, Glycine max
  Peptide Sequence Number=SeqID_95443
atggtacctttgacatcgattcaaggaggagggaatgatataggattattcaaggaggaagtgtttgacttgggtgggttcaacatagatggatcaatcacttaa

SEQ ID NO: 3759 - DNA, 132 bp, Glycine max
  Peptide Sequence Number=SeqID_95444
atggtagaaagggaaaaattcgatcatatagaagaaaggctaagggccattgaagaaggcggagactatccttttgccaacatggcagaactatgcctagtgcttgatgtcatcattcctccgaagttcaag

SEQ ID NO: 3760 - DNA, 285 bp, Glycine max
  Peptide Sequence Number=SeqID_95445
atgtgggctatcattgaccagtataaagagaagctaaatctagctgctagccgtgagcaaaggctagaggacaatcatgcaaaagtgtcagtcatgcaatgggaaagggaagtaagggagagagtgacaaattcattacacagagaagctatgatgtggatggataggttcgctttcacattgaatggaagtcaagagcttccaagactattagccaaagccaaggcaatggcggacgtgtactcggctcccgaggaagttcatgggcttttcgattattgttag

SEQ ID NO: 3761 - DNA, 510 bp, Glycine max
  Peptide Sequence Number=SeqID_95446
atggctctgaagaaattctccacgaagaggtctagaagagatgccacaggagaagggtccagtgtcgcccccgagtttgatagtcatcgtttccagagtgccgagcaccagcagcacttcgaggccatcaaaggatggtcattccacaaggagaggcgtgatcagctcagggaggatgagtatatggactttcaggaggagatagctcgtagacattggacaccactggtgactcacatggccaagtttgaccctgagatagtcctagagttctatgctaatgcttggcccacggaggagggagtgcgagacatgcgttcatgggtgagggccagttcctgggtgacccgcttgttttggaggaaggccagcagtgtgagttcagccagaggaggaactgggccgacgggttcgatgaggaagccattgcctagctgttgtgcacaccggggcaggatttcgcccagacagctgcagggaggtgggtgcggatcatgcgcaccagcatga

SEQ ID NO: 3762 - DNA, 333 bp, Glycine max
  Peptide Sequence Number=SeqID_95447
atgcagaaaagattcacacgcatagttaatcaccttgcctccttagaaaaaatctttcctaatgaagatttaattattaaagttttgggatgcttaagtaaggaatggcagcccaaggaacatgagatggaactccaacgactaaatcaaaatgaagaaacagacaagaggaaacgaagcataacactaaaagcctcctcatcaatgcaagaggaaaatgtagatgaagaatcagaagatgaagaagacttctcaatctttgtgaataagtttcacaaatttgtcaagaatagaagaatcgagaggcgtcaaaatttcaaccatggaaaatga

SEQ ID NO: 3763 - DNA, 201 bp, Glycine max
  Peptide Sequence Number=SeqID_95448
atgactctttatgcaaagaattctctcaagacatgtaaacaaaccaagaatggaatttttgttaatcaatcaaagtattgcaaggaattgattcatagatttgggatggagaatgctaagcatatggctacaccaatgagtactgcttgctatttggataaagatgaaattgatcagtcaatagatgttaagcaatattaa

SEQ ID NO: 3764 - DNA, 123 bp, Glycine max
  Peptide Sequence Number=SeqID_95449
atggggatcattttgatgtcgttctcgttggaacgcgtctggaatgcggggcaggccgatgaccgggcattaaccgttgcccgatcggtcccctctcccgcgcgcgggagagggttagggtga

SEQ ID NO: 3765 - DNA, 429 bp, Glycine max
  Peptide Sequence Number=SeqID_95450
atgcataaggcattgcgattaaatgctcctttaccctatccacacttagttgctttgttccttctacattttaacatccctcttgattttgaaccttatgttctaatcaagagatctttcttgatcggtgctgctatggttgcctcctttggttaccgcaaagagcgtgatggctctagggtaaaaaagggtgttcaaccaaatgatgatgaaggacactttccggttgaaggggactcttctctccttcagagtattttggacagatttgatggacttcaaacctatgttggtgagaggtttgactccttggaacgtcaagtggacacacgattcgaggagatgaactcaaggattgcaaaggttgaagaagatggcaccatcattcgcgactgccttgatttacctccaccaccaccatcagtttag

SEQ ID NO: 3766 - DNA, 291 bp, Glycine max
  Peptide Sequence Number=SeqID_95451
atgaagaactggatgcagaatttaaaacgggatgtctacctaggagcctacctgaatggtgctttgaaaggattggacgatacttcacaacctaaattcaaggctggtgctaggtggattgttgttaaatgtaatagacaaaaaggaagcacaaagtgtggctattacgtgatacactggatgtccactataatcttgggaagtttcaggaataattgggaaacggccattggaagcagagagattgaaggcgcttcgcatccagtggacacagtattatctcaaagttag

SEQ ID NO: 3767 - DNA, 798 bp, Glycine max
  Peptide Sequence Number=SeqID_95452
atggaagctttcgtcgccgcgatgcatggtgtagggcaggggcttgccgatgcgagaccagaggaagccgacgatgcggtggtggctgtcctcgagatcgcgcggatggccgggcgcgccggcccgttgcaggtaggcgggcgcggcatagacgcgcaattgcaggtcgccgacgcgccgcgccatcagggattggtcggtcagctcgccgccgcgcaccacgcagtcgacgttctcgccgatcacgtcgacgatgcggtcgctcacgcccatatcgagctggatgtccgggtagcgcgcatggaaggcgggcagggcgggcaccaggatcatgcgcgccagcggactgggcacgtcgacccgcagccggccgcgcggcacggacgcggcgacggagaggctggtctcggcgtcgtccatgtcggccagcaggcgcagcacgcgttcgtagtagaccgcgccgtcggcggtgacgttgaccttgcgcgtggtgcggttgagcaggcgcacgcgcaggcgggcctcgagctgctgcaccagctgggtgacgctggtcttgctcatgtgcagggtgtcggccgccttggtgaagctgccggtctccaccacgcgggcgaaggcctgcattgcgtcgaaacgatccatcgccactccagggatcaggggattgtttgcattttacaaacagtgatggacaggcttgcccgtttatcggcggccgcgccgtccgtacagtgcctgcatcatcaatacgggcttcaaggcccgggacaggagaatgagtatggcaacgcgtga

SEQ ID NO: 3768 - DNA, 579 bp, Glycine max
  Peptide Sequence Number=SeqID_95453
atggagaggagtatgattgatgctgccagtggtggagcccttggtgatatgactcctgctgaggctaggaatttgattgagaagatggcttccaactcccaacaattcagtgcaagaaattatgctattgtccttagaggagtccatgaggtggccacagattcatcttcatctgctaaaaataaaaagcttgagggaaaacttaatgccttggtcaacctagtaactcagcttgccatgaatcagaaatctgcatctgcacttgatgcaagggtctgtggtctatgttcttttgcagatcaccatagagatctctgtctttctttgcagcaatctggagtcaatgagcaacctgaagcttgtgctgcaaacatttacaatagaccccctcagcagcaaaaccaacaacaacagactaattatgatctttcaagcaacagatacaatccaggttggaggaatcatccaaatctaagatgggcaagtcctccacaacaacaacagcctgtccctcctttccagaatgttgctggtccaagcaagccatatgttcctccttcaatgcagcaacaacaatag

SEQ ID NO: 3769 - DNA, 329 bp, Glycine max
  Peptide Sequence Number=SeqID_95454
atgaagagatgcttatgcgatgcatgcatttacggacacgagagcccggaaaattatctcttcttacttgcgtattcggggacgcagtgccccatgtgtgcagttaagaagatgatatggaccttccggcttcccgtgacaaaagacgagataaccatacaacgtatgtgtgataacatgatgcagatacgcaaaaccgcaacagggggatatctatcatatgctgacaatagccgagaagtccgtggatctcctcaggggtggagtaggtgtccaccattgccttggccttggctagtagtcggggaagctcttgactccaattcaag

SEQ ID NO: 3770 - DNA, 527 bp, Glycine max
  Peptide Sequence Number=SeqID_95455
ccgatgccggcgtcgaccgggtagccgatgaagccgtcctcatccagtccggtcaggtcctgcgtggtccagcgcgccatctgccagtgcagggcggtcgcggtgagagcttcgcgtggcttgaaccagaccacggccaacgccgggcggccgctgtgcacgatgatctcgaccggatgccgccccagcggggcggtgtagtcggccagcgcaggcgcctcggcctgcaccagcggatcgcagaccaccacgtgcccgctgctgaccggcaggtgcccggcgaaggtgcggtgcagggccacagcggccagctgggtgtcgtccagctgggaggtgcgcaggttggccagatcgagatgggccatgggggctccgattgcagtgaaggccccaccgtgccggatgcgaagggcaggggcaaggtggtcttgggcaaatgcccttcacgtgcgagaatacgccgctgcccgggcgtaaccgggacccgattggagagatggccgagcggtttaaggcaccggtcttga

SEQ ID NO: 3771 - DNA, 375 bp, Glycine max
  Peptide Sequence Number=SeqID_95456
gtcacgattgcagaaggtggggtggtcgacaaaagcgaggcttttgctcctacgtatccttcatttgtgatgaccacattggcctctgcttgtcaatcgaacttggggtctctgaataacgaggtgcggataaccggaaggtgtttccgcatgctaccagagtcttgggtcttgatagaaaaaggtggggtggttgacaaaatgcggggcgagaaagtcgctagcgcacaagattttggttggcaatcaaagggagaggaccacttcgggtcgagggtttatggtaagttgggattttggctcaaggcttgtagaacggctggacatgatatatgtcaggatgttggtttggccaatggttcaggaaaaggagat

SEQ ID NO: 3772 - DNA, 633 bp, Glycine max
  Peptide Sequence Number=SeqID_95457
atgagtatgacatcctccactgcctcaagcagatcttccaaaatttacatccagactttcatagagatactatcattctaccatcaacaatgggcaccaaattacccagaatcggtccaaatgagatacaatggagcaacttaccaaatacaactccaacaacaccgaggcagattttttttggcagatggactcacagacttcatagcagatttaaagatctacgagtctatcatcatcaacttcttagcctgcgatgataactccatctttgatgtacacttcactcctccactcgatcaacagacatgtgccaaaccactacttcatttccgtcaacacatctggatagaagaaataactcaatgtatcctgggtgctcctcatccactagaaatcccattccatgcagccaaacatctgaatgaatatggtaatcacatgacaattttaagaaagcatagacctcctctacaatggaaggtggttaccctcgatgttggcattaaagataaaagcattgtccgaccatcgtataagttcctcaaggaaaatgactttcatcatggagacgaagtatcattctattaccgaccgcatgaaaaaatttgggagatcgtgattagaaaatag

SEQ ID NO: 3773 - DNA, 321 bp, Glycine max
  Peptide Sequence Number=SeqID_95458
atgactttagtctctgcatgctatcaggcattgagtcttacagatagcaaaagaatatttatatggataaccacttgggctatttctgcctgccccctaacctcacggcatttcgtttctaaacgaccatttagaggaaacactgggtccaacaaaaatagaagaaaatcactcaaagtgtatcaatctcacacaggcgaggatgggaattctcaccctgggtcaaggtttatggtgagtttggattttggctcaaggcttgtagaacggctggacatgatatatgtcagagtgttggtttggccagcggttccgggataa

SEQ ID NO: 3774 - DNA, 723 bp, Glycine max
  Peptide Sequence Number=SeqID_95459
atggttgcaatggtgtctatagtgcttggttctatccagacaaagtctaggaggaggtataaggggctcacacttgtcgtgtttgtgtcgcttgttcgacctatgcgagttggtccttgtgctaccttcccttttgtcacatttatgttcaacctatcgaacttcatttcaaaacctcaacatttcttccatctgaatgtaccattggctcgctctcgtaactcatccatgttgttagaaggtgaggaacacatgcaggtgctcctccgggtctgtggtcccatcatgacgctccaggttgagcagtttccaacccaagggcaggtcaaccaccacgattcgatctatgaaaggaagtcatcgagtcatccatccttcatgtcgatatgcatgcgaggtgttgttatcatccatggtattcttggtctgacaaggatgcgattccccttaggtgcactcattgattgtatgggcggagtgttcgtctccttgaaggaacccaacatgagcctctattggcggagagcatcgttgtccatcatggtcgtcagagggggatttcaattttctgggggtggctatcgcctaagaccgaatcgtgtactaaccataagtgtgggtggccgcgaggaaggttttactatggccccacaggtggactgtcgtcagaatgggctccataatctccagtgtcatacttgcaggtatccagagcaaaggtaa

SEQ ID NO: 3775 - DNA, 246 bp, Glycine max
  Peptide Sequence Number=SeqID_95460
atgtgtagcccatggacgagggagtcagagagaagcgctcctaggtgcggggccaatggatcccctttgatgaggataccatttgtcgcaacatgcccttttgcgggtgagcgaggcgaggctcacgggtgcgctttccaaaggaggaaagatgcgtggagtcgccaccaacgtttatttgtggaaaaaccgaacgaaaccggtcaaaataaaaattctaagttcgggagttatatttacgtttga

SEQ ID NO: 3776 - DNA, 201 bp, Glycine max
  Peptide Sequence Number=SeqID_95461
atgttacggaattttacggattgcgcattaacacttcctttcaactcccaacatgtcgcgatacttcacggattgcctaacgatgggtgtcaagtacctcgaagtggtcaagcgaaggtcgcatcccaccaaacagatggtctccagacgaaattagagtatgaaagttgcccctctttacttgtattttattggagataa

SEQ ID NO: 3777 - DNA, 234 bp, Glycine max
  Peptide Sequence Number=SeqID_95462
atggaagttgtgatcctgtttgaggtggagattccttctttaagaatcctagtagagtcgggattgggagaagcagagtgggcccaggcatgctttgaccaattaaatcctatcgagggaccgtttgtggtgaagaaggctttcttaggaggagcgttgttgcacatgaatatggatgatgaagagttgccttcgcctatgaattctgacatcgtcaagcgatattacgtgtaa

SEQ ID NO: 3778 - DNA, 189 bp, Glycine max
  Peptide Sequence Number=SeqID_95463
atggttatgcaatggctccgaagaagctttctgctaaaaatggctaggaaggccaccgcaggggagggatcccgtgcagccccacaagcggagattgagtttgaagaacatcgtttccaaagcgaggagcatcagtgccgtttcaaagcgattaaggattggtctttcctaaaaggtgggatcctctag

SEQ ID NO: 3779 - DNA, 372 bp, Glycine max
  Peptide Sequence Number=SeqID_95464
atggctaaggaagatcacgacgcgtctttgatcgatgatggtaatcctaaatgccagggacatcaagtcaacaagcctaatggcatcaatcaatctactgcattatctgtgccaatggctattgctctctctggcccacttcttcttggacaacctataatggtgaaaccttctgaagctgaaaagaaccttgttcaatctaatgcttctggtggagcagccagtgtaactggcccctatggagctgtggaccgaaaattgtatgtggggaatcttcacttcaacatgattgagagttctggccttgtttctaaacagtgcagttttgtggcatcggttaatgggaaagaaggttcttgcggtctcaaatga

SEQ ID NO: 3780 - DNA, 645 bp, Glycine max
  Peptide Sequence Number=SeqID_95465
atgggcgactatcttctccaactctgggggaagtcccacatcttcgttctcttcatcctctgtctgatccgtttcttgctcaaaatcgatggtcgggtcccagctaccacaagagcccttgaacaagaaaccaagaggactcgcaaggaagagcatggccatgaaaaatttcgtggagctttgtggggcagcaacagtgagctcaagcttcgaagggaagagaaaaaccaatcacgagcacatagcatggtcttgaaagaggagttagccgcttactcaaggtccaaaagaaacttgtctcagcgtttatgcgagacagagaccaacatgttagccatcgtcagcaagtaccaagaagaactaaatctagccacgacccatgagcataaagtggcggacgagtatgcccaagtgtacgcggaaaaggaggctagaggaagggtgatcgactcgttacatcaagaggcaacaatgtggatggaccgatttgctcttaccttgaacgggagtcaagaacttcctcgattgctagccaaggccaaagcgatggcggacacctactccgtccccgaggagatccacggacttctcagctattgtcagcatatgatagatttaatggcccatataattagaaacctctag

SEQ ID NO: 3781 - DNA, 450 bp, Glycine max
  Peptide Sequence Number=SeqID_95466
tcgtttggagtccccgttgcacctaccaaggtgattcggccacccatcacacgggattttattgagaagtactgcacccagagacaggctcagggggatgctccgcaggtcgcagacgtgccgccacctcatcaggctggccagactggatcgtttgatatggagtggtatttgcggcatttggttcgccagcaggcagccaaccaccaggcacatgtacagacccatgattgtctttaccagctgagcctcagcatgcagagtcagggcttcgcttctttttcatgccctactccagaccagttcagggcagaggtcgcatggcccggggagtggcctgaggcccaagcaggagaggcgccagaggctcccgacgatggagaggaggcccacgaggatgaagagatggccgatttgcttgacttcttgggagggagtggagctacatga

SEQ ID NO: 3782 - DNA, 441 bp, Glycine max
  Peptide Sequence Number=SeqID_95467
atgaccactcttacacagatatggatgacgttgctacttagcaacattccgtccagcgaccacaatgctggtctccccctgcggaagtatcagttgggatcgcgcccacaaggcacccagtggacccggaggagtccaacagggtcttggggtttccagctcaaattacgggcctctgtcagttctatagagtgcctatcacccccagcaaggtcatcaggccccttactaaccgagctttcatcaagaagtactgtgtccccaggcaggcacagggcgatacaccacaacagcccggggatggccgacagcgggcaaccgatgcaccgccgccacctccagagcccctcagctcatctacaaaggctggagcgttgcccacggccagttgacgaccgacgggcgaccaagtccaaagccaaagataagcaaaagtactaa

SEQ ID NO: 3783 - DNA, 111 bp, Glycine max
  Peptide Sequence Number=SeqID_95468
atgggctgccacacgatccagctcttagaggataccccaactggaattccaagggtatcatcagcatattggaggatgttcacttcttcttttaaagatcccacaaggtag

SEQ ID NO: 3784 - DNA, 713 bp, Glycine max
  Peptide Sequence Number=SeqID_95469
atggggacaaatcaaaacggaaaaagattctatcaagtcaagattaagggcctagatgttactagccttaaagagttgggacggttgatgggacccctccaaaggcaagcctactgcaaaatgtatggaaggattttagatttgaccacaacggagcggaagtacttggaaggcaagccaagggatatggcgaatcaagaggagtgggttccatttgcggatataatagctttgctaatctttggggttgtcctctttccaaacgtggacggtttggtggacctagccgcaattgatgctttccttgcatatcaccatagcaaggagagcccggtggtagctatcttggcggacttatttgatacatttgaccgaaggtgcgagaagaacagcgcacggattgtctgctgcttacccgctctttctgtgtggttggtttcgcacctattccaacaagacataaggcacccgtgtccgcttcaaagttatcactcgtgcatcgaaaagagaagagtagattgggaccaatacttggctgggataggaggcagcacaatcaactggtttccgcgatggaaggaaggaaaggagggagttctcttctcatgtggggactacccaaacgttccattgatagggatgaggggttgtattaattataatcccgcacttgccataagacagttagggtaccctatgaggggagcaccgac

SEQ ID NO: 3785 - DNA, 728 bp, Glycine max
  Peptide Sequence Number=SeqID_95470
ccataggtggtgatgtggcgacccacgcgcggcaacagctcgcgcactaccggatcgtcgatgcacatcaccgcgcggccgtagaacggcaggttgtgcaagaaattgataaacgtctgcttcaggttctcaaagtcgccctggtaggtgtccatgtggtcggcttcgatattggtgaccacggccaccatcggctgcagatgcaggaacgacgcatcgctctcatccgcttccgcgatcagataacggctggaccccagtcgcgcgtgggtgcccgccgccttcaccagcccgccgttgacaaaggtcgggtccaggcgggcttcggcgtaaatgctcgaaaccatcgccgtggtggtggttttgccgtgcgtgccggcgatagcgatgccgtggcgaaaacgcatcagctccgccagcatctctgcgcggcggatcaccgggatgcgcgcttcacgggcggcgacgatctccgggttgtcggcggagatggcggtagacaccaccaccacgctcgcatccagcacgttttccggacggtgattgaagtaaatcgtcgccccgagcgcgctcaactgttgggtgaccggattcggcgccaggtcggagccgctgatctgatacccttcgtttgccaacacttcggcgataccacccatgccggcaccaccgatgccgacaaagtgaatgtgccggacgcgacgcatctcgggcacgatagtacgtag

SEQ ID NO: 3786 - DNA, 255 bp, Glycine max
  Peptide Sequence Number=SeqID_95471
atgatgacattcaagaatgagttcaagattgagtcaagaacactacaaggatcaagagcaaatttgatttcaagaatcaagaaccaagattcaagattcaaagattcaagaataatcaagatcaagattcaagactcagagattcaagaatcaagagaagacttaatcaagataagtattaaaaagtttttcaaaacattgagtagcacaagaaaaattcaaaatgaagagtcacatctgttgatgtgtaattga

SEQ ID NO: 3787 - DNA, 509 bp, Glycine max
  Peptide Sequence Number=SeqID_95472
gtcgactctagaggatccccaccgggacgtggcggctgacggcaacgttagggagtccggagacgtcggcgggggccccggaaagagttatcttttctgtttaacagcctgcccaccctggaaacggctcagccggaggaccgagtgcctcccacgcccggtcgtactcataaccgcatcaggtctccaaggtgaacagcctctggtcgatggaacaattcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgcgaaaccacagccaagggaacgggcttggcggaatcagcggggaaagaagaccctgttgagcttgactctagtcggcttcggccggtcgatccgggcggaagacttgtcaggtggggagttggtgggcggccatctgtaaagaacgcag

SEQ ID NO: 3788 - DNA, 582 bp, Glycine max
  Peptide Sequence Number=SeqID_95473
atggatccattaagtgggagtcgtttcctctacactccatcagaaattgaagttcctagtggaagggcatttggtcatcgtatcgggcgaggaagacatcttggtgaattgcccatcctctatgccatatgtggaggctggagaggagtcattagaaaccgctttctagtctttcaaggtgtaatagtggcccgggtaatgttggggaatggctacgagcccggaatgggtttaggcaaggacaacggcggcataactagcctgataagcgccaaaggaaatcgtgtgaagtttgggttaggctacaaacccacacaggcagatataaggaaaagcattgcgggaaggaaaagcggaggtcaaggctcgcgattaagacaagaagacgaaggaagcccgccctgccacataagtaggagctttataagcacgggtctaagggatgaaggccaagtcgttgcaatatgcaaagatgatcctccgagtggttcggatttggtacgaccatgccctcctgatttccaactaggaaattggcgagtagaggagcgcccaggcatttacacgataagcataatgtaa

SEQ ID NO: 3789 - DNA, 939 bp, Glycine max
  Peptide Sequence Number=SeqID_95474
gtcactagtttacgagaagttgggacaattaatggggtcaacttcaacggcaagccttccgcaaagcctatggacttccagctagtgccgactgtgaaagagtttgaagaaatcctgggatgcccactgggaggaaggaagccatatcttttctctgggttctatccctccacgacaagagttgccaaggtagtgaaaacctcagcacaagagttggaccgtgtaaagcaaaacagaaatggagtagtcggagtaccaaggaagtgtttggaggaaaagggcaaaggccttggcaaaatcaaggcgaatgggcttattttattgacatcttggcgctttttgatctttggagttgtcctctttccgaatatggaagggttggtggacctagcagtgatcgacgcttttctcgcctatcataaccacaaagaaagcccggtcgtcgccattttggccatgtatgacacgttcaaccggggatgtaaaaagagtaacgcaagaattgtttgttgtgcactggctctctatgtgtggttagtttcacacctttttctccaagaaggtaggcccgtctacccgctacaaggtcaccgctcgtgcgtcgaaaaaggaaaggcgaattgggaccaactcttggctagcatggaggggcgtctgttaattggatccctcgctagaaggaaggaagaatcaggattgtatcttcatgcgaaggatgacaaagagcttaggggaagcagtaatgggatcatcggcggctatcataagtggctgagagcccgtacacaaggatttgattggctcccaaatctaaagactgtgagagacgatgaggttaaagcttcggaagaaagtgatgaggtacaagccctaaaggcagagcttgaaagagcccgggtagtcgaagaggagttcaagtccatagccatcaaagtctga

SEQ ID NO: 3790 - DNA, 360 bp, Glycine max
  Peptide Sequence Number=SeqID_95475
atgaactgcgggtatgccgcaggcgagcacggcgccaggccgagcgtggtcagaatgggcatggcgtcctccgtgttgccgttgcagggccatcttaggccagcagctcaccacgtgaagaagggctggcggcggctaaagggcgcgaagcaggcgcaggccataggccgggctttcagcatcccagcgccgcacgacctgcgctggcagcagcaacgcttcgaagctgtcgtcggtgtacttgtggctgtattcgacagcggatcaaggcccgatgctgctgcagaagtggacgcgccatccacgcgctggcagcgctggctgaccagatcggcgatgcgcagccgcgcgatgctgtag

SEQ ID NO: 3791 - DNA, 591 bp, Glycine max
  Peptide Sequence Number=SeqID_95476
atgacaagcagagaccaagtttggtcattctgcacccaagatacgcggagataccttacggttatccgcacccttttgtcatccagaggcggcgggcccgatgacaagcagagaccaagtttggtcattctgcacccaagatacgcggagataccttacgatacgcggagataccttacggttatccgcacccttttgtcatccagaggcggcgggcccgatgacaagcagagaccaagtttggtcattctgcacccaagatacgcggagataccttatggttattcgcacccattcttttgctatctgctgacacagtcttctgcaccttttgttcctccggggacaacaaagtcatttacatgtggaaatttcatggtcacccgcgactctcgtcagccgagaggagcgaaattagtgtcatacgctgattttcggggacctttgtttgatgacatgcgaccattctttggtccttgtgaggtgcttggcatccatcatcaggcagtttgtgaaatcctaggaacgacaagtcacagtcacccgcgactctcgtcaaccgagaggagcgaaattagtgtcatacactga

SEQ ID NO: 3792 - DNA, 525 bp, Glycine max
  Peptide Sequence Number=SeqID_95477
atggagagaagtatgatatatgcttccagtggtggagcccttggagacatgacccctgttgaagccagaaatttaattgagaagatggcttcaaactcccagcaatttagttccagaagtgatgctattgtcattagaggagtgcatgaagtagccacgaattcatcttcatcaagtgagaataagaagcttgaaggtaaactagatgccttggttaacctggtaacccaactggccatgaataaaaaatctgcacctgtcgccagactctgtggtttatgctcctctaccgaccaccacacagacctttgcccttctgtgcaacaatctgaagcaattgaacagcttgaagcttatgctgcaaacatctacaacagaacaattatgacctctctagcaacaggtacaatcccgggtggaggaatcatcccaaccttagatggtcgaatccttcacaacaacagcaacaacaaccttattttcaaaatgctgttggcccaagcagaccatgcgttcctccactaa

SEQ ID NO: 3793 - DNA, 282 bp, Glycine max
  Peptide Sequence Number=SeqID_95478
atgttcctcgtattcaacagtgctttgaaaggacatgatgatactccacaacctaaatccaaggctggtgctaggtggatttttgttcagtgtaatagacaaaaaggaagcactgagtgcagctattacgtcaagcactggatgcccacgataatcttaggaactttcaggaataattgggaaacgtattttaacgatgttagaccattggaagcaaagaggttgaaggcgcttcgcattcagtgggcacaattttctctcaaagttacaaatcaaagttag

SEQ ID NO: 3794 - DNA, 258 bp, Glycine max
  Peptide Sequence Number=SeqID_95479
gcggccaaccaccgggggcaggtgcagatacatgagtgtctctaccagctcagcctcagtcagcagggccagggtttcattccttttgcgtgccctactccagatcagtttagggctgaggtcgcatggcccgaagattggcccgaggcccaggcaggggaggcacctgcagaagctccgagcgatgtagaggaggcctgcatggatgaggagatgacagatttgctcggtttcttgggagggagcagagccacatga

SEQ ID NO: 3795 - DNA, 291 bp, Glycine max
  Peptide Sequence Number=SeqID_95480
atgtatgcttatgtactagagacttccagtaaaattttggagtcgatccaacggttaacgaattggatcgaaggaattgttactggggtctttaaagttttctgcctttgccctgttttcttggttgtgcttgggaggattgatggggacccggtgttgagagaaacgaggatatgggctacatgggagtacgtgagctcagatggaggtgggcaacaggggatggtgggtttatgcgcgctttgtggatgtggaaaacttgttgtgcaccatcgcccgaccgccacctag

SEQ ID NO: 3796 - DNA, 201 bp, Glycine max
  Peptide Sequence Number=SeqID_95481
atggggatcgcacccacaagacacccagtggacccggaaaagtccaacagggccctggggtttccagctctgttctacagagtacctgtaacctccagcaagggcatcaggccccctactgatcaagctttcatcaagaagtactgcgtccctaggcaggcgcagggcgaaacaccacagcagcattgggatggccggtag

SEQ ID NO: 3797 - DNA, 417 bp, Glycine max
  Peptide Sequence Number=SeqID_95482
atgtttggtgaaggaaccgattgggaaaataacaaaaaaccgtattttcccctcaccggaggcttcgtacttgataacggaggacgcatgaacagtgctaggcaatcaattcatggggctccgaataagatggtggaggatgcacgaacagcgctaggcaatcaattccgccaggcaatcaactcatgggactccggactcgatggtggaggatgcatgaatggcaatcaattcatggggctccgaacaagatttgatggtggaggatacacgaacagcgctaggcaatcaattcgtggggctccggactcgatggtggaggatgcacgaatggcaatcaattcatggggctccgaacaagatttgatggtggaggatgcacgaacagcgctaggcaatcaattcgtggggctctag

SEQ ID NO: 3798 - DNA, 150 bp, Glycine max
  Peptide Sequence Number=SeqID_95483
atggtggagttgagggaaggaaaaagcagacgaaggattaagggcaaaaaaagggagaatgaagaagaagaatcacaagacaagagtgtgttggacgtggaatggaaaaggaagggaagtgaaggaaccctttctgagttaatttattaa

SEQ ID NO: 3799 - DNA, 1205 bp, Glycine max
  Peptide Sequence Number=SeqID_95484
atggataaggcagagaaagctgtgcagaagagctactttgatgtattgggtttgtgctgttcctcggaggttcctcttattgaaaacatcttgaaacctctcgaaggaatcaaagaagtttcagtcatcgttccatcacgaactgtcattgttgtccatgacactcttgtcatttcgcaacttcaaattgtgaaggcactgaatcaagcaaggctagaagcaaatatcagagtgtatggggacgaaaagcaccaaaagagatggccaagcccttactcaattgcctctggagcggttgctgtgggtgcctacccaatcatcttaaaggccattgtctccattcggaaccttaggctggacatcaacattcttatgcttatagcagttattgggacaattgttatgaatgattatttggaagcaggcaccattgttttcctcttctcaattgcagaatggctagagtcaagggcaagtcataaggcaaatgcagtaatgtcatcgttgatgaacataacccctcaaaaagcagtcatagctgaaacaggagaggttgtggacgctgatgaggtgaaaatagacactgttttagcagttaaagcaggcgaggtgatacccattgatggagttgttttagatggaacctgtgaagttgatgagaaaactttgactggggaatcattccctgtggcaaaacaaaaggattctactgtatgggctggcaccatcaatttaaatggttatattagtgtgaaaactactgcactagctgaggattgtgtggtggctaaaatggccaagcttgttgaagaagctcaaaacagcaaaaccagcattcagagattgattgacaagtttgccaagttttataccccaggcgttgtaatcatatcagctcttgtagcggtgattccacttgcgttaaaacaacataatgagaaacattggcttcattttgcactggttgttttagtaagtgcatgtccatgtgcactcatcctttcaacgccagttgcaactttttgtgcttactccaaagcagccacatcaggtcttctcatcaaagggggtgatcatcttgaaacacttgcaaaaattaaggtcatggcctttgacaaaacgggtaccataacgaagggtgaatttgtggtcacacattttcaatctctttcagatgacattgatttgaacacattggcttactg

SEQ ID NO: 3800 - DNA, 924 bp, Glycine max
  Peptide Sequence Number=SeqID_95485
atggcggaagttaacactctggtggtgcggaagccctgttttggtcttccaaccggttgccctcaatgcctatctgcttacatctatctcaaattcgctcaatttccattccaattggacttccacctcaacaaccctcattctgatcaaatcccttactttgaagttggtgactatgtggcttataacaatgagaaagaggggattattgagtgtttgaagaaagatgttggggttgttgatttggatagtggggtttcttcactccctgagtggatttcaactaaagcaattctcaccacttggcttgctgatgcacttacctatgaactctggctgggatgtgaaggctcctctgcttatagtatctattaccctgatcttccatggccattggggaagattctctcttggaagaaagctcattgggtgaagctgaaacatgggataactaatgacaatgctgaggtgaagaaagaagagatttatgagagagcaaagtctgcatatgatgccttgtcaagttgcttaggtgaacagaattacttatttgagaacagagctattattgacttcaacctcctggtgatgtattcatatgctttatttggtttatgcaggccatcaagcttggatgctatttttcttgcacatggactagttgttcttcatgctttacctgaatcttcaatgttgcgaatcaagttttcagagcatgctcatttagtcagatatgtgcaacaatgcaaaacagaatttatagaagcagctccatctccttcctctgccccacgatttcatactggtgcatcatcgtctgcttctaaaagtcattcaattgttgtgttcctcacacttatgacttcatttgatgatgctgaagtggagttagatgatgatggtggttatgatttcgatgaatga

SEQ ID NO: 3801 - DNA, 324 bp, Glycine max
  Peptide Sequence Number=SeqID_95486
atgccgggttcgaacaagtttttggcgccattgccagggaacttctttctatttggaaaatctcccacaggaaatttagttcatctggacttggagattgaagctacgttaagaaggaacagagccaagaggagaagaaaattactgcaagacaggacagtagcttccattctagaggaagaagctcattttttttattctacatcatctgactcaccatcatcaagggaatccgtgacatatttaccagaagccgttatcatggctgataaacaccagcaaagggttacccttgaagactactcaagcagttcaataccataa

SEQ ID NO: 3802 - DNA, 143 bp, Glycine max
  Peptide Sequence Number=SeqID_95487
atggtgggtgtcccaaacgttcatggaggagctttgggtgatgtggcaacactgcaaacccaagaaagattaggcttgaggatagtaaagaaccatgagattcatgtcctacggccaatcgtccgacccgtatcacggttcct

SEQ ID NO: 3803 - DNA, 195 bp, Glycine max
  Peptide Sequence Number=SeqID_95488
atggaaaaaggggaggaggttgctgcccagctcgcccaggcgagctgggttgcttccttcagaagcaatccagcttcgaaaaatactttgggttatgggaattttacgaaagcattacgggtgtcccggaagcccatttttcaacaacacaggggaggtggttgccacctagctcgcccaggtgagctcagctag

SEQ ID NO: 3804 - DNA, 345 bp, Glycine max
  Peptide Sequence Number=SeqID_95489
ttacacacactccacacacgcacttcttcctctctccatttctctaactctgagcatgcaattggcattggtctcattgcattctctgtggaaatgatgaacaaggccaaaggaaaaggcaaggaggctgccgaaaaaggtttttccggcaagcgcaagggcgccttcgacgatgacaagaccggcggcggccgcaagagaaacaagcaaggtgtccttcactttttttctgacgacgaattaaatgccgcgccaagaaggatggacatgccagataagggccagagtaacagcccacgtgtcgtccctaaagaggaaatgttggcccaaaaccagcttttttga

SEQ ID NO: 3805 - DNA, 429 bp, Glycine max
  Peptide Sequence Number=SeqID_95490
ggtccagcggctggaagagcaccgcacgtcgcgtggtgtccggtgcgcccccggcggcccttgaaaatccggaggaccgagtgcctcccacgcccggtcgtactcataaccgcatcaggtctccaaggtgaacagcctctggtcgatggaacaattcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 3806 - DNA, 342 bp, Glycine max
  Peptide Sequence Number=SeqID_95491
atggtagccataaccctagccaaggttcatcaacctccatttctccgagaatacgactcgaacgcaatgtgtgcttgtcatggagaagccccggggcgttccattgagcattgtagggctctgaagcgtaaggtgcaagttacaatgttaaatgaaatggataaagttgatatatttgtccctcatcctctcacaaacgcatctttgcttattcaactttcactggaatatgggtggaagccattggtccgtttgctcaagcgacctgcgctcctgagtgttgacttccaagaccgttcaattagagattactcgtcttgcacgttggtgggggtgccgtaa

SEQ ID NO: 3807 - DNA, 339 bp, Glycine max
  Peptide Sequence Number=SeqID_95492
atggctctgaggtttccaactctatttacgagcctctgtcagtcctacaggatgcccgtcccccaagcaaggtcatgccatcgtgacatagagtgcccgtcacccccagcaaagtcattaggccccctactaaccgagcttttatcaagaagtactgcgcccccaggcaggcgtagggcgagacaccacaacagcctggggatggccggcagcaaacaacggacgcaccaccgccacctccagagccccttagctcatctacaaaggctggagcgttgcctacgacccatggctgaccagcaggcgaccaagtccaaagccaaagtactaggtccgtga

SEQ ID NO: 3808 - DNA, 900 bp, Glycine max
  Peptide Sequence Number=SeqID_95493
atggcaattccattcaagacaaaagatgtcaacgaggaagtaacctctaaggacattaaaagcctaatggaacaggcaaattataccaataaatacttacaagctttaggagaaaccattaaaactaaagtagttcctaaacaaaaatcaattgagggagcttcgccaagtgtccccattgaaattgaaaaacctttattcaaacctttcaaagttagtgagaaggctaaacgaaaaattagggaacttagaaaaactaaatccttaactgagggcgtaggtgacaatcatagtgaattactaaacaagattggtagtttacttaaggtcatttcagatactccccaagcctcggaaaatacttccaaaatggtaacaagaagtacctccaaattaattaatgttattaatgaagatagtgaccaaaactcagataacacaactgagataggatcagtgtcagaaaagaatataaatccaattaattccaaacactggaaaacaccctccaaattatattatcgacgtccaactgcccctgaccttctattagaagaaagaggtgaaaacaattttaaaagttttagtgcaaataacatctacgaatggaacatagatgcacaaacggagtataacatcatgaatacactccaacatatgaccatggtagctacagcttaccaaacctcccatgaatgtttagaagaaacctttatagatatcttagtggcaggattttctggacaactgaaaggatgcgcagttaagacggatctcaatggaaaagtcattactaattacgatgataaagagattcctgacgctgttaacacattaatttttacaatagcccaacatttcattggagacccatccttgtggaaagataggtctgcataa

SEQ ID NO: 3809 - DNA, 1341 bp, Glycine max
  Peptide Sequence Number=SeqID_95494
atgacgaagaaaagcactgaaacgtctcgagctgatgtgagacccaagaaacccactggggtgaagatccaagaagggaaacaagaagagaaggaagaagaggaaagaccactcataagaaaaagaaagttaccttcgacttcgaccaagtctgctgaacaaacagagacaggcaattctcaggctcaaatgcctaagaagaaaaagaaaggtggtgagccatccaagaagaaaaagaaaaagaccaagtcttcaaaagaacaaggtgacaatcaacctgttgacgtccaaccaccttcgaccgatattgacggcaccgaagtagaagctgctccttctattgctgagatgggcaaccctgtcgagcaaccgaacttatcacaagaacaacctgccgtcgaggtgcaacaaaatgtttctgcagaagaaataccctcatgtgcgcgaacctctcccgctcctgaggcggatgcagtgaatgttgaggaatggggtgaaggtcaaggcattggatccagtcgtcctcatggttgggcagaggtcgatgaccctcatgagccgaaccagtcagataataccactcctcatgaatcgagtcagaaaagttcatctgaagaaaacttttttgatgaagacgccataaaagaggctgaagctggaggttcagacatttacccggtgtcttcaacatctaagctttccgctagcatagggatcgcagaagatacattcattcaaatgcaaaacgaagaccctgctgcagcccttcgactcctgctgaacacaagtcaagccaacacctcaagtgagaaaattcctggtgcttcgaccccatctgatgctgaaataaactcttcagtacgccaagattctctgctcttgaagttatcaacggaatacgcactgaaagatgtgcttaaatccattgaagagaacccctctgctgcctttgggcacctgaactttttgaagaaattgcacaacccccttacctctgatgagactctaggcaaagttatccaaatcgaggccatcattgaccagtttgcaagtgctgtgcagaaaaaacgcgaaaatggcacaagactagatgcccagaaacaggcacatacccttctgctcgagaaagcccgagctgctcaacatgaagtcgaacgtctcaccaaagaggcgaaagaagggtcttctgagatcaaagactgtgatgataacatctcctcctgggaggcaactattatggatctgctgtttcatgtcgatgatctaaggcagaaaattgtgacagagcaggccaaacgcaaggaactccaagagaaggctgctaactcgatccagaaactg

SEQ ID NO: 3810 - DNA, 327 bp, Glycine max
  Peptide Sequence Number=SeqID_95495
atgcttccatttgatttccggtgtgtcacggaaacttacggattgtgcatcaatattttttggttttccggcatgtcttggaatttcacaaattgcctaatgatggatgccaagcacctcacaaggaccaaagaaaggtcgcatgtcatcaagcaaaggtccccggacgaaattaggtttagggctaaggtcgcatggcccggagattggcccgaggcccaggcaggggaggcgcctgcagaggctcccggcgatgtagaggaggcccgcatggatgaggagatgacatatttgctcggtttcttaggagggagcggagccacatga

SEQ ID NO: 3811 - DNA, 357 bp, Glycine max
  Peptide Sequence Number=SeqID_95496
atgcagtcccagttgcaatcacagatccaatcacagggacttgcactgacttcggagcctgaggttggtccctcagcagctcgtgtcagcacaaaggggagttgtgttgatccctcagcgaccaatccaaacacaggtgactcagacaaatgtgggttgtacatcgaagaaaatccttcccacctggttgccctaggaagagtttatgagggatctatagcagttcacaacatccctttgttgcatggccaaatgaaggttggtgttgaggaggttaaagatgcaaaggctcccgttcctatacccactgatgaggctattttagtgggacagacacttaacatcttccttgcttga

SEQ ID NO: 3812 - DNA, 410 bp, Glycine max
  Peptide Sequence Number=SeqID_95497
atgaaagataagagggatgaggaagaaaaactagaaaaacaaaagaaaaataaggatagtaaggtcttgtcttcaaaggccaaggggaaggaaaaagagggaaatgattcctccaagaagattgttaagaaggaaaatcattttttcaacaaaagggaaacataccttagcactaccatacctcttgagcttgaggttattcctcaagtaaaggagttgttggataagggtttggttcataagagcttaactccttgtgctttgttggtgccaaaaataggaattatgaggcaccaaatccctatgataggtggtatgatgaatgtgttgagtggtgcaaccctcttttgtaaaatcacccatgcatccaacatcttcatgattcacatacatagggactcattaggtag

SEQ ID NO: 3813 - DNA, 396 bp, Glycine max
  Peptide Sequence Number=SeqID_95498
atggactcgggaaggttccagattagtataccaggtgatggctaccccagtaagactttcctggaagaaatgcgtcaacaatttttcatctttcgagtaagctcccatcttccaacagtacatcttcagatggctcttgggacaaatagccaccttgtacttgtcaaagtccggcaccttaaacttgggaggtgtcataccctaatttcgtcaagggaccatctgtttgttgggatgcgaccctcgtttgaccactttgaggggagtgcaaatagcaaccaggctcacttgggccttccaggaagttctccagaaggcggtgccttctggaggaagcaacctagctcgcttgggcgagctaggtggcaagctcctccctcattttcctataaatag

SEQ ID NO: 3814 - DNA, 870 bp, Glycine max
  Peptide Sequence Number=SeqID_95499
atgagtttttctaccatttcagtgattggccttgggtacattggtctgccaaccgctgccgcatttgcttcccggcaacggcgggtggttggcgtggacatcaatcaacacgccgttgagaccattaaccgtggtgagattcatatcgtcgagccggatttagcgagcgtcgtaaaaacggcggttgaacagggatatttaagcgccaccaccgtgccggtggagtctgacgcctacctgattgccgtcccgacgccgtttaaaggcgggcatgagccagatatggcctttgttgaatccgccgctaaatctattgccccgaccctgaagaaaggggcgttagtgatcctggaatccacctcgccggtcggttcgactgaacagatggccgagtggctggcggcgatgcgccccgatctcagcttcccacagcaggtgggcgaggcggccgacgttaatgtcgcctactgtccggagcgcgtgctgccggggcaggtgatggttgagctcatcaaaaacgaccgcgttattggcggcatgtcgccggtctgctcggcgcgtgccagtgagctgtataaaattttccttgaaggcgaatgcgtagtgactaactcgcgcactgcggaaatgtgcaagctgacggaaaacagcttccgcgacgtcaacatcgcctttgctaacgaactatcgctgatttgcgccgaccaggggatcaacgtctgggaactgatccgcttggcgaaccgccatccgcgcgtcaatattctgcagccgggtccgggcgtcggtggccactgtatcgccgtcgacccgtggtttatcgtggcgcaaaacccgcagcaggcgcgtctgattcgcaccgcgcgcgag

SEQ ID NO: 3815 - DNA, 444 bp, Glycine max
  Peptide Sequence Number=SeqID_95500
atggctctagaagacttggagcaactaatgcaaaagatcaggggccagttggaggagtcgatcacagaaaaaggactcgcactgcctccggagcctgaggttggtccttcagttgcttgtgtcagcacaaaagagagttgtgttgatctctcagggaacgatccagacacgagtgactcagagatatacgggttgtacgtcgaagaaaattctccccgcctggttgtcataagaaaactttatgaggggccaacaaccgtttacaacatccctttgcaccatgatcaagtcaaggttggtgttgaggaagttagagatgcagatgctcccattcctgtacccactgaagaggttcagttagaggggcagacacttaacacctttgttgcttgtccaacacatcttgtcaagcatttatcagaacatgtatttcactgtcattaa

SEQ ID NO: 3816 - DNA, 171 bp, Glycine max
  Peptide Sequence Number=SeqID_95501
atgagtgttgagatcaaaagtgaatccacagataagagcttcaaggtcaatggacaccggctgaaaccattcctcacaaatccctccttagtagacctcacaaatccctccttagtagatgtagtggtggatgagacctccttacttcaccctacctctcttccgccatga

SEQ ID NO: 3817 - DNA, 333 bp, Glycine max
  Peptide Sequence Number=SeqID_95502
atgaccggacacgattggccacggattttgtttcctacttgcaggtacatagggacggatgcaagtggggatagggtcacgaccgaccgatcgttgccccttcccggcgctaaacaagcagagaacatcgctgcaaggttagctcgcctgggcgagcaacccctgcacccaaattataaaaacgagggaggggaatgttttggcatccaaaaacttccccccccccccccctcattcaaaagaaagaacacgaaggcttgcggttcttcctcaagccactttcggttgccttttgctttcatttttggtgttattattcactccaacaagtaa

SEQ ID NO: 3818 - DNA, 366 bp, Glycine max
  Peptide Sequence Number=SeqID_95503
atgacatttctaggagaaactagcagtcagacgattgtcaactcaaggttggctttcatttatccaaatggatcgattattcacaatgatactggggtttacttccaaacttcaactccggtgcccattcgagtaccaaattggtgtgattttgcaagcctaaaaaccagaatacacaatacccttcagctatccgacaaacaatttttgaatgaaattcactaccggaagccattcaccgatacaggaaaaaatcctaagaaatttcaaattccttcaacatgtaccatcgatgaactgaagaatttaatcaagaaagttgcacctaaagggattccccctcttggaattcacaaatcacaaacg

SEQ ID NO: 3819 - DNA, 1098 bp, Glycine max
  Peptide Sequence Number=SeqID_95504
cgccctacagtacttgcttatgctttcactttggcctgtattgcattgccccttcatcacatcatcgacaacgttcactcaaatctgcgagggaataaatgttcattcacttcaggaacctcttctgattctgaattagatggaaaccaacacaaaggtgacaactttaccgtgccatacctcatcaactcatgtggggtgtccccaaaacttgctaggaaactctccaaaaaggtcaatttgaaaaccccaaatggcccaaattctgttctggatcttctcaacaactacgggtttgacaaaacccatcttgcaaagcttgtagagaaacatcccatggtgcttgttgctaacgcagagaacacccttttgcctaaactcaagtttttccgttctattggggtttccaacactgacatgcctaagatcctactttgtaaccatgtattattggtgagtagcttggaaaattacctcatcccacgttacgagatcctaaggagtgtacttcgtgacgatcaggaagttgttagagctttgaaaaacgccccatttggttttacgtatggtagctttataaacagcttggttccaaacatcaaggttttgaggcaatctggtgtgccccaagcttccgtgtcttacctgatgatccactctggggctgtagtctactccaaacattcaagatttgtggaggctgtcaacactgctaaggaaattgggtttaatcctttgagaataagttttattaatgctattgaaatgcatctaagtaggagcaaagcagtgcgagaatcaaggtttgaggtttatgagaagtggggttggaatggcgaaatggctcttcaagtatttcgaaagtttccctatgttatgaagttgcccgaggagacatttaccaaaaaaatgagtttcctagtgaaagatatgggttggttatcagaagatattgctgaatatcctcaggtgttagcgtacaacttggagaagaggattatccctagattctcgaaatttgtcatcaattatcagaaagatttgcctttcttgccagatttctacaacagtttgactaatcaacagaatgtagtatag

SEQ ID NO: 3820 - DNA, 327 bp, Glycine max
  Peptide Sequence Number=SeqID_95505
atgactaaggggctgtggtgggaatccatgagatggatccggggtataggagctcttccaactgatccggctagccattttattcaattctgtgatgggtttgctgcttcgagtaaccacagtaggcggggcatgtggtggattgctctatctattacaatatggcagcataggaactctctcctgtttcaaggcactctttttgaaccgcagaaagtcttggaggaggcattatttttagtttggtcttggctaaaagttggagacaaaggtttcaatacatcttataaccactggtctaccaatcttgtggaggcctttggttaa

SEQ ID NO: 3821 - DNA, 541 bp, Glycine max
  Peptide Sequence Number=SeqID_95506
atggcggttttccgtggcggaatttcgaaaaaacgccaccgaatagcggtggcgttgcgggtttgggatggcggcgccatggcggccgccatagccatggcggtcgtggtggggtggcggaaatggcggaaatggcggatttcgtggcctacccacgaacgaaccgcacgcgacttctacagcttacccagccgcacgcacgagaaccgccgtgacgagcctacctgcagccgcgacgacaccacccaacagcctacctgcagccgcgacaccacccagccgccgccgcgacaccaccccctgcagcacgcacgaacggcggcgacgagcgaagaagaagaccccggcaacgcagtgaacgcacgaagaagaagaagacaggaagaagacgcgggaggaataacccgagccaaacaacacctgattgggaagtcgggcaacgttgcagcttgcaagaaaactcccccaaatgtaatcgaagagttgaaggaatatatggctacaaaaaaaagtgggaccacttacagtacttctggcagtg

SEQ ID NO: 3822 - DNA, 303 bp, Glycine max
  Peptide Sequence Number=SeqID_95507
atggctatatcttttttacaaagtacagtggttatctctgttggagaacctgatacaccaaataagattgtcaagcaaccagatgctctgaaaaagccctacacccacaaccaatatcaatcaagctattccctcttaactccctccaaattcaacaagaaccattcaagttttgctgacactaaccattctagaggccaatctctagatcttgggagagaaaatactgcttcaagatctgccagaaactcagacattgatcatgccttaagtcaagtctctagttgcaaaagctttatttaa

SEQ ID NO: 3823 - DNA, 393 bp, Glycine max
  Peptide Sequence Number=SeqID_95508
atggtatcaagggaacctcttctttcccaacctgtaattcaagacatattcgtggatgaggatcgtgggatagagacactaaatgaagatccaatgcatataatgataaatgatgcatttggattgtctagattgtgtgccaatgaagagtcatttccatcatcacctgaacatagtggtggggtgaaggagggggaagatgtagataaagaggaacacaaaacatgtcatacatctaggtggaagcaaaagaagcaaaatggtcgtgagaatgaagttgatgcaggtgtgaaattaattggcacaacaagtcactttgtgattgagggacttgttgctgtacctattattgaacaaatggtgaacaaagttgagtgttcaccttctgtttag

SEQ ID NO: 3824 - DNA, 879 bp, Glycine max
  Peptide Sequence Number=SeqID_95509
cttgggaggattgatggggacccggtgttgagagaaacgaggatatgggctacgtgggagtacgtgagctcagttggaggtgggcaacaggggatggtgggtttatacgtgatttgtggatgcggaaaacttgttttgcaccatcgcccgactgccacctatggtacctggagatatgtcgcgggggtcaggagaccttggggacgtcaggtggggcgagctcctggcagtcaacagataaaaggaacaaagaccacaaagcttaaaaatgaagacaggaggctaagatggtctctggtaatcgattaccaaggggcctctggtaatcgattaccagtctgtgtaatcgattacacagaggaatgggtcactggtattcgattaccaagtatgtgtaatcgattacacagtgcctttttcaggttttcatgtcctgaagctatcgtgatggcggcgcagctaatccatgatcgagtggagatggagtgcctagagggagcttgggagaccctcgaaggcaacacgaggtgccgatttcgggccacgattcgatttacggctacttcattggtgcatccagatgaacccacgcgcacgcttcagcgcactgaggagtggatactacccacgcctacaccataccgtctagtggatccagtccaagtgatcgaggtgacgtcatccgaggaagaccctgaggaggatcccgaggagctacctcctgagcctgctgtggatgctcttgactttctagagggtgatgaagacccactccctaaggtggattctcccgaggacgtcatgtcggcatctgaggcagactctacggaggatagtggtcctggagagatggcgatcagtggaggctcttcatcatag

SEQ ID NO: 3825 - DNA, 948 bp, Glycine max
  Peptide Sequence Number=SeqID_95510
atggcggaaccatcaaagaagcgcaagggatcctcgagtcgaagccaacggcattccaaggctcaggaaacgcagattccctcctccatttcctcttcctcattgttctcaacggaagaacaaaggatacggtacacaaatcttttctcttctcattccattatcgatccaaaattcattgacatggatttcttttccaatgagagttttgaatgcattcaggcatttgaaaactccaatctcattcctttcatgtctttaaaattgtctgtttatactgaattagttaaagccttctattctaacctagaaattcaagaaggcactttgatttctgaagtttatgggataaaaatggtcattgaccaatccctattctatgacttgacccaattatctagtgaaggtgtaccatttgaaggtacactgaatgatgattggaaatttgacttctctttacatgatgtctgccggttggtttgcaccaaccaagcggatatgaccggaaggcttcttgccggatcattggcttttgaaagccgcatccttcattatctcattgtacgtattttgcttccaagatcttcaaaccttgcacaagtttctgaggaagatcttattgtcatgccagacaactaccttaaaggaataattaacagtgctttgaacggacttgatgatactccacaacctaaatccaaggctagtgctaggtggatcgttgttaaagaaagtttctacttatatatattttattgtaatagacaaaaaggaagcactgagtgtggctattacgtgatgcactggatgtccactataatcttaggaagcttaaggaataattgggaaacgtattttaaagatgttagactgttggaagcagagagattgaaggcgtttcgcatccagtggacaaagcattatctcaaagttagaaatcaaacttag

SEQ ID NO: 3826 - DNA, 441 bp, Glycine max
  Peptide Sequence Number=SeqID_95511
atgaagcatttggaggtgcttcaacttggtcgttggctgcaagattcacaaaaacatcatattgaagtggagattgaagaattcctgaaggagttaaggggtcaaaagaatttgaggcatcttagccttcgtgggatatcaagagtatttgagcagccacctttcatttgtcaacttgagaacctacaaattctagttctcaaggcctgtcacaatctagaaacgttacctagtgatattttatcattgagaaatctcatacaattggatttgtctgaatgctacttgttggacagaatgccaaaggggattgaacctgagtctgcttcggcccaaagaatgattcatcaagaagattcaagattcaagaataatcaagatcaagattcaagactcaaagattcaagaatcaagagaagacttaatcaagataagtattaa

SEQ ID NO: 3827 - DNA, 273 bp, Glycine max
  Peptide Sequence Number=SeqID_95512
atgatctcggattcattcactgttggatcatcgttaaatttaagcacccgcccaccaaacaagtctcataaaaatgacaatctcgaacccgttcaccgttggatcgtcgtgaaatttgagtatcatgttcgcaacacaattccgagcattctcaccgttgggaatttcgatatcagggagaaaaaggaatcgtatgaagacagtacaagtggaggtttcaatctcttctccgtctctctgacgtttgggaattctatcggagcagtcggatga

SEQ ID NO: 3828 - DNA, 741 bp, Glycine max
  Peptide Sequence Number=SeqID_95513
atggctaagtttgacccagacatagtcctggagttttatgttaatgcttggcccacaaaagagggagtgcgggacatgcggtcatgggtgagccagttcctgggtgacctgctagtgttggaggaaggtcaggagtgcgagttcagtcagagggggaacaaagtcgacgggttcgacgaggaggccattgcccaattattgtgcacactggggcaggatttcgcccggaccgctgccgggaggcgggtgcagatcatgcgcaccaacatgaccaccttaacacagatgtggatgacattgctgcttagcaatgtcttgcctagtgattataactccgaccttcctttgccgaagtgtcagctggtgtatgtcatcctgacacggatgagcgtccatgtggctcagttgattgtttacgccatctatttatttgaaggtatgccacccaccaggcaccctctagacctggataagtctaacagggccctggggtttccaacattgatcacggacctctgccagtcattcggggtttccgtcacacctagtaaggtgatccgaccgccgatcacttgggcctttattgagaagtattgcacgcctagacaggcgcagggtgatgcactgcaggccgcagacgcaccgccaccaccgcatcaggctgatcccgttgggtcattaggcatggagcggtatctacagcacttggttcgccaacaggcggccaaccaccgggggcag

SEQ ID NO: 3829 - DNA, 297 bp, Glycine max
  Peptide Sequence Number=SeqID_95514
atgaatgatgaaggagatgaaaatccttttctcttattattgggaaagttagaatttcagccgccattgccattggcggcaaggctgaacccgccatacccactggcggcaaaggtggagagaggagagtgccgccagtaccagtggcgatataagccacgtaggagggagagaggagagtgtcgccaatgcaaatggcgacacacaagctacgtgggactcgcccacagtgatggcgagatagagccacgtgggactcgcccacagtgctggcgagacgggccaggcttcacgtga

SEQ ID NO: 3830 - DNA, 606 bp, Glycine max
  Peptide Sequence Number=SeqID_95515
atggcaggtggagctatttcttggaggagtgttaagcagacttcgactactacttctaccatgaaagctgagtttgtcccttattttgaggctacatcacatggtgcttggaagaaccaaaataaggtagctctttcatggcaatggctggagtttgcaacatcacaggttaaaaaatttagtctaacaagcagcaatatcagttgtagagataccagttgtggtcgattggtcatggtggcaatgacgatactggcggcgattattgaggtggcattagtgacggtaatgatgatggtgacagtgatagaggtagtattagtggggatggtagcaatgtcgatggtattgatggtgtcggtgacaatggtggtggcgggacggtggtgtgataatggtggtggtggtggttgcattgatgatggtggtggtggtagcaatgttagtggtgatggtaatgtcggtggcgacgatgaagacaatgacaatgatggtggtggcaccaagtggtggtggttgcatcgatgttgttgtagttatgtcggtggtaatggtgatgccaatgacgatggtgatggtggtagtggtgcaaggtcgtgttggtga

SEQ ID NO: 3831 - DNA, 237 bp, Glycine max
  Peptide Sequence Number=SeqID_95516
atgaatgttaaggtgcatagctctgatgataccaagaaggatgaagaggttgtgcttcctggctttagattccaccccacggatgaagagcttgttgggttttatctgcagagaaaggtggacaaaaagcctctaaaaattgaactcatcaaacaggttgatatctacaaatatgatccatgggatcttccaaataaattgattttgttgaatgaaacgatgagatatggcgcttaa

SEQ ID NO: 3832 - DNA, 998 bp, Glycine max
  Peptide Sequence Number=SeqID_95517
gtgctactgtcccctacacatccgtaaatcatggtttacatggaccaattggggaggcatcttccttccagttgtccgttggagaaatgatcatcactctagatgatttgtcttgtctactgcacttgcctatgacacgtaggccccttgatcatatgccatcattctttgtcagagaggcagtgaagaccttgctaatgactcatctgggcattccaacagagacggaggcttttatggtggcaaacgcaagtgccatggtgaggctcttaggctacaatgacttatctcatgcacttgatcaacaatatgatatttgccataagttctcgacttgcattcatgttgcctattgccagtacctcaacaacctggatgcttgccataagtaccatggcaaagttggaggattatgtgatgagggatgtgataaccaccagatagaaaccaatgagcgataccaagcatgcccttcgagtcaggacatatcatccaaaggtgttgggggaattttggccatgtccagaggattccacgctagccacctccccgtcctacctatcatctttgtgattgagcatgggcagagtgacaacaacatatcattcctcttggggatgttgtggcacctgagggtccttgggcttgcacctatgactatctaccttgattttacaaggtttcccatccctatgtcattccatcgaaggatggacaaccaccatgtggtcttgtacgtttatcgccaacctaggcagccattgattgactatgtaccaggtggagactactcttgtctgggtaggagaagcaataacaactggaacacaacaaatgcctcaagcgatgatggtgtaaatgaaggttcaaatgaaaattttgatggaataggtggtgggaactggagaggtggttaccagggtaaagtggctccaacaaaggtgactttagaggtagacatttttggggtagaggagaacacaatggctttggtctaa

SEQ ID NO: 3833 - DNA, 339 bp, Glycine max
  Peptide Sequence Number=SeqID_95518
atggatcatgaggatgaggaggaagatgatgataaccacaacaataatgatgatgatgataatgatggttatggtagtgatgatattcatcaacaacaacaacaaacagttacacgtgatcatcctagaacaagaagaggaagaggtcgtagaataagagaacaacaatcactaacaaatcaagttgggtcaattggaccacctcgatccagcattccggctcaaggagaaataggcaagttggaatgtgttgacggacttgattgggttggatttatattaacacaattgatttgggtcaagtatgagtttaacaatctcaaatgtgactcttgttga

SEQ ID NO: 3834 - DNA, 282 bp, Glycine max
  Peptide Sequence Number=SeqID_95519
atgccatgccaaaatgactttgttgattactcgttcacaagaaaaaatctcaaaaagtttgacattccttccggatgttccatggatgaactgaaagatttgatcaagcaagttgcacctcatgggattcctccttatggctacttggggattaagttgatccgcaatcttgcggcggatcaagttgatccgcaagcgactcgtgaatcatctatgtcacctacagatcaaatttttcttctgcggatcaaccaaaaccaatgcgcggatcaacctcaatga

SEQ ID NO: 3835 - DNA, 336 bp, Glycine max
  Peptide Sequence Number=SeqID_95520
atgaaggtccatggtgaagttctgcccctgtatttgaaccgcaactccgacacacagttggtggcaagcaaaaacctcattgccatttcctaccacgacccaaaggggatgagtgggctgagcagtgaggcccaagaaatggatgaggcggccttacacgaaattgtagtggtgagacacgactcagaagtgctgaatgatttcaagaggtttgaggaaatggccttggttggactatggtgtgttcatccgaatccagctcttaggccttcaatgaagcatgtgatgcaaatgctagatggaaccgtggaagttgggattcctcatttggtatga

SEQ ID NO: 3836 - DNA, 288 bp, Glycine max
  Peptide Sequence Number=SeqID_95521
ctcagacgtgatatccaaattcccaacggtgagaatgctcctaaatgggttttgaacatgctgtttaaatttcacgacaatccaacggtgaataagtccgagatcatcatttttctgagacaggtagtgatgagacacgactcagaagagttgaatgatttcaggaggtttggggagatggccttgattggactatggtgtgttcatccaaatctagctcttagaccttcaatgaagcatgtgatgcaaatgctagatggaaccgtggaagttgggattctgttgtga

SEQ ID NO: 3837 - DNA, 894 bp, Glycine max
  Peptide Sequence Number=SeqID_95522
atggcttctgctagtggaaatggtgtctctaatggctctggctctccttgcggggcatgcaagttccttagaagaaggtgtgctgctgattgtatctttgcaccttacttttgttcagaacagggccctgctcgatttgcagccatacacaaggtctttggtgccagcaacatttcaaagttgcttttgcacataccaactcatgattgttgtgaagcggttgtcacaatcacttatgaggctcaggctcgtattagagaccctgtctatggctgtgtctctcacatttttgccttacaacaacagagtccccctgtggaactaaattcccaagtccaattcacttatgcaaaaaaccttgtggttgcatacccgatcgggactattgctcagaccacatatagtggtagtggtgcaacttctgatcacatgcaagatgatgaaaattttgtcatgaatgactccaacttagaatctgagcttcaattcaaactactctcattgggaaatttcatgttacagatgcaagacgatggcaacttggtgctaaaagcgtgtcaatggtcagaccctgcatactggtacacttcaaccacgacccgcaatgtgaatttggagtttaatgctaccagtgctctcttgcaccttgttagcggctctaagaactcctaccccttaaccaagaacacttcaacccccatggaagattactatcaccgcgctacaatatatgggaaaggcaatttccatcaatatgcatatcacagaaagaacggcaccgggtggaggagggtttggaaagctgtggaagatccctgcagactgaatcttgtttgtggtgtttatggcttgtgcacttgtaagatttgtgaaaatgaacccactttttattga

SEQ ID NO: 3838 - DNA, 192 bp, Glycine max
  Peptide Sequence Number=SeqID_95523
atgtcttattcacaagataataggttgacaatgaacatgggagttaaaaaattgcaggagaaggataatcatgtggaaacaaatggtgcattccaaggaaaggcaaaattgctctttgctcatgctggagacaaatgggatgttgagttttatgcaaaagtcaatgatgatgtctatgtaaatattggttag

SEQ ID NO: 3839 - DNA, 700 bp, Glycine max
  Peptide Sequence Number=SeqID_95524
atggcgcgcaaagataaattatggtcatctgcccccttttcaaagactcaatgtcttttgactgagactgttaagtctcctttgctatccagagacaatcaagtccgatggcacgtagagacaaatatggtcatttgccctcttgtcgaagactcaatgtctttcgaccgagactattgcatctccctctgtcatctagagacaatcgagcccaatggcatgcagagaccatcatggccattcgctttcatttgttttcaagactattgtagtctccctctgtcatccagagacacgagtccaatggcatgcgaagaccattatggctaccagagtcctttgtcgagacttcaatgtctcccttactttgcaagacttcaaggaaatgtgcaaaatactcaaaagaggggcaaaatggtcactttgggcgaaaacgttgtggatgaagcaactaactcgcccgggcgagctaggttgcttctagaggaagcaagcagctcacttgggcgagctgtcatgcaacctcctcccctcattttcctgccttggatcttcttcatcgatggagtcttttgcttcttgaggtttgattacaatagaatggagaaggagaaagatgattggagatgccacttcaacccagtaaatccaagatcaatttcaagattctcactaagtgtgcttaggtgtcctgaggcat

SEQ ID NO: 3840 - DNA, 1266 bp, Glycine max
  Peptide Sequence Number=SeqID_95525
atggcaatggtgaccctcggaaggatgtatcagtctcctttcccttggtggtacaaccccaatgcaaccaacgcttatcatgggggtgtggaagcaatgtcttccaaggttattttgataatgccaaagaatcaagagtcaagcaaattccaaagattcaagattcaagagttaggtttcaagaatcaagattcaagattcaagaatcaaggtacatctacttgggttgttgtaactgagaacaagagagggtacatctcttatggatcagttcaagtggagggtacatccacttggttgttcaaagagaacaagggaggttacatcccttgtggatctttgcttgtaaaggcttttacaaggttgaaaagaaatctcaaggaccgcaggtcgcttggggactggatagggtacatctacctggggattgttatactaagaacaagagagggtacatctcttgtggatcagttcaagtggagggtacatccacttggttttttcaaagagaacaagggagggtacatcccttgtggatctttggtttgtaaaggattttacaaggttgaaagaaatctcaagaaccacaggttgcttggggactggatgccacctgatcctacagggggtaccccggggcattcgatagaacagcgtgtggccctcaagcataaggtccaaattaatgcaatagaggagtatggacttcagaggccaaagcaaataaaagatgtggtaacctctaggaggtttatatttgaggcgctgcaagaagcgggcatgatttcctttgatgggcacaagggggattcttgtttaatgcatccgggtgcatcacatgacatggaaacatgctcaacgacagaggagctattacaaggaatgatggaccaagcccggtttgaaattggtgatgcaagcaagggagaacaacatgtgtgcatgcaattggcagacaaaagcccaagcaaacccaaacctttgatgatccacttcaccagagatgctgcctcccaaaaaccgcgaggctcccaacctatcccgggtaagaagtttgtcccattcccttgcagaagcaacaaggcggtcccatggaggtatgcccctcaaaagcccaacgaaaagaaggacaaggccgtcggagatgacctatcctttgccaaagttacttacatctctggcatgagtggtgtgacccgcagtgggcgtgtcttcgcagcaccggacccgttggtgtggtccaaggatgcgaagggaaaggcaaag

SEQ ID NO: 3841 - DNA, 1863 bp, Glycine max
  Peptide Sequence Number=SeqID_95526
atgacaacagtgccctacatgcagctaggtcacgacgctaccaacactaagcccatggcggcagctacactaagcccacagcaggagcacaatgagcatgacaatgatggatggttcaaggatagtaagcacgcaggaaaggagaggacaatggacgtggctaaggtgggctccaagatctcgcacgtcaaactaaggatagtctttgttaagaggacaagaggggagacctgtaaaacaaaggactttgaggctcaaggtcgcgagttcttggagcccccaagtatggacaagtattgtctgatgttgagagtggtgaacatgcttttggctttacgggcgggatctgacatgtcaggcaactgcatcattgtgcgaaaaattagggcaccatttcagctcctaccagttaccgaagagttgtgcattcacattaaatggaatgaacgtatgggcagtagtgactccgggggttctgatgcaatcctctctaggaagggaccagttaccagagtaatgagcaagaggctccaagaggattgggctagagctactaaagaaggccctagggttctcatgaaccttagggatctcattgaagctcaaagatccagcctccatagaagctccacaagcaagcttccatcaggttcgattcagcaacccctggtggacccaaaggtcatctccatcgacacttcttgcctttgtgggagggcgaacccttccgttgcttctctagtcgggaaacctatttcggccaccatgattctaaccccttctatttctaagggagcaaggaaaagtggttgcggggacgtgtctgttcaaggtcttgagtctggttctttccttgacctctttccatctgaccccgccaggtttaagtcttttgatgaggatcttctgacccttgtacaggggacgatcctcttgcgaccttggatggtaaagtgtcttaccttgttctcttttatgtctgaggtcagaccagcaggtgggactatgccaccgtctgctgccattcctcatgctgaagaagggggtaaaactgttgttgaggttggccttactattgaagttgttgaggtctcccctagtgttccttcctttgttttggttaagaggaagcaagatggcaaccctagggtatcaggacggaagaagtcgagggctcctcttagcctttgtacattaatgcaagctgcttctgctcctactgttgttttcatttatgctcctccacctcctcctgctacgcctgttcatgctatcgtggctcatttgcccaccgtcgatgcacccttgctgagtgtcggtgtggcgacaatgagtgctcccgagatgttacctcctccttcttcagcttcaccagttcccccctcaatcgtattggcatcgacatcaccttccacctcttcccatcattgtgtttctttagatcacatctacacctccaacgatgttgattcactgtggtgcattggttacaaacctgagaagaagaccctgtttggcactcctagaaaaaaaaatgggcaaaggcaccaagaggcgctaagcaaggtggcaagcttagaggctgaggtagttagtgtcacctccgtctttgctgaagctttgaagtcaaaccaacaactatcttccaaggatggaagtgtccttgccagggagaaaaatgagttggctgatagggtggagaacactgtggcgaagaaggatgagccttccaaggtggttgctaacttagaggccagactgaaggagtcagagtccaggctagaagagttcgagctacgggcatccaaggagatggaggccagaaaagagctagaagaggagctgctaatatacaagaaatag

SEQ ID NO: 3842 - DNA, 276 bp, Glycine max
  Peptide Sequence Number=SeqID_95527
atgccgccctccgaaaagggaaatcatcactcctataagcctgaatgcttgcaggagtccttaaggcttgccaatttcacttggtgctacaaagcaacgacactttccataaaggtttcccgactagagaagcaacggaagggttcgccctcccacaaaggcaagaagtgtctgcaccaacacggggcgaggccgtcaacctctatgaggaagaggactcattataataagtcccacaacaagtctcctctgaggaagaactaccgatggagatga

SEQ ID NO: 3843 - DNA, 588 bp, Glycine max
  Peptide Sequence Number=SeqID_95528
atgcaaggtttgtccttggtgagtctcacaggcttgttaaacccaaggtctgcccttagtgagtcttgcttctccaaaggcttatcaaaacaaaggtctatccttggtgagtctcacaagctcatcaaacccaaggctcatcaaatccaaggtctatccttggttagtctcataggcttgtcaaactcaaggtccactcctgatgagtcttacctctccaaaggcttgtcaaacccaaggtcccttcttggtgagtcttgcttctccaaaggcttgtcaaacccaaggttcatccttgttgagtctcacaggctcgtcaaacccacggtccgtccttgtctcataggctcatcaaacccaaggtccacccttggtgggtttcagttctccaaaggcttgtcaaacccaaggtccgttcttggtgagtctcacttctccaaaggctcgtcaaacctaaggtccatccttggtgagtctcgcttcttcaaaggcttgtcaaacctaaggtccgcccttggaagacaagtttgcaagaacaacagaaacccaaggtctagccttggttcagaaatccaaggttcatcctag

SEQ ID NO: 3844 - DNA, 464 bp, Glycine max
  Peptide Sequence Number=SeqID_95529
atggggagagaggttttggattcaaagggtatttgcaaagggggtctattttgctatgggtgtcgccagaagcaatggcgagaccatgatgctgccatcaccactggcgagaagggtggtgacgtggagtgtgctgccagcaccactggcgagaagggtggtgatgtggctgtgaggtgggtgtgcctccagcaccataggcgagaagcattccacgtaggaagcatgcagaagccgccaacagcaatggcgagacatgtgccaacgtggaacgtgtctcaccattgcatcttgcgagacctattaccatgcaatgccgccattgcttcctgcgagacacttgcatccaggccagacctgttcgtgagccatttgcatgcagggctagttgcagctgtgcaagggtcacatggatacagtgtgcctgtgcaagggtcacatggatacagtgtgcctatgcaagg

SEQ ID NO: 3845 - DNA, 339 bp, Glycine max
  Peptide Sequence Number=SeqID_95530
atggttagaacacgaggtttaggtcgtgcgttaggagctggtagaggtagaggcattagtgaggatgtgcatcaggctgatgttcctcggcgtcgcagacctactgcttcagcacagagacctgaggatgtgcctcagttgcatgaggatgttcctcatgtgtctgatgccaccccaaagatgacagacgccgcctatgctgttcagacagagggagtggctactgatgggagcttggggtcacctgctgcagatgagggattccccggtggaccacgcgacccatcgattttgaccggttttgctgagcatgtcgcacacagcatctggagtggacag

SEQ ID NO: 3846 - DNA, 111 bp, Glycine max
  Peptide Sequence Number=SeqID_95531
atggctttgttgatgggggaaggtgacaaagatgaaaaagtggatgggaaaagggaggggagttctttcaatgctacatctaatatacttgaaatggaagatgatgattga

SEQ ID NO: 3847 - DNA, 231 bp, Glycine max
  Peptide Sequence Number=SeqID_95532
atgaaaactgaggttgtgtttccgcaacaccaccgaacgattgctggcttgcagaagtatcagtgtgatgaccctgaaaaggatactaatacatcggtgtcggatactcagcaaatgtttgtggcgtgtaatacattccatggccacgctccggcattttttgggaatattcttccccttcaacagtctcccttcgtctgtctatgccctgagtttcaacacttgactgaa

SEQ ID NO: 3848 - DNA, 1384 bp, Glycine max
  Peptide Sequence Number=SeqID_95533
atggttttgagggtttctctcattctagttctccttgtgttgcactgttcctgcactgtgcaatccatttttgggcatcacaatcacaatgatctcaacaagaatggatcttctcttgctgcagtcaagtttcctgatcatgcacacttcaatgctgtttcttcttccacagaaactgggtgtagcttctccaagtcagagaaatttgagccttcggtagcaaccatgacatcaaatggtgacacggatggtgaagagggagaggcttttgtggcagcaaaacagcacaagcaatctgtgaaactcaatttgagacaccactcagtgagcaaagattctgagcctaaaaggtctgtggctgattctacagtgagagacttgaagagaattcagacccttcacagaagggtcatagagaagaagaaccaaaacacaatttcaaggctggagaaagcaccggagcaatcaaagaagtcctataagctggcggcagcggcggctgctccggctgccccgccggagtatttctccggtcagcttgtggcaaccttggagtcaggggtcagtcttggctctggtgagtacttcatggatgtgtttgttggcacaccccctaagcatttttctctaatacttgatactggtagtgaccttaattggattcaatgtgttccttgttatgcttgttttgagcaaaatggaccatattatgatcctaaggattctagttcttttaagaacataacttgccatgatccaaggtgccaattggtgtcatccccagaccctcctcagccttgcaaaggtgagactcaaagctgtccatatttctattggtatggagatagttccaacacaactggggattttgcacttgaaactttcacagtgaatctcaccacacctgagggaaagcctgagctcaagattgttgagaatgttatgtttggttgtggtcattggaatagaggactttttcatggtgctgctggattgctagggttggggagagggccattgtcatttgctactcagctgcaatctctctatggtcattccttttcctattgccttgtggataggaacagcaattctagtgttagtagcaagttgatatttggtgaggacaaggagcttctcagccaccccaatttgaatttcacttcttttgttggtggcaaagagaaccctgttgatacattttactatgtcctgataaagtccatcatggttggtggtgaggtgctgaagattccagaggagacttggcatttgtcagcacaaggtggagggggaacaatcattgattctggcaccactttgacttactttgctgaacctgcttatgagattatcaaggaggcattcatgaggaaaatcaaag

SEQ ID NO: 3849 - DNA, 261 bp, Glycine max
  Peptide Sequence Number=SeqID_95534
atggggagtcgcaggagaactgggacatggcagcgtacaccaccacacccgaccacagcattcaatacggcgcaaggcatggcccaggcctttcgtgctggcgagtacttccgccgcatgatgggtagcgacaactactccccgactgatgggtatgatcatcggcatgaggaaagagtcgcgagttcgagaatgagatttcggaaactttcgggtggaagagaggatgaaggttataaaggaaatacgcgaacattttga

SEQ ID NO: 3850 - DNA, 495 bp, Glycine max
  Peptide Sequence Number=SeqID_95535
atgtacccttcacttgaactgatccacaagagatgtaccctctcttgttctcagtataaaaacccaagtagatgtgccctctacttgtgccacaaaggatgtaccctccaatgtgttaggacaaagaattctcaggcggttagtcctttgaatctttgtaaggggaaacaaaagatgtctcaggcgagggagaagggagacataaaagaactcaggtgttttcttgaccagacatgtgtagaaacaaagattcatagtgaatcaaaggtgattcaaaggtgttttgatgataacaatgatgatgacaaaggtgatgacaaaaagctcaaagatcaatctatgaacaattcaagagttcaagaatcaagaagaattcaagactcaagaagaaagcctagaatcaagaatcaagattcaaggttcaagatctcaagaatcaagatcaagattcaagattcaagcatgaagaaaatactcaatcaagataagtattaa

SEQ ID NO: 3851 - DNA, 228 bp, Glycine max
  Peptide Sequence Number=SeqID_95536
atgttaaggtctttgcaagccttaccaagaggtgcaaccagcccgtctaatgatcctttacatgggattggaggtcctatgacaaggtccaagactaagaggatgaagcaagctttgcaaggcctgattctaaagatcaaagagaaagaagaccgatgtgaattaagggttgcacttaagtgggtcgctctccgacaaattgatgaagatgctttgaggccaacttga

SEQ ID NO: 3852 - DNA, 639 bp, Glycine max
  Peptide Sequence Number=SeqID_95537
atggcaccaagttctgcagtgccagatgaacagctacctaccaccaatgtagagtttctgcaatttttattcgaacaagataagatggttgttgttggagaggagattgagcatgtaagagtggtcactttgaacaggccaaggcaattgaatgccatctcaccagaactggtttctcagctagcaacatatttggaaaagtgggagaaggatgagaaagcagaactagttattataaagggagctggtcgggctttttgtgctggaggagatttgagagtcttctatgatggaagaaaaataaaggatgcctgccttgaagtggtctacagattttactggctttgctatcacattagtacctataagaaaacccaggttgcgcttgttcatggaatttcaatgggtggaggtgcagctttgatggtcccattgaagttctcagttgtaacagaaaaaactgtttttgccactcctgaagcaagttttggatttcatactgattgtggtttctcatactaccattctcgtttacctgggtatttaggtgaatacttggcacttactggaggaaggttgagtgggaaggaaatagttgctgttggagtggcaacccattttgtcccttatgaggtttga

SEQ ID NO: 3853 - DNA, 2625 bp, Glycine max
  Peptide Sequence Number=SeqID_95538
atggcgaacgtgtccgtcgcggcggagtggcagctcctctacaaccgctactaccgcaagccggagctctaccctatgccgtggaagcacgtggacctcgcccgcaccaaggtcgccgccgcgcccttcggcggccccatcgccgtcatccgcgacgactccaagatcgtgcagctccacgctgagtccgccctccgtaagctccgcctcttctcctcctcgggccgccccctcgccgacgccgtctggcgccaccccggcggccgcctcgtcggaatgtcctggaccgacgaccagactctcctatgcgtcgtccaggacggcaccgtctaccgctatgacgtccacgccaacctaatcgaaccgaacctctccctcgggaaagagtgctttgaagataacgttgcggattgcgtgttttgggggaacggtttggtttgcatcaccgaggcgaatcagttgttctgtattgccgatttcaggaaccctagcgcggtgaagctcgcggatcccgagatcgaggaaatgccgcattgtatggccgtgattgagccgcagtacacggtatccgggaatgttgaggttttgctcggcgtggatgatgctgtggtgcttgctgtggaggaagatggcgtgcagaggctcggggagggagtgctgcgggggccgctgcagaagatggtggtttcgcgcgacggcaagtggctcgcgtcgtttactcacgacgggaggctcttggtgacgacttcggacttgactggagttatcatcgagagggagtgtgagtgtttatgtggtttgtggaattcaagggatgtgcagaaggacatgataatggatttagaaaaagtctgtgactgtgattttggctgtaatgtcaagtcagctcttcctccgcagcagattgcttggtgtggaatggatgctgtgctgctgtactgggatgatatgcttttaatgatgagtcctgagggagagccagttcactacctttttgatgaaccaataattcttatacctgagtgtgatggagtaaggatattgtccaatactagaatggaatttctacagcgggtgcctgattccaccgtttcaatcttcacaattggaagtacatcacctgctgctttactatatgatgccttggatcattttgatagacgaagtgccaaggcagatgaaaatttgagattgataagatcatcccttcctgaggctgttgaagcatgtgttgatgctgcaggtcatgaatttgatctttcacgccagcaaactctcctaagggcagccagttatgggcaagccttttgtagcaattttcaacgtgatcgtatccaagagatgtgtaaaattctgcgggtcttgaatgcagtgcgcagccctgagattggcgttcctcttagtattcagcaatacaagttgcttacaccatctgttctgattggtcgcctgattaatgctcaccaacatctgcttgcactgaaaatatcagaatatcttggaatgaatcaagaggtggtgataatgcactgggcatgttcaaagataactgcttcactggcaattcctgatgcgactcttctggagattctgctggataagttaaaactgtgcaaaggcatatcctatgcagcagttgctgctcatgcagacaaaaatggccgacgaaagttatctgccttgcttgttgaacatgagcctcgttcatcgaaacaggttcctctcctgttaagcattggagaagaagatatagccttgatgaaggcaaccgaatgtggtgatacagatcttgtttaccttgtactttttcatatttggcaaaagaggcagccattggagttctttggcaccatacaggccagaccattggcacgggacttatttataacttatgcacggtatgtggccttgaaccatattccagaaggcaagacagtgtggctcttcctggatgtggcatttcttctgtggaaagaatcctgggaacttgggaaaaaccccatggcaagcaaaggatctccacttcatggtcctcgaataaaacttattgagaaggcacatggtctttttgctgaaaccaaggagcatacctttgaatcaaaggcagctgaagagcatgcaaaacttttaagaattcagcacgaacttgaagtgactacaaagcaggctatttttgtggattctagtataagtgatacaatccgtacttgtattgtcttgggaaatcatcgagcagcaatgaaagtgaaaacagaatttaaggtgtctgagaagagatggtattggcttaaagtttttgccttagcaacaatcaaggattgggttgccttagagaaattttcaaaggagaagaaacctccaattggttatagaccatttgttgaggcatgcattgaagcggatgaaaagggagaagctattaaatatatcccaaaacttgcagaccctcgagaaagagctgagtcatatgctcgaattggtatggccaaggaagctgccgatgctgcttcacaggcaaaagatggtgaattacttggtcggttgaaattgacatttgcacaaaatgcagcagcttcatcaatatttgatactcttcgagatcggttgtctttccaaggtgcttaa

SEQ ID NO: 3854 - DNA, 258 bp, Glycine max
  Peptide Sequence Number=SeqID_95539
atgggggagggggtgtctcgccagtcctgtgggcgagacccaggctgtctcgccagccttgtgggtgagtcccaagtggactgtatcgccagcttggggtgtatcgccatttgcattgacgacactctcctctctccctcctacgtggcttatatcgccactggtactggcagaactctcctctctccacctttgccgccagtgggtatggcgggtttagccttgccgccaatgacaatggcggcttccactcaataa

SEQ ID NO: 3855 - DNA, 465 bp, Glycine max
  Peptide Sequence Number=SeqID_95540
atggctctggtcaaggagttttatgcaaatctatttaatccagaggataaatcccccaggcaggtccgagttcgggggaggctgattaaatttgacggggagacgttgaacgcctttttggagaccctagtggtttttggagccaggggagcactactcagccttctccaggttctgccatactcatctagaccctcaggagcttgcttccaagctctttattctaggacctggagcatcctctcttattctaacatcgctcccacttctcacacgttcgatcttaatatggacagggcgaggaagaactgctggaacctggatgatcccatgatcacatttttggggacccgcaagactcaggctaggggacctgatacttctgctcctactgctccagctcccacacctgcacctacaccaacaccagcccctctcccagcaccctccggcacctccacttag

SEQ ID NO: 3856 - DNA, 303 bp, Glycine max
  Peptide Sequence Number=SeqID_95541
atggaagatcgtagcacaattggacatccagttgcaatgcagagattttatgctgacactaatatattatggtcctatggaaactttgttgatattaagggaccaacagtcatgaagatcatgacaatagaagccattgggggagaggttgacatggggtatctaggcactctgaattcctctgcctttttctttcttgtggttaacaatcagatggcaaaatcaatcaaggaactcaagaaggagaatcaattcttgaagagtaaatctgagaagtctgatgtcacactcagagttagttga

SEQ ID NO: 3857 - DNA, 543 bp, Glycine max
  Peptide Sequence Number=SeqID_95542
atgaagctaaaatttatgattgcggtgctacttgccaccgctggagcaatcatgtccataaaaaatttcaacaacctcttcaacaatagtcatcaaagattaggagttgcactatatggtgttatctggctgcaagttttacttggcatttttcgaccacaaaggggatccaaaagaagtgtgtggttctttgcacactggatacttggaactgcggtcacattccttggtgtcctgaatgtatatcttggtttaggagcctaccaccaaaaaacatccaaaggcataaaaatttggaacatacttttcactgttcagatatctttgattgtgtttttctaccttttccaagaaaaatgggtgtatatacaaaaccaaggagtggttttgggcaaagaaataaaggctcccatttgtcaagaaagtcgtccagatgaaaaggagaagaaatggcaaagccattcaaagatgataattgcggataaatgcacctgcggtgataattgcggttactttgtagtagtagacattttaacaacctag

SEQ ID NO: 3858 - DNA, 510 bp, Glycine max
  Peptide Sequence Number=SeqID_95543
atgggtttgtttgatgccccagactttaatctgagagccatctgcgagagtaacagaaggcaagtctacttcaacatgaacttagttcttgtggtagttacagtttataccacgtccaccaccaccacatcctccatgatgagaggagtgagagacaagagtagaggaatccttggtagatgtggaaaagggtccaaagggccaagagagaaccataggacattgcataaagaggtgtcaatttgcttccaacaagctttgttgttggttggaacatctgttaattttgttctcaagatcaatggaataatggtaaaagtcacaatgaaactcaaggcgaatgcggtagccatgagaaaagttccaaaccacagtcaaaacaaccaaatgtggccaaacagtagccaaatagacccaaacaatgctcaaacgaggtcatcaaaagtggagggtcatggtataggagggtcgctggaagaaggcacgccagaaaaggcgtgtcacgcgtga

SEQ ID NO: 3859 - DNA, 432 bp, Glycine max
  Peptide Sequence Number=SeqID_95544
atgtgcacacaaacatatgcccatacaagagaggcatgtgtcagcaagcttgaattagttggttatattataataagacccttcaccacctcagccaacgacgactcctacagcagtaagcctcattgcgcaccaaactcagcccaaagtggcgcttctagcagtagtgacagctgcctcagagcagcgacaaagaggttgaggccaagaagcacgaacaggagaaggaggaggtccaaggaggtcaccaccacacctttctccacgtgtcatgctcttcgagattgcccattgcgtccttcatctacctcctcaacttcttcagcattgacttcttctccgagatctatctatggttgtaatgcatttgatattgtggctgtttgtggtcgggggtgggttcgtaacgggggaggaggaggtccaaattag

SEQ ID NO: 3860 - DNA, 610 bp, Glycine max
  Peptide Sequence Number=SeqID_95545
ggagttagatttgagttggagcaatggatgcaaaagaaaggtgaaaattgagaagttcgatgcaaatcaaccggagggcacgaaggatgaagattgggctcttcttgatagacaacccctcggagttatccgattgacgttatcctgcaatattgctttcaacattgcaaaagaaacaaccacaacgggtcttatggcggctctttccatacgagcattgacacttttgtcttctctaccaaaaagttggaatgctattgtcataactgtgagtatctcgttgggaagtaataagttaaagttcaatgatagtcaagaggaagaaattcaaccagaggatatgaacgttgaaaatcaaaagaccacaggaggtccaaatccaagaatcatcgaagttccctcaactcgaaaactatcgagtgttggaattgtggaaaaatcgggcattacaaaaatcaatgcaacattgcaccaaataatcaagaggaaaaaggcagaggcaaatgttaactccaccttaggaggagacaatgcattgatacgttctttagagaacaagaaagaatcttgggtattagattttggagcatcctttcatgctacttcgtag

SEQ ID NO: 3861 - DNA, 267 bp, Glycine max
  Peptide Sequence Number=SeqID_95546
atggaagtgaaggaagaggatagatgtagcacaaaaattggctacaaaattgaggaacttatagagattctagtctttaacatgggcttgtgtggggaaacaaagaatctcatggcagaaagaagaagaacaaagcatttgaatgatagtccttacaatgctaaggaaacaactttgcaagggctattgattacaaaggaaacaagtttaccaaggctattgattgcaaaggaaacaagtttacaaaggctattcattatcggctaa

SEQ ID NO: 3862 - DNA, 336 bp, Glycine max
  Peptide Sequence Number=SeqID_95547
atgtactcagacaattggcacttgttggagtcgaagagtttcacggagatgttgtcggagtgttcgctagattggagcagacaagagaaaagaggacatggaggaggagttggagaagacaatgaaggtttctttggagaactcgaggtccatggatttgggttggtggtgttgaagatgttaggttttgtgaaatcaaaggttatactatgtgactgcgaaggggaaaaggtgactaggttagctggtaggcgagaatgttggaagtggaagggaggggtgcacgcaaaaatgggcatggttggtgtggcgtttgagaaaggatcgatgggatag

SEQ ID NO: 3863 - DNA, 357 bp, Glycine max
  Peptide Sequence Number=SeqID_95548
atggaaagcaaagaagccgaggctacaacaagcaaaagtagacaagcacaagctgcagctaaaggtgaaaaaatcaatcccactcctattccccaaaaatcaaagaagaggaaacccaactccaatagcccatgcaagacatcacctataagtggaaatttcaatttagtggcagccaaccataggttcaacgtagaggtttgtagaaaagccttagctacctttgtcattgtagatgagcatccttttaaggtagttgagggcagtgttgttaatggcagatggcgaaagtcaaaaatccgccataaaaatatggcggatggcgtagcgaaaaatggcggacgtcatggcagataa

SEQ ID NO: 3864 - DNA, 446 bp, Glycine max
  Peptide Sequence Number=SeqID_95549
atgcgtgtggtggtggtgggtggttatggcggcatgatgatgagtttggtacacagtggaggccgtcgttcattcctccgttcacgtcgtgccgctagtgagtgccccgtcgtcaacgtcgacgttgtcattgtctccgccgatgttgagcatgtggattatgcaactgatgagatttatgagcagcctcaagagacaattgcttatgatgtagttgctgatgcccagggttttccaggcggaccccatgatacattagttttgacgaaatatgttcatcatgaacatcctaagttgaagttgtcctctcatggaaggagagtagaaaaatttggaaggtctgctccaaatattgaaggcatagtggctaccacaagattaagtcctctgattgcatgttccttggatactggtgacaggagacttatatctacttttgcggagag

SEQ ID NO: 3865 - DNA, 309 bp, Glycine max
  Peptide Sequence Number=SeqID_95550
atgttggcccgccaagagaggaggcggaaagccaaacgcctctctcgcttagtggattatctcactaagcgagtgggtcgaaaaatggtgccttttagaggccttaaaagggatgaaaacgaagttcattttttttcattttttctggaaaacacgacgaatgcgctaagcacgtcgaatgtgctaagagagttcatcaaaagacatgcgtacacgagcaccctactaagcctccaatacatgccacccacaacatatatgcacaagcaccctactaagtctctagttcgtgccacccacgctgagtga

SEQ ID NO: 3866 - DNA, 174 bp, Glycine max
  Peptide Sequence Number=SeqID_95551
atgtcttatcatcaaagaaagctatgtctagaaaatagagtatatgatcatggagatgacaaggaaggaggaactggtgctgtgggtgcttcagatggtccgtggcgtcaatggcctgcaacagcggtggtggaggatgatccctttcgcttctttgacgattctgccatttga

SEQ ID NO: 3867 - DNA, 279 bp, Glycine max
  Peptide Sequence Number=SeqID_95552
atggcatggagtcatctcaggtttgatttcaacttggttaaaggtcttgtcacccatctggtggggcttccttctattttgtggagcttctcccttgatggttgtgaggagttagttcattttgttgaactgggacctaagaaggtggtcgtcatagttgctgtgagtgagcagaccaaggtggtaccttgggttttttggaagtatgtacgaagggcggaccttgggttttgcaggaatatgtaccaaatgttagacaaatggcctcagttatcttaa

SEQ ID NO: 3868 - DNA, 363 bp, Glycine max
  Peptide Sequence Number=SeqID_95553
atgaagggtgacaaagaaggtggaggagaaagggagcttagagggaaccaaagggttttggatgttgcggagagtttagacgagaaatgcacgctaagtgcaattccaaccgaggggaattgcgctgagcgacccaaagctgcgctaagcccaattccgactgagaggaagtgcgttgagaacccagaggacaggccccctaagcgaaagttgcagaccaccgatggctgccaccagccgccgttgcttgccattggacccccacaccaagaggaacactttaatcggagcggaatcctcagaatcctcctcgaagattcgatggagaaaatccctcaatcctccatttcaaagtttctttga

SEQ ID NO: 3869 - DNA, 504 bp, Glycine max
  Peptide Sequence Number=SeqID_95554
atgaaattacaccagaacgcatccaacactgcatacctcgtatgccatcgacaacgaccactgcaacaccagagaccgtcgctacctccaccttcacctttaccttcatcaaaacgaacaaaacggggaagcactgcgcaccggagacacaacagaacgagagaatgcgcaaatggcagcattgtgccatttttaaacgcaggtggtactattcacggcgacactgtttatcgagatgaagagaaggagcaacaggggcattttgggaattttttaaagttgctgagtgcaccagcaataatgctgggtgcacctagcaactccctaaaacaaagaaggaacacattagttcggtttccactcagactatttctcccaacaacaaaacacgccactcactcagtgtgcctctcacgccgacttcctatggcaagggacagttgcctcgctcgtgtcaccgccggcgccgctatgggcggcgctgtcggcggcgccgtcggttag

SEQ ID NO: 3870 - DNA, 411 bp, Glycine max
  Peptide Sequence Number=SeqID_95555
atgggagcaatcatctccttagagctttatgtggatccgtccatgcaggccgccacacaatcccttgagttgtggaactcaaggattgcttctgcttatggatttcatggtcaaggacaagaagcaatcaaggttttcaatgagatggaacaagaaaatctgccagaaagtgaagtaatattcttaagatggctaaccaaagaggaaacaggttttgatgacgtgtcttgtggagggacatttgctatttgttggatttttcttatgctaccttggttacccagtatttatgcttcttttgagtctaaatacagtgtaacctctggtgggttgtacaagcctcataaggctgaggggttgtttccttgggaggttccagaacagattggtcctctacattatagtccttag

SEQ ID NO: 3871 - DNA, 105 bp, Glycine max
  Peptide Sequence Number=SeqID_95556
atggaggtttttagaggaaaggcgaataatgaggagatttcagacctcgatgaaaccattgttgctcttattccaaaggttgaggtggtggtgaatataaagtag

SEQ ID NO: 3872 - DNA, 111 bp, Glycine max
  Peptide Sequence Number=SeqID_95557
atgaagaatattccagattcgggagttatctttacgtttgaggaaggtcgacaaaagcggggttcttgctcctatgtaccctccatcgaagaagaaatcaaacctacgtag

SEQ ID NO: 3873 - DNA, 507 bp, Glycine max
  Peptide Sequence Number=SeqID_95558
atggatgaggagtacgatgtgattgtgttgggcatgggtctcaaggagtgcattcttagcagtcttctctccgtcgatggcctcaaggttctggacatggacatgaatgactattacggaggagaatccacttcgctcaatcttattcagctttggaagagattcaagggagatgacaagcctcctccacatttgggtgctagcagggactataacatcgatatgaaccctaaggttctcatacataccgatgttactaagtatctctctttcaaagttatggatgggagctttgtgtttaataaaggaaaggttcataaggcttctaaattgaaattaagggatgttaaaggagcattactggatacagaatttgcaatgtgtgagggagatgacaatgctaaagctttgttccaccaaggacaggcatacatggcactccatgacattcatgttgcagttgaaagctttaagaaggcactgaccatggagccaaatgatggttag

SEQ ID NO: 3874 - DNA, 180 bp, Glycine max
  Peptide Sequence Number=SeqID_95559
atggcggaacatggcagaaggccgaaattccgccatataacatgcattgtagattgcaccttatggtgccaccaaggcaaacctcttcacaaattgcctatggcggttgacaaaaaatccgccacgccattccaccatggcagtgccatggctttgacaatgcaaaagctcatgtcctag

SEQ ID NO: 3875 - DNA, 402 bp, Glycine max
  Peptide Sequence Number=SeqID_95560
atggcgcctcctctcacctattctcctttgtcttccactgcatctccatggtggaaaatcaccattgaagctcaaagatccagcctccatagaagccccacaagcaagcttccatcagtgcctgatcagtggaagcaacttgcagccaattacttgaattgtaatttgttggccattccttttgtgtacttgggcatacccattggggcaaacctgaggcgatgtcagttggtccctaatagagtggtggataagctggtgagcttacaacaaagattcctttggggtggcagacctgagcataacaagattgcttggattaagtgggagaccgtgacaactatgggctacggtattggagtcaaaatatggtggttggaggagcctggatacaacatctag

SEQ ID NO: 3876 - DNA, 306 bp, Glycine max
  Peptide Sequence Number=SeqID_95561
atggtaagaaactcttccaacagcaaccagtcggggaggactaccattgacatacaatccacatttgttagagtcacccgtttctgggtcctaccccgaggcatcgacacaactttcctttgtgctgacatgagcaatagaaagaccaacctcagcctcaggtgtcacttgatggaagcttgcttgtggggcttctatggaggctggatctttgagcttcaatggggtcctttaatggtgattttccaccatggagatgcagcgaaagacaaaggaaaagaggtgagaggaggcgccatccattaa

SEQ ID NO: 3877 - DNA, 286 bp, Glycine max
  Peptide Sequence Number=SeqID_95562
atggcccgcatgaaaaaaatcggtcaaatgacgtctgaggtgacaaaggaagttgcagacatgattgattccatggaagagcaggccacactgggaagctttgtcacccatggacgtcaagatgtactgactacagccattgggcctaaagcagttgacacaaaatatcagagatcggctagaggagtcgatcacgcaaaaagtgatgatgcaatcctatcccgcaagggcattgggaatcttcttaaggaagcttctcaaggaggtgagcttagttatgagaggg

SEQ ID NO: 3878 - DNA, 216 bp, Glycine max
  Peptide Sequence Number=SeqID_95563
atgcacccacgagtcacgcgtcgcccttccgccgaaggctttaatcttttggcatcatcaaaatcttcatacagcatatgcacttacaccttcttcactgagaaagggtttagtagttttgctttctgcattcgggatgataaaggccactttgttcaggtcttaatcgttggactccatttctctgcccccaagtgcaagaaggtgaagccatag

SEQ ID NO: 3879 - DNA, 819 bp, Glycine max
  Peptide Sequence Number=SeqID_95564
atggctcccaagaagcttccagccaagaaggcaaggaaagatgccactagagaaggttccagtgtggccccacaggagaggcaggtccagttgagggacggagagtacgctgaatttcaggagcaagttgccaggagacaatggactcagcttgcggcacccatggctaagggccaatggatccccttcgatgaggatgccattaatcagttcctggggcatccattggtcttggaggagggccagcgctgtgagtttagccagaggaagagtcaggccttgggatttgacgaagaggccatcagccagctgctgtgtgttccgggcatgaccaccctcacacagatttggatgacgttgctgatctcaaacgctgtatatcagtttgcagggatcacgcctcctagacacccaatggacccagagaagtccaacaaggcactggggtttccagctttgatcacgggcctttgtcaattctatggggtaccgggccagcagcagccaaccgtagatgcacttccaccacctctacaggagccaccatctctggattctatctttgcccacttgcagaggatagagctccagatgcacacatacatgcagcatgtgactagccagcaggcgactaatcacaggagtcaggacctcagtcctttcccatggcctacccctgagcagtccggggccacggttgcatggccgggagatgagcccgactttcagataggggcaggacccgcagggccccccggagatgaggatggagctcaggagtatgacgatatggttgatgtgttggagtacttcatgtga

SEQ ID NO: 3880 - DNA, 777 bp, Glycine max
  Peptide Sequence Number=SeqID_95565
atggttgagataaaagaagtgcaagagcaaatgaaggtcaatatggaggccatgaaggatcaaatgacctccatgatggaggccatgttaagcatgaagcggatgatagaaagcaatgtggccgcaatggccgctactagtgctgccgccgaggcggatccgacccacccatccaccataaaccaagcaaaccaaccaatcccagacatggtaggccagggaggggaggtgttaggcagcatgggtggtccacacatggggcataataggaattcttacccatatggcctaccccccaactatacaccacccaacgagaacgctaaccacgccgttcccattccctttgaaggccagcaaccccagttagggcatacgcctttcgctcagcctgtgggggacgcctgtgactttgaaccatacccgacgtttgcccctgagggaccgacgtgtagtgccgcagaaggaatggagaaattggagctcatcgaggagaggctaagagccatcgaagggattggtgattacccgttcgccgacatggcggagttctgcttagtgcctgatgtcgtcagatttgttaaggaacccgggtcgttcccctacaaaagtgacaagacggtgccatggaggtatgcaacgcaagggtctgatggaaggaaggacgcatctgtcgtacacgctaaagatgatttatcctctgccaaggtcactaacatctctggcacgagcaacatgacccgtagtaggtggatctttgcggcacccgagccacca

SEQ ID NO: 3881 - DNA, 528 bp, Glycine max
  Peptide Sequence Number=SeqID_95566
atgggggctgctaaagctacttatgaacagttgtggaaacataaaatgcaacagattaaggacatcaatgaagctacatatcattggttgtataaccttgagaggacaacatggtgtaagtatgatttctcacattacccaaagtgtgggaattgggtagctacttggggaggagatcgacattttgaagtcacagatattgcttcggtggaggaggtggagtttaaactggtcttattcagcatcaaaagaatgatattacacaaatcaaatgtacaaacaaaaacaataagaaaagcttttggtcctcatcaaaagcaacaggccaagcctagaaataggcacacaatggggcaccatgggcacaacatatctgccaatgaaacacttaagaaacttgctcctaaacgcaaggcaccaataacaaatattagaaattcaagcaaaagaattaaagggtgtcagctaccaactattgagaagaaggttgagctgggaattggattcctacttcacaataccaattaa

SEQ ID NO: 3882 - DNA, 1523 bp, Glycine max
  Peptide Sequence Number=SeqID_95567
atgggggagggtgggggcagggatgaggtttcgtggaacgcgatgatcgtggcatgtgggcagcaccgggagggattggaggctgtggagttgtttagggagatggttaggaggggtttgaaggttgatatgtttactatggcgagtgttttgactgcgtttacttgtgttaaggatttggttggggggatgcagtttcatggaatgatgattaagagtgggttccatgggaattcacatgttgggagtggcttgattgatttgtattctaagtgtgctggtggcatggtggaatgtaggaaggtgtttgaggagattgctgcaccggatttggttctttggaacacgatgatttctggattttcacagtatgaggacttgtctgaagatggtatttggtgtttccgggagatgcagcacaatggttttcatccggatgattgtagtttcgtgtgtgtgactagtgcttgttctaatttgtcatccccttctgtgggaaagcaggttcatgcattggctatcaaatctgacattccttataatcgtgtttcagtgaataatgctcttgttgccatgtattccaaatgtgggaatgttcatgatgcaagaagggtttttgatacaatgccagaacataacatggtgtcgctgaattcaatgattgcaggctatgcacaacatggtgttgaggttgaatcgctcaggctttttgaactgatgctgcagaaagacatagcacctaacaccataactttcatagctgttctttctgcatgtgtacacactggaaaagttgaagagggtcagaaatatttcaatatgatgaaagaaaggtttcggattgaaccagaagcagaacattattcatgcatgatagatcttttgggtcgggcaggcaaactcaaggaggctgagaggattattgagacaatgccatttaatcctggttctattgaatgggctactttgcttggtgcgtgtaggaagcatggaaatgtggaacttgctgtgaaagcggccaatgagttcctccagctggaaccttataacgctgctccatatgtgatgctttcaaatatgtatgccagcgctgccagatgggaagaggctgcaacagttaaaaggctgatgcgggaaagaggagtgaagaagaaacctggttgtagttggattgagatagataagaaggtgcatgtctttgtggctgaagacacttcacatccaatgataaaagagattcatgtgtacatgggggagatattaaggaaaatgaagcaagcaggatatgtaccagatataagatgggcattggtgaaagacgaagaggtagagccagatgagaaagaaagacggttactgtatcacagtgagaagctagctgttgcatttggcctgatctccactgaagaatgggtgcctatactggttgtaaagaacctaagaatttgtggtgattgtcacaatgccatcaaacttatttcagccatcactggtagggaaatcactgttagagatactcacag

SEQ ID NO: 3883 - DNA, 663 bp, Glycine max
  Peptide Sequence Number=SeqID_95568
atgtccagaattgctttactcacaattagtttaaaacctatgattagtggatatgttaggaataagaggctcatggaggcattggagctttttcgcaagatgcagagacaaagggttcagcctagtgaatttacaatggtgagtctgttaggtgcttgtgctcacttaggagcacttcaacatggggagtgggttcatgattatgtaaaaaagggtcattttgagttgaatgtcattgttctcacatcaattattgacatgcactgcaagtgtggagctattgtaaagggtattcaagggcaatcaaatacccacaatatctgtgggatgaatttagaatggctagaggtctcaggaagtggactaaaagggacaatcccaactgaaattggtaatcttcccaaactcactcatctcaatttgtctagaaattaccttgatggtgccacacctctttcactaggaaatcttatcctattacagagcctagtcatatcttgcaacatcgttcaaggttccattccctatgaattggtgtccttgaaaaatcttactgtcttagatttatctcacaacaaatcaatgcaaccttgcccatttaccttacaaatctcacattattacaaaagcttgacatatcccacaatttatttggttccctaa

SEQ ID NO: 3884 - DNA, 546 bp, Glycine max
  Peptide Sequence Number=SeqID_95569
atggttttatcagcaagggttcaacttttccaatttgttggaagtgcaagggctgtcaaagctggtgtagatgaaagagactttttatttggagctagtcaaggcaacctcttctttaccgttaatggagtagatatggtcattgatgttgttatgtggaaggaagtagctggtctgaacaagggaggagtccacatgtttgatgaaattgttgatgattacaacaagatgcagacctataggggaaggcttcttgatcctgctaggtcaagcaatcatgcccaggttacagatgatgatttacagattgtttatattctgaaatcagatattatgttgaagtgtcttcgtttgttggattatgagtttccttatgttttggattttaccaaagcttccggtgagattatcgaaaggcatcttaagaatcttggaatgaggtttgttggtcataaatggataatggttggagagcctactgctagaaactttgaagagatggaagaagatgatgaagctaaagctcaacatgaccctgcaccttaa

SEQ ID NO: 3885 - DNA, 447 bp, Glycine max
  Peptide Sequence Number=SeqID_95570
atggcttttttaaagatctccattcaggaattgtatgctaatttgtttgaccctgaggataaatccctgaggcagtgccgggtgcggggcaagctgattaagtttgatgttgcgacattgaacgagtttctagagacccccgtggttctggagccaggggagagatattcagcatattccagattctgtcaaaatcacccagaccctcaggagttcgcctccagattatgcattccagggcgagggtttgtgctgaatgctgagggagtgccttggaagctcctgaggaaggacctcactacattggctcagacctggagcatcctatcttattctaaccttgtccctacttctcacacgtccgatcttaacatgggcagggcgaggttagtatataggctggtgatgaagatggacatggacgtgggctccatcatttctggatga

SEQ ID NO: 3886 - DNA, 420 bp, Glycine max
  Peptide Sequence Number=SeqID_95571
atggcggatttaggtggcggatttgcgaaaaaacgccaccgaatagcggtggcgtggcgggtttgggatggcggcgccatggcggccgctatagccatggcggtcgtggcggttatggaggggtggcggaaaatggcgggatttgcttggtttttgtccgcggtaggagttgggccgacccgacccaaccctacccggttatgcattcaattaaatgttgtcccacgccgcacctcacctctgcgtccttccctcaccccgccgcacccagccgccgccgcccgcgacacccttacacgaagacgaaggccaacttcgcgcgagccccggcaacgcagcctcccgcgaccgcgacgcctcttctttctgtctcgtgaagaagacgaagaagacgaagacgcagacgcggtccctttttag

SEQ ID NO: 3887 - DNA, 150 bp, Glycine max
  Peptide Sequence Number=SeqID_95572
atgtgggtgtcgacggagcggtttccggcagatttcgggcgggaggagaaagagaacaacgattttaggcaggaggatgacaaagagaagaggcttggaaatgtcgacagtattgttaggccgctaaaaatgtatttgataactccatag

SEQ ID NO: 3888 - DNA, 264 bp, Glycine max
  Peptide Sequence Number=SeqID_95573
atggagaagaagctggtgtttgctacccgtgatgatgttttacattgggctcactcttgtggaagcaatgtcttccaaggttattttgatgatgccaaagaatcaagagtcaagaaaaacccaaagattcaagaatcaagtttcaagaatcaagattcaagattcaagaataatcaaaatcaagattcaagactcaagattcaagaatcaagagaagactcaatcaagataagtactaaaaaagtttttcaaaatattgagtag

SEQ ID NO: 3889 - DNA, 732 bp, Glycine max
  Peptide Sequence Number=SeqID_95574
atggtgatgctgactggctttgcgagtgagaagcataagggtgactccatcaatgattatggaggtgaacacggagcaagaaaaggaaggaggctaacaggttttgggcggattctggcagcattgtggtggtgcggcaagagaattccaatggtgattgttggagttgagaacaaagttgagaacaaagttgacaacgaatgttgcacacgctttgctaataagagtatgacacatgtacatgtgatattcttggatgcttttcgtgacctcaaccaaattggaagctacacatggggagttgttgtactggtccatatgtatgagaagtcgaatgatgcgtcaaagataagcgccagacaacttacttatgagcattttcctactgttgcttcttttattgctgttgaaaattatcatgagaggaaaccacgtgcttgccattggaagtctgggaagacattactgtgtgcattggattacaatgagtggttctacttcatatctcaccccttcatgagtctgacacagcctgaggatcctcctagacatccacccatggtgcacaatgatacatttattgaactagatcctcctcagcagtcggtcaccacaacgactatgccacaaccacctgcacttgctgatgtagacatgcctcgacatgcagtgggaatgtatatgttcggtcaagacgaaggtggcatacaccggacgcatgaagattgttag

SEQ ID NO: 3890 - DNA, 324 bp, Glycine max
  Peptide Sequence Number=SeqID_95575
atgggtcttgcgatgaactcgctaagtgagcctgcctcgctaagcgagttcatacattttgatgaatttctgggtttcaggatgaattcgctaagtgtgccttgttccgctaagcaattgttgtttttctgttgtcacgctaagcgtgccctgcgtgctaagccacttgctgctatttctatggcctcaaagaaaagatgtgcttcatcctctagaccacatgagctttatgacacatctcgatttgtgtcggagacagcttgggacaggtacgagcgaacgtccataacaggaatattctcccagagaggaatatggagttag

SEQ ID NO: 3891 - DNA, 234 bp, Glycine max
  Peptide Sequence Number=SeqID_95576
atgggctgctcttgctccaatgctggtgtggatggtagggtatcctcagagatagccacaactgaatcagaagcaaatgaaaagggctcaagagaagtaagctcatcttccgctgctggtgtatgctcctctgcgagctcaggctcttgggttgtggaggtctcacccctccagaaggaaaaggctggactcttggccaagccacctgagtgtgaaagtcttccatgctcatga

SEQ ID NO: 3892 - DNA, 876 bp, Glycine max
  Peptide Sequence Number=SeqID_95577
atgggagaaaagacatttttggctctagtcatgtttgttatgacatatggtttggcagcaacaacattcactgtatctcaaatccctccttcatgcaatggggatgaatcattactcaccttttgtgggccttatatggggaatatccaacccaatccaacttctgattgttgtaaagctgcaacttctgtgtttgacaaagccatggccacgggtcaaggacctgggtatagggccctaatagctcaccgttgtagaagcaagcttcatgatgaatcaagattgattcaaagaagttttgatgataacaaaggtgatgacaaaaagctcaaaggttcaagaggaaatttgatttcaagcatcaagaatcaagattcaaaggttcaagcttccaagaatcaagatcaagattcaagactcaagattcaagaatcaagagaagacttaatcaagataacgtacatctacttgggtttgactgagaacaagagagggtacatctcttgtggatcagttctagtggagggtacatccactaggttgttcaaagagaacaagggagggtacatcccttgtggatctttgcttgtaaaaggatttttacaaggttggaaaagaaatctcaaggaccgcaagtcgcttggggactggatgaataggttatttcaagatcatgatgaagaccaagtcaacttgtgtctcatgacaaaatctcatgaccacaacaaagaagaatctgtaaggaaaaagtggtacatcgacagtggatgttccaagcatatgacgggagatgtatccaaattcgcaaccattttctccaagaaaagtggacatgttacatacggcgacaacaatattagtaaaatctcaaaagag

SEQ ID NO: 3893 - DNA, 516 bp, Glycine max
  Peptide Sequence Number=SeqID_95578
atgtgggacaaaggaactaagaccacaaactctaacaacccgagcagtgtacgcagctcagcagggacttcactagccatgagcacaggcgcatcgctgatgtcttacataagaacacaaacctgtttgcttggcagcaatctgacatgtcgggaatccatcccagcattatctgccacaagctcaccatttgtccccaggaaaaaccgatatcatagaagaaatggaagatgggagaaaaacgacacaaagctattaaagaagaagtggacaaactcctcaatgccaacttcatcagagaattcagatattccacctggttcgccaacgttctcatggtcaaaaggccaacaacaaatggcgaatatgctaagcttcctgaacgcttactctagatacaaccagatcaggatgcatgctccagacaaggagaaaatgacattcatcactaaagatcccaacttttgcgatagagtcatgcctttttgcctaaaaaatgcaagcgctacgaactag

SEQ ID NO: 3894 - DNA, 405 bp, Glycine max
  Peptide Sequence Number=SeqID_95579
atggcttctagaaaaaggaaagtcgcagcttccaggcctcagcctcactacgatactcatagattcacctctgaggatgcctggaaccgctacgctctcaacgttcttggccggaacatccttccggaaaggaacatgaagctttttgtcacagagtttgatgagttcaggacaaagctagtcagaagaaactggcacaggacgctgactaaccttatggaagggagcatagatgtggctttagtgaaggaattttatgctaatctttatgtcccgggggataaacctccaaagcaagttagggtcagagggcatttaattaagtttaatgcagattccctcaacacttttctggagactccagttgttctagagtcaggggagactcttcaatactactcgcaa

SEQ ID NO: 3895 - DNA, 198 bp, Glycine max
  Peptide Sequence Number=SeqID_95580
atggttgtggagttagggcaacagacggtggacgtatccactctcgtcacactcgtcgctcacgataactcatttgattcattagcggcgctaaccaatccgaggacttatcgtgagcgaaatgggagatcgcttggaggatatgatttgagaccttggacaagactcttttcagcaagcacatacccctatgtatga

SEQ ID NO: 3896 - DNA, 1347 bp, Glycine max
  Peptide Sequence Number=SeqID_95581
atggtaaccattaaagcatcttacacagtccttccaaatgaaccaactccggagggccttttatggctatctgatattgatcaagtggcacgtctacgccacacacccaccatctacattttccatgcaaaacacaaccatgatacattaattgagaggatgagaaactctcttagcaagattttggttcactactatccaatagccggtcgattgagaaggatagaaggtagtggtcgattggaattggattgcaatgcaaaaggggtggtgttgcttgaagctgaatccacaaaaacattggatgattatggagactttttacgtgagtccatcaaggacttggttccaacggttgattacacaagccctatagaggaacttccctcgctactagttcaagtaacaacattccatggtggtaaatcctttgccattggagttgccttatgccatatcttgtgtgatggggttggtgccattcagtttatcaactcttgggcaaagttagctcgaggagacacattggagccacatgagatgccatttctggatcgaacagtgctcaagttcccacaccctctgtcgccgccgcgctttgatcacctggagttcaagcctttgccacttatattgggaagatctgacaacacagtagagaaaaacaagaaggttgatgccaccttgctgaagctaacaccagaacaagtggggaagctgaagaagaaggccaatgatgactcaacaaaagaagggtcaagaccttatagcagatttgaagctattgctgcacatatatggagatgtgcctctaaggctcgtaaactagataagaatcaaccaactctagttcggttcaatgccgatattcgcaatagactaattccacctctccctaagaattattttgggaatgctttgtccttaacaacagcatcatgtcacgttggagatgtcatatcaaattctttgagttatgctgctcagaagataagggaagcaattgaagtggttacatatgagtatatatggtcacagatagatgtgattagaggtcaggagcaactggataatgcaagggctttgttctttggacaaaatgaaggaaaggatgccttgttttatgggaaccctaaccttcttattacaagttggatgagcatgccaatgcacgaagcagattttggctggggaaagcctgtgtatttaggtctaggaagtgtatctacacaagatagggcactgattattcaaagccctgatggtgacggctctattattctgtccatacactttcagatggaacatatgcagcttttcaagaaatatttttatgaagatatgtga

SEQ ID NO: 3897 - DNA, 694 bp, Glycine max
  Peptide Sequence Number=SeqID_95582
ctctcttggtgacttgaattctatagcttcggcttctcccttggctctgtttttcgactcttctcttagtttccaccaacttcagtgttttaaaggctacttggacgtttcagcttctgaaggctcgcttagtgagactgactcgctaagcgagagtaacacatctctaactgatcctcttctaggatttcccaacacgctaagtgagttgctgccaactcagcgtttaggagcaaaggtggttatgaaatcctccaaatggtgcagtttgctcaatttccttttggccctaaggttagtgcttgtctccccactgtctgcttgtaattcttccttgctctatcacttcataacattccctggcccatcaaaaacaccttgtcctcaaggtgttggctgtaggaagattgaacctggatcccaaattagaatgggtgtaggaatgagtgaatgtctattagtggcacggaggcagaaccagttagcggcatcggtgtgcaagatgacgctgccgggcagcatggatgagaactctggctccgatacgggtcgtgacgacaaccacaccgcttgcgccgcactgtgtattatcggcagaggggcacctatgatgacaacttcggcgtacccacaaggacaagttcctccaggcgttgctgggaacttcctcgccggcgtggtggctgttgattga

SEQ ID NO: 3898 - DNA, 429 bp, Glycine max
  Peptide Sequence Number=SeqID_95583
atggggccctgcggcacccctacacctcttaggtgctccacgttggggatcaaatggttgatcaagccacggccgcgcggaacaaggcagtacttgaggctgccttccaagaggacggagtttccgatgaggagtttggggaggtcggaggtggagaggccgatggagaggaagaactggagcttgggcagaatggtcttttcgggtttgatcttgaggactatggggaagcgtttgacaaggagggacaactggagttcggagaatccgaaggttttgaggagtaaagaagagaaatgggtttgggtggtttcagctttcagatgctgtgattgcaattgcatgacacattacgaggagagtcccatttgtgggttgcacaacacaacggtgagttgttcgatcacctgtcaagaaatcgggttatag

SEQ ID NO: 3899 - DNA, 999 bp, Glycine max
  Peptide Sequence Number=SeqID_95584
atggttagcacccgatttggcttcatacgtgagatcccttttggaggctccaaccctccaccaatagccatgacagatactgatactctccaaaaaatccaaaaccgtattggcgatgagcactctattcacacattgcttaagcgcacccaaggggaatcacacacccgacacatagtgaacactcaagatgatctaagtctctcccatatgcaccgtccagtagggcagactactcatcgacatcccttagtcaaatgcatcatggaagttgacatacccttaggttggaaaccactcaacctgaagcgatatgactggaccaccgatctaaatgaacatttagatgattttctgactcaggcaaatttgtacactaatgacgatgtgattttgtgtcatgtattcccaacgtccctcaagagggcagcattgacctggcctggcaagtttgcggataattcaggaatgaagtcagacaagccagacaagccagacaagcaccaacctctctcaaaagggtctaggtacgagcgttacacacccctgacggccaatcatactacaacccttgaggaagctttcaacttagagcttcacaccatctgggacatcgacatcaactatgttgatgcaccatcaccacaaagtctcctttctatcactttcacgaatgtagacttcaagggtatcaaccctatcaaccaagacgaccccatggttgtctccatcataatcgccaacttcatggtgtccaaggatcaagtaaagactagaggctatatcaaccttatgactaccttcggtcaaggcacactctctaggagcttcacaaatagttatctaatcatcgatgtaaatacctcttacttttcttttattggaaataagacattcaacgagcttggagccatcgtctccatactgcatttgaagatgaagctccccaccttgacgggagagattgtgactgttaaggcaggtcaaaagttagcatga

SEQ ID NO: 3900 - DNA, 345 bp, Glycine max
  Peptide Sequence Number=SeqID_95585
atgtcactacttgttgatgggttaaccaaggtgactacggataagtggatagatataaccgacatggaatatgtcattgcatcaaggtataatgtaatcgttgtatccttgtctaaacaacaaagcatgacattctttcctcttagaagtcaactgctagcaaattcttcattgtatcgtataatttgtatcggtcatgtgtacgacagtcatttcattgagaaagtgcgtgacatgaccttgcatagcaagactacacatgcagatctgatgcaagataaagcgtatcacgtcattggtgtagttgacaacacatacagaaagcatgtgcatgcgcatttttaa

SEQ ID NO: 3901 - DNA, 213 bp, Glycine max
  Peptide Sequence Number=SeqID_95586
atgacgaacgaaaagccatggtttgggagcttacctagacggtggatggtgataaagctccctcgacggtggacgacgtcgttgctcttcgcggaagcctcatcaatgcacctcgcaacctcttcacggaaacctcctattcatggcaacaatggtggcaagctcctcaacgaagaagaagaagaagaacctgttcccacaacctccttttaa

SEQ ID NO: 3902 - DNA, 252 bp, Glycine max
  Peptide Sequence Number=SeqID_95587
atgtcattttttttgttggagaggaagaacaacagcaatgacgcgaacaccagaagaggagcaagcatatcagaggaagaggaagacaaagaaccggtcttaggcagaggagaaggaaagttgcacagacgaataattaggagtatttatagtattggggttaagggcattttggacttttcaccatcgttgctggtgccccagcaaaaatgctggatgcaccaagatacaccctcttcactcgagtcttga

SEQ ID NO: 3903 - DNA, 180 bp, Glycine max
  Peptide Sequence Number=SeqID_95588
atggagtttgttgagtcgaaccctctcttccaaaaccccaaatacatgtcttattttgtgcttctcctccaacttggtgtgagattggcgtttggagggttgatttgtgtggatgaggatgggggtgagggtgagggcacactagaggtgggagagatgggtacttgtagggattcctag

SEQ ID NO: 3904 - DNA, 429 bp, Glycine max
  Peptide Sequence Number=SeqID_95589
atggtttcgaaacatgagactagagacaaaccactgaacaatggattttcatcattaacagagaacagagacataccttcaatggcttccctgggagtcttaaagccagcccaatggatttcgaaaatcgattcccaccctttccgggactctttccttgcccagttttcttcgagctgcgaaagtgaccaaatgttaaaacaaaaggatgtacctcaatcaataagtggcagagacgaactcggcaaagacgaactccacaatgtgcttacagtgacggcagggcagggcagtttgcggcaaagacaaactcaggtggaaggagaaagaagaagaacaacagggttcaagcgcgcggggtgtgcaatttcagataatcataatgctttgacaattgttagcgtgtgggcacctgtagttgttgtataa

SEQ ID NO: 3905 - DNA, 613 bp, Glycine max
  Peptide Sequence Number=SeqID_95590
tctaagggttgaatctcaacactttgctactgtacatgatgacaatcctcgtgtagcttccatgccttactttggagttattgaagaaatctgggagaacaagctaaacaagtattttatgttcaagatccttgtgatgaaagatgatgatgattcaacccttgatacttgtctcactcctttctctatgcaaatgtcgagtaacgccaacggagaagaagaaattgacgacgtcctcgcaaatcgcacatggctacaccacccagctcacctcctcatcctcctcttgagtcaacaacaccttcttcatcgtctacgtcgaagaagacaagaaaagaaacatgattcagatcagattgtcgctcatgataaggtggatgttacatatgataattggaaacaagtccctgtcgctcaaaaggatctgatctgggaggatattcgggctaaatttgatatttctgaatcatccgatttgaggacaaagaaaaaaaatacttcagaccgtaggagagcggtggagggcgaggatgacaaagtctgtgagaagtacgaaataagcaaagaaaagtggatccagttttgtcagagccgtagagaaccttcatgggag

SEQ ID NO: 3906 - DNA, 402 bp, Glycine max
  Peptide Sequence Number=SeqID_95591
atgaccatgattacgaattcgagctcggtaccccccaaggagattcttcatggactgtcaccttcaaaaagcatagaacatcaagttgatctccttccaaaagcttcattgcctaacaggccaacttacaatagcaagccccaagagactcagcataaggatgcacaggccaaagttgagtatgtgaaaagattgtatgaccaagtgaaggtgcaaattgcaaagaagaatgaaagttatgccaaacaagccaacaagaaaaggaaggaagtggtacttgaacccggtgatgatccaggacatttgagggcaaatgttttccaagaaggagggaatgatgagaatcctgaaactggccaaatacaggctaaaggcccaagtggagaaggacaaagcccctga

SEQ ID NO: 3907 - DNA, 84 bp, Glycine max
  Peptide Sequence Number=SeqID_95592
atggggatgaggaagcaaggcgagtccaactcgcctaggcgagctggacaacaacctcctcccccttttcctataaataggtga

SEQ ID NO: 3908 - DNA, 861 bp, Glycine max
  Peptide Sequence Number=SeqID_95593
atggcttctccacttgcctcgcctccttctcctcttcctcgtcctcctcatcctccttcagacgcatcagcttcaccgtctgccgtgaagcggacacgcagagcctcactggtccacattgatcctgctaccggtaaggccgacggtccccataggaagaaattaagaacttatttggggattgtggcacgtgataaggtggacatcacgtacgagaactggaagaaggtctctactgctcagaaggacttgatttgggacgatattcagagacttttgacagtaggacaaaaaggaagttacttcagactatgggcgagagatggagccgatcacgacggtgtggatgacactgtctgtgaaaaatacggcataagcaaggaaaactgggcccagtttcgccagactcgcagagacccttcttgggagaagctcctggctgagaatacgaagaagaagctggaggaagctgcacagtcaggaagcattgatggtgtcatcgacccttcatccccggttagacgccacgtgaagtggaagatggcccgcacgaagaaaacaggggagatgacgaaagaggccgcaaaggaaatcgctgagaagatcgattcctttaaggagcaggcgacacaggaatctttcgtcccctatggacgtcaggatgttcttaccgctgctattagacgttcagagcacctggacgtgtccgtgctgctggagccggtgtcaccatcaagcactactttggttcgactccacgggtttttcaataaactgatgttggttatttctaataacatcggttatttatacataaccgatgctaatatacaaacgttaacattggttatttataaataa

SEQ ID NO: 3909 - DNA, 709 bp, Glycine max
  Peptide Sequence Number=SeqID_95594
atgaagaagctggaggaagttgcacaatcaggaagcgttgatggcgtcatcaaccctccatcccccgttagacgccacatgaagtggaagatggcctgcaccaagaaaacaggggagatgacgattgaggctgcaaaagaaatcgctgagaagatcgcaagtcattttcaactaaccattagaattatatttctttatttggtgaatgccatgtgcaaatgtgtcttttctgtgcaggattcctttgaggagcaagcgtcacagggatccttcgtcccccatggacgtcaggatgttctcaccgctgctattggacgtccagagcaccctggacgtgtctgtgctgctggagccactactaaaaaaaaggctttctacatcgctccattaacatcggttattgcgaaaaccgatgttaacgaaagcgcgtcgctgttctctttctcctcccacctgaaatctgttggaaaccgctccctcgacacccacattgttttcaatactacaggaaacccctcgctcgaacccacagaaccccctacactgctcttggaagtgtttcttgaagaaaaccctacatacactcttggtactagggtgctgaaacactcgtgcgtgctcaaagctcaaagctttctccgcaaggaaagcttcaagtttcgtgccattttgttagatctcactgccattgttactgtttgggttcgag

SEQ ID NO: 3910 - DNA, 483 bp, Glycine max
  Peptide Sequence Number=SeqID_95595
atgcaacttcaacaagtagagaagtcaaggaattcattggaagtgtttggctccccaatattgagtagcaggagcaagtcttcgagctttgataaaaagttggcaaagacctcttcctcttcttgggatgttgctcctaaaattgaagaaactaacttctcagcaatttctggtggaaactacaatgatgttgatagtgatgcaagttcaaactttaatgtaaatattgattcggagaagaaaaagaatagtttgggcataaaaattgctgctgggatagcaactgttgcttctgctttagcaatatctgcaataatcattttcctgatttctagaagaaatatgaaataccagaagaagattttcaggaaacgaatgttgcctctcataccacagtggcttcaactcctcttgaaatcaagttgtcagcaaattgtgctgcaagaccagtcacaaatattgaagccagaggcggaagaatag

SEQ ID NO: 3911 - DNA, 284 bp, Glycine max
  Peptide Sequence Number=SeqID_95596
cacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccccgtcagtagctgaacaggagggacagctgatagaaaacagaagccactgggagcacctcaaaaacaccatcatacactaa

SEQ ID NO: 3912 - DNA, 515 bp, Glycine max
  Peptide Sequence Number=SeqID_95597
gatggcatagatcacatcttagacctcactcctgtagcagagaaaaggaaagaaagcctcaagaggctaacattaacctcccatacttccattggaaggacaatgtagaagcttacttagattgggaaataacaatagagcaacaacttaaaaggaagtctacttcaaaatcttatgactctcactcatatccaaagaaagatcaaggtcaaggcatcttaggggcggcaccttctaagcccaaagatgataaagggaagacaatagaaaaacaaccccctaacactagtatgcaagagaagactagctctataaagtgctttaaatgtcttggaagggacattaattctcaatgccccaccaagaaaaccatgattatgaggggccaagacatttatagtagccaagatgaggctactacttcaccttcctctagtgaaagtgaagaagcaaaaggggaagaatctagtgaagaaatctacccccaagaagaaggacaaccattaagtggttaa

SEQ ID NO: 3913 - DNA, 132 bp, Glycine max
  Peptide Sequence Number=SeqID_95598
atggagcaagttagcataggacaccagaattgggggatggcctttgtggataactgggtggtaggtaaggagaagggttgttattggctaagtaatgacattgttgagctggtgggggagtttccattgtag

SEQ ID NO: 3914 - DNA, 588 bp, Glycine max
  Peptide Sequence Number=SeqID_95599
atgaccgaattttacttcccccggtcttcaaatttagcacaagcctttgaggaggatttgattctgatgtgggcttttctcgccggtcgtcagattgattgggcccatttggttcggtaccgaatgcataaggcattacgggccaatgcacctctaccttatccacacttgataactttatttctgcgtcattttcaaattccgcttgatgatgagccatttgttcaagtcaagtgttcctttgctattggtgctggtgttatgacttcctttggttaccataaggatcagaatggtcaatggctgaagaaagacacactccctcctcaagatgagcgtactccttcacctcttcctcagtgtgaagattcagcactcctgaatgaagtccttactaaattacgaggtattcgttcttatgttggtgaacgtttcgactcattggatacacgctttgctggcatggatattcgcctcacacaagttgaagaagatgtctccttcatccgtacttgctttgatccaccacaccgcctccatcatcctcttagattaattgttattattattatgactgagtcttattag

SEQ ID NO: 3915 - DNA, 290 bp, Glycine max
  Peptide Sequence Number=SeqID_95600
catccttgccaaataggccaacttacaacagcaagccccaagagactcagcataaggatgcacaggccaaagttgaggggaatggaagctatgccaagcaagccaacaagaaaaggaaggaagtggtacttgaattcggtgatgatcttggacatttgagggcaaatgttttccaagaaggagggaatgatgagaatcctgaaacagaccaaatacaggctaaaggcccaagtggagaaggacaaagcccccgagtggagaaggatgaaggcccaagtgagaaggattaa

SEQ ID NO: 3916 - DNA, 393 bp, Glycine max
  Peptide Sequence Number=SeqID_95601
atgggtgacatagaagaggtgcaggaacaaatgaaggtcgatatgttggccttgaaggatcaaatggcttccatgatggaagccatgttaagcatgaagagaatgatggaaagcaatgcggccgtagctgccgccgccaatgctgccattgaggcagatcctacccatccatctgtcacaaatcaagcacaccaacccatcctggacatggtggggcaaggaggagaggtgttgggtagcaccagaatgaagaatcacaggagcaggctcaaggtgacttcgacccgtatcccatattcactgccgagggaccaacgtttaatgctacgcctcaacccaatattgcgggagctcctcaaccctgccctctgcaaccgctgcatttctcagtaa

SEQ ID NO: 3917 - DNA, 174 bp, Glycine max
  Peptide Sequence Number=SeqID_95602
atggggccagaaatctaccctaaggctcataagaaccctagggccttctcttgcatctttggcccattctacttggggtcttctatccaatgcccttgcaggggaattggaaaggaggattggtgtcatcccttgaagaatttgagtcaagaagcaaggggccaaccaccttaa

SEQ ID NO: 3918 - DNA, 531 bp, Glycine max
  Peptide Sequence Number=SeqID_95603
atgccatatgtggaagccatagaggagtcattagaaacggccttccagtcttttgaggtggttagcattacctctatagattccttctctgggcaacctttcctatccgatgcggcagtaatgatggcccgagtgatgttggggaatggttacgagcctggaatgggtttaggtaaggacaatggcggtataaccagcctaatatgcgctaaaggaaaccgtgggaagtttgggttaggctataaacccgcacaagcggacataaagaaaggcattacaggaaggaagagcggaggtcaatgctcgcgattgggacaagaagtcaaagaaggcccgccctgccacatcagtaggagctttataagcatgggtctaggacacgaaggccaagtcgttgcgatatgtgaagatgattcgccaagtgggtcggagttgaatcaaacagaggatgaagaggacgaggatgtgggacttcccccggagttggagaagatagtcgcccatgaggaccaagaaatggggcctcattaa

SEQ ID NO: 3919 - DNA, 240 bp, Glycine max
  Peptide Sequence Number=SeqID_95604
atggacttgcaagtcgacatgcggttcgatgccatggattcaaggatcaccaaggttgaagatgtctccttcatcccttgtcttgatttcagggattgtcatcatcaaaaagagggagattatagacaaaggatcaagctgaatgttttgatgatgccaaaggatcacatgtttctcaaagctttattcaagacaaagaaattaaagatattcaagatggatgatcaagacagtctctag

SEQ ID NO: 3920 - DNA, 51 bp, Glycine max
  Peptide Sequence Number=SeqID_95605
atggacatccgtctccgtgtgattggtgatcccatgaatggagttcaacgg

SEQ ID NO: 3921 - DNA, 786 bp, Glycine max
  Peptide Sequence Number=SeqID_95606
atggcatcattggtggattggctcgccaagttaaaagtcgtcagcaaagagaattttgaagcaccggaagaggacgaagaagtccaagctctcaaaagcgagttaggaaaggcaaaactcgccaaggagaagttcaagttggctgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaatagtgaactcgagttgcaaagggaagaaagagaccagtcgcgagcacatagcatggttctgaaagaggagttaattgcttgttcaaggtccaaaagaagcttgtctcagcgtttatgcgagacggagaccaacatgctagctatcatcgccaagtaccaagaagagttaggtctagccacggcccacgagcatagaatcgtggatgagtatgctcaagtatatgcggaaaaagaggctagaggaagggtgatcgactctttacaccaagaggcaaccatgtggatggaccggtttgctcttaccttgaactgggagtcaagaacttccccgcttgttagccaaggccaaggcgatggcagacacctactccacccccgaagagattcatgggcttctcggctattgtcagcatatgatagacttaatggcccacataatcagaaatcgttaggaaacttgtatggtctctcagaccttgactggatacgacttcctttttag

SEQ ID NO: 3922 - DNA, 120 bp, Glycine max
  Peptide Sequence Number=SeqID_95607
atgaatttccgaagccagcgagcatccgctaagcgcaacatttattggctaagcgcgaggaagaatatggaagaagatgagttgtacaagttcgctgagcacaccgcttcatctcactaa

SEQ ID NO: 3923 - DNA, 315 bp, Glycine max
  Peptide Sequence Number=SeqID_95608
atgatggcacatcactgctgctcagaaggatttgatatgggagaatattcaggatgtgcgaaaaagacacaggccatccagaagcaaaatgctgccccccacgtgttgtctcttgggggttatgaatatttagaacaaaagctcatggcagaaaagacaaaaaagaaactagaggaagctgcacagtttggaagcacagatggtgtcattaaccctccgtctcccatcagacgccacgtggagtggaagatggcccgtacgaagaaaattgggcagatgacgtctgaggcaacaaaggaaatcgctgaaaagatc

SEQ ID NO: 3924 - DNA, 141 bp, Glycine max
  Peptide Sequence Number=SeqID_95609
atggctgaagaggcaaggagagtgacccttgaagattactcaagttcaaatactattcgattgagcttgttttcattctcattgtctggagaagctaagaggtggcttcactcgttcaaaggcaacactcttaagacttag

SEQ ID NO: 3925 - DNA, 668 bp, Glycine max
  Peptide Sequence Number=SeqID_95610
tacctatcttcttcagagggctacatgtccacgccatcagagggctgcacgccctcgccttcagagggtcgcacaccctcgccttcatagggctacacgccctcacctttagagggctgcacgccctcgcctttagaggactatacgtcctcacctttagagggatgcacaccctcgcctttagaaggactatacgtcctcaccttcagaggactacacatactcgcctgcagaggactacacgtccttgccatcagaggactacacggctacatgccctcacctttagaggactacacgttcttcaccttcatagggctacatgccctcacctttcaaaggactacacttccccgccatcagaggacgctcctcaccttcaaaggactacacgtcctcccttcagaggactacacgtcctcgcctttagatggcttcacgtcctcgccttcagagggctgcactcctcgccttcagaggactgcacgccctcgtcttcagaggtctacacgtcctcatcttcagaggtctacacgtcctcatctttagaggactacacgtcctcgccttcaaagggctacatgtccccacctttagagggctgcacgtcttcgccttcagagggctacgtgctcttgccttcagtgggatccatatccgcaccttaa

SEQ ID NO: 3926 - DNA, 84 bp, Glycine max
  Peptide Sequence Number=SeqID_95611
cgattatgtggaaattcttcatcgttcttcggcgttcttcaccgttcttcatccattcttcgttcgttcttcatttttcaacgg

SEQ ID NO: 3927 - DNA, 192 bp, Glycine max
  Peptide Sequence Number=SeqID_95612
atgtcgcgggggtcaggagaccttggggacgtcaggtggggtgctattgcccaaaaccaagcttggccaatcccgacccaacccaggcatagtcagccaggtttaaaaattgaaacagaacgttcagtagctgctggtaatcgattaccatttgtgtgtaatcgattacacagtgctatatgttgctggtaa

SEQ ID NO: 3928 - DNA, 648 bp, Glycine max
  Peptide Sequence Number=SeqID_95613
atggatagagctaggttggtctatggcttggtgactaacatggacatgaacatcggagcccttatctcaggtcagatttcttctattgctcagagtaactccgctaggctcggatctctagccttgatcactgccctatgcagagctagaggagttacctctaacagtctaacttatgagagcctaagcccggccattaacttggcctacataaagaaaaactgttggaatatggatgatctaacagttaactttagaggggcgaggaaggcaagggtgagaccagctgatgttccttcttcttctactctaccagctccttccacttctgctactcctacaccagctcctctaggctcatctactcaggactctcagcgctttgaagccatgcttcagagtattcatcagggacaaattttattactgcagagcttacaggtgatagctcctctagggtcaattttgtcaatagagcagttcattgagaaggtatcctggcctggaaccttgccttctgttgtgagagaaggtgagggtcctagtgctcaagtacctcaacaggcaagcagggcacaggtaaggcaggaggctgctactctagagagattgatcgaacccagcaagtgcaccagatcgcgcaagtag

SEQ ID NO: 3929 - DNA, 432 bp, Glycine max
  Peptide Sequence Number=SeqID_95614
atgacccgcagaccgaacgatccgcagcggcgcgagcgcatcctgcaggcgacgctggataccatcgccgcgcacggtattcacgcggtgacgcaccgtaaaatcgccagctgcgccggggtaccgctgggctcgctgacctattattttagcggtattgaggcgctgattgaggaagcgtttcgtaacttcaccgtcgaaatgtcggcgcagtatcagcaattcttcaacggcgtcggcagccgccaacaggcctgcgacgctatcgccgaacttatcttcagcgcccagcagccgaccggcgctgaaagcggtcatgcagagctggatgctgcgcagccagcagacgctggagcagtggttcgaaccggcgacggcgcgcgggctggatgcgtttatcgaggggatgacgctacacttcgtgaccgatag

SEQ ID NO: 3930 - DNA, 336 bp, Glycine max
  Peptide Sequence Number=SeqID_95615
gtggtggcggtgcgtctattgcccgctaccggccatcctaatgctactgtggtgtttcgccctgcgcctgtctggggcgcagtacttcttgatgaaagctcgattagtagggggcctgatgcccttgctggaggtgacagaatattgctaagtagcaatgtcatctatgtaagagtggtcatgttggtgcgcatgatccgcactcgtctctttgcagcggcacgggtgaaatcttgccccagtatgcatagtagcagtgtgatagcctccctctctagttgtgctcgcacagttggccctcctccaatatcagggggtggcccaggaaccgtttaa

SEQ ID NO: 3931 - DNA, 111 bp, Glycine max
  Peptide Sequence Number=SeqID_95616
atggagaccaccaagggggaggagcttgccacccaactcgcccaggcgagccaggttgcttcctccagaagcaaccgccttctggaggaacatcttggaaggcccaagtga

SEQ ID NO: 3932 - DNA, 162 bp, Glycine max
  Peptide Sequence Number=SeqID_95617
atggagcagaaggagcagtcagtgaggaaagaggcgcagtcgatgatgccacgtagaagatttcgaggcagagataaagcacaaggatacattgatgcgtgtgtttctatcggagaatggacttttcgtggactcatctctaaccagttaagttctttttaa

SEQ ID NO: 3933 - DNA, 978 bp, Glycine max
  Peptide Sequence Number=SeqID_95618
atgacagtgggctacatggaagaactattctttatggcaaaacaagctaggcaagtgttttacatccaagatccaaatgattctagattatcagtggttatacaaggaagaccaattggtattagggaacaaaatgatcatgcaacccttgacattttgaacaacctaaggtggatgacgtacatgcgattcataatgatcatgatgaaagtttatgggagaacattcatgcttaactgcgttgtatcaatggtcatgggaacaccgccaaggtcccctccacagtcagatggtaattcggaggctacgcctaagaagacaagacaatccacacgtcttagaaggttgacattaagaaccttatatcagcctagaccaacggttagtgtcgatcctgcaactagaagaggatcaagcccaaaaaaacaaaagttccacagctatttaggggtcgtagctcaacaaaagatcccaattgtccatagcaattggaaagatatgctgaaaactcttaaggacctagtatgggatgacattttgtctttgctaaccactaaatttgtctatgttgacactgaaggccaacaaaaagaagatccttctataaaatatggtatggatcaacaaacttgggatgaatttactgcaagtcgtaagacccctacctggcagtgtatcacaggtgtcgcaacctacccttcggtgggagggcgacgcgtgactcgcgggatgcgtgttccacgaaaggaatacgcgcggagtcgccaccaacgtttatttgaggaaaacgtcgaaaaaaccggaaaagacgcgatctacgaacttttaagtgaaaggttcgggagttgtatttacgcacggggaaggagagaaacgttaaggcattggaccattaacgatctcttggggtggtcgacaaaagcggggcttttgctcctacgtatcctcaattgcgatgaggaaatcagacctacgtag

SEQ ID NO: 3934 - DNA, 291 bp, Glycine max
  Peptide Sequence Number=SeqID_95619
atgaagaaccggtacatccatagtgacccaattgttgtggaagatatagaagaggatgctgacattcctctcattcttggccacccattcatgtctactgcaagctgcatggtgaacatgggaaagaagatactgcagatgggcatagaagaccagaagatcagctttgatttgttccatgaggacaaagatccacctcaccaaaatgtttgtctgaaagtgcatgtgatggaggaaaagagacctgagaagaaggtccctgaagtaagaactctcttagatcctggataa

SEQ ID NO: 3935 - DNA, 180 bp, Glycine max
  Peptide Sequence Number=SeqID_95620
gggcagaatcatcttaggccacagtcggaggttgagacaaagctaaaagcaaaaaccaatcaaggggttgtaggggatgaccttaggcctagagtgcatcctgaagcaggggggtatgccacattgcccccactctcttgctattcatacctaaacatgcgcccaccaagtgctcagtga

SEQ ID NO: 3936 - DNA, 90 bp, Glycine max
  Peptide Sequence Number=SeqID_95621
atgaaaatacgaaaaaggggtcccatgaaccctaagagaataagggtgttgaggaaaaaagcccagagtttcaagaacctcgggatttga

SEQ ID NO: 3937 - DNA, 84 bp, Glycine max
  Peptide Sequence Number=SeqID_95622
cgattctgtggaaattcttcatcgttcttcgtcgttcttcaccgttcttcatccgttcttcgttcgttcttcgttcttcaacgg

SEQ ID NO: 3938 - DNA, 664 bp, Glycine max
  Peptide Sequence Number=SeqID_95623
ggagcaatacttggctgggataggaggcagagcaatcaaatggtttcctcgatggaaggaaggaaatgagggagttctcttctcatgtggggactacccaaacattctgttgatagggacgaggggttgtattaactacaatctcgcacttgctataagacagttagggtaccccatgaggggagcaccgacggaagagagcctctcgcctttccttgtgagagattttggtgcacaaagtttcaagattgtacaaagagtccacaaggcgtgggaaatcccgttaagaaaagataaagaacttaggggcatccataattgcatcatcggtgctccggaagagaatgaagaagtccgagctctaaaaacagagctaggaaaggcaagactcgccaaagaaaaattcaagttagtcgctacagacgagttagctgcttgctcaagatccaagaggagtttggccaaacacttagaagccacggagcaaaggagattagaagatgtggccacatccagaagattcatctaccagtcgctgcaggcagcatgcatggtctctggtggcggtgacaaaagcgatgaatgtctgtttcatctcggggaattacacgacatggaaacatgccccgcggtggaagagctacttcaacggctcctggactga

SEQ ID NO: 3939 - DNA, 312 bp, Glycine max
  Peptide Sequence Number=SeqID_95624
atgaattgcgttttcgttcatgtgtcctccaccgtcgagtttggagctatgcgtagtgattgcttagtgcaattctccattctcaatctttttcggagccccatgaattgcgttttcgttcatgcatcctccacccatgagtttggagccatgcgtagtgattgcttagtgcaattctccattctcaatcctttttcagagcccatgaattacgttttcgttcatgtgtcctccacccacgagtttggagccatgcgtagtgatttcttagtgcaattctccattctcaacccttttttcggagccccatga

SEQ ID NO: 3940 - DNA, 636 bp, Glycine max
  Peptide Sequence Number=SeqID_95625
atgacattgaccatcccagagcttttcttgaggccttatcaggctatatgggatgccaccgtgttcggggtcgttaatccagatttccccctctacataaagcacgaagacctctccgaaatcgcacacggtggtcaatgtctcagcatatcagtgttacagttatggattctgaatctcactgaaacatgtatgcgagtagggaattctgatatctatggattcctcgagccacagtccattcagaggtctgggcaatcacagtttgagtctgaaagttacataaagagttggatgcagagttcacaacgtgatgtctatcttggagcttacctaaatgggccagacaactaccttaaggggattattaatagtgctatcaagggtcttgatgatgctccacaggctaaatcaaaggcttctgcttggtggattgtcgtcaagtgtaatagacaaaaaggaagtactgagtgcggctactatgtgatgcactggatgtccaccatcattttaggaacttttaggaataattgggaagtgtattttaacgatcctagaccattggagctagagagattaaaagcattgcggatccagtgggcacagttttatctccgagttagagatcagccctag

SEQ ID NO: 3941 - DNA, 333 bp, Glycine max
  Peptide Sequence Number=SeqID_95626
atgacccgagcattttcgctcaatccatgggtgtcataccctaatttcgtccggggacctttgctcgatgacgtgcgaccattctttggtcctcgtgagcacccaggcccacttgggccctccagaatattcctccagaaggctgttgcttctggaggaagcaacctggctcgcctgggcgagctgagctcgcctgggcgagctgggcggcaaccacctcccctatttgctataaataggggaggaagtgaagaagaaaagggttcagcccctttggcacttctctctctttcgaatttgcttggaaaaatcgtttccgtgaagaaaatctaa

SEQ ID NO: 3942 - DNA, 318 bp, Glycine max
  Peptide Sequence Number=SeqID_95627
atgtctattcaaagctttgggttcaataactccaatcacgtctataccccacatagagaacgaccaaggagctgtcaagatgttcaaaggtatgggcggagcattgacattatcggcaaaggcctggcacttgtggcacttcctcacatggatgtaacaatcattttccatagtgagctagtaataccctgctctcagaatcttctgggccatggcatgtgttgcaaaggatccctcatgcacttctaccagcatttgcttagcctctctggtatccacacatcgaagcaaaaccatatcatggttcctcttgtatag

SEQ ID NO: 3943 - DNA, 159 bp, Glycine max
  Peptide Sequence Number=SeqID_95628
atgtcattgcctagcgctgttcatgtgtctccattatcaagtgcgaagcttctgaagaaaaaagaaggaatggagatgagagtcgtcatcacagaaagggcaggacggacgaaatcagtgtcctatctttgctttcctcttatctccgatgagaggtaa

SEQ ID NO: 3944 - DNA, 147 bp, Glycine max
  Peptide Sequence Number=SeqID_95629
atgacgctctcacttaggaaaactaggcagcaagtgtcgatatcaccctgtcgtgcacaggcaactaccctccatggtgatcaacctgagtctcaaggaagttccaaatcgagtgacatgcccccaaggatgcttaaaactctttaa

SEQ ID NO: 3945 - DNA, 318 bp, Glycine max
  Peptide Sequence Number=SeqID_95630
atgacccctactcatgatgccctgctatattacaatgggaggtggaacatgccatgccaaaatgagtttgttggttactcgttcacaggaaaaaatcccaaaaagtttgacatttctttcggatgtaccatggatgaactaaaggatttgattaagcaagttgtgcctcatgggattcccccttatggtatccatgaaacacaaatggtgttagcgcagtctaactactggaaaaaatttgggccaacagaatttttagttgtttttagtaaatatgttatggaaatggaagacgacttgttcttgtcgcaaaattag

SEQ ID NO: 3946 - DNA, 391 bp, Glycine max
  Peptide Sequence Number=SeqID_95631
gctcacttcactactccgtcaagcatgctctgcgtcctaatgagctttcccagatgccagccatggatgtggccagtaaaggcagaaacttcaggaccatcataaagaagatggagaattttgtcattgtcgaagaacagagagtagaaacccgaggacccataggaatatgcattttcgccaatggcaaagaaaccagcaaacagggtttgggctttagaaggtttattctccgctctcgtctgaaacctgaaacccttttcttcatcgtcggcagaagcatgtcattgtcatcatcaagcaatgcctacaacgtgccatgggtagaaaagtatcgtcccatcaaggtcgccgacattgtcgtcaacgaggacgccatctccaggaaact

SEQ ID NO: 3947 - DNA, 204 bp, Glycine max
  Peptide Sequence Number=SeqID_95632
atgcttgtaagagcggcgatcgacagcttgctgtgttggatatatgagcattttccctctgttgttgagtctttgagtaatccagactatgatgagatgtcaccacgtgtctgccagtggattgctacgaaggcttcttcgaagtcattactagcatcgacgtaccggaaacgtctagatggactgacgattgctgatgtttga

SEQ ID NO: 3948 - DNA, 270 bp, Glycine max
  Peptide Sequence Number=SeqID_95633
atgaggtggtggcttgcggccttggtcgatgataatatgttgggtggggtgaaaagaaagagaaggaaaagagggaggggggttgagaatgctcatttgtcattaaagagacttctacaaaactcccttggtgacatatgcagtgtttgggaagcaatgaacaacatgatgacacttcaacacacccaaatccaagcatcttttgagacaagtacgcacatggttgagcatgtgtttaaagttgccttgtacaaaaaactacttggcatg

SEQ ID NO: 3949 - DNA, 326 bp, Glycine max
  Peptide Sequence Number=SeqID_95634
atgactagaggcaattcatttgacttacaaccctttgatcctgagatagataggacatttcatagattagttaggcatcattttgtaccttttgagcatcctgagcattttgttattggtaattttgaacatcctgattttgagcattatagttttgaacattctgagaacatgtcacaacctccaacccatgagaggactctaagggaaatggctgcacctgatttcacctacgaaagcttgtgcatccaataccctgatgaggatgccccatatgttcttaaaactggactgatccatttgcttccaaagtgggatcctctaga

SEQ ID NO: 3950 - DNA, 237 bp, Glycine max
  Peptide Sequence Number=SeqID_95635
atgaaagtcaaacacaagcgttatgcaacaaatacgctagactcaagcctacatgcaatgtggtttcatttttcagtgaaaaacctcgtcaggggcctaagagtacatgacaggacatgcctcatcatggggagaccagttagggtcactctattttgcgagaatgctccaaccatatgcgatcagcacatgcttaaaggaatactcaaaccaggtgtatttaccccaaaggcctaa

SEQ ID NO: 3951 - DNA, 168 bp, Glycine max
  Peptide Sequence Number=SeqID_95636
atgctgccatctctaaagctcgagaaaacctccatcttcctcctcgacgactttgacacccatgaggccttccttcaagtgatgatatcgttgttcaagatctaccgcggtctagctggcctcttcaattatgacccccaaggttgcattgctaaagtccaagattaa

SEQ ID NO: 3952 - DNA, 483 bp, Glycine max
  Peptide Sequence Number=SeqID_95637
atggcatttttgggagaaacaagtagtcagaccattgtcaactctcgattagcttttatttttccaaatggatcgattattcacaatgaatttagtgtttattttcaaagttccacttcgatacccattcgagtacctaatgattgtggttttgaaacactaaaaagcagaatgcacaatacccttcaactaaccaacgatcaatatttggatgaaatttactaccggcagccatttgcagatgcagccattatgactcctactcatgatgctctactgtattacaacaggaggtggaacatgccacgtcaacacgactttgtgggttattcgttcacagaaaaaaatccaaaaagatttgacatttcttcaggatgtagcattgacagactgaaggatgtgatcaagcaagttgaacctcaagggattctcccttatggtattcatgaatcacaaacgataaggcgattgttttttcgatag

SEQ ID NO: 3953 - DNA, 276 bp, Glycine max
  Peptide Sequence Number=SeqID_95638
atggaggccataaaagagcaaatggccacaatgataaaggccatgatgagcatgaagaagataatggaagccaatgcggttatagttgccgctattagcgctgtcgctaaggtgaacccgatgctcccatctggcctcaagcaaatgaatcgtccaatatggaccctcagtttcgcccaaaccacaaccattgcgttttgtggtgggaagagcccctcctgctatggccgaaaagggaaaggcggatcatctaaaggaaaggctcagggccattga

SEQ ID NO: 3954 - DNA, 366 bp, Glycine max
  Peptide Sequence Number=SeqID_95639
ggatcgcgcttgcaagacacccagtggacccgaagaagtccaacagggtcttggagttgtcaagctctaattacgggtctctgtcagttctacggagtacctgtcacctccagcaagggcatcaggccccctactaatcgagctttcatcaagaagtactgcgtctccaggcaggcgcagggcgaaacaccacagcagcctggggatggccggcagcaggaaacagacacaccgccaccacctttagagttcacctctgctcatccacaaaaaggtttgagtattgcctacaccacatggccgaccaataggcgaccaagtccaaagccaaaggtagagagataccttagatgtgcgtgtatgtag

SEQ ID NO: 3955 - DNA, 420 bp, Glycine max
  Peptide Sequence Number=SeqID_95640
ttgatcacgggcctctgccagtcattcggggttcccgtcacacctagtaaagtgatccgaccgccgatcatccgggccttcattgagaagtattgcaagcctaggcaagcgctgggcaatgcaccacaggccgcggatgcaccaccaccacctcatcaggctgatcctgccgggtcattaggcatggagcgatatctacagcacttggttcgccaccttagtcagcagggccagggttttgttccttttgcgtgccctactccagagcagtttaggactgaggtcgcatggcccggagattggcctgaggcccaagcaggggaggcgcctgcagaggctcccggcgatgcagaggaagcccgcatggatgaggagatgacgggtttgctcggtttcttgggtgggagcggagccacatga

SEQ ID NO: 3956 - DNA, 246 bp, Glycine max
  Peptide Sequence Number=SeqID_95641
atgacaatcaattcatggggctctggacttgatggtggaggacgcaggaatagcgctaggcattcaattcgtggggctcgagactcaatggcaatcaattcgtggggctccggactcgatggtggaggatgcatgaatgacaatcaattcatggggctccagataagatttgatggtggaggatgcacgaacaacgctaggcaatcaatttgtggggctccggactcgatggtggaggatgcatga

SEQ ID NO: 3957 - DNA, 417 bp, Glycine max
  Peptide Sequence Number=SeqID_95642
atggatgatctaacagtaaactttagaggggcgaggaaggcaagggtgagaccagctgatgttccttcttcttctactctaccagctccttccacttctgctactcctacaccagctcctctaggctcatctactcaggactctcagcgctttgaagccatgcttcagagtattcatcagggacaaattttattactgcagagcttacaggtgatagctcctctagggtcaattttgtcaatagagcagttcattgagaaggtatcctggcctggaaccttgccttctgttgtgagagaaggtgagggtcctagtgctcaagtacctcaacaggcaagcagggcacaggtaaggcaggaggctgctactctagagagattgatcgaacccagcaagtgcaccagatcgcgcaagtag

SEQ ID NO: 3958 - DNA, 563 bp, Glycine max
  Peptide Sequence Number=SeqID_95643
gtagaaatgaatgggccccattcatagacattctcgcactgttgatctttggaggagtcctcttttcgaatgtggatgggttggtggacctggcagcgatcgacgcttttctcgcctatcataaccacaaggaaagcccagttgtcgctatgctagccgacctatatgacacgttcgaccggggatgtaggcccgtctatccgctacaaggtcaccgctcgtgcgtcgaaaaaggaaaggcgaattgggaccaactcttggctagcatggaggggcgtctgttaattggttccctcgctagaaggaaggaagaatcaggattctatcttcaggcgaaggatgacagagagcttaggggaagcagtaatgggatcatcggcggctatcataagtggctgagagttcgaacacaaggattggattggctcccaaatctaaagactgtgagggacgatgaggttaaagcttcggaagaaagtgatgaggtacaagccctaaaggcagagcttgaaagagcccgagtagtcgaagagaagttcaagtccatagccatcaaagtctga

SEQ ID NO: 3959 - DNA, 72 bp, Glycine max
  Peptide Sequence Number=SeqID_95644
atggctacaccaatgagtattgcttgctatttagataaagatgaaactgaaattaatgaagcattggcttga

SEQ ID NO: 3960 - DNA, 1779 bp, Glycine max
  Peptide Sequence Number=SeqID_95645
atgtctgaagaaaaaatcatggccgcgccacaatcggtcacggcgagcgccggaaattatctcgcgctgatactggcaatactgtttttttccggtttgctttataaggtcgaaggctttagctggctgggcgcgtttgatttcaccacgctgggcggcagctttggcaccatcaaagagtcaggttccacctttctcggcgccggtggcatcagcgccaaagccggcttcctgttcgcgctgtcgctggcacccactgtgatgctggcgctgggcgtgctggagattttcacccactacggcgcgattcgtgccgcccacacgctgctgacgccactgctgaaaccgctgatggggttgccgggacgctgcggcctggcgctgattaccgatctgcaaagtaccgatgccggcgcggcgctcacaaagagatggcggatcagcagcaaattgacgcgggtcaataataatccgtttgatatttttattgtcggcgcgcgtaaaggcttccatattgctattcacaatctgatgcccaatgtggtgatggcctacgtactggcggaagtgctgaatctgctcggcatcatgcagtttcttggccacgcgtttgcgccgctgatgggaattttcggtttgcccggcgaggcgatcaccgtgctgctgactgcgtggctgtcatcctcggccagcgtcggggtggcggtgagcctgatggccaaaggtctgctgagcggtaccgacatcactatcctcgcgccggcgatttttctcatgggttcgcagttgcagtacatgggccgcctgctgggtgtcgccgatgtgccaaaaaaatactggccgctgctgatgctcaccagcattatcaatgcggttatcgcaatgaagttaaaacttcggcctacatcgccggccagctggaacaggctggcattaaggtcacgcgcggcatcaaccagaccaccggcatcgtggcaggagatcgacagcggcgtgccgggcccggtgctggcattgcgcgctgacatggatgcgctcgggcatgtgatcgacggcgttgcctgcgcccgccatacctgcggccatgacggccactcgtcggtggtgctgaccgccgcgcaggagttgctgcaggaaggcgctattaaaaaagggcggctgaagctgctgttccagccggctgaagagctgggggccggcgcgctggcgatgattgagggcggcgcgctggatgacgtggagatgatcctcggcttccatttgcgcccgctggaggagtgccaggtcgggcaggcgacgcctgcggtgatctattcagcgtgcagcacgctggaggtcaccattaaaggtgttccggcccatgccgcacgaccgcatctgggcgtcaatgcgcttgatgcagcagtccaggcggtgcaggcggtgaacagcattcatctggcaccgggcctcacctggagcgtaaaagcgacgcgcttcctgtgcgacgccggcgtgaccaactcggtgccggacgaggcgcgcgtggtgtgggatctgcgttcgcaggagaacgcgccgatggaactgcttaaagagaaagtcagccaggcgattcagcacagcgtggccgcgctgggcgcaaccgctgaagtggtggtgttgaaagagatgccggcggcggaaattgatgccgatgccaccgcgctgctgagcgccgcgattgtcgatgtgctcggcgagcagggattactggcggcgaaaaccacgccgggcagcgaggatttcttctactatccg

SEQ ID NO: 3961 - DNA, 261 bp, Glycine max
  Peptide Sequence Number=SeqID_95646
atgcagcgtgttgcttcgtgcccctattcaagggacctatatgggagggagctaactaggcttttagtgataattcctaaggtggtcatatctctcttgatggtctctagagtggagtcgccaactgtcgcaacctaccctttcagcaggaggtcgatgcgtgactcgtgggtgcgtgttccaagaacggaatacgcgtggagtcgccaccaatgtttatttgaggaaaacgtcggaaaaaccggaaaagacgtgatctaa

SEQ ID NO: 3962 - DNA, 225 bp, Glycine max
  Peptide Sequence Number=SeqID_95647
atgcctttttgcgggcgagcgaggcgaggctctcgggtgagtcttccaaaggaggaaaatgcgcggagtcgccaccaacgtttatttgtggaaaacgtctggaaaagccgaaggaaaccgatcataaagaatattccagatttgggagttgtatttacgttcgaggaaggtcgacaaaagcggggctcttgctcctacgtaccctccatcgaagaggaaatctga

SEQ ID NO: 3963 - DNA, 198 bp, Glycine max
  Peptide Sequence Number=SeqID_95648
atggaggttgaagaagaagtcctgaagcgcaagcctcacgctaagcgaatcttttgttatgcgctaagcggagagtctctggcgcttagcgctcaatccttgcatctcaagctgatttggtctgctaagctgaccaaggctgagctaagcctatttcaacttgatctgaattcggctaagcgatggcctgctcgttaa

SEQ ID NO: 3964 - DNA, 252 bp, Glycine max
  Peptide Sequence Number=SeqID_95649
atgcgtgatgacgcgggtcatgtcccttcccccatccttgaaagggagcctcctcgacagtcggacgaggttcacgaggatcgtagagagtatgcccaaggaggcatcgatttctaccccccggtccccgtcgaggggctggcacccaacatactgcctcagcccaacctcccagcactaccaatattcttgtccacagaaggaccaccctcggcagcggaagaaagaaggaaactcgatctcatcgaatag

SEQ ID NO: 3965 - DNA, 492 bp, Glycine max
  Peptide Sequence Number=SeqID_95650
atggatacctcagagccctacactggggcaatgaaaggcaccattaccctcgccttaagagggctacacgtcctcgtgttcaagggactacacgtcctcgccttcagaggactacacgtcctcaccttcagaagactacacgtcctcgcctttagagggctgcacaccctcatctttagagggctgcacgtcctcaccttcagagtgatatgtgccctcgccttcacgggactacacatcctcgctttcagagggctgcacgccctcgcctttagaggactacacgccctcgccttcagagggctgcacgtcttcaccttcagagggctacacgcccttgcctttatagggctacacgcccctgccttcagagggctacacgccctcgccttcagaggactacacgtcttcgccttcagagggctgcacgccctcgccttcagagggttgtgttcgcaacgacaagtgtgccgaatcgcacaagtagtataa

SEQ ID NO: 3966 - DNA, 578 bp, Glycine max
  Peptide Sequence Number=SeqID_95651
gtctccgtgttgatggagcaccattaattggtcaaacaaatcttgattgggctgatttatgtgatgaattgttaggagtcagaccacaggaaggtgaacttcaaggcagtgtggttaaattaagttggtctgctcaacatttttcgcaattaaataaccatgacggtgacgtacaacaactacaaaggtttacccatgcatggatccttagattcataggaggtgtcctatttgttgataaaagcactagcaaagtttccctaagagagatgtgcagcgccaccgattacaaaactaaatcaatcggagatatatgcatcttaatccaaatgtgggcatgggaacgattcacgactttggctccaaagaggactcctcccgtaatagaaaaaaaaccactcagacacaggtggttgcggcgtggaaatcaacatattggtaatgatgatctcatagtttttcgtcgcaaattggatatcacaaaacgacatgagtttctgtgggagccttacacaacaattgtgatgtcagcgttgcctccaatttgtttggttggaagtgtagcatggtgcacggtg

SEQ ID NO: 3967 - DNA, 549 bp, Glycine max
  Peptide Sequence Number=SeqID_95652
ggctacacgccctcacctttagaggactacacgtcctcaccatcagaggactacacgtcctcaccttcagaggactacgcgtcctcacatcagaggactacacgtcctcaccttcagaggactacacgtcctcaccttagaggaccgcacgtcctcaccttcagaggactgcgcgtcctcaccttcgtagggctacacgccctcaccttcagagggctacacgccctcgccatcagaggactgcacgtcctcaccttcgtagggctacacgccctcaccttcagagggcttcatgccctcgccatcagaggactgcacgtcctcaccttcgtaggactacatgccctcacctatagaggactgcacgtcctcgccttcaaagggctgcactccctcaccttcagaggactgcacgtcctcaccctcagaggactgcacgtcctcaccctcagaggactgcacgccctcagctttagagggctatgcatcctcattttcagtgtgctccacatccacaccttaagagaatttaaggtcctctgcccttaa

SEQ ID NO: 3968 - DNA, 500 bp, Glycine max
  Peptide Sequence Number=SeqID_95653
atgtttttcgcatcaggtctttacttccagaatatcattgaggtaccctctgtttatcataaacaatgggctccagattacccgaattatgtggtgttggactacaatggaaagaagcaccatataagagttagaaaatttagtaaccgagtttacattggtgatggtctcaaacacttcaggagggatatgggaatatatgaaggtgtgatgatcacatttgctgcgccagacaagaattggaagtttgatatccacttttcaccgccactgcatacacagacatgtggcaggcttgcccattctgccagagaatatgtgtttactgtggatgtcgacaatcgcatgattgttagactttatccattggtactgtcactcgatgctgtgagttatgttaatgcaagagacgagtatgttactgtccttggtgttcatgggcgtcgtcacttttggaagttgagtatgcataatgggcttcaatgttttgctgagccatg

SEQ ID NO: 3969 - DNA, 1244 bp, Glycine max
  Peptide Sequence Number=SeqID_95654
atgggttggtggaccgggcagcgattaatgcttttctcgccttttacgaccgcaaggaaggctcggttgtcgctatcttagccgatctatatgacacattcgaccgaagatgtgagaagaacaatgcgaggatcgttttttgtacaccggctctctacgtatggttgatttcacacttcttttgccaagagatgagacacgtttgcccgctagaaagccaccgcttatgcaccgagaaaaaagaggaaaactgggaccgactcttagcaagcaaagaaggagcgcctgtcaattggttcccccaatggaaggaaggaagagctgggattcttatttcatgggcaccatcagaggaaggcctcacaccttttattgcacgaggtttcaatagcaccaatgcgggggtcttcagaagtccgcaaggcatgggagatggtgcaaaggaaggacaaggaattaggggaagtagcaacgggcccattggtggctaccataggtggttgaaagcctacatgcaaggtctggattggctcccgaatttgagaaccactaagggggtggaagttgaagctccggaggaggacgaagaggtgcaggccctcaggacagaactcgagaaagcccaaactgtcaaagaaaagttcaaatcaacagctcttaggatccgaaaggagaatgtcaaactgagagacataaatatagccaccaccaaggccttggaacaagagaccaaaagggcctgtagggaagaacatgaccgaaacaaattccgaggggctttgtggggcagtaacagcgagcttaagctttggagagagaaaagggaccaaacacgagtagacagtttgatcttgaaagatgaattgaggatttgcctaaggtccaacagaagcttgtctcagcggttatgtgagaccgagaccaacatgttagccatcatcagcaaataccaagaagaattaaatatagccacggcccacgagcacaaagtggcggacgaatatgctcgagtgtacgtggaaaaggaggctagaggaagggtgattgactcgttacatcaagaggcaacgatgtggatggaccaatttgctcttactttgaacgggagtcaagaacttccccgattactggccaagtccaaagcaatggcggacgcctactccgcccccgaggagatccacggactcctcagctattgtcagcatatgatagacttaatggcccatataattaggaaccactag

SEQ ID NO: 3970 - DNA, 363 bp, Glycine max
  Peptide Sequence Number=SeqID_95655
atgcaggttagctcgcctgtgcgagctgagctgacctgggtgagcaacccctgcacgaagagggttaaaaagggggagggggaaggtttctgcacccaaaaaactctcccccccccctcattcaaaaaacaaaggctcacgggattcacgagttttgcatcccttaggtcaccatttttcgcgtttttgattccattttgctctattattcatctccgacaagaaatggctccgaaaaagctttccgtgaagagatctaggagggacactgcggctgaagggaccagtgccgctcccgagtttgatagccatcgtttcaggagcaccgagcaccaacagcgcttcgaggccatcaaaggatag

SEQ ID NO: 3971 - DNA, 285 bp, Glycine max
  Peptide Sequence Number=SeqID_95656
atggccccaaggaagcttgcctcaaagagatccaggaaggataaagcgactaaaggaaccagttctgctcccgaatatgacagccaccgttttaggagcgctgagcaccaacagcacttcgaggccatcaagggatgggacgacgagtataccgacttccaagaggagatagttcaccggcggtgggcatcactggttacccccaaggccaagttcgacccagacatagtccttgagttttatgccaatgcttggcctacagaggagggcgtgcgagatatgtga

SEQ ID NO: 3972 - DNA, 499 bp, Glycine max
  Peptide Sequence Number=SeqID_95657
gccaacttacaacaacaagccccaagagactcagcataagtatgcacaggccaaagttgagtatgtgaaaagattgtatgaccaagtgaaggtgcaaattgaaagaagaatgaaagctatgccaagcaagccctcaagaaaaggaaggaagtggctaaaggcccaagtggagaaggacgaaagcccccgagtggagaaggatgaaggcccaagcccatatgatgaggacataaccaagggcaaggaccatgaagcacttgaaggtcccatgaccagaggcagacttaaacaagcccaacacgtcatagagacaaggctgacttatcaaggtaatccttgtggcgtctaccccgacttatcttccttcaccggaagtggcgtctaccctgacttatcttccttcaccggaagtggcgtcatccaaatcttcgtaacctgtatcaagcgatccgctcctactcaggttcacatcatctggtatcagagcttcggctcttga

SEQ ID NO: 3973 - DNA, 135 bp, Glycine max
  Peptide Sequence Number=SeqID_95658
gaaaagaaaggagaagcttgccacccagctcgcccaggcgagctaggttgcttcttccagaaggcaccgccttctggagaacttcctggaaggcccaagtgggcctggttgctatttgcaccccttgtttactaa

SEQ ID NO: 3974 - DNA, 479 bp, Glycine max
  Peptide Sequence Number=SeqID_95659
atgcctgagcggggcgaagccagaggaaactctgtttccctcacgatagctggaatcaagcttatcgataccgtcgacctcgaggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 3975 - DNA, 1347 bp, Glycine max
  Peptide Sequence Number=SeqID_95660
atgttacccttagagcatcattttcgctatcaccctcccttaaccctcaccaaattgaaacccttttcccgcgcaaattctagggtttcccttccccatatcgacaactccttccatcgtttcaaccccaatccgtgtcgcttccgatgccctatttcatccaacgattcgcttaggtttggtttgagggtcggccaccgagcatcatgggtgtgtcgttccaccggagaacccgattccgcggcggattccggtgagaagaaaaccggaagcagcagcagcgatgaagacgccgattcgaaccggaggaagggcgggtggtggtcacggtggcgccggtggcgttggcagcccctgattcaggctcaggaaattggggtcctgcttatgcaaattgggattgcgttcttcgttatgcggttgctccggcccggaattccgctacccgggtcggatcctcggtcttcgacggtgtttgtaagtgttccttatagtgagtttttgagtaggatcaatagtgaccaggtgcacaaggtggaggttgatggggttcacattatgttcaagttgaaggctggtgttggaacaagcaacgatgatggtggtgatgttgttgcaagtagtactagcagtactactaggttgcaggaatcagagtctttggcgaaaagtgttgcaccaactaggaggatagtttacaccaccacaaggcctagtgatatcagaacaccctatgagaagatgctggacaataaggtggagtttggttccccagataagcggtctggcggattctttaactctgctctgaatgaagcaattgttttgttttaccaaaaaaatttcactcagtcaatgctgaatatcaataactatgatgaaggggcaggagtaaaatctaggtacttcggtgtttacttcttcttgaagagaagagcagttagagatgtggatgcagctccaatcctttggcttctccatcgattccctgtaagcttttctcagcatacggctggtcagatatggaaccgcaaatcaggcccttctgctggtacaaagtcatctgagcaaggagaaacaatcacttttgctgacattgctggtgttgatgaagctaaagaggagttagaagagattgtggaatttctgcgaaatccagacagatatgtaaggcttggtgctcggccacctcgtggtgttctcttgaaacactctgcaggaattattctttccaaaacagagacagaattacaacaattagaatcagaatattcactcaaacaagccaagattttgagagcttggttctctccctcccaaggtctaaaccacacatcttcaggataa

SEQ ID NO: 3976 - DNA, 108 bp, Glycine max
  Peptide Sequence Number=SeqID_95661
atgtcggatacgatgctaaaggcccaagtggagaaggacggaggcctaagtggagaaggacaaagcccccaagtggagaaggatgaaggctcaagtggagatggatga

SEQ ID NO: 3977 - DNA, 294 bp, Glycine max
  Peptide Sequence Number=SeqID_95662
atgggtgaagtagaggaggtgcaagagcagatggaggccgacatggaggccatgaaagagcaaatggccacaatgatggaggccatgatgagcgtggagaagataatggaagccaatgcggttgcagttgccaccaccagggctgttactaagcacgcctttccgccatatggcttgcgtctcaactatacgccacccaatgtggcgtacactcccaataagaatgtcaataactccacttctatacccattgagagccaacaaccccaaactgatcatgcacatgtctcttaa

SEQ ID NO: 3978 - DNA, 340 bp, Glycine max
  Peptide Sequence Number=SeqID_95663
atgggggataagcttcatcgtcgagagggaaacagcccggatcaccagctaaggcccctaaatgaccgctcagtgataaaggagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaaggggcctaagatcaggccgaagggcgtagtcgatggacaacaggaggctaggttagccgaaagtggtatcggtcaggacgcag

SEQ ID NO: 3979 - DNA, 428 bp, Glycine max
  Peptide Sequence Number=SeqID_95664
atcctaagacgggtcactcagataggtgcggcttgtacatcgaaacagatcctgcccgcctggttaccctagggagagtttatgagggatccactattgttcataacactcctttgttgtctggccaagtaaaggtgggtgtggaagaggttacagatgcagatgctccagttcctgtacccactgatgaggtttccttagtggggcagatacttcacaccttccttgcttggtcgacacatctggtcaagtctttatcacaacaggtagttgtgtctctgccaaaaccacctccaaagcccgatccggaggtcgatgatccgctttatctgatgacattgaccatcccagagcttttcttgaggccttatcaagttacatgggatgccaccgtgttcggggtctttaatccacatttctcgctctaa

SEQ ID NO: 3980 - DNA, 447 bp, Glycine max
  Peptide Sequence Number=SeqID_95665
atggttcttaagacaagtcgtcgctttgtacctgtcgaaatcaggttctcctgtgaggttgggttgaggcagtatgttgggtgccggcccctcgatggggaccaaggggtagaaatcgatgtctccttgggcatactctctacaatcctcgtgaacctcgtccaactctcgaggaggctccccttcaaggatgcgggaagggatgatgtaagctccattggagcttgtaggcctaggatcttcttcatcaatggattcctttgcttcttggaagatgaatggcagcggaatggagaaaggaagagagagaagagacgccacttcaaggagaagatgagtctagaagaagctcaccaccatagaaggtcatggataagagcttggaggaagaaggagatgaatgaagggagagggagagaagagcacgaaattttgtgctctaaatga

SEQ ID NO: 3981 - DNA, 402 bp, Glycine max
  Peptide Sequence Number=SeqID_95666
atgggccccgacgggtgcagagaaacgcgaggaactgggactagagaggcggcatgcaaaccgaggcatgattttagcatccaaaaggtcaaatttttctcctttgtggctgagtatgaagtcaaatcaagggaaaaagcaaatttcataagcttttctccctctttccacattgcttttcttcttccttcttctccaccattgttgtccattgaagctccaaaatccctcctcatttctactcaaaattgcaaggagaagccatttttggagtcttggagcacacctctacatcgtgggacttcgaatttcaggcatgggtggacttcttctcacatgaaattcgtgggtgttgggtttttgggagttatgatgggtagttctactaggttattgccttag

SEQ ID NO: 3982 - DNA, 338 bp, Glycine max
  Peptide Sequence Number=SeqID_95667
atggcggcacagctaatccgtgatcgagtagagatggagtgcctagagggagcttgggagaccctcgaaggcaacacgaggtgccgatttcggggcaccattcgattcatggctactttctttgtgatcgaggtaacgtcatccgaggaagaccctgaggaggatctggaggagctacctcctgagcctgctgtggatgcccttgactttctagagggtgatgaggatccacttcttgaggtggattctcccgaggaagtcatgtcggcatctgaggcagactctacggaggatagtggcccgagggagatggcgatcagcggaggctcttcatccta

SEQ ID NO: 3983 - DNA, 221 bp, Glycine max
  Peptide Sequence Number=SeqID_95668
ggttatcatttactactgctaattggcgttgctgtggaagcgctttgattatatctttgaagcctcgaactcagggctgggcaaagcctttctccagctgtcttcttcgaaaattccctttagtagggattctatctttgatcaatcgccaagcaaatattgttggttttaaagggattttgagctgccataggtcctctaaagcctcatccacagtctga

SEQ ID NO: 3984 - DNA, 249 bp, Glycine max
  Peptide Sequence Number=SeqID_95669
atgaatcggccaacgcgcggggagaggcggtttgcgtattgggcgctagcggagtgtatactggcttactatgttggcactgatgaggctgcaccggtgcgtcagcaggaatatgtgatacaggatatatttccgcttcctcgctcactgactcgctacgctcggcgttcgactgcggcgagcggaaatggcttacgaacggggcggagatttcctggaagatgccaggaaagatacttaacaggggaa

SEQ ID NO: 3985 - DNA, 414 bp, Glycine max
  Peptide Sequence Number=SeqID_95670
atgattggcaagcgggtttgtttttacgttgggctggtcctcttgaaacgtcagccatctgacttctatcaaattttggaccttgtgtttaaaggccaagcactgttcggtggagtggcccagggttttcccatggtatgcacaggttgcatcagggttataccactttgggaaaggaggctggtagatctttcaaggagatatcacaaccatcttgttggcgacgagggatggcaagaggtcttcgtacgtcattgggatcggggggaatgttggcctcgggggaaagttccttatcgtgttggaaatggcgccaaagtgggcattgccggccaggcgagtcggggttggagtcgtagcttggggggtctccctctggatgggcataggtgccctagtttgtacgggtgctga

SEQ ID NO: 3986 - DNA, 480 bp, Glycine max
  Peptide Sequence Number=SeqID_95671
atggaagtatcagttggtctatgtcgttccgacatagataaggatcatgcccacaagacacctagtggacccggagaagtccaacagggccctagggtttccagctctagttacgggcctttgttagtcctacagggtgctcgttccccccattttacggagtgcccgtcgcccccagcaaggtcatgccatcatgacatagggatcgcgcccgcaagacacccagtggacccgaagaagtccaacagggtcctaggatttccagctctgattacgtgcctctgtcagttctacaaagtgcctgtcgcccgcagcaagttcatcaggtcccctattaatcgggctttcatcaagaagtactccgcccccaggcaagcacagggcgagacaccacaacatcctagggatggccagcagcgggcaacaaacgcactgccaccacctctagagttcacctcagctcatccacaaaaaggttag

SEQ ID NO: 3987 - DNA, 507 bp, Glycine max
  Peptide Sequence Number=SeqID_95672
atggcttccatctcggaggtcatgttaaaactccagaaaaccataaaggataaagccacggcaaccgcctccagtacagttagggaagcggagtcggtgctgcagcccgccttgaatccgggcctagacagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 3988 - DNA, 255 bp, Glycine max
  Peptide Sequence Number=SeqID_95673
atggaacaagtgtccaagtggaatttgcttcaagagcttggatttcctcatgcattgctcgacgccattcaagataaggaacaacttgatgatagaactaagctattaggtggctatggtgattggctacaagtctggtcagggttaggtaaggcactgctcgaggagaaaacttgttccttgatgatggaagagtggaaacaaatgctaaacatccaaaacttcttaaggcatgatagtcaggttcctttttga

SEQ ID NO: 3989 - DNA, 258 bp, Glycine max
  Peptide Sequence Number=SeqID_95674
atgtctaatgaagaattgaagttgaaggatccacgatgtcggatacaatgtcctgacatcctgctcgaaaacactggaagtgctgtacaatgcaagataaaaattttcaggaagaagatagatctcctccagcatcaagaacttgcagcccagaatcgtacacggctatataatcatggaggctgcacgagttctgacttgagtgtttttgtgagccaccttgatggtatactaacatcaagtgttggacctgagtga

SEQ ID NO: 3990 - DNA, 150 bp, Glycine max
  Peptide Sequence Number=SeqID_95675
atgaagaactggatgcagagttcaaaatgggatgcctacctgggagcctacctgaatggtgctttgaaaggagttgacgatacttcacaacccaaatccatggctgcaggtgctaggtggattgttgttaaattaacgttgaatatctaa

SEQ ID NO: 3991 - DNA, 603 bp, Glycine max
  Peptide Sequence Number=SeqID_95676
atggtgaagaggatgaggaggaaggggtggttgagatttgtgtccctgaccgtggcagcacacacaatagaaagggagaagcgaatgtcgaagagaaggatgctgcgactggatggctttgtgtgggaccggttactggcggttgggagggggtcggaggagagtgtgtggtgcttgttaacgggaaggtgggaagttgccatgggaaggggaggcaacgtggtttctactgttggtggaggcagtatggtttttgctgttggtggtggtttagcagaggaagaagatgggttggttaccttgggaagcaaaggcgacatagatggtgacttctcaaaggcagaagatggagagggttgtctgggtaccatggtattcagtatccggagaatgtcatcaagtttggaagcaatggaagtttgggctgcagtagtggaagtttggattgcagcaagtttggccatggcggcctcaagacgatccacacaggcggtggaaagttcggtgtccgccattgaagagtggcaggtcggaccaattgttagcggtggttcccttaagttcgagactaagggtagtctccaagaggaagaaaggaaataa

SEQ ID NO: 3992 - DNA, 324 bp, Glycine max
  Peptide Sequence Number=SeqID_95677
atgccaggaagatacttaacagggaatgagtcgtattacaattcactggccgtccttttacaacgtcttgactggaaaaaccctggcgttacccaaattaatcgccttgcagcacatccccctttcgccagctggcgtaatagcaaagaggcccgcaccgatggcccttcccaacagttgcgcagcctgaatgacgaatgggacgcgccctgtagcggcgcaataaccgcggcgggtgtggtggttacgctcagcgtgaccgctacacttgccagcgctgatgtccggcggtgcttttgccgttacccaccaccccgtctctag

SEQ ID NO: 3993 - DNA, 510 bp, Glycine max
  Peptide Sequence Number=SeqID_95678
atgggtaaagtgaaggaggtacaagagtatatggaggccgacatggaggccatgaaagagcaaatggccgcaatgatggaggccatgatgagtgtgaagaagataatggaagccaatgcggttgcaattgccgctaccagtgttgttgctaaggtgaacccgacatccccatccgacatcaaccaaatgaatcatccaacctcagataagacacatgaaattcgccaccacaatctagccgacttcgagccttggctcagatatgccattgaagggcaaacagttggtggtataccccttgaaaacacttcggaaggccctcaatatcacccccagctatacctcttgcattccacaacaagtaaaaaccctcgtgctatggcagaaatggaaaagttggatcatttagaggaaaggctcagggccattgaaggaggtgaagattatgcctttgctaacctaaaagagttgttcctagaacccaatatcatcacccctcccaagttcaag

SEQ ID NO: 3994 - DNA, 426 bp, Glycine max
  Peptide Sequence Number=SeqID_95679
atgtatgagcaacacacagatacacaattaagacacttgggctgcaagaatgatcatgctcacaacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 3995 - DNA, 303 bp, Glycine max
  Peptide Sequence Number=SeqID_95680
atggagtatagagataagccaattactactctattggagggaatccggttttacataagctccaaaattgtgaagttgaggactatcctcatgaggtatgagggttcaatctgtcccaaagttcaggaaatcattgagaaaaataaaaaagcatgtgaagcatggcaggcacattggtgtggtgatgttgatttgtctttgtttaaggtgtcaaagggcatgaaatctactgtgttgaccacatattcatttattgtttacccatgtaatggactgaacttaagggagctgactagggggtga

SEQ ID NO: 3996 - DNA, 513 bp, Glycine max
  Peptide Sequence Number=SeqID_95681
atggctaaatttgacccagagatagtcatggagttctacgcaaatgcatggcccaccgaagaaggagtcagggataagcactcttgggtgcggggccagtggatcccctatgatgaagatgccatcaaccagttcctggggcatccgttggtcctggaagaggagcaacattggatcacgcctccaagacacccagtggacccagaaaagtctaatagagcactgggatttctggctttgatcacgagtatctgccagttctatgggatgccagttatgcccacaaagctcatccatcctcctattaacaggcacaacagtcggggcaggacaccatctctagagtccatctcagctcacatgcagaggatggaactctacatgcaacattgggcttaccagcaggtggccaaccataggggtcaggtgcagttgaacgagaccttttaccagtataccctgcaccagcagcgccaggaccccagtccttacccatggcctactcccgagtag

SEQ ID NO: 3997 - DNA, 189 bp, Glycine max
  Peptide Sequence Number=SeqID_95682
atgacattgaggcatgtcactcggtttggaactcccttaagactcaggctgatcaccatgggaggagttgcctgtgcacgacaaggtgaccttgacacttgctgcttagttttccttagtgagagtgtcgtgtggacatgcttaggctatttccttgatgaatggtaccacattgcatttgagaattga

SEQ ID NO: 3998 - DNA, 2778 bp, Glycine max
  Peptide Sequence Number=SeqID_95683
atgaaggatccagaggagcacccagtgaagtctagaaggcctcttcagaaatctgcagaacgtagaagaaggtgcaggagaaggagccagtgcaagatagagaaaatgcaagaaacggaacttgattcacaccttggtttctcttctgccacttgcaagagtcttgtgtttcatcaaaggcctggctttggccaacttggtactaagtgtgtcatcaaagctaaccactttcttgcagatatatcagtttctgacttgagccattacaatgttataataacacctgaagtcacttctcgtaaaacaagcaaggctatcatagcagagttggtgaggcttcacaggaacactgacttagccacgaggctccctgtgtatgatggagggagaaacctttacactgccggtttgcttccttttacttacaaagtgttcaatgtaacattgagtgtggatgatgatgctaccggtggtaccagggaaagggattttaaggtggtaatcaagtttgcaactcgtgtcagcatgcatcagctacgtgagcttcttagtgggaaacaagtgaacaatccgcaggaagcgctaagtgtctttgacattgtgctaagggagctagcggctcagagttacgtgtcgattgggaggtttctctattctccggatgtaagaaaaccacagcagttgggtggtggccttgaatcatggaggggcttctaccagagtataaggcctactcagatgggattgtcacttaacatcgatatgtcatcaatggcttttattgaaccactacctgtgattgactttgttgctcaaattttgggacaagatgtgcactcaaagttgttgtcggatgcggatcgtatcaagatcaaaaaggccctaagaggtgtaaaagttgaagttacacatagaggaaattttcgaaggaagtatagaatatcaggactgacttcacagcctacaagggagctagttttccctctcgatgagcaaatgaacatgaaatcagtagttgattattttcaagaaacgtatggatttactatcaaatattctcatctgccttgtcttcaagtaggaagtcaaaggaaggtgaactatttgccaatggaggcatgcaagatagtcggaggccagagatatacaaaagggctaaatgaaaagcagataacttctctgctgaagatctcatgtcaaaggccccgcgaacaagagacagacattttgcagacaattcaacaaaacaattatgagaataatccctatgcaaaggagtttggcatcagcatagagaacaagcttgcatcagttgaggctcgggttcttccagctccatggtttttccattatgattacattatattttggctcttcttgtccctaaagttgaaatatcacgacactggaagagagaaagaatacttgccacaagttggtcagtggaatatgatgaacaagaaagttataaatggaagtactgtaagatattgggcgtgtatcaacttctctcgaagtgtacaggagagtacagctcgtggattttgccaacagttagttcagatgtgccaaatctcaggcatggaattcagtcaggaccccgtgattcctatatattcggcaagaccagatcaggtaaagaaggctttgaagtatgtacattctgctgctatagacaaacttgatgggaaagagctagagttgctgattgccattcttccagacaataatggctctctctatggtgatctcaaaagaatctgcgaaacagatctggggttgatttctcaatgctgccttacaaaacatgtattcaagatcaatagacagtacctggctaatgtggcactaaaaatcaatgtcaagatgggaggaagaaacacagtacttttggatgctttaagttggaggattccacttgttagtgatattccaacaataatatttggagccgatgtaactcatccagaatcaggagaggattcttgtccatccattgctgctgttgtagcctcccaggactggcctgaagtaacaaagtatgcaggactggtttgtgctcagcctcatcgagaagaactcattcaagaccttttcagatgctggaaagatccacagaggggtgtagtttatggtggtatgattagggagcttttactatcatttaagaaggcaacaggacaaaaaccattgagaataatcttttacagggatggggtaagtgagggacagttctaccaggttttgctatatgagcttgatgccattcgcaaggcttgtgcatccttggaacctagttaccaacctccagtaacatttgtagttgttcaaaaacggcatcacactagactcttcgcaaacaatcatgacgacagaaatagcactgataagagtgggaatatcttacctggtactgtggtagattctaagatctgtcatccttccgaattcgacttctacttatgcagtcatgcaggaattcagggtacaagtagaccagcacactatcatgtcctctgggacgagaacaatttcactgcagatgaaattcagtctctaaccaataatttgtgctacacttatgcaagatgtacacggtctgtttcagtagtgcctccagcatattatgctcatctagcagcctacagggctcgattctacatggaacctgatgttgctgagattacaaaactgcgaggaacaagattgaaagaagggcctgttcggccactgcctgctctgaaagagaaggtgaagaatgttatgttttactgttga

SEQ ID NO: 3999 - DNA, 132 bp, Glycine max
  Peptide Sequence Number=SeqID_95684
atgaagatgttcttcataccacatgatgtacctcctatgtggagcttcggaatggagaggagacgccacttcaaggagaagatgagtcaagaagaagctcaccaccataggaagccatggataagaccttaa

SEQ ID NO: 4000 - DNA, 1256 bp, Glycine max
  Peptide Sequence Number=SeqID_95685
atggggacaaatcaaaccggcaagaggttttaccaagtcaaggttaaaggcctagataccaccagcatcaaggaattagggcggttgatggaacctctcaaaatgcaagccttccgcaagatttacggaaagatcttagagttaaccatagcagagatatccatagaagccattgcatcactcacccaatactacgaccagcctttgagatgcttcacgttcggagacttccaattggtaccaaccattgaagaatttgaggaaattctaggatgtcctctcgggggaagaaaaccatacctttcctccgggtgtctcccctctttgagcagaattgcaactgtggtcaaggattcagcaagaggtttggaccgcataaaacagactcggaacggcatagcgggcctaccacggaggtacctagaagacaaggcaaggggtatggccaatcaaggagactgggtcccgtttatggatgtgttagctttgctaatttttggggttgtcctctttccaaacgtagatggtttggtggacctagcagcaatcgacgctttccttgcataccaccatagcaaggaaagtccggtggtggttgtcttggcagatttatttgacacatttaaccgaaggatttcggcgcacaaaatttcaaggctatacaaagcaatccataaggcatgggaaaccccgttaaggaaagatcaagaacttaggggcattcataatggcatcattggtgggtaccatgaatggctgaaagttcatatacgaggtttagattggctcgccaagttaaaagtcgtcagcaaagagagttttgaagcacccgaagaggacgaagaagtccaagctctcaaaagcgagttaggaaaggcgaaacttgccaaggagaagttcaagttggccgctacacacatccagaaggagtgtgctggattacgggaagagaatgcgactaccacgagagcccttgaacaagagaccaagagggctcgcaaggaagagtatggtcgtaacaaatttcgcggagctctgtggggtagcaacagtgaactcaagctgcgaagggaagagagggaccagtcgcgagcccatagcatggtcttgaaagaggagttagttgcttgttcaaggtcccaaaggagcttgtctcagcgtttatgcgagacggagaccaacatgctagctatcatcgccaagtaccaggaagagttaggtctagccatggctcacgagcttaggatcgcggacga

SEQ ID NO: 4001 - DNA, 594 bp, Glycine max
  Peptide Sequence Number=SeqID_95686
atgggtgccaagcacctcacaaggaccaaagaaaggtcgcatgtcatcaagcaaaggtccccggacgaaattaggagggctacacctcctcgccttaagagggttgcacatcctcgccttcagaagactacaggtcctctccatttaaagggctgctcgccctcgcctttagaggactggatgtcctcgccttcaggaggagtacatgtcctcgactttagagggctacacgtcctcgccttaagcgggctgcacgttctccccttaagagggctgcacgtcctcgccttaagagggttgcacatcctcgccttcagaggacctcacattcagacttcaatggcttcagagcactcatgctccttgcctttagaggactacacgtcctctaccttagagggctgcacgtcctttccttcaagaggactgcacatccttcccttcaaaggactgcatctactgacctttagagggctacacgccctcgccttaagagggtcagcacatcctcaccttcagaggactacagcacctctcactttaaagggctgcacgtcctcgcctttagaggactatgtcctcgacttcggagga

SEQ ID NO: 4002 - DNA, 207 bp, Glycine max
  Peptide Sequence Number=SeqID_95687
atgtgcaaactgctgcattctaaagctactctttccatcatggacctcatgtatcaaaagcaaatacaaatgggagtggatgctgatgttgcacctgaattttctcctttgaaaactgttcaatttggaaatccttctcaagacactgttgacccaagagatggaggttttggaggaagactatggagatggaaatgggaaaaatga

SEQ ID NO: 4003 - DNA, 342 bp, Glycine max
  Peptide Sequence Number=SeqID_95688
atggaggatagggtcacgaccgaccgatcgtcgtccctttcccggcgctgggcaagcggaggacgtcgctgcaaggcagcccagtatcctttgaattcacagttagctcgcctgggcgagctgagctcgcctaggcgagcaacccctgtacgaaaatatgaaaggggtggagggggaacattttcttcacccaaaacccttccccctcacttcaaaaattcccaagctcacgggaattacaagaacagcagcccccaagcttccgttgttgagttttgcttctcttttcacgctttaattcactccccacaagggaaggccttagcctgtgttgtattctga

SEQ ID NO: 4004 - DNA, 451 bp, Glycine max
  Peptide Sequence Number=SeqID_95689
ttgaagacccctgaagaggtaattgagctaattgagaatatgtcagccaacgatcatggccattttgcgctacagagttcatcaacccacaaagaaaatcttgttacaggttgtaccatctgtggtgaggcttatgaaacaagccaatgtattcccattgaagaaaacactcaagaagttcactatatgggaaatcaacagagacaaggatatactcaaggaggattcttaggcttccagccaattcaacaagggcctaacatctttcagaggacttctaagctagaggagactttgactcagtttatgcaggtaacaatgtcaaatcataaaagcactgagtcagcactgaaaaaccttgaggtccaggcagaggatgaggatagtgttgtatccaagaagaaagctgctagaaagaaaggtactgatgaaaagaaaaatgatgtgagag

SEQ ID NO: 4005 - DNA, 357 bp, Glycine max
  Peptide Sequence Number=SeqID_95690
atggttaaggaggagtgtaagaaggtaagtgtctcctctaagaggttagctaagaaggaaagtcattttgcaataaagacaaacattatagaaacttcccttcttagacaatctccacatcttttcctttgtaaaaggacacttgttagctctgccatacctcttaagcttgaggttattcctcaagtaaaggagttgttggatgagggtttggtacataagaacttaaatctttgtgctttgttggtgcctaaaatatgtattattaggcaccaaatccctaagataggtggtataatgaatgtgttgagtggtgcaaccctcttgtgtaaaatcacccatgcaacatcttcatga

SEQ ID NO: 4006 - DNA, 766 bp, Glycine max
  Peptide Sequence Number=SeqID_95691
aacccggcggtgaaaaacccactttaatcgccttgcatggcctgacaggcagtggcgcctgctggtcgcaaatggcccgcgaactggagcctcactatgacatcatcatgccggacgccagaggtcatggcatgtcgagtgcgccacagcatggatacacttaccaggaccacgcaaatgatgtgattgagctgatcagaaccctcgatattaaaaatccgtatttgctgggacactcgatgggcggcatgactgcagccatggtagccagccggttagggtttgcgatcagcggcattatcctggctgacccaaccttcatcagcccggaatggcaggatcaagtttacgaaagcggcatcgtagatcaacatcggcagatgcttaaatctaccagggaagcgttgtttaaagaagctaaggcaaaacatcgtttccgttcatctgagctgcttgaacatattgttgaagcgaggctgcaaaccagtgtgaaagcgtttgatgtcctgattccgcctaacccggaatttgaggagctgattcggaatatttatgtcccaaccctgctggtattagggagtgaaggcatcgtttcgtctgaaacggcgcgtgaattgcacgagattaatccagatctgcagtacaaactcatcccggatgttgggcatggcttgccatatgatgaacctgtgcgtttggccgctgctattgatgctttcctgaaacccagattcaaaactaaacagcgcatgaaaacaccgtcaaa

SEQ ID NO: 4007 - DNA, 711 bp, Glycine max
  Peptide Sequence Number=SeqID_95692
atggtatctaatcgagagggacggggtggtcatggaaaccgaggaggacgagctggaagaggaggtctccctcaatgttctttttataagagagtggatcacacacaagacacttgctattctattcatggattccctagaaaatcggtgaatatttcaaagtctgaaacatctgagataaagttttcgaagactgactatcaagagtatctccagctaaaagctgccaaggaatctcaaacatcatcttctataagtggtcataactctactgcctgcatttcccaatctggtaataatcaaagtccatggataattgattcaggtgcttctaatcacattgccagtaatagttctttattttcatccctttcgcctcctaaaattcctcatttctttactttagccgatggttctagagttgcagcaacaggaatcggccatgaacgtggtacgggtcggacgattggcgtaggacatgaatctcatggtctttactacctcaagcctaatctttcttggagaaggtgtgaaatgttgctgatgaactcgcttagcgagacagattggctaagcaagcctcattcgcttagcgaggcaaccaactcgcttagcggatgcaaaaccctagaagaggataagtcagagagcaacgcgcttaacacgcagccagcctgcttagcgaggacgttgtctttactcgtggcttag

SEQ ID NO: 4008 - DNA, 417 bp, Glycine max
  Peptide Sequence Number=SeqID_95693
atgaattttgcagcgagaaagcctgtagaattcaccctaattccagtgtcctatgctgagttgctcccatatctacttgataattcaatggtagccataaccctagccaaggttcatcaacctccatttctccgagaatacgactcgaatgcaacgtgtgcttgtcacggagaagccccggggcgttccattgagcattgtagggctctgaagcttacaatgttaaatgaaatggataaagttgatatctttgtccctcatcctctcacaaacgcatctttgcttattcaactttcaccggaatgtgggtgcaagccattggtctgtttgctcaagcgacctgcgctcctgagtgttgacttccaagaccgttcaatcagagattactcgtcttgcacgttggtgggggtgccgtaa

SEQ ID NO: 4009 - DNA, 705 bp, Glycine max
  Peptide Sequence Number=SeqID_95694
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcagttcatcatgccgtttgtgatggcttccatgtcggcagaatgcttaatgaattacaacagtactgcgatgagtggcaggcggggcgtaatttttttaaggcagttattggtgcctagaaatattttatctgattaa

SEQ ID NO: 4010 - DNA, 648 bp, Glycine max
  Peptide Sequence Number=SeqID_95695
tgctggatatatgagtatttttccagtgttcatcagtgcgtcactgatgatgggtacgctgagacgaccccacgtgcctccaggtggcttacgatgaaggcgcacatgaatgggatcaagggagcgctgtacagggcacgtttagatgctctgacgatcacgaatgtttcttggttgccctacactgagcatcgggcagggcagctcagatggggtcatgttgtggtctatgtcagactaaagagggtggtacgccagttcgggtacatccagaccatccctccgccgccagttactggttcgttgtcatatgaggacatagacgacaggtggatgcatttaagggatcatctagcacccgcaagtgagatttgtgttgcccacaaccaggaaggtgatgagcccagacatccacctgccccaaatgtggatgcatacgtcgagccacatatcccggaggttccagtcgcagctgatttccctagacattcagtggttgcttgtgaaggttgcgaagcgatcacagaaaggttggagcgtgtgctcaaccttaggatggtcactgtaggaacagagttatatgagatcatggaagattgcctgcggatcgctaggggtgacgcctctgatggaagtcttagggcgtga

SEQ ID NO: 4011 - DNA, 399 bp, Glycine max
  Peptide Sequence Number=SeqID_95696
atggtagcctggcccgggacccaaccttctcttcatagggaagatgaaggtcccacagcccaggtacctcaacatatggaggatgagtcatctgaggccaccatcccagagccatttgatataggagaagaggcagaggagacacaggtgagacaggtagctactgccactcctgagcgatcccttaaggctacttcaaagccttttgcaccagtggtaaacctaccctcacctcagcctgcagcaaaccccttcactcctctcctagagatgccagaggacccgactacaccattcctagctatggacacttctcctccaactactccagtgcttcagctgatagatgaggaggatggtcagacacaggacacccaggaccagtcatatgaattttga

SEQ ID NO: 4012 - DNA, 753 bp, Glycine max
  Peptide Sequence Number=SeqID_95697
atggatatgaatcttggatctttcatttctagtcagattacactcatggcccagcacgactcctcgaagctcggctttcctgccctaatcactgctttatgtaaagcccagggagttcactctaattccttgacccatgagagattaagtcgtgccattaatttggcttatattaagaagaactattggaatcttgatgatccaacagtaacttgcagaggacccaggaaggctaggggtaagagatttgaggccccttccacttcagcatcagaggcaccaacacctccttcttctacagtacctccctcttcttccactcagattccagttattcctccagtacctctacagatgccacttctagcttctctctctacaggtccatcagattttatttttacaccacagatgctgcacttcatgctccagagcatccacagggggcagtccattatcatgcagagccttcagggcttgggcttgccctccattatgagcatggaggagtttgagactcaggtgacctggctaggagaccaaccctcttcttttggagggggtggggcctcagcagcccaggagcctgtgactgaggagcctccaacaccaacaccagcagcagcagaggagcaaactactccagaccaaaccccacagccttctccatcctctgcacttgctcctgaggagactcagccatcaacattggatcataatgaagaccatccacaggaggagcaggacgtttaa

SEQ ID NO: 4013 - DNA, 321 bp, Glycine max
  Peptide Sequence Number=SeqID_95698
atgtcgaggtcaccctgccatgtacaggcaactccctctccccccacccacggtgatcagcctgagtctcaagggagttctaaactgagtgacatgcccccaagtacaagtattcctcctcacgagaaactacaaagatgcttaaaactctttaaccactctatttcctccaccaaggatatccaacaaggtcattgcaccccccatgtgcatacggaacataacatcatcacagtgcattttcaacatcatcaacatttcatctcaacatcaacatcatctcatctcaatgacattaacaacaacataatctcatattaa

SEQ ID NO: 4014 - DNA, 363 bp, Glycine max
  Peptide Sequence Number=SeqID_95699
atgaaaaagttacggaagcatataggacttgattttattctctttcctcttctttctcagccatctaaagtgaaatatgcttatttagggttacggggattttatgaaagcattactgtcgcaacctacccttcgacgggagggcgacgcgagactcgcgggatgcgtgttccacgaaaggaatacgcgcggagtcgccaccaacgtttatttgaggaaaacgtcggaaaaaccggaaaagacgcgatctacgaactgataagtgaaaggttcgggagttgtatttacgcacggggaaggggagaaacgttaaggcgttggaccattaacgatctcttgtctttgaaaggagagaaacgttaa

SEQ ID NO: 4015 - DNA, 285 bp, Glycine max
  Peptide Sequence Number=SeqID_95700
atgacgtcttttccagttttgccgacgttttcctcaaataaacgttggtggcgactccgcgcatattcctttcttggaacacgcacccgcgagtcacgcatcgccctcccgccgaagggtaggttgcaacatatatctctgaagatactgacatccctacaagcgtgctccagaacacaatgtttgcttaaaggtaatggaaggaggtcaagaggttctgaaagtaagaaccaaaacataagatcacccagtgaggagtataccagccaatctttgaatgtttaa

SEQ ID NO: 4016 - DNA, 348 bp, Glycine max
  Peptide Sequence Number=SeqID_95701
atggtgaaagttggaacctcttacgtgccgatcaacgtctcattttcgccaaaagttggcccagggcttcccggtatcataaagcaactggggtttgaacttgtggtgaatgcttgggtcgtctgcacaaggatcaagcttatcgataccgtcgacctcgagggggggcccgtgaagtgcttcatgtggcaggagaaaaaaggctgcaccggtgcgtcagcagaatatgtgatacagaatattccgcttcctcgctcactgactcgctacgctcggtcgttcactgcggcgagcggaaagtggcttacacggggcggaattcgatttcctggaatgccagtattatag

SEQ ID NO: 4017 - DNA, 1037 bp, Glycine max
  Peptide Sequence Number=SeqID_95702
atgttagccgtagctaccggtatcgaagagcacaacatctacgccgtcgattttatcgaagcctgtgccgacatcaaaacccacctgccgcacgcgatgatctccggcggcgtgtccaacgtgtcgttctcgttccgcggcaacgatccggtgcgtgaagcgatccacgcggtgttcctgtatcacgccattcgcaacggcatggacatgggcatcgtcaacgccgggcaactggcgatttatgacgatttaagcgccgagctgcgcgacgcggtggaggacgtgatcctcaaccgtcgcgaggacggcaccgaacgcctgctggagctggcggaaaagtaccgtggcagcaaagataatgacgtggcggtgcagcaggcggagtggcgcggctggccggtggagaaacggctggagtattcgctggtgaagggcatcaccgaatttatcgagctggacaccgaagaagcgcggcagcaggccgaacgcccgatcgaagtgatcgaagggccgctgatggcggggatgaacgtggtcggcgatctgttcggcgagggcaagatgttcctgccgcaggtggtgaaatccgcccgcgtgatgaagcaggcggtggcctacctggaaccctacatcgaggccagcaagcagcagggcacctccgcgggcaaaatcctgttggcgacggtgaagggcgacgtgcatgacatcggcaagaacatcgtcggcgtggtactgcagtgcaacaactatgaaatcgtcgatctgggcgtgatggtgccgacggagaaaatcctgcgcaccgcgcgcgaggagaacgtggatatcatcggcctgtcgggcctgatcacgccatcgctggacgagatggtcaacgtggccaaagagatggagcgccagggctttacgctgccgctgttgatcggcggcgccaccacctccaaggcgcacaccgcggtgaagatcgagcagaactacagcggcccgactacctacgtgcagaatgcttcgcgcaccgtgggcgtggtgtcggcgctgct

SEQ ID NO: 4018 - DNA, 390 bp, Glycine max
  Peptide Sequence Number=SeqID_95703
atgggcaaaaatgtatcagcattgataggtaaatctgttcctcacattcctgagaaatgtaaggacccaggcaggccatttatgaaaacagcccgaaccaagatagatgtttatgctggcacattgtctatggaatttggtgatattgttgttcatttaaacattcttgatgccatgaaacatccatctgaggatcattctatttttcgtgctaagataattgatcagattgttgatgattatatgtttgattttgacaatgttcttcatggtaggaaacatccatttttatctgatttgcatacttgtcattccttatgcattgtatctgaatctgagtttgaatttgatcctgtgatcgaggccatacccgaatcaaataaacattaa

SEQ ID NO: 4019 - DNA, 2208 bp, Glycine max
  Peptide Sequence Number=SeqID_95704
atgggtgctacgaactctagagcggaaaagaatgaagctttgagtctgtgcaaggaaagaaagaggttcatcaaggtggctattgattcaagatatgctttagtagctgcacatgtttcgtacattcaatctcttcgaaatgttggcattgctctccgcaggtatgctgagtctcaggtagaggtagagtcatctctttctatatctaacaaaaccccttctcaaactagttacccttctccatcatcaccttctcatgttgctgaggttgaggttttggagtcaccgttgcacaccgagagtcctctttcgcctcctgtggccaccactcttagttacatgaggtcagggggtagtgctgctgtcactgttaggatcaatgccttcggtaacaacaactatttggatgatgaatccaccgtggttccaatgcctccacctccaccacctcctcctgagtcaggtgcatcttgggatttctttgaacctgcagaggacagtgacagcttcaggtttgcagtgcattgtagtgagtccagagagtttagggatgaagaaaagggtgatcaatggttacatgttggttctgataggcattgcatgatgcaaccactcctggatgagaagtttagtggaaacttcagcagtgctgcaatgggaaatgagtgtggcaactcttatgcacattgccttgataattcaactgtttcaagaggagttgaaggtggcaaaggaatggttgatggagaagtgagagagctagagttgccaagtgctgcaggtgatgtgagccgagctgttgcaaacaagggtgctggtggaaggtccagtgcaaagagggagcaaaacatggctggaaaaaatgcctccacagaaagagaggatccttcagagttcatcacacacagagctaaagattttctctctagcataaaggatatagagcataggttcattcgagcttctgaatctggtagggaggtcttgaggttgttagaggctaacaaaatcaaggtgggatattctgaggcaaaagggaagtcgtctaccactgctttgttgtctgctgtccagcctgtttgttgcggtagaaaggcttcacctgttttccaggaacctgcccaaaaaattattagttggaaaaggacagcatcttctcgatcatcctcgtccaggaatgctttggctacaaaaacaaaggaagatattgatgatagtggaagtgactttgtagaagaattctgtatgattgctggaagccattcatccactcttgacagactatatgcctgggagcgaaaactctatgatgaagtaaaggctagtgaattcataaggaaggactatgatcgaaaatgtcaccagcttaggcatcaatttgcaaaagatcaaggcactcatgtgattgacaagacccggtcagttgtgaaggatctgcattcacggttaacagtggctatatattctgttgattcaatatctaaacgaattgagagaatgagggatgaagaattgctaccacaacttttggagttaacagaaggattgatcaggatgtggaaggctatgcttgaatgtcatcatgcacagtacatcaccatctccttggcatatcattcaaggagcacaccaggaaccttgcaaggagatgcactcagagagataatgactcggctgctagaagaagttgagttctttggtctgagttttgctaactggattaacagcctcacctcatatgtggaagctgtcaatgcgtggctacaaaactgtatactgcaaccaagggagcgtaccaagagcagaagaccattctcccctcgccgagttctggcaccacctatatttgttctttgccgtgactggtctgctgggatcaaggctttaccctctgaggaactaagtcaggcaatcagaaactttttgtctgatcttcatctgcagacggagcagcataatgaccaacttctcaagaaacagaattctgtcaatgcaagtatggcagaaaccgagagcaaaactaatgaagagaatgaagatgagtccacgaatttgagctgcatacatgcaagattaacaaaggttcttgatcgcctgaccaaattttctgaggcatcattgaagatgtatgaagatatcaagcaaaaaagtgaatcagctcgaaatgcataccataattgcagaactatcagggctgaaaaattttaa

SEQ ID NO: 4020 - DNA, 336 bp, Glycine max
  Peptide Sequence Number=SeqID_95705
atgaagcacttcactgacaccctcatcagtgccaacataagcggccgccaccgcggtggagctccaattcgccctatagtgagtcgtattacaattcactggccgtcgttttacaacgtcgtgactggggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcggtgaccgctacacttgccagcgctga

SEQ ID NO: 4021 - DNA, 219 bp, Glycine max
  Peptide Sequence Number=SeqID_95706
atgcaaaatcatctccttgctcttactttcaaatactacatgacgattttattgtgtaataggccaatcatacaagttgacggcacacatttatacggcaaataccgtgggaccctgttaatggccacatcgcaagatggaaatggtggtgttcttcctctagcattcgtcgggcgagacgctaacagcatggtcatggtttttggcccacttgcgtga

SEQ ID NO: 4022 - DNA, 237 bp, Glycine max
  Peptide Sequence Number=SeqID_95707
atgacgggagattcatcaaagttcacacatatctctcccaagaaaagtgggcatgttacttatggtgataacaacaaaggtagaattcttggagttggaaaaatagggtatagagttaacaatgtttatatgatagatttaagccaaaaactagataataataaatgttttcttagcaaagatgatgatccatggctatggcataaacgtattgctcacataaacatggaacattaa

SEQ ID NO: 4023 - DNA, 204 bp, Glycine max
  Peptide Sequence Number=SeqID_95708
atggaggagttcatggcacaggtggcctggccaggagtccaaccttctcctttggggggagaggtctctgagggtgaagaagacgccgaagacacagactatgcagcagatttacaggaggcacagagtacctgggaaccctggcctacagcagcacaggagacacctcaatcagcccaggatacttcttcacctcatggctag

SEQ ID NO: 4024 - DNA, 204 bp, Glycine max
  Peptide Sequence Number=SeqID_95709
atggccccctacagcggcgttttccgcttgtccagcgcgggaagggacgacaatttgtcggtcgtgaccctagcctttatttgcatccgtcctaagtacctgaaagtaggaagcgacaatgcatggcaaatcgtgaccgcatcgtcgacttaccttgattggtttctgcttttagctttgtctcgacctccgattgtagcctaa

SEQ ID NO: 4025 - DNA, 337 bp, Glycine max
  Peptide Sequence Number=SeqID_95710
atgctgactctcctagctgaacccacaccacaacaactagcaggccattgtagggcatacattttagggctaattggtggggtgttgatgccagacaagtcaagcaacacagttcacccgatgtacctacccttgtttgtagatcttgatcaggttggctggtgcagcttgggtttaggatgtttaacacatttgtatagagaaatgtgtagggttatttatcccacatccaaaaaatacggggatgtacactacttttacagtcttgggcatggtatcgcatatcattcattcaaccaagggtcgagcactagctgtcatatccacttgctaatag

SEQ ID NO: 4026 - DNA, 228 bp, Glycine max
  Peptide Sequence Number=SeqID_95711
atgccatcgcacatagggatcgcgcctgcaggacaccccgtggacccaaagaagtccaacagggtcttggggctttcggctctgattacgggcctctgtcagttctacggagtgcccgtcacccccaacaaggtcatcaggcctcctactaaccaagctttcatcaagaagtattgcgcccccaggcaggcagagggcgaaacaccacaaaagcctggggatggctag

SEQ ID NO: 4027 - DNA, 219 bp, Glycine max
  Peptide Sequence Number=SeqID_95712
gcaaccaagtccaaagccaaagataagcaaaattactatgcctatgaccgacaagtcatcacgcgttcggctcaagacgttaaagaagcgctactaggaggcaacctagaattggctacgaagaagcttccggcgaagtggtccatgaagggcatcattgaagaggattccagtgtggccccacaagccgacacaggctttgacaaacaccgattctag

SEQ ID NO: 4028 - DNA, 102 bp, Glycine max
  Peptide Sequence Number=SeqID_95713
atggatccattcggtgggagtcgttccctctacactcctccaaaaattgaagttcatatggaagggcatttggttatcgtatcgggtgaggaagacatcttg

SEQ ID NO: 4029 - DNA, 683 bp, Glycine max
  Peptide Sequence Number=SeqID_95714
ggacaccaggattatttattctgcgaagtgatctccgtcacaggtatttattcggcgcaaagtgcgtcggctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggcgattacctcctttggttatcgtaaggatgatgatggtcggtgggtttggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 4030 - DNA, 831 bp, Glycine max
  Peptide Sequence Number=SeqID_95715
atgctagctataataaggcagtacaaagaggagctaaaccaatctttggctcatgagcaaaagctagtagaggacttcgcacaagcatacgccgagaaggaggcaagagggagggtgattgatgcattgcatcaagaagcgaccatgtggatggataggaaactcaccataactaaaaaagcgcaaaggcacccctataacacccgatccaaaagtaagatgggtaacgaagagggagtgcaagaacagatgaaggccgacatgtcgactttaaaagatcagatggcttctatgatggaagccatgctaaaaattcaaaaatcaatagaagacaatgctacggcggtcgctaccaacataactagggaagcgaaaccggtgctacaacccgcaatgaactcgggccgggacagaagcacgacgggtttcaatctgaggtatagtcctcaagcctacccttatggcttgcatccaaacttcactccccgtaccgctccagacaatttgagccaagcccctactttcgaggggcaactccctcctcatgccaactaccctctagaggaagatgacgaaggagatgcccatttgggccctctacttcccccaagggaaccgaccccccataagttgccccagccaaacataatctaccatgccccatctcaatccacacccgttagggaacccgttcccatttcaaaagaaaagggaaagatcgatcttcttgaagagaggttgagagcggtggaaggcctcggcaactatcctttctcggatatagccgatctatgtctggtacccgacatcatcattcctcccaagtttaag

SEQ ID NO: 4031 - DNA, 273 bp, Glycine max
  Peptide Sequence Number=SeqID_95716
attcacagctatatcaacatcagaaataatgccacatcaagagggcttaggagtcacacacttaacaagccaaaactcattcacaatgggttgtcagtcactctcataagtaagatcatagagagaccacagggtcacgatgttttcgacgatgctcaccatataggtcaacataggcttaaaggagcttttactcaaacccgtgacccccaagctaacaacattccgaagatcctcaaggcaactctccctcctgattcagtccaaccctaa

SEQ ID NO: 4032 - DNA, 729 bp, Glycine max
  Peptide Sequence Number=SeqID_95717
atgttccctcaacagcagacaagcgctatccagcaaatcccaactgccagctcagcaccttcatcctcagaaataatctttgagttcctgtttctgctatgctatcatcttcccgcggcccttggagaatcaccttgtcctcaaggtgatgatcttgtattagctgatcccaatcctcctaagacgtttcatccgaagacagtcctcgccattgaactaatacttcccatggagcatcctgggcaaaggatgaatgacggtagtccagaatggctaagggagacagtaaagcttcaaacgataagccacagtgccgacccgatcaagtatctggaagggaccgtagaagtgtttggccaatttgtcagaaactgcctgcgctcccttggcggacctctaccggtaaggtcggagtttcaggagaacccaatccccaggttgataagttatctccctacgcttgacatcagcgttgtgattcatgatagcctgggccttgaccaacttttttcgaatgctgtgaaacacttcatccatgttattcaacatgttgtcaatgacgtctatgttcaaggatcccaagaggtattctgggaaattgaagggcttgcggacaaaggtaatctcatatggggtggaccctattcccatgttccacgaagtattgtgggaccattcaacccacgggagaagctttccccacgctctgggccagcgatgaacaaatga

SEQ ID NO: 4033 - DNA, 216 bp, Glycine max
  Peptide Sequence Number=SeqID_95718
atgaccaaagttgatatagtcgtggctgcaggggggtggcttcgagggccagtgcctccaagagagaaaggacaaggaagaagaacagagaaaaagcaagaaagaatattctcactaacggaattggttaggaatgttccctcagcagtagacaagcgctatctagcaaatcccaatttccagctcagcaccttcgtccgcagacataatctttga

SEQ ID NO: 4034 - DNA, 198 bp, Glycine max
  Peptide Sequence Number=SeqID_95719
atgactttaaagaacttcatgctagagaatgctgggacacaatgctttgataggatagggtgtcacacggtggttcggcggcaagtaacggtggctcgtgatggtcaccagtggtcgtgggtggtggaggaggaggtgttagggcttgggtgggcgtttgaagagaaaaaagtgaaaatcgtatttttttcaccctga

SEQ ID NO: 4035 - DNA, 198 bp, Glycine max
  Peptide Sequence Number=SeqID_95720
atggtaaaaagttacccttttgagctacagagcaagaagagacgtactagcttgaagtgcacagccgtcacttcctcctttctttctccaatttggaggcttcccatgactcttccaacaagtttgtcgtgtatgccatgggcgcttgccaatgttgttaatggcggttcatggtggaaagccaaaaatccaccataa

SEQ ID NO: 4036 - DNA, 156 bp, Glycine max
  Peptide Sequence Number=SeqID_95721
atggcgatggcagaggtagcaagtggcaacgttggtagtggtaatggcgataatagtgttgtctgtggtggaatggtggtggtggtggagtcagcaaaggcgaggtgcaatggtggtggaatggtggaggcgctaacgatgatggaatggtggtga

SEQ ID NO: 4037 - DNA, 510 bp, Glycine max
  Peptide Sequence Number=SeqID_95722
atggctccgaaaaagctttccgcgaagagatgtaggaggggcgccgcgactgaagggaccagtgccgctcccgagtttgatagccaccgtttcaagagtgctgagcaccagcagcatttcgaggccatcaaaggatggtcgttccacagagagagacgcgtccagctcagggacgatgagtacacagattttcaggaagaaatagctcgccgacattggacatcactggtcactccgatggctaagtttgacccagatatagtcctggagttttatgctaatgcttggcccacagaagagggagtgcaggacatgcggtcatgggtaaggggtcagtggatcccctttgacgcagatgccctcagccagttcctgggtgacccgctagtgctggaggaaggatttcacccagaccgctgcagggaggcgggtgaggatcatgcgcaccagtatgaccaccttgacccagatgtggatgactttgctgctcagcaatgtcctgcccagtga

SEQ ID NO: 4038 - DNA, 780 bp, Glycine max
  Peptide Sequence Number=SeqID_95723
ttaaaagggctacacgtctttgccatcggcggactacacgtggtcacattcagaggactacacagcctcaccttcagagggctacacgccctcaccttaaatggactacacgtcctcggctttagagggctacaaaccctcgcctttagaggtgtacacgccctcgccttcatagggctacacaccctcaccttcagagtactactcgtccttaccttcaaaggactacacgtcctcgccttcagaggactacacgtccccgccttcagagaactacacgtcctctccttcagcggactacacgtccttagcttcaaaaggctacacgtcctcgccttcacagggctagatgccctcaccttgagagtacttaacgtcctcgcctttttaggactccatgccctcgctttcgtggggctacacgccctccccatcagaggactacacgtcctcacctttagagggctacacgccctcacgttaagtggactacacatggtacatgccctcaccttaaaaggactacaggtcctcgcctttagagggctacacaccctcgcctttagaggtgtacacgccctcgcctttagaggactacatgtcctcacctttagagtactacacgtcctgaccttcagagggcaacacgccctcaccttaaaaggcccccacgccctcgccttcagagggctaacaccctcacctttagtagactactcgtccctgccttcgaaggactacacgtcctcactttcagaggactacacgtcctcaccttaa

SEQ ID NO: 4039 - DNA, 429 bp, Glycine max
  Peptide Sequence Number=SeqID_95724
atggcacaagccaggataaagaataaaggtatcgggcatcacaaagttaatgatcaggctcagaatattgatttcaatattcgtgattcatcagaggatgagagttctgaatcaacacaagtttcttcacctgagaaccaaaattatatgtcctcatctaatgagcccgcaattaatagaaaaggatattctgatcttggtgatcaactcatgcagtgtagtgtcactgtaatgcaaatatgtggtatgatgaaagagtctcaaaagataaaagaactacaaatccaagattcagtttatgttttggaaatggcaaggttgaacttccattgttatagaatccacctaaatatctctaccaacttttgtatgatcttggtatatctgatagtaaaaattaccaacagaacatatggacatataacatga

SEQ ID NO: 4040 - DNA, 465 bp, Glycine max
  Peptide Sequence Number=SeqID_95725
atgtctgctgggagggagaaagccatatatctctttttgaggttttaccccttcatggcaagagtagccaaggcattggcagatcgaggggaatgggccttttttattgatgtcttcgcactattgatatttggtgtcgtcctctttccaaatgtggagggattagtggagctagtagcaattgatgccttcctttcttatcaccatagcaaggaaagcccggtcattgctattttggccgatgtgtatgacacgttcgaccaaagatgcccacctatccactgcaaggtcaccgcttatgcaccaagaaaggaaaggcaaactgggagatttccaaatgttcctttaatgggaacaagaggttgtatcaattataatcatgtcctcgccaagacaacttggctactccatgagaggagcaccatcggaggaaagcatcacgcctttcattgcacggggttttag

SEQ ID NO: 4041 - DNA, 353 bp, Glycine max
  Peptide Sequence Number=SeqID_95726
ggacgtcaatatggccacagttgaagccttggaacgaagaggccatcatcgataagtgcaaagagaagctaaatctagcggcgactcacgagcaaaggctagaggatgagtatgccaagatatcagcagaaagggaagtaagggaaagggtaattgattcattgcaccaagaggcaacaatgtggacggaccgatttgctcttactttgaacaggagtcaagaacttccccgatttctagccaaggccaaagcaatggcggacacctactccgcccccaaggagatccacggacttctctgctattgtcagcatatgatagacttaatggaccatatgattagaaaccgctag

SEQ ID NO: 4042 - DNA, 492 bp, Glycine max
  Peptide Sequence Number=SeqID_95727
atgaaagataaatggaatgtgcatgaattgcacaatatgttagttcaggaagaaacgaggcttaagaatcaaggaagtcactcagtctattatgaaagccaccaagggaatcaaggagctagaaagaaatttatgaagaagcatgataaaagcagagggaaatcaggacatttccagaaggattacctaaagtgcaagtcttggttcgaaaagaaaagtgggcttaatgctcatagattccttacaatccaaaccataagcccaaatgagaagttcattttcatgggaaatggagtgaaagttccagtggaaacaattgagacttattgtttaaaactcgacacgggacatcgtttagatttactggaaactccttatggaaaacaagcaaaacatacaaagaaaggagctacaagaagcactcagcttcttgaaattgtgcgtactgatatttgtggaccttttgatgttagttcttttagaaaggaatga

SEQ ID NO: 4043 - DNA, 204 bp, Glycine max
  Peptide Sequence Number=SeqID_95728
atgccaaagaatcaagagttaagcaaaaggtttcaagcaaagattcaagaatcaagtttcaagaatcaagattcaagcttcaagaatcaagattatagattcaagaatcaagtttcaagaatcaagaatcaagtttcacgaataatcaagatcaagtttcaagacacaagattcaacaatcaagagaagactcaatcaagataa

SEQ ID NO: 4044 - DNA, 780 bp, Glycine max
  Peptide Sequence Number=SeqID_95729
atgtacgaccagttagatgaggcttgtaggaccaccacccgacagcttgcggggtacttgacgctacttcagtgctggatctatgagcacttccctagtgtgcatcagtgcgtgactgacgatacataccaagagacgtccccacgtgcttcccggtggttgacgtcgaaggcgcacatgaagggcatcacaggagcaccctacagggcacgttgtgatggtttgaccgtcacatatgtgtcctggttgccgtacacggagcatcggggtgttagggcgtttcaggagatttcatcgttccagggtcagctcagatggggtcctatgatcgtcacagttcgaccggagagggtggtacgccagttcggttacatccagagcatccctccgccgcctgttagtgcacgattgtcacaggatcagatagatgacaggtatctgcggattacattgagtggttttttccgcatatctcaccctttcatgacaccgacccaggcagctgaccagcagagggatgcaccagctgcagaccctgaggactacatacagccgcccagcccccaggttccagtggcatttgacccccctccatatgtggatgattacgagggatatgaggcgattgcacagaggttggagcgtgtgctcaaccttaggatagtcactgcaggcacagagttatatgacattatgcaggactgcctgacgatcgcgagagggggacccagtgctgatgggacggtcagggctcgtcagagacgccgcacggaccattga

SEQ ID NO: 4045 - DNA, 609 bp, Glycine max
  Peptide Sequence Number=SeqID_95730
gtggaatttgaaatcccagaagcttctgacagtaggacgaaaaggaagttacttcagaccgtggccgatcaggacggtgtggaggacactgtctgtgagaaatatagcatcagcaaggaaaaatgggtccagttttgccagactcgcagagacccttcttgggaggatgtgcgcaaaaaggcacaagccatccagaagcagaacactgccccccacgttttgtctcatgggggttatgactatttggagcagaagctcctggctgagaagacgaagaagaagttggaggaagctacacagtcaagaagcattgatggcgtcatcgaccctccatccccggttagacaccacgtgaagtggaagatggcccgcacgaagaaaataggggagatgacgactgaggccgcaaaggaaatcgttgcgaagatcatcctcgagttagcacaaagaggagttgtgttgatccctaaggaaacgatcctaagacgagtgactcagataggtgcggcttgtacatcgaagcagatcctgcccgcctggttgccctggggagagtttatgagggatccactgttgttcataatactcctttgttgcttggccaagtaa

SEQ ID NO: 4046 - DNA, 153 bp, Glycine max
  Peptide Sequence Number=SeqID_95731
atgactgaagcacgtcaaaaagggggtataaaaaggagaagcttgtcgcccagctcaccgaagcgagctcagctcgcccaggcgagcaaggttgcttcctccagaagcaacagccttctggaggaatcttctggagggcccaagtgggcctga

SEQ ID NO: 4047 - DNA, 171 bp, Glycine max
  Peptide Sequence Number=SeqID_95732
atgaatatcccagtttctgattccaatcattttgcccaacatgaatctcaatctgtgtctgtgacagcagaccatgatccactgcttggactccccttgatgccaacaaagcggcaggcatttcaagattgtgatgatgaagcagggacctctcaaatttcacctgcatag

SEQ ID NO: 4048 - DNA, 222 bp, Glycine max
  Peptide Sequence Number=SeqID_95733
atggaggccatgaaagagcaaatgaccacaatgatggaagccatgatgagtatgaaaaaaatgatggaggtcaacacgactacaatggttgccacaagtattgccattgaggtggacccgactcacccatctggcctcaaccaagtaaatcgcccagcctcggatatggtaggtcagggaggcaaagcaattggaagtgcgggcggcccccattttgtgcag

SEQ ID NO: 4049 - DNA, 192 bp, Glycine max
  Peptide Sequence Number=SeqID_95734
atgggacctctccaaaggcaagccttccgcaaagtgtacgggaagattctagatttggccgcagcggaggtatttacggaagctatcgtatccctcgcccaatactatgaccagccgttgaggtgtttcacgtttggggacttccaaatgcaaaagagttggatcgcacgaagcaaactcggaacggcgtag

SEQ ID NO: 4050 - DNA, 162 bp, Glycine max
  Peptide Sequence Number=SeqID_95735
cttggaggggttgatggggacccggtgctgagaggaacgaggataagggctacgtgggagtgcgtgagcttagttgaaagagtggtacctggagatatgtcgcggggatcaggagaccttggggacgtcaggtggggtgctattgcccaaaaccaagcttga

SEQ ID NO: 4051 - DNA, 258 bp, Glycine max
  Peptide Sequence Number=SeqID_95736
atgaggcttaagaatcaaggaagtcactcagtccattatgtaagccaccaagggaatcaaggagctggaaagaaatttatgaagaagcatgataaaggtagaaggaaatcaggacatttccagaaggattacctaaagtgcaagtcttggttcgaaaagaaaagtgagtttaatgctcatagattacttacaatccaaaccataagcccaaatgagaagtttgtctttatggggaataaagtgaaagctccagtgtaa

SEQ ID NO: 4052 - DNA, 219 bp, Glycine max
  Peptide Sequence Number=SeqID_95737
atgcctataggttggacctcccataagagtggagctgatattgaggaggaggaactaacagatttgaggtcaaatcctattcaaggggaaggggatgatgcaatcctccctaggaagggaccagtcactagagccatgagcaagaggctccaagaggattgggctagagctgttgaagaaggccctagggttctcatgaacctcagggtagatttctaa

SEQ ID NO: 4053 - DNA, 279 bp, Glycine max
  Peptide Sequence Number=SeqID_95738
atgtggtaccaagcccatgactacaatagtatggcacaaccacccatagctttaccaacccccgatgatgctcgacatagttctctatacagttggtgcattgttggttcttcaggcaatggtgcacgcaacatgcttagcaaccatgtcagtttcagtgtagctcatttacgtgcattttcgggagggacttcccctagtaactcatggcataactcatcccaatgtaagaagctaggtccagccacaacacgactatcgactctaatgcttagatga

SEQ ID NO: 4054 - DNA, 378 bp, Glycine max
  Peptide Sequence Number=SeqID_95739
atgggtgaagtagaggagatacaagagaagatgaaggccgacatggaggccattaaagagaaaatggccacaatgatggaggccatgatgagcgtgaagaagataatggaagccaatgcggttgcaactgccgctaccagcgttgttgctaaggagacacatgaaattccccaccacgatctagccaacttcgagccttgcctcggatatgctgctgaaggacaagcagttggtggtatacccctgcaaaacactttggagggccctcaatatcttccacaaccacaaccctcacgttccacagcggttaaaaaccctcatgactatggcaggaatgggaaagttggatcatctagaggagaggctcagggccattga

SEQ ID NO: 4055 - DNA, 137 bp, Glycine max
  Peptide Sequence Number=SeqID_95740
atggctccgaaaaagctttccacgaagaggtctaggagagacgccgcggcgaaaaggtctaatgccgcccccgagtttgatagccaccgtttccagagcgtcgagcaccagcagcgctttgaggccatcaaaggatg

SEQ ID NO: 4056 - DNA, 141 bp, Glycine max
  Peptide Sequence Number=SeqID_95741
gaatccattgatgaagaagatcctaggcctacaagctccaatggagcttgcatcagtggagtgcactaaccttgtcggatggcccagacgtgggtggcaagcgtggttaaagaatctaagcatttctgaggggatgcttag

SEQ ID NO: 4057 - DNA, 450 bp, Glycine max
  Peptide Sequence Number=SeqID_95742
atggcaggagctggtgacaatggtggtgtatatcatcaactacacggatttcagcgcctattactggacgcgatgactacacaaatgcaacgtttgttgaaccgtaacaatgaagagctctataggcgaatagaaggactagagcaccaaatgaatccaaatgctgggagaccttatggtggcaacagaagggtcaatgatggatcgaaccgaatagaggggcaagacagaattgagggagtaaaactcaatatgaagattcagcttgcattctcctacaatgattgtcctgaagagcagaaggtgaagttagcagcagctacattctcagactatgcccttgtttggtggaagaaaaatcaaagagagatgaagaaagaagaagggcgggagatagatacatggactgagatgagaaaggttatgcgaaagatgtatgtttccaactag

SEQ ID NO: 4058 - DNA, 186 bp, Glycine max
  Peptide Sequence Number=SeqID_95743
atggcagctatacaaatgaccagccttgtctctatgacgtgttgggcttgtttaagtctgcctctggtcatgggcccttcaagtgtttcatggtccttgcccttggttatgtcctcatcatcaggatcacatcatctggtgtcatctggtatcagagcttcgactcttgatacagactttgtgtaa

SEQ ID NO: 4059 - DNA, 117 bp, Glycine max
  Peptide Sequence Number=SeqID_95744
atgggcccagttctgccagactcgcagagacccttattgagaggatgtgcggaaaaaggcacaggccatccagaaacagaacactgccccctgcgttttgtctcgtgggggttatga

SEQ ID NO: 4060 - DNA, 165 bp, Glycine max
  Peptide Sequence Number=SeqID_95745
atgtaccatccaggacttggaggacctatgacaagggctagagcaaggaaagccaaggaagctcttcaacaagtgttgtccatactatttgagtacaagcccatgtttcaaggagaaaagtccaaggttgtgagttgtatcatggcccaaatggaggaggactaa

SEQ ID NO: 4061 - DNA, 402 bp, Glycine max
  Peptide Sequence Number=SeqID_95746
atggtacctaatgcatggttaactaagaaaagatgtttcttcgggcatctcaattgcataattacattttccatgcatagcatacgtattcccgagtatttcatctctatgaaatgttgtcgaagtattggcgatcaaattgtcattctttggattatggggttgaaccaagctcatgcttttacgaaaagaacccgtgctagagctagagtaatgggtgaagtagaggaggtgcaagagcatatgaaggctgacatggaggccatgaaagagcaaatggccacaatgatgaaggccatgatgagcatgaagaagataatggaagccgatacggttgcaattgccgctaccagcgctgttgcaaaggtgaacccgatgcctccatatgatctcaaccaatga

SEQ ID NO: 4062 - DNA, 623 bp, Glycine max
  Peptide Sequence Number=SeqID_95747
atggattgggaccagctcttggccgggataggaggtagaacaattcagttggttccccctatggaaggaaggaaaagaaggagtccttttctcatgtggaagatacccaaacattccgctggacgagaagtccaagctctcaaaagcaagttaggaaaggcaaaacttgccaaggagaagttcaagttggccgctacacacgttcggaaggagtgtgccgggttacgggaagagaatgcaattaccgcaagagcccttgaacaagaaaccaagagggctcgcaaggaagagtatggccggaacaaatttcgcggagctctatggggtagcaatagtgaactcaagttgcgaagggaagaaagggaccaatcgcgagcacatggcatggttctgaaagaggagttgatgacttgttcaaggtccaaaagaagcttgtctcagcgtttatgcgagacagagaccaacatgttagctatcatcgccaagtacgaagaagagttaggtctagccacggcccacgagcatagaatcgcggatgagtatgctcaagtatatgcggaaaaagaggctagaggaagggtgatcgactctttacaccgagaggcaaccatgtgggtgggtcg

SEQ ID NO: 4063 - DNA, 510 bp, Glycine max
  Peptide Sequence Number=SeqID_95748
atgctaacatctccggaaagggtgaagatgaccacattggtctctgcatgtcaatcgggcctggggtccccaaatgacggggtacggataaccggaaggtgcctccgcatgctaccagactcttgggtcaggagaacaaaaggtggggcggtcgacaaaagcgaggcttttgctcctaccgttttgtttctaaacaatcatctagaggaaacactgggtccaacaaaaatagaagaaaatcactcaaagtgtatcaatctcacacagtgcgaggcgaaaaagtcaccgacgcataggattttggttggcaatcaaagggagaggaccacttcaggtcgtgggcaaggatgggcattctcaccctgggtcaaggtttatggtgagttgggattttggctcaaggcttgtagattggctggacatgatatatgtcagagtgttggattggccagtgattcagggaaaaaggagatgtcccacattatttccacgatacacatgcaacactga

SEQ ID NO: 4064 - DNA, 81 bp, Glycine max
  Peptide Sequence Number=SeqID_95749
atggctgttggatacgatctgatagaagatgctgcagctagagcatggagacagggggagcagaaagctgatatcacgtga

SEQ ID NO: 4065 - DNA, 144 bp, Glycine max
  Peptide Sequence Number=SeqID_95750
atggcggatagcgcgctaggcaatgacattcatgggtctccgaaaaaaagtggagaatggagaattggcgaacagcgctacgcaataacttcgcggggctccagactcgaaggtggaggacacatgaacagcgctaggcaatga

SEQ ID NO: 4066 - DNA, 383 bp, Glycine max
  Peptide Sequence Number=SeqID_95751
ctctacggggagatgaaggtcccacatcccaagtaccacagcatgtggaggatgagtcatctgaggccaccattccaaagccattcgttgtaggggaggaggtaggcgagacacaggtgagacaagtagttgctgctactcctgagagatctcttgaggccacttcagagtctcctgcaccagtagtggacctaccctcatctcagcataaagcagacccctccactcctatcctagagatacctgaggacccgaccacaccagtcctgactctagacacttctcctccaactactccaataccttgcttagattctaggagagcatatgtttcaaggaaaatttaccccaaatttgggggagtggaattgattgggatgtaa

SEQ ID NO: 4067 - DNA, 281 bp, Glycine max
  Peptide Sequence Number=SeqID_95752
tcaacagggcctggggtttccagctctggttacgggcctctgtagtcctacagggtgcccgttccccccggcaaggtcatgtcatcatgacatagggattgcacccgcaagacacccagtggacccgaagaagtccaacagggtcttggagttgccaagctctaattataggcctcggcaggcgcaaggcgaaacaccacagcagcctgaggatggccggcagcgggcaacagacgcaccgccatctcctctagagttcacctcagctcatccacaaaaag

SEQ ID NO: 4068 - DNA, 848 bp, Glycine max
  Peptide Sequence Number=SeqID_95753
ttttggctcttaaactatcatcagcacttttgttttctgcagccacggggatgctacttgcaaccaacaaaatccaaccctcacaacttgctgaggaacaaagaaacgttgcaagactgtttaagcagcttcaaacacagatccaaacagaaatcgccattggaaatccaagtgaaggagatgtgagggatgcaatagagaaggttttggctctatacaaggcttatccactccccttgttgggtggtgcaatgctcaaaaagtttccagcaaagtttgaagcagctagatggtggccagaaagtagattatcgagcaacgacaaagacaagataatggagattaagaacaacaataataatggatggaatgtggagttggaagaggaaatgagggaggttattgaagtgttgaagagaaaagacgtggaagactatgagaggttagggaatattgcactgaagataaacaagggttttgcggtttcagcacctttgctcacaggaattgctgcactagggtctgtgttttcaggagatggattagttcttgcccttgctggggtgttggccatggtggttaatgcttttgagcatggagggcaagttggcatggtgtttgaaatgtacaaaacttgtggtggattttttcagttgttggaggagacaattgaagccgcaattgaagagaaagacttggacaaaagagaaaatggagagctatttgaaatgaagatggctttgcaattgggaagaagtgtgtcacagctgagagaacttgccacaaaatctgcttcatgtcgtattgaagggagggagatacatgaattcgccaacaaactcttctaa

SEQ ID NO: 4069 - DNA, 210 bp, Glycine max
  Peptide Sequence Number=SeqID_95754
atggctgggagcacacaaaggttcgagataggggagaagacatcacgaggatacaaatatgttggttcaaagtggggatgcaaagtgtacaagaggaaacacttgaggaaccatgataacaaagtgaagaagaaagtgaagttttctaatgttgtgaaagtgttcggagatatatccgttggaaggagagtttgttcactctcaaattga

SEQ ID NO: 4070 - DNA, 213 bp, Glycine max
  Peptide Sequence Number=SeqID_95755
atggaagcagaagggagattaaaaagcaaaattgtttgtatcaatcagctgttggaagaggcccagcaattatgggacttggggacaaccataggcttggaagcaaacacatgtcacttgtgttttattcaaagctttgcagatatggaggccagagacagaaatgaagctatggagtttgatgcaatcctactccgcaagggcattggatag

SEQ ID NO: 4071 - DNA, 174 bp, Glycine max
  Peptide Sequence Number=SeqID_95756
atgaaagttatgccaagcaagccaacaagaataggaaggaagtggtacttgaaccagggacctatgaccaggagtaggaccaaacagtcagtggataccctccaacaaatggtagcaggcatacataacaaggcccaagtggagaaggatgaaggaccagaagcagaggattaa

SEQ ID NO: 4072 - DNA, 168 bp, Glycine max
  Peptide Sequence Number=SeqID_95757
atgaaagaacaaatagaggaagcaaaagaacatcacctagatgaagatgctatgataccacataatgtagctccatgtagagcttgtaggccttggatcttcttcatcaatggagttctttgcttcttgaagatcaatggcagtggaatggagaaggtggaaaggtga

SEQ ID NO: 4073 - DNA, 174 bp, Glycine max
  Peptide Sequence Number=SeqID_95758
atgccaggtgccaacttgttggcaatgggttcctcatcagcagcttctcctaggtcaatgaggacgtctggagcagtggtgcccttggtagatgatggagatgatggtacagaggtgaaccaggagatgaagtatcttttgttggtcaacatgctccagtgtgataacttttga

SEQ ID NO: 4074 - DNA, 1179 bp, Glycine max
  Peptide Sequence Number=SeqID_95759
atggttagaggaactatatgtggagcaattagacataaattgataccgactcctcagaatttggtgacttcaactccattaacaactacttatgaatctttttttggattacatccattatctcaagttttggatcaaactaatccattgacccaaatagttcatgggagaaaattgagttatttgggccctggaggattgacggggcgaactgctagttttcggatacgagatatccaccctagtcactatggacgcatttgtccaattgacacgtcggaaggaatcaatgttggacttattggatctctagcaattcatgcgaggattggtagttgggggtccatagaaagtccattttatgaaatatctgagagatcaaaaagaatacgcatgctttatttatcaccaagtagagatgaatactatatggtagcaacaggaaattctttggcacttaatcgagatattcaggaggaacagactgttccagcccgataccgtcaagaatttcttacgattgcatgggaacaggttcatcttcgaagtatttttcccttccaatatttttctattggagcttctctgattccttttattgaacataatgatgccaatcgagctttaatgagttctaatatgcaacgtcaagcagttccgctttctcagtccgaaaaatgcattgttggaactgcattgaacgccaagatatttttatttggtaatggagatactctaagcattccattaactatatatcaacgttccaacaaaaatacttgtatgcatcaaaaaccccaggttcgccgaggtaaatgtataaaaaagggacaaattttagcggatggtgctgctacagttgacggcgaactcgctttgggaaaaaacgtcttagtagcttatatgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcgtggatcctctag

SEQ ID NO: 4075 - DNA, 261 bp, Glycine max
  Peptide Sequence Number=SeqID_95760
atgaatgaaggctcttttggcatccttttcaattacgtgaggaagtttctctcaaggttgattccttatggtgtcaccgtgacttatcttccatctctggaagtggcgaccctcgtcgtcaacattcctgtatcaaacgttccgccccgtaaggttcacttcaggtatgaattacaaccaatctttcagttgatgtggaaggttgacactctatataatcaatttcaaaacctaagtcccccaattgatcactcccactga

SEQ ID NO: 4076 - DNA, 1221 bp, Glycine max
  Peptide Sequence Number=SeqID_95761
tacacatcctcgccatcagagggctgcacgccatcacctttagaggacaacacgtcctcgcctttagagggctacatgccctcgccatcagagggctgcacgccctcacctttagaggactacacgtcctcgccatcagagggattcatgctctcaccttcagaggactacacgtcctcaccttcaaaggacagcacgtcctcgccatcagaggactacacgtcctcaccatcagaggactacacgtcctcaccatcagaggactacacgtcctcatcttcagaggactactcgtcctcgcctttagaggactacacgtccttacctttagaggactacacttcctcgccatcagagcgctgcacgccctcacatttagaggactgcacgtcctcaccttcagagggctgctcgccctcaccttcagaggactacacgtcctcgccatcaaagggctgcacgccctcacttttagaggactacacgtcctcgccttcagagggctacatgccctcgccattagacggctgcacgccctcaccttcagaggactacacgtcctcgccatcaaatggctacatgctctcacctttagaggactacacgtcctcacctacagaggactacacgtcctcgccatcagaggactacacgtcctcatcttcagaggactacgcgtcctcgccatcagagggctacacgctctcaccttcagaggactacacgtcctcgccttcagaggactacacgtcctcgcctttataggactgcacatcctcaccttcagaggactaaacatcctcattttcagaggactacacgtcctcatcttcagaggactacatgtcctcacctttagagggctccacgccctcaccttcagaggactaaacgtcctcgccatcagagggctacatactctcacctttagagaactacacgtcctcaccttaagaggactacgcgtcctcgccatcagagggctacaagctctcaccttcagaggactacacgtcctcgccttcagaggactgcatgtcctcaccttcagaggactacacctcctcgccttcagaggactacatgccctcgccttcagaggactgcacgtccttagcttcaaaggactaaacgtcctcatcttcagaggactacacgtccttatcttcagagtactacacgtcctcaccttcagagggctgcacgccctcacctttagag

SEQ ID NO: 4077 - DNA, 1606 bp, Glycine max
  Peptide Sequence Number=SeqID_95762
ccgatggcatgcgcctcggtgtgttgatcggcgcgatctcggcgctgctggtggcagtgttcggctcgctcaacaagcgcatggtcagccacgcggatccgctcacggtcaccgcactggagctgggtgcgggcaccctcaccctgaccctgctggcaccgctgatgccctacctgctgccggcgctggccagcccgctgtgggtggttccggacctgcacgacggcatcctgctgctggtcctggccgggttctgcacgctgctgccgttcgccctggccctggtcgcgctgcgccacctgagcgcctacacggtgcagctggtgaccaacctggaaccggtctatgcggtggtgctggcggtggtgctgctgcgcgagcagcacgaggtcaccccgtggttctacctgggcgtggcgatcatcgtcggcgcggtgttcctgcatccgctgctgaaccgccgcaagccggtgcagcatccggaaatccttggcacggccgaggcacgcaacatcgccgattgagcgcgtccacgcagggcgtggatggccgtatcaacgctgcggccagtgccatgccggcgcatccagcaggccctgcccgctcagcagcgtgcggccctgttccttgtgcaggtgcagcgaatgacagccgggcgcttgctccacgcagcagccagcagcaggaagcgcagcgtaccgtcggacagttcggccatcgacaacggccgcagcaaccccggctggtggaagcgcagggccagtcgaccgtccagctcttcgaagccgaccgtggcgccggggaacgcatcgtcgacgctgcgtgccaacgcgaccggatctccgatttcgagaatggtcacccaggctgccgccagatcccgaccgtcgtgatgcagcaccggcgtgcgcgtggccatcgccggttgtcgcgccggggcatcggcatcgctgcggaaatggtcgtagaagcgccagcgacggatgtactcacgcaaggcgatggtttccggcatgcgctgcggatcgccgacctgagtgaacaggctgtcgaacagcgacaaccggtcatccacgagatcccagccgcgcgcatgacgttgccgcaccattgccccacggcgatcaaccagcaggttggcgctgcgcaggaacggcccggcccagatcgcctccaccttgatctgcggatccagcgcaaacgccgaatggctgggcggcgggtagcccaggtcgatggcatagccgaattcgtcggtggtgaagccgagcttcaatcccaccgatgcctgccgagggccaccctgcagcgggatctcgccggccgcgacccggcgatcgatggattcggggccggcccacagcgccgaacccagccccccttcgcgggccagcaccgccgcaacgccgccctgtgcggtctccgccagcaggcgcagcgcgcggtacaggctggacttgccactgccgttgtcaccggtcaccacgttcaactgctgcagcggcaggaccagcccgtgcagcgaacgatagtgggcgatggccagggtctgcagcatggtcggcgtccgtgggaacaggaacggcatattcgccgggcacaatag

SEQ ID NO: 4078 - DNA, 411 bp, Glycine max
  Peptide Sequence Number=SeqID_95763
atgataacggcccggggaaaaacccgggccgttttctgttctggcggttgcaaactgccatcctggcggtgcgaactgccatcctggcggtgcgaactgccatcctggtgggtgcgaaccttggttcgcaccgcctctgccgccactcaatcagacgatgtggatatacagcttcctcgagtccagtctcaaatcgaggaagtactccacaccacacccgcggcaggcagcgggacaatcctcatcgctcccacgttggttctccgaggcatcagccaccaccggatatccacaatcaaaacacgtaaaggcaatgttgctgccatgggggtcggcccatatttcatctccatcgccgtccattacaagaaagtccgtgatgttcatgattcaccgggatcgcttggttga

SEQ ID NO: 4079 - DNA, 372 bp, Glycine max
  Peptide Sequence Number=SeqID_95764
atggcgcctaccaggcaccctttggatccagataagtccaacagggccctgggatttcccttgctgatcacaggactctgccagtcgtttggagtccccgttgtacctaccaaggcggccaaccaccgggcacatgtgcagacccatgattgtctgtaccagatgagcctcagcatgcagagccaaggcttcgcttctttttcatgccctactccagaccagttcagggcagaggtcgcatggcccgaagattggcccgaggcccaagcaggagaggcccccccagaagctcccggtgatggcgaggaggcccacgaggacgaggagatggccgatttgcttgacttcttgggagggagtggagctacatga

SEQ ID NO: 4080 - DNA, 127 bp, Glycine max
  Peptide Sequence Number=SeqID_95765
aatgaccaaacttggtctctgcttgtcatcgggcccgccgcctctggatgacaaaagggtgcgaataaccataaggtatctccgcgtatcttggtctctacacacaaatggaagtagggtgacctag

SEQ ID NO: 4081 - DNA, 354 bp, Glycine max
  Peptide Sequence Number=SeqID_95766
atgggggtgtatttagtaaacaggggtgtgctaatagcaatcaggcccacttgggtcttccaagatgttccaacagaaggcggtgccttctggtggaagcaacccagctcgcctgggcgagtttggcggcaaccactgagaaaaattgtttccgtgaagaaaatccaagccgaggcacttccgcaacgcttccgagacgtttccgtgggcgattttgtgaagattttccaccgttattcatcgttcttcgttctttcttcgtcgttcttcggtcttcaaccggataaaaacaacttaaccaacgcttatgatggaagcttgcttgtggggcttctatggaggctggatctttga

SEQ ID NO: 4082 - DNA, 327 bp, Glycine max
  Peptide Sequence Number=SeqID_95767
atggagcattttcttgagcaagtagcctggcctgaatctcaacctccattggtgggacccaacttggctgctcctcctaagcccacacctgcacgggttgaaccagtgccaactgatccacaatctccagtggtgagttcaccttcttctcctgagcttgaagtagttcccccatctccacctctgattatcctctctgattccccatctggagaagttgcggatccccctgattccccagttggaggagctgcttatctttcagattcctcatctggagaagttgttgttgtctcttattccacagtttttccatctgatagatga

SEQ ID NO: 4083 - DNA, 360 bp, Glycine max
  Peptide Sequence Number=SeqID_95768
atgcacaactattatgagaaaggaagagctcctgatcttgaaagtgtattggaagacttcatgacgtaccaagctagctctaaaggtgactgttattccatgcaacagcagggagctcagtttgaaagggactattcttctgtagattatcaatgggagtcaaaatggaaaccttattatcacaatgaagtagaaggattgtctaatctggatgacctgctaatgcaattcaaagatactatagattcaatgcaacaagcctttaaaagaactgaaactcagcttggcaagttggtagatgacatgactaaagttgtggtcagaagagaagaagagtatgaaaagattgaagcacatcaa

SEQ ID NO: 4084 - DNA, 2758 bp, Glycine max
  Peptide Sequence Number=SeqID_95769
gccctctgcggcctctggcggctctccctcaaggcgggcgctgacgtagtcgagaaaacaggtgaggcgcgccgccagctgggcgtcgtggtaatacaccgcgttgatcggctggcgcacgtccagcgtctcccgcaccagcagcggtaccagccggcccgcttcccgatcgcggcgggtcatgaagtccgccagctggacaatgcccgctccgcgcaacgccaactcacgcagcgtctccccgctggaggccgagatcgtcggttcgatggcgaaatgccgcgcctgccggtaacgcagcggccactggttcagcgattctgggtaggtgaatcccaacaggcaatggcggtgcagatcttccacgccgcgcggttcgccatgccgttgcaggtaatccgggctggcgaggatgcgcaaccggctgtgccccagcaggcgcgcatggagcgtggagtcacgcagcgcgccgatgcggatcgcgatatcggcgcgtttctccaacaggtcgatattgcgatcgtcggtgtccagctccagctcaatctgcggataacgacggcggaactccgccaccatcggcaccagcacgtgcgtcatgaaaggggcggcggcgttgacccgcagccgaccggcgggcagctggcgccgcagcgccatcagttcttcggcctgatccaccgaacgcagtatttcgcgcgcaggcgccaggaagctctgcccttcttcggtcaggctcaggcgacgcgtggtgcggcgcaagagcgtagcgtcgagtttcgtttccaggcggctgagtgcgcggctgacgccggaggtggtttggccgagccgatcggcggcggcggtgaccgaaccgctgtccaccaccgcagtgaacgccagcagctcttcgagggtgatcttcacgcggttcgccccaggttgacgggcgccgcatgcaacgccctgcgggaaagcaggcccggcgtttcaccgggccaggccagttgcggcgatcttccgaacgcttcttggccaacagcatgtccatcacgccagcgtctgatcgacgtcatcctctgccaccgtcagttgcaccagacggcgggtgttcggatcgagggtggtttcgcgcagctgcagcgggttcatctcgcccagccctttaaagcgctgtacgttcggcttgcccttcttgcgcttcagctgttccagcacgccggctttctcttcttcatccagcgcgtagaacacctctttaccgagatcgatacggtacagcggcggcatggcgacatagacatggccgcctttcaccagcgaacggaagtggcgcacgaacagcgcgcacagcagcgtggcgatgtgcaggccgtcggagtccgcatccgccaggatgcagattttaccgtagcgcagttggctgagatcttcgctgtcaggatcgatgccgatcgccacggaaatgtcgtgcacttcctgcgaggccagcacttcgtccgaagacacttcccaagtgttcaggatcttgcccttgagcggcatgatcgcctgatattcgcgatcgcgcgcctgcttggccgatccgcccgccgagtccccttccaccaggaacagttcggtcatggccagatcctgcgaggtgcagtccgccagcttgcccggcagcgccggcccgctggtcagctttttgcgcaccactttcttggcggcgcgcaggcggcgctgggcgctggagatcgccagctcggccagctgttccgccgcctgaacgttctggttcagccacaggctgaaggcgtctttcaccacgccggaaacgaaggccgcacactggcgcgaggagagacgctctttggtctgcccggcgaactgcggatcctgcatcttcaccgacagcacgtaggcgcagcgatcccagatatcttccgccgacagcttcacgccgcgcggcagaatattgcggaattcgcagaactcgcgcatcgcgtccagcagcccctgacgcaggccgttgacgtgggtgccgccctgcatggtcgggatcaggttgacgtagctttcggtcagcagctcgccgccttccggcagccacagcagcgcccagtccaccgcttcggtgtccccggcgaaattgccgacgaacggcgcttccggcagggtgatcaggccgttgaccgcttccatcaggtagtcggtcaggccgtcctgatagcaccagcgctgttcggtgttgttcaccttgtcgatgaaatagatctcgacgccggggcacagcaccgctttggctttcagcaggtgagtcaggcgcgataccgagaagcgcgggctgtcgaagaactgctcgtccggccagaagtgcacgctggtgccggtgttgcgtttgccgcaggtgccggtcaccgtcagatcttgcaccttgtcgccgttttcgaaggcgatgccgtagacgttgccgtcgcggcgcacgttgacttccacccgcttcgacagggcgttgaccaccgagatcccaacgccgtgcaggccgccggagaactggtagtttttattcgagaatttaccgccggcgtgcagccggcacaggatcaactcaaccgccggcacgccctcttccgggtggatgtccaccggcatgccgcggccgtcgtcgatcacttccagcgactgatcggcgtgcaaaatcacgtcgatgcgcttggcgtgaccggccaacgcttcgtcgacgctgttatcgatcacctcttggccgaggtgatttgggcgcgtcgtgtcg

SEQ ID NO: 4085 - DNA, 616 bp, Glycine max
  Peptide Sequence Number=SeqID_95770
gatccctaattataatcccgcactcgccataagacagctagggtaccccatgaggggagcgccaaccgaagaaagtctatcgcctttccttgtgagggatctaggcgcgcaaagtctcaaggtgatacaaagagtccacaaggcgtggagaagtccattgaagaaagacaaggagcttagaggcatccgaaatggcgtcatcggtggttatcatggatggctaagagttcacacgcaagggttagattggctctccaaattgaaagttatcaatgaggagaacttcgaagctccggaggaagatgaagaagtccaatctctaaaattagagctagggaaggtgagactcgccaaggagaagttcaaatcagccgctacacacatccggaaagagtataccgaaaattccgaggagcattgtggggtagcaacaacgagctcaagctctgaagggaggaaagagaccggtcacgggtccaagaggagtttggctcaatgcttggaagccacggagcaaagcatgctagctatcatagggcagtacaaggaagagttgaaccagtctgtgacccatgaacaaaagctagtggaggattttgatggcccatataattag

SEQ ID NO: 4086 - DNA, 393 bp, Glycine max
  Peptide Sequence Number=SeqID_95771
atggaccaccacggcaaaataggggagaagcttgcctcccagctcgcccacgcaagcagggttgcttcctccagaagcaacaaccttctgaaggaatcttctagagggcccaagtgggcctgcttctcaaagaagcttgttgagaaagcttctcaaagaagccacgaggaagcttctggaggaagcctcttaatgaagcttctagagaaagctacatggagctgcctcggtaaaaacgatgcccagcgtttgttaaccgttggattttctcaaaatttggtctgcaactccacaagacaattttccattatcggaccgttgggatctttgagaagatgtctggagtgtgctagaagcctcttaatgaagcttctgaaggaagcctctaaatga

SEQ ID NO: 4087 - DNA, 363 bp, Glycine max
  Peptide Sequence Number=SeqID_95772
actcaaagcatgataccaagctgagtggggaaactcgtagatacagattctccgcccttttatcattcaggaacgacaagctgagtgggaacgacaagctgagtgggagcagtgaggcgggtgataaacacgcagagacaaattctgcgccctttgtcattcaaaaacagcaagttgagaggtgggcggagacaaattatggtcattccgcgcaccttttcgccgtccagaggcggtcgtgtccggtggcacacagagacaaattatggttattctgtgtcacgccgcccaggctcgattgtgtccaacaaaacgctgagacaaattatggttccgctgacagggaggttcactggccaagtg

SEQ ID NO: 4088 - DNA, 469 bp, Glycine max
  Peptide Sequence Number=SeqID_95773
atggccgatgagaaacctagacgagtaacccttgaaggctactcaagtacaagtaatagcttgaggacttgggatgaagttgtggaaaagtttctgaagaaatatttcctagagtccaagactgcagagggaaaggctgccatctcttcctttcaccagttcccagatgaatctttgaggggtaaaataaagcttaaaactcctgaagaagccatggaactaattgagaatatggctgctagtgatcacgctatcttgtgtgatagaacacactatcccaccaagaaaagttgcacactttgtggaggagctcatgaatcaagctgttgtgttcccactaaagaatcaatacatgaagttaattatatggggaaccatccaaggcagaattttaatgtaggtggattttttggattccaacggggccagcattacaaccagcagcaaaatctatggacaactcaccctg

SEQ ID NO: 4089 - DNA, 294 bp, Glycine max
  Peptide Sequence Number=SeqID_95774
atgaaggcccaagtggagaaggatgaaggcccagaggcagagacactatcaagactattaattgttgctgaaggcccaagtaatccttgtggcgtctacccagacttatcttccttaaccggaagtggcgtctacccagacttatcttccttcactggaagtggcgtctaccctgacttatcttccctctttggaagtggcgtcatccaaatctctgtaacctgtatcaaacgatccgctcctagtcaggttcacatcacaacgtttgtcaaaaaattgcgcaatgttggctga

SEQ ID NO: 4090 - DNA, 359 bp, Glycine max
  Peptide Sequence Number=SeqID_95775
ggccttggggtttccagctctggttacgggcctctgtcagtcctacagggtgcccattcccccagcaaggaatcgcacccacaaagacacccagtggacccggagaagtccaacagggccctggggtttccagctctgggatcgcgcccgcaagacacccagtggacccgaagaagtccaacagggtcttggagatgccaagctctaattacgggcctctgtcaattctacggagtgcctgtcgcccccagcaaggcaggcgcagggctaaacaccacagcagcctggggatggctggcagcggacaacagacgcaccgccattacctctagagttcacctcagctcatccacaaaaag

SEQ ID NO: 4091 - DNA, 56 bp, Glycine max
  Peptide Sequence Number=SeqID_95776
atggagaattggcgaacagcgctacgcaataacttcgcagggctccagactcgaag

SEQ ID NO: 4092 - DNA, 393 bp, Glycine max
  Peptide Sequence Number=SeqID_95777
atggccttcatcatgttctcatttacacatatcattctaaaattcagagattcatgcaaagattattactcccagctagccattcactcacagagtaacgtcacactcttaccggttttggttcaagcttttctttcacaatcaatttgtctactgactaacaattctactcgagaattcgctaagcgcgacactcagtggctaagcgcaaggaagaaaccagaagatgatgagttgtcaggttcgctgagcgcaccgctccaggtcatcaagcacaccgcttcagctcattcgctaagcgaaagaagtgcgctaagccacaatccacttatgcatgctaagcgattcaaaattacgctaagcacgcgagcacggaccaacccacctatttaa

SEQ ID NO: 4093 - DNA, 405 bp, Glycine max
  Peptide Sequence Number=SeqID_95778
atggtgttaaaagataagttgaaggctgtcaaatggcaagaaagtttgatggaacagctgagcagaacgaaagagaatatgttgataactattaatcaatataagaagaatgtgaacctagctgctagtcatgggcagaggctggaggatgaacatgcgatggtatcaactttgcaaattgaaatggaagcaagagagagggtgatagaatcattgcacgtggatgctatgaaatggatggataggttcgctctcactctgaataggagtcaagagcttccaaggttgttagccagagccaaggcaatggccgacatgtactcggctctcgatgaagttcatgatcttttcgattactgccaacacatggttgaaataatgacccatataattaggaattgctga

SEQ ID NO: 4094 - DNA, 135 bp, Glycine max
  Peptide Sequence Number=SeqID_95779
atgacctcatggtgtctccgcgggctaccagctcttgggtcatggcaacaaaaggcgggtgtggtcgacaaaagcgaggctcttgctcctacgtatcctccaatgaggaactcagacctacgtagttctggataa

SEQ ID NO: 4095 - DNA, 739 bp, Glycine max
  Peptide Sequence Number=SeqID_95780
tcaggaagtgttgatggcgtcattgaccctccatccccagtcagacgccacgtgaagtggaagatggcccgcacgaagaaaataggggagatgacgactgaggccgcaaaggaaatcgctgagaagattgattcctttgaggagcagaccacacagggatccttcgtcccccatggatgtcaggatgttctcgccgctgctattggacgtccagagcaccctggatgtgtccgtgttgctggagccggtgtcaccatcaagcaatactttggaccggctccacggacgtcccgcaacgcttcctccctgcctcctgaagaattgcagcaactgacccagcaaattagggaccagctagaggagtccatcacagagaaagtgacgaggcagatgcaatctcagggacttgcagtgcctcctgagcctctggttggtccctctggtcctcgagtgagcacaaaggggagttgtgttgatccctcaggaaacgatcctgagatgggtgactctgacaggtgcggcttgtacatagaaacagatcctgcctgcctggttgccatggggagagtttatgagggatccactattgttcataacactcctttgttgcctggccaagtaaaggtgagtgtggaggaggttacagatgcaaatgctctagttcctgtacccactgatgaggtttccttagtgggtgatgcaatcctaccccacaagggcattggatataagactccaa

SEQ ID NO: 4096 - DNA, 243 bp, Glycine max
  Peptide Sequence Number=SeqID_95781
atgatagaagtgtcagttgaagcaattgcatctctcactcaatactatgaccaactgctcagatgcttcacttttgggaactttcagttagcaccaaccatagaggagtttaagaggatcttaggatgcccgataggagggaggaagccatacctctttttcagggtactatccttctatggcgagagtagcaagagtggtcaagatctcggaatgaaaattagatcaagtaaagcaaagtag

SEQ ID NO: 4097 - DNA, 857 bp, Glycine max
  Peptide Sequence Number=SeqID_95782
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataaaagatgaagtcgttgctaatgggagacaagatcgttcaagtggtgtcatccaagatcgtgacagtggacttgggcaagattcatgcggaagtagtaagcatgctgatcataggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 4098 - DNA, 273 bp, Glycine max
  Peptide Sequence Number=SeqID_95783
atgttggtggcgactccgtgcatctttcctcctttggaaagcgcaccttcatctgccccatctgatttgtcagactctgaatggaggctcttgtctcttgctgaaattgcatattctggatggtcatttgtctcactaactcatctaaggaaggttcaggaggaacctcagttgcttgttgtctttgttatgactattgtcgttgctgctgatgtattggaggaggaacatatggcttgcttggaccagcagcattctgaaatggagggatag

SEQ ID NO: 4099 - DNA, 438 bp, Glycine max
  Peptide Sequence Number=SeqID_95784
atgccttatttgcaagatggaagacccgttgatatggtcttcaatccactaggggtaccttcacgaatgaatgtaggacaaatatttgaatgctcgctcgggttagcaggagtggacattatgcactttgttacacaacaaccacttagaggaagggccaagcagggaggacaacgggtaggcgaaatggaggtttgggccttggaaggatttggtgttgctcatattttacaagagatgcttacttataaatctgatcatattaaaactcgccaagaagtactcgggactacgatcattggaggaacaatacctaaacctacagatgctccagaatcttttagattgctagttcgagaattacgatctttagctatggaactgaatcatttccttgtatccgagaagaacttccggattcataggaaggaagcttaa

SEQ ID NO: 4100 - DNA, 522 bp, Glycine max
  Peptide Sequence Number=SeqID_95785
atgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatccgggtaactatcgtcttgagtccaacccggaaagacatgcaaaaagcaccactgggcagcagccactggctaaactgaaaggacaagttttgggtgactgcgctcctccagccagttacctcggttcaagagttggtagctcagagaaccttcgaaaaccgccctgcaaggcg

SEQ ID NO: 4101 - DNA, 282 bp, Glycine max
  Peptide Sequence Number=SeqID_95786
atgagggacggcaagaggtcttcgtacgtcattgggatcagggtgaattctagaattggcctcgggggaaagttcctcatcacgttggaaatggcgccaaagtgggcattgccggccgggcgagtcgtggttggagctggagcttgggggcctccctttggatgggggcgggcactctatgctgtacgggtgctgaattcgaagagttcccagcacgagctgagaagctcgggtgatgttgctcatactgatgggcaccacgacaggtctgcggttgcttga

SEQ ID NO: 4102 - DNA, 378 bp, Glycine max
  Peptide Sequence Number=SeqID_95787
atgttcaaaactataatgctcaaaatcaccaataacagaatgctcaagatgctgaaaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggggacgcgccctgtacggcgcattaagcgcggcgggtgtgggtggttacgcgcagcgggaccgctacattgccagcgctgat

SEQ ID NO: 4103 - DNA, 1002 bp, Glycine max
  Peptide Sequence Number=SeqID_95788
attgtgacaaccactcagaggccccgaggtttccagccctttacggttaagaagcctgcgctcttcccttacaaaagtgataaggcagtgccatggaagtacgctgcacaagggcccaacggaaggaaagacatgttcatcatacatgttaatgatgattttccctctgctaaagttacaaacatatctggtacgagtggcatgactggtagtggacgaatcttcgtggcgcctgagctaccggtgcggtccaaagacaaaggaaaggcaaaggcggatttaggcgagaacgataaggcgggcctaaccccgaatgatgaggtcacgattggaaagattgtagaggaaggggccgactttagcaagaagggaatatccgctgaggaggagaccaaattcctaaggaccatccaacagagtgagttcatgtcaataacatcatggccaacaattacctcactttcgccgatgaagagatacccgtcgaagacaggggacacaacaaagcctttcacgtggtctgttaaatgtttgggccatatactggccaaagtggtcatcgacaatggctcttcccacaacatcatgcccaattctactttggacaagctgccttttaatgcgtcgcacttgaggccaagctccatggtggtgcgggctttcgatggtagttgtcgggatctgcttattaggccgaccttggattcattcggttggggtggtcccgtcaatgctgcattagaagttaaaattcgtggctgcagaggagtcattggaaacatccttccaggcactggaagttatgagcaatgcttatgtggtgtctcctctggtgccattttaatggtggctcgggttatgttggggcacgaatataagcccagaatgggtttaggccgaaatgggaatggcatagcaagtttggtggagttcgcagagaatcgtagaaggttcaggttgggttatgagcctagtgtgccgacaagaggaggatcgccttag

SEQ ID NO: 4104 - DNA, 342 bp, Glycine max
  Peptide Sequence Number=SeqID_95789
atgcctcaaggctttccttctctggtaatcgattacacagcattggtaatcgattaccagaggccaaactcgagttacacagcttcaggacatggaaacctgcactatccactgtgtaatcgattacacatgactgtattggtaattgattaccagaggcctcctcaacatactgtatccatttctaagcctggtaatcgattacaccccttggtaatcgattaccagaagccatctcaacttcctgatcccatttttaggcctggtaatcgattacacacccttggtaatcgattactagagaccatcttaacttcctgtcttcatttttatgccttgtaa

SEQ ID NO: 4105 - DNA, 432 bp, Glycine max
  Peptide Sequence Number=SeqID_95790
atggcagcgcaattaatccatgaccgagtggagatagagtgcctagagggaatttgggagaccctggaaggcagtacaaggtgccgattctggggcacgattcgattcacggttacttcattggtacatccagaggaaccagcacgcacgcttcagcgtactgtggagtggatattacctacacctactccatatcgactagtggagccagtccaagtgatagaggtgacgtcatcggaggaagaccctgaggaggacccagaggagctacctcctgagcctgctgtggatgctcttgactttccagaggatgatgaggacccactccctgaggtggattctcccgaggacgtcatgtcggcatctgaggcagactctacggaggagagtggtcctgaggggatagcgactagtggaggttcttcatcatag

SEQ ID NO: 4106 - DNA, 216 bp, Glycine max
  Peptide Sequence Number=SeqID_95791
atggagggtacatccacttggttgttcaaagtgaacaaggaagggtacatcccttgtggatctttgcttataaaggttttttacaaggttgaaaagaaatctcaaggaccgcaggtcgcttggggactgaatgtaggcacggaagcaaagcttcatggagaatcaaaggtgattcaaaggtgttttgatgataacaatgatgataacaaaagatga

SEQ ID NO: 4107 - DNA, 873 bp, Glycine max
  Peptide Sequence Number=SeqID_95792
atgccatacacatttattcatgcattcatccatttcacctatgatagatgtcggagtcttgatttgcactggtttttattccactttggtaagaacataggattgagcaaggcgccttcacttaaaaagaggttctatcaagtcaaggtcaatagcctaggaatcaccagtctgaaagagttaggacatttgatgggtcagctccaacgacaagcctttcgcaaagcttatggtaagatctgggacctaatcatggccgaggtctccacggaggccatcgcttccctcgcccaatattatgaccagcctttgaggtgcttcacctttgcggacttccagttaacacccacggtggaagagtttgaagagatcctgggatttcctctgggaggaaggaaaccatatctcttctcaggattctatccctccttagctagaatttctaaaatagtcaaagtctcgacacaagaattggaccgcgggaagcaagtcaaaaatggggtggttggggtaccaaggaaatgtttggaagcaagggcgagagtcttggcaagtcaaggcgaatgggccccgttcatggacatcctggcacttttgatcttcggggtggtcttctttccaaatgtggatgggttggtggaccgagcagcgattgatgcttttatcgccttttatgaccgcaaggaaagcccggttgtcgctatcttagcggatctatatgacacattcgaccgaagatgtgagaagaacaatgcaaggatcatttgttgtatgccggctctctacatatggttggtttcacacttatttcgccaagagatgagacacgtttgcccgctagaaggccaccgctcatgcaccgagaaaaaagag

SEQ ID NO: 4108 - DNA, 93 bp, Glycine max
  Peptide Sequence Number=SeqID_95793
atggcctttgtggataactgggtggtgggtaaggagaagatccctcttgtaagactagactcaactcaagcagcttacgagagtttagcctaa

SEQ ID NO: 4109 - DNA, 479 bp, Glycine max
  Peptide Sequence Number=SeqID_95794
atgtgtgtgcacctgacgggtgaatgcaatgaagatttttcccgaagccctgaatggactcggatgtgtgctgctaaagttgacgtctcactaagcgagctcaatgcgcttagcgagtgtcatccgctaagagaggcatcaacgcgcttagctgataggaggaatcaagaagggaatctgtcatgctggcatgcactcagggcgtcattagctcgctccgtgagtcgtttgtcaccttccaggcttagcgcgagtttggcgctgagcgattattcacttactcgcaccaagcgcgagaatggcattaagtgtgacgtcgaggtcagtgagcccttttttatgcctgacttgtggagaattgattgtgaggttcctagaggtggaggagacatccccactcctttcattgaaagatgtattgtctccttagaacttgatagagcaggattaggttaccgtatgtttggacacggagggcg

SEQ ID NO: 4110 - DNA, 585 bp, Glycine max
  Peptide Sequence Number=SeqID_95795
gacatcgtgtccgacatcgtggatcctgcagcttcacttctgcacttgacttttatcttgcattgtacaacaactccagtattctcgggcaggatgtcaggacattgtatccgacatcgtggatcctgcaacttcacttctgcacttgacttttatcttgcattgtacagcaactccagtattctcgggcaggatcgtgactcaaaagtcaatatgacagatcttgtgagcgcggaagatgacagagcaaaagtttatacggataaccactcgggtatttccgcccgtcagcgtgactcaaaagacagtatgacagatcttgtgggcgcggaagatgacgtatatctccgcgtgtcaacgggcttttcgtcttacagacagcaaaaagtttatacggataaccactcgggtatttccgcccgtcagcgtgactcaaaagtcagtatgacagatcttgtgagcgcggaagatgacgtaaatcaccgcgtacagcaaaaagtttatacggataaccactcgggtatttccgttcatcagcgtgactcaaaagtcagtatgacagatcttgtgagcgcggaagatgac

SEQ ID NO: 4111 - DNA, 396 bp, Glycine max
  Peptide Sequence Number=SeqID_95796
atgagagtagaagaagctcaccactataggaggccatggataagaacttggaggaagaaagagatgaatgaagggagaggaagagaagagcacaaaattttgtgctctaaaagagctctgaaatctgaagggggcaaaagggtcttttccttggttttcctggaccctagcccacctaggctagcctctcactcgcttgggccaccaaatagcttcatggtgaagaaaccaactcgccagggcaagctcattgcttcagcactaagtgatgtaagctccattggagcttgtaggcctaggatcttcatcaatggattcctttgtttcttggaagatgaatggcagcagaatagagaaggaagagagagaggagacgtcaccttaaggagaagatga

SEQ ID NO: 4112 - DNA, 279 bp, Glycine max
  Peptide Sequence Number=SeqID_95797
atggatgctcatccgtgtcaggatggcgtacaccagctggcacttcggcatggggaggtcggaattatgatcggtgggcaggatgttgctgaggagcagagtcatccatatctgagtcagggtggtcatatttgtgcgcatgattcgcactcgcctccctgcagcagtccggggcaaaatcctgcctcgtggccctcctccaatatcaggagagtggcccagagaaccgttaaaagagaaactactggtcccttaaccgggagtgcaagtcttggttaa

SEQ ID NO: 4113 - DNA, 456 bp, Glycine max
  Peptide Sequence Number=SeqID_95798
atgtctcgcactccctccctctatgggccaagcattagcgtaaaactccaggactacctcagggtcaaacttagtcatgggagtcaccagcgacgtctaatgtcagcgggctatccactcctgaaaatatgtgtactcatcctccctgagctggacgcgcctctctctatggaacgaccatcctttgatggcctcgaagcgctgctggtgcacgacacttcggaaacgatggctatcgaactcgggggcagcattggtcccttcagtcgtggtgtctctcctagatttctttgcggaaagctttttcggagccatttcctacgaggacaaacattgaggcaatcctactccgtaagggcattgggtagaagactccaagtagattgggctagagatccaaggaaaggccctagggttctcatgagccttagggtagatttcgagcccatgggctaa

SEQ ID NO: 4114 - DNA, 923 bp, Glycine max
  Peptide Sequence Number=SeqID_95799
gccttggaaaatcaaagcaaatgggctttcttttatggacatcttggcactttggatctttggagttgtcctctttctgaatatggaaaggttagtggacctagaagtgattgacgctttcctcgcctttcatcatggcgaggaaagcccggtcgtcgccattttggccatgtatgacacgttcgaccggggatgtgaaaagagcggtgcaagaattgtttgttgtgcactggctctctatgtgtggctggtttcacacccttttctccaagaaggtaggcccgtctatccgctacaaggtcaccgctcgattctatcgcacggggtttcggtgaccacaacgcgagggtactccaaggagttctcaaggcatgggatgcggcgtgaagaaaggacagagagcttaggggaagcaactgtgagagacgatgaggttaaagcttcggaagaaagtgatgaggtacaagccctaaaggcagagcttgaaagatcccgggtagtcgaagagaagttcaagtccatagccatcaaactgaagccttggaacgaagaggtgaaaggaatcatcacgggtcaaaggcatgatctccgaagaggtgaaaggatcatcacgggtcaaaggcatgatattgaaggacgagctaaagggaatatgtgggccatcattgataagtgcaaagagaagctaaatctagcggcgactcacgagcaaaggctagaggatgagtacgccaagatatcagccgaaagggaagcaagggaaagggtaattgattcattgcaccaagaggcaacaatgtggacggaccgatttgctcttactttgaacaggagtcaagaacttccccgatttctagccaaggccaaagcaatggcggacacctactccgcccccaaggagatccacggacttctcagctatt

SEQ ID NO: 4115 - DNA, 480 bp, Glycine max
  Peptide Sequence Number=SeqID_95800
atggggacaaatcaaactggcaaaaggttttatcaagtcaaggttaaaggcctagatgttaccagcattaaggaattggggtggttgatgggacctctccaaatgcaagccttccgcaagacttacggaaaaatcttagatttgaccatagcagaggtatccatagaagccattgcatcactcacccaatactacgaccagcctttgagatgcttcacgttcggagacttccaattgaattgcaactgtggtcaaggattcagcaagaggtttggaccgcgtaaaacaaactcgaaacggcatagcgggcctaccacggaagtacctagaagacaaggcgagggatatggcaaatcaagaagagtgggtcccgtttatggatgtgttagcattgctaatctttggggtcgtcctctttccaaacgtggatggtttggtggacctagccgcaatcgacgctttccttgcataccaccatag

SEQ ID NO: 4116 - DNA, 264 bp, Glycine max
  Peptide Sequence Number=SeqID_95801
atggtgaaagttggaacctcttacgtgccgatcaacgtctcatttcgccaaaagttggccagggcttcccggtatcaacagggacaccaggatttatttattctgcgaagtgatcttccgtcacagtggcttctgtttctatcagctgtccctcctgttcagctactgacggggtgttgcgtaacggcaaaagcaccgccggacatcagcgctggcaagtgtagcggtcacgctgcgcgtaaccaccacacccgccgcgcttaa

SEQ ID NO: 4117 - DNA, 336 bp, Glycine max
  Peptide Sequence Number=SeqID_95802
atgcccttttgcgggcgagcgaggcgaggctcacgggtgcgctttccaaaggaggaaagatgcgtggagtcgccaccaacgtttatttgtgggaaacgtcggaaaaaccgaaggataccggtcaaaatgaaaattctaagttcgggagttgtatttacgtttgacgaagcggggctttttgctcctatgtaccctcctttggagaggaaatcagacctacgtagttcttttcttaagagtgaatcaagcgattctttttacttgaaaggtgatcattttaaggcgttggaccttaaaaatgatccattttacttaattaggcgagaaatgacttaa

SEQ ID NO: 4118 - DNA, 321 bp, Glycine max
  Peptide Sequence Number=SeqID_95803
atgggtaaagcaaaggaggtgcaagagaaggtgaaggctgacatggaggccatgaaagaaaaaatggccacaataatggaggccatgatgagcatgaggaagataatggaagccaagcgcgtcaaccaaatgaatcatccaacctcagctatggtaggcaaagatttgggaagtacgggcggcccccatgatgtgcaaattcaaaacgagcacgctttcccgccatatggcttgcctctcaactatacgccacccaatgtggcgtacactcctaatgagaatgtcaataaagccactcctatactcgttgagagccaataa

SEQ ID NO: 4119 - DNA, 372 bp, Glycine max
  Peptide Sequence Number=SeqID_95804
atgtcattgcctaacgctgttcatgcatcctccaccaacgagtctggagccccgcgaatgtcattgcctagcgctgttcgccaattctccattctccactttttttcggagccccatgaatttcattgcctagcgttgttcatgtgtcctccaccttcgagtctggaggcctcccgaatgtcattgcctagcgctgttcgccaattctccattgtccactttttttcggagccccatgaatgtcattgcctagcgctgttcatgcatcctccaccaacgagtctggagccccgcgaatgtcattgcctagcgtttttcgccaattctccattctccactgtttttcggagccccatgaatgtcattgcctag

SEQ ID NO: 4120 - DNA, 921 bp, Glycine max
  Peptide Sequence Number=SeqID_95805
atggctgaaccttcgaagaagcgaaagggcacttcgagtcggagtcaacggcattccgggtcacaggaaacgccaattccttcctccattccctctagatcattgttttcatcagaggaacaacaaatccatgaaggtaccctaatgtctgaagtttatgggattaagattgtcattgaccaatccctattctatgatttaacccaattgccaagcgaaggtgtaccatttgaaggtgcactgattgatgattggaagtttgatttctctgtacatgatgcccgccggttggtttgtaccaaccaagcggatatgaccggaaggcttctagccggttcattggcttttgaaagccgcatcctccattaccttattgttcgcatcttgcttccgagatcttcaaaccttgctcaggtttatgaagaagatctcattgtcatgtgggcctttcataaaggtttacaaattgattgggcacatcttgttagatatcacatgcataaggcattacgactgaatgctccattgccttaccctcatcttgatacccttttccttcaacacttcaacatccctcttgattctaaaccttatgttccaatcaagagatctttccttataggcgcttcagtcatagcatcttttggttatcaaaaggagcatgatggctcttgggtgaagaaaggtgctcgacatgttggtgaagaaggacatgatggagaggattcatctctcctttcaaagataatggacaggtttgatggtcttcaaacctttgttggtgaaaggtttgacactttggaattacaagtggatatccgcttcaatgaaatggagtcaagaatcacaaaggttgaagaagatgtgtcttacattcgttcaagcttcgatcttccaccaccgccgccaccatcatcttag

SEQ ID NO: 4121 - DNA, 855 bp, Glycine max
  Peptide Sequence Number=SeqID_95806
atgtctctgaaattacctatctattctgaattagtcaaagctttctattctaatttagaaatccatgaaggtatcctaatgtttgaaatctatgggattaagatggtcattgaccaatccctattttatgatttaagaaaattgcctagtgaaggtgtgccttttgagggtgcactgattgatgattggaaattcgatttttctgtgcatgatgcctgccagttggtttgcaccaaccaagcggatatgactggaaggcttcttgccggttcattggcttttgagagccacatcctccattaccttattgtttgcatcttactccctagatctttaaaccttgctcaggtttcggaagaagatctcattgtcatgtgggcctttcataatggtttacaaattgattgggcacaccttgttagatatcgcatgcataaggcattgcgattgaatgccctattgccttatcctcatcttgttacccttttccttcaacacttcaacatccttcttgattctgaaccttatgttccaatcaagagatcattccttataggcgcttcggtcatagcatcctttggttatataaaggagcatgatggctcttgggtgaagaagggtgctagaaattttggtgaagaaggaaatgaaggagaagattcatctcttctttcgaagattatggaaaggtttgatggtcttcaaacctttgttggtgagaggtttgatactttggaattgcaagtggatatgcgcttcaatgaaattgagtcaagaatgacaaaggttgaagaagatgtatcttacatccggtcaagctttgatcttccaccaccgccgccaccatcatcttag

SEQ ID NO: 4122 - DNA, 774 bp, Glycine max
  Peptide Sequence Number=SeqID_95807
atggatttcttttcagatgagagttttgaatgcattcaagcatttgaaaactccaatcttattcctttcatgcctataaaattgcctgtttattctgatttagtcaaagccttctattcaaacctagaaatcaaagaaggcactttaatttctgaagtttatgggattaagatggtcattgaccaatccctattctatgatttaactcaattgccaagtgaaggtgtaccatttgaaggtacactgattgatgattggaagtttgatttttctgtgcatgatgcccgccggttgctacgcatccttcattatctaattgttcgcatcttgcttccgagatcttcaaaccttgcacaggtttctgaagaagatctcattgttatgtgggcctttcataaaggtctacaaattgattgggcacttcttgttagatatcgcaggcataaggcattgcgattgaatgctcctttgccatatcctcatctagtcactcttttccttcaacactttaacatccctcttgattctgaaccctatgttccaatcaagagatccttccttataggcgcttcagtcattgcatcctttggttatcaaaaagagcatgatggctcttggttgaaaaagggtgctcgacatattggtgaagaaggacatgatggagaagattcatctcttctttcaaagattttggacaggtttgatggtcttcaaacctttgttggtgaaaggtttgacactttggaattacaagtggacatgcacttccattag

SEQ ID NO: 4123 - DNA, 96 bp, Glycine max
  Peptide Sequence Number=SeqID_95808
atggagtgtaaaccatctagactaagtgaagagccagttgggacctccaaagggtcatctaagccttcacataggaaaccgtctagcttgctttaa

SEQ ID NO: 4124 - DNA, 413 bp, Glycine max
  Peptide Sequence Number=SeqID_95809
atggcgcaaatacattccgtgcttttaacccaacccaagctgaagaaacttattcaatggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 4125 - DNA, 96 bp, Glycine max
  Peptide Sequence Number=SeqID_95810
ccacaactcagcaccacaactcaacttcatcataggcatcatgtaggaaactcagaaaacaaaaaagagttcaacaagactacttctaggaattga

SEQ ID NO: 4126 - DNA, 951 bp, Glycine max
  Peptide Sequence Number=SeqID_95811
cgacggaccgcacttcatgccgatcgggttcttgatgccgcggaaatattccacatgcgcgtggtcgagctggcgcgtgcggtcgccgatccagatcatgtggcccgacgtcgcgtaccagtcgccggaggtggaatcgacgcgggtcaacgcctcctcgtaaccgagcagcagcgcctcgtggctggtgaagaagtcggtttcacgcaggctcggattgctgtctgccgagatgccgatcgccttcatgaaatccatggtttcggagatgcggtcggccagcttgcggtaacggtccgcctgcgggctgtccttgatgaagccgagcatccactggtgaacgttttcgaggttggcataaccacccatcgcgaaagcgcgcagcaggttcagcgtcgcggccgactggcggtaggcgtcgagctgacgctccgggttcggaatacgcgaagcctcgttgaattcgatgccgttgatgatgtcgccacggtaggacggcagggaaacgccatcctgcacttccacgttggaagagcgcggcttggcgaactggccagcaatgcgtcctaccttcacgacaggcagctgcgcgccataggtcagcacgacggccatctgcaggaaagcgcggaagaagtcgcggatattgtccgcgccatgctcaaggaagctttcagcgcaatcgccgccctgcagcaggaaggcgttgccttcagccacattggcaagctgctttttcagacgacgggcttcaccggcaaaaacgagcggcggataggtcgcaagcgtggcttccgttgccgcaagcgctgccgcgttaggatattcgggaacctgctggattggcttttgccgccagctgccgggggtccaattctgtgccatgttcttacccttttctcgcccgcgcaacagcggcgcgaccgcctcgaaaaattgagcggcttatag

SEQ ID NO: 4127 - DNA, 666 bp, Glycine max
  Peptide Sequence Number=SeqID_95812
atggatacctcagagccctacactgggatgatcagccctctcaatgagtcaatctcttgctttctcataagggtggacccttgggtactagtaccctactcgtcttcagagggctgctcgccctcaccttcagaggactatacgtcctcgccatcagagggctgcaagccctctcctttagaagactacatgtcctcaccttcagaggactacacgtcctcgcctttagaggactacacgtcctcgccattagacggctacacgccctcgccttcaggactacacgtcctcgccttcagaggacaacacgtccttgccttcgccttcgtagggctacacgccctcacctttagaggactacacgtcctcgccttcagaggactacacgtacttgccttcagaggactgcacgtcctcgccttcagagggctacacgttctcgccttcagagggctacacgtcctcgccttcagagggttgcacgtcctcgccttcagaggactacatgtcctccacttcagaggactacacatcctcgccttcaaagggcgacacgtcctgaacttcagagggctgcacgcccttgcctttagagggctacgcgtcctcactttcagtgggctccatatccacaccttaagagaatttaaggtcctctgcccttaa

SEQ ID NO: 4128 - DNA, 257 bp, Glycine max
  Peptide Sequence Number=SeqID_95813
gatttagaagcaacgacaactccagaagaagaacctcgatcttccgaggcatcttctagttttcctattgcagggaattctcatatagaacctgttgaagacccaatcatggctgaagagccaagaagagtaaccttggaggattattcaagttctattgtgccacaatttttcactaacccttatgctcacttggccacctacatagagatatgcaatactatcaggctggcgggtgtgcttgcagatgcaatcag

SEQ ID NO: 4129 - DNA, 247 bp, Glycine max
  Peptide Sequence Number=SeqID_95814
atgaacttcaggaactttggtgataataatagtaaccaccccacttgggatgccatgcatgggaagacaccagcaaacaatgttactactctgctgagacagccctcaacaatatactcattgacatttgatgagtttcagagcacaatgggtgggattgggaaggattttgggtcgatgaacatggatgaactcttgaagaacatatgggcagctgaagagactcaagccatggcattttcagctg

SEQ ID NO: 4130 - DNA, 1380 bp, Glycine max
  Peptide Sequence Number=SeqID_95815
atgtcgttgctgctactccctcaacctccgacacccctctcaacggtcaccttctccgccgccgcacgcgcacccttcgccgccgtcacgcctccgcgcccgagaacgctaactccgaaacccgcactctccctctctgccccaataacaacaacagcacccaataatgcaatccctccgaagaaggtcctggttcccatcggattgggcaccgaagaaatggaagccgttatcatgattcacgtcctgcgccgcgccggcgccgacgtcaccgttgcctccgtggagccgcagctccaagtagaagccgccggaggcaccaaactggtcgccgataccgacatttccgcgtgttccgatcaagttttcgatctcgttgctttgcccggagggatgcctggctctgcaagactacgggattgcgatgtgctgcggaaaatcacgtgcagacaagctgaggaaaacaggctctatggtgctatttgtgctgctccggctgtcacccttttgccatgggggcttttgaaaaaaaagaagttggggctaatatgctctattctgtcatgcaagataacttgccaccccgcattctacgacaggcttccaagattttgggccgttaaatcaaatcttcaggtttccagaggactcacaaccagccgggggcctggaactacttaccagtttgctttgtccttggcggagcagctatttggggactctgttgccaatgaggttgcagaatcgatgtttatgagaacagatgatgatcatgcagctaaggagttcaataaagttgaatggtctgttggccaccacacccctagtgtcctcgtaccagttgcacatggttccgaagagattgaagtagtgactgtggtagatattctaaggcgagcaaaagctaaggtcatagttgcttcagttgaaaaatctcttgaagttttggcttctcaaggaaccaaaattgttgctgatatattaattggtgatgctcaagagtcagcgcatgatctgattattcttccagggggaactgctggtgctcaaagactaagcaaatctagaattctgaagaagcttcttaaagaacaaaattcagctgaaaggatatatggggcagtctgctcttcacttgccattctacaaaaacaaggtttactaaaggacaagagggccacagctcatgcctccaccttagacaagcttaaagacaaagaaataaatggtgctaaagtagttattgatggcaaactgatcactagtgagggacttgccactgtaacagattttgcattggccattgtgagcaagctatttggtaatggaagagcaagaagtgtagcagaaggccttgtttttgagtatcctaagaagtag

SEQ ID NO: 4131 - DNA, 522 bp, Glycine max
  Peptide Sequence Number=SeqID_95816
atggacataattggaggcgactacagcagccagtgcttaatgaatagaatagtcgctatgaaagacggtttcaagaaacgccaccacaaggtgtcaaatttggacgatttggtgtcgtgccttgataagatgactcttttagctgaggaagaggatagaattattgaggcacgtgaagaagctcctcctttggttccacaatttgaacgtcaacagtttgatatgttgggtaggagtgtggagacccaaggtttagggcgacatagggaaagtgtggatgcagaagcacatgttattcctatgatgccagagcgccaacatggaatgtattacacacctgatcagttcacccaagatccgtctcaaatgtcgcccctgtatctgtacccatatcaaagcgaaacttcatcaagggcgataggagaaggaatccagatcgataagctcggagatgggagcgaccatgtgggacgtcctcccgccataacacacatcatgatgatgatgatgatgattgattag

SEQ ID NO: 4132 - DNA, 252 bp, Glycine max
  Peptide Sequence Number=SeqID_95817
atgacctatattttagacgatttaactgatcatgcgcttgctacgacatttgcacatttagatgctactattgtactatcaagaggattagcagccaaatgtatctatccagcagtagatcctttagattcaacctcaactatgctccaacctcgaatcgttggtgaagaacattatgagactgcgcaaagagttaaacaaactttacaacgttacaaagaacttcaagatattatagctatggcacaatag

SEQ ID NO: 4133 - DNA, 1434 bp, Glycine max
  Peptide Sequence Number=SeqID_95818
atggctttagagggagcaagtgtgaagaggacgccggagctccaagcagcattgctctgcggcagatcggggcagtttaatttggcagcgccgtggttaagcggtgtttggatttggtggggatggaagaaggtagaacatgtgacacgtgcggcagaaatggaaggttcgaaaaaagctgagccctgcgccgaaatggaagccaccattctctcctccctcatctcccaactcctccttctcctcctccacaacattttccctttccccccaaattccgtccctccaaacaattccactgattccatcctcccgctcctcctcttctcccaccaactcgccgccacactctccctctcccccaaacaccgcaaaaacaaacgcaaacgcgattttcaacaccccaatcccctcacccgcaccccggactccttccgcaacaccttcctcatgtcctcctcctccttcgagtggctctccggcctcctggagcccctcctcgagtgccgcgaccccgcccccctcttccactccctccacctctcctccggcgcccgcctcgccatcggcctctcccgtctcgccgagggccaggactaccaacaaatctccgcccgcttcgccgtctccgaccccgtcgctaaattctgcgtcaagcaactctgccgcgtcctctgcaccaacttccgcttctgggtctccttcccctccccttccgacctcccctccatctcccaatccttccaatccctctccggcctccccaattgctgtggcgccgtcctatgcacccgctttaatatagtagtcaacgccaatagcaccaccaccaccaccaccaccaacgacaaagtctcagtttctcaagtcgccgcccaaatagtcgtcgattcctcttcccggatcctcaccatcgcggccggcttcctcggacacaaatccgattcccaaattctacaagcctccactctttacaacgacatccagcagggaaccctcctaaacgcgccgtgtaatcagtttctaatcggcgattcagagtatcctctgcttccctggcttatggttccctatgcaaaccctgctcctgcctctgctgaagagaatttcaactctgctcatgaaatcatgcggcttcccgcgctcagagccgcggcgagtctaaggaattggggggttctgagtcgaccggtgtgtgaggagcttaagacggccgtggcttacattggcgcgtgctccattcttcacaatagtttgctgatgagggaggatttttccgctctggcttcggagtttgaggattgtaatcaaggttgttatggcgagccttgtaatgctatgttggatggtgaggctgtgtcttccaaggctttggctttgcgtgacaatttggctgccgtggcaaagaaaattcgtgactcgaagaattcttga

SEQ ID NO: 4134 - DNA, 531 bp, Glycine max
  Peptide Sequence Number=SeqID_95819
atggttgaatctgaaagacttagctacatcagaaacaaccaaaagaaacttagagttgacaagtattgtagcttacaaaattcattggatattggaacagctaaaggcttaaccaaagggaaaagagtcatcttaccttcaacgtttgttggcggtccacgttatatagatcaactttactttgatggtatggcaatatgcaatcatgttggtttcccaaatatttttattactctaacctgtaatccaaattggcctgaaattcgtagattactttcacctttgaatctcaaaccaacagacaaaccagacattgtatcacgaattttcaaattgaaatatgaacaaatgctctcagacttaacaaagggtcaattactcggaaaagtagttgcatatacatttctccctgtgaagttgcttggagaatatttgcttttccaatccacgggagaaagcctgctgttgagagattgtattttcatcttccagatcaacacaatgttctttatgaagatcatgatgatatag

SEQ ID NO: 4135 - DNA, 378 bp, Glycine max
  Peptide Sequence Number=SeqID_95820
atggccaggtgctaccgcccctactcatctataggcaagtccatcaatcatgtcccgtcactttttgatagagaggcagtaaagatcctattgatgagtcatatgcacattccgacagagactgaggcctttgcggcaacaaatgtaggtgtcaagatgaggttgacgtggttggaagacctttaccaccgctacattaatattggctactccgagggggaggattatgttgtggacaaatcggtagccaccagattgaagccgttaagaggttctgggcgtgcccttctaatcatggagagactggatgacctacatatggatgctattatgtggtgtccatataaggcacatagggcagtgagaccttttgggtaa

SEQ ID NO: 4136 - DNA, 54 bp, Glycine max
  Peptide Sequence Number=SeqID_95821
atgggtgtggaaaagaggcagttccaggggatgtgtggtggcctatggagatag

SEQ ID NO: 4137 - DNA, 207 bp, Glycine max
  Peptide Sequence Number=SeqID_95822
atgatggttatagcctgggaacaatgtcagagatcatctcgaaatgatacaagtgagtaccatgttttccttggtgaaaatggtgttcatgacattgaaggaaatgaattacctcgtcttgtgtatgtgtcttgtgagaaaagagctggatatcatcaccacaaaaaaggtggacctatgaatgctttggtgagagtattggcctaa

SEQ ID NO: 4138 - DNA, 669 bp, Glycine max
  Peptide Sequence Number=SeqID_95823
atggtggcaattctcaaagagttccagctgagacttgatctagatctactagtagatggtcttgaaatcaagaaccaggctgggggagaagcaagctatactgtggaagcagagaatgatggaaaagtgtcaaagctctatgatggagcttggaagaagattggagggaagcagagcttacccatggggaacaatccaaacaagagtgaaagaaaaggaaaaaatagttctctttgtgggagtcttgtgactgacttttgtggaagaattgcagaagaagtgcctatggaaatggtggctaggaaattacaacaattgaattgctcccatgtcccaatgggcaaagtccagcaaaataaagaagaggaccttggtaatcatcagctacgaccatgtgcactagtgcagtttgcaagagagccaactcagccaagggatcttctcgatataactataaaggctttgatgctctgtttcatgaccaactggagtaggaggtgggctgcaggtaggaggtatttcgactcaccacaaccgcattgcggccgcatcagctgcattttcccgccattgcccaaaaggcagcagccacaagatgttcaccttgaggacaagaagatgcaagcacgtggggaggatagggagaaaggtggcctcatggaggactaa

SEQ ID NO: 4139 - DNA, 255 bp, Glycine max
  Peptide Sequence Number=SeqID_95824
atgtgtccaaaatttggaatcatctgtgctttaaataccttgacgatagtgtatgataaagacagtggcaggtctagaggctttggatttgtcattttttcaaatgaagatgatgctaaatgtgcaaaggatgcaatggatggaaaggcactgttgggtagaccattgaggataaattttgctcttgagaaggcccgtggtgtacctgttgtagttcctcgactttcagatattggacatgtgaataggcactaa

SEQ ID NO: 4140 - DNA, 618 bp, Glycine max
  Peptide Sequence Number=SeqID_95825
atgtcagaacttaaagttagcctctctaggttatgtgcgtatgcttctaagggagtggccagaatgaggaaggataaattggtgagcactacggaattcctttcacagatcgattggggaagtatttgggtaagaataccagtgtggagattcatcaagaaagttattcctttcttagaagataaattctggtgcccggtttgccaccttgaagatgaatctatttggcattgtctcttactttgccctcgagtgcccaggctttggaagagaggatacatggtcttgattattttttgggtggtttggtgctcgagaaaccgaactgtctttgaggaagtcattgacttagagtggactctccttacgaaaattttctcccaagaagagtatcatccaagcttatgcatcccccaacaagcccaattcagtctctaccattctgaccgagtgaattgggcttcaagagatttacgcattaagacaagggttggaaatatgtttggatctgggtataagggagttaacgtgcgaaacagactctcttcacacccttcagttggtttgaggagcttgttgctggttgatgcattggggacctcgttccctcgtctgtag

SEQ ID NO: 4141 - DNA, 375 bp, Glycine max
  Peptide Sequence Number=SeqID_95826
atggatttcaagtcacatctagaacagaggaagacactacatagtaggaaccaaagtagccctaatctgctggaggaagcaatagctcaatgggaattggcaaaagaactggggattaagcgtgcactatgggaatctatcaggcagcttaagaaccttgaaccttgtggtctttggtgtattctgagcgattttaacaacattagacatccatctgagagagtgagtgtgactcagagggagggggatctcaataatatcatagagttcaatgactcgttagcagacttagaagtagaagaagcaccatgtatagggagaaaatttacatggttcagaccaaatggggctgcaaagagcaaattagacagatga

SEQ ID NO: 4142 - DNA, 150 bp, Glycine max
  Peptide Sequence Number=SeqID_95827
atggggaaaggaggagtgagagggattaatagcacaatccagcggagagatctgagccgttggatgagggaggaggtggggcccgaggggagggatagaggattgcgaaagcagaataaagatgaagaaaattcttattactacgagtga

SEQ ID NO: 4143 - DNA, 423 bp, Glycine max
  Peptide Sequence Number=SeqID_95828
atggggaggtcaggtagtggtggaaaggctttgccgtggtgggggttactgattttattatctgtcaagcatttaattttgtggtacttggtctctgtcttaccaccgacattcaatgagttacaaaaactgcttagtaagactaatggccaagttgtcggtgacttgatgactccaactccacttgttgttcatgaatcaactagtcttgaggaagctgctaggctgttacttgaaacaaaatatcgtcgactacctgtggtagatgatgatggaaagctgatttgcttgaaggttgtgctggcgacggtcagcgtaacctctatattattagctacggataatgttaatactattgcaaatgtatatggcaggccaaaggaggagctggaggcaacttttgatggccttgtgagatcttag

SEQ ID NO: 4144 - DNA, 309 bp, Glycine max
  Peptide Sequence Number=SeqID_95829
atgtcttggcttttcactttccttctcactctcctactgtcattccattcgttgctatggttccaagggcacaaggcccaacccatggacgacgaaagcctgaacgggtcttctcgcgttccatcgccaacgacgatgtcgtttaaggcaacaaacgacgcgtgggatgttttgtatgcagttgtagggcaagttgcaaggttgaagatgaaagatttagtctcttcaaagtttgatttcgagaacagtggagtgttggatgatcttcctccacctattgcggaggagaatgcattttttccaaactag

SEQ ID NO: 4145 - DNA, 690 bp, Glycine max
  Peptide Sequence Number=SeqID_95830
atggagttgagtaaccaattgttgtcttgcactttacgggacgattattgccttcaatttttggaatatttagatgagcatgagagtgaaagccccattattgtgttgttgaccaatgccagaattaaggaaggccagggatcctatccatcctcagttagcaattctttgaaggcttctaagttggctattaatcagcaagtggcaccaatccaagaattcaatcagagcttgcattcagtgccacaaaaaatagatgagtacacagaaccgttcgcatgcgcatgtggaaaacataatgatcgagctgtgcttaggtcgttctatcccttttccaatttttgtaccaccatatttatctttgattttaacactattatatatgtttgcaaacataatgaaaacgcaagattcctcctctgggaccgtgaatgcactgaattgattggacagtcagctgatgaaacatgttcaaagattaaagttacaatgcttggctccaatgatcctgcccaacatgcatctcaatccatgtctatgacagcagaccatgatccacttattgggctctccttgacatcgacaaagcgacaaccatctgatgaatgtgacgatgaagcaagaagctcccagatttcacctgctcagctatcgtccaacaaattagggaaacatgagcaaatcgaatag

SEQ ID NO: 4146 - DNA, 756 bp, Glycine max
  Peptide Sequence Number=SeqID_95831
atggagttgagtaaccaattgttgtcttgcactttacgggacgattattgccttcaatttttggaatatttagataagcatgagagtgaaagcccaattattgtgttgttgaccaatgccagaattaaggaaggccagggatcctatccatcctcagttagcaattctttgaaggcttctaagttggctattaatcagcaagtggcaccaatccaagaattcaatcagagttattttgctcatgttgttgttaatatatgtttactgttttttcccttggctctggcattgattcacttgcattcagtgccacaaaaaatagatgagtacacagaaccgttcgcatgcgcatgtggaaaacataatgatcgagctgtgcttaggtcgttctatcccttttccaatttttgtaccaccatatttatctttgattttaacactattatatatgtttgcaaacataatgaaaacacaagattcctcctctgggaccgtgaatgcactgaattgattggacagtcagctgatgaaacatgttcaaagattaaagttacaatgcttggttccaatgatcctgcccaacatgcatctcaatccatgtctatgacagcagaccatgatccacttattgggctctccttgacatcgacaaagcgacaaccatctgatgaatgtgacgatgaagcaagaagctcccagatttcacctgctcagctatcgtccaacaaattagggaaacatgagcaaatcgaataa

SEQ ID NO: 4147 - DNA, 171 bp, Glycine max
  Peptide Sequence Number=SeqID_95832
atggaagtggagaaggctgtgaagaggataatgacaggggaagaagccattgaaatgaggaacagaacaaaaatgctttcgcatttagctaagggagctattgaagaaggaggatcatccatttctgaattcaaagctttaattggggagttaagttcattgagccactaa

SEQ ID NO: 4148 - DNA, 1149 bp, Glycine max
  Peptide Sequence Number=SeqID_95833
atgaggaagttgtgccctaattttgacaatgaagatgggttggataccgtccttgaggtgccaattcccgaggagatgttgtccggcatgggcagcaatgggtccaatcgttggaagaacatgcgaactctcatgaatgctcaattcgttgataagtcttctggtctctcaacaccatcaaacaatgaattcatggtgttgcttaagcttgtgggtgctccccttattcctcttcaggttccatcagaccataatttgactcgccccctcaaagattgttccattagagattcgagtgccaagtacatagttcagcagtacgtggcagcgacgggaggagtagctgcgttgaattcactggaaagcatgtatgctatgggacaagtgagaatatgtggatcggaggtgcgtcgtcaaggtgatggatacgaagaaagcgttcaatcaagaggcaaaactgaagtgggaggctttgtattatggcagaagaaccctgatttatggtgtttggaattggtcgtttccggtttcaaggtcagtgctggcagtaatggaaagctagcttggaaccattcttcttctcaacctttccatgctaacaaaggtcctcccagacccctccgccgcttctttcagggactggacccaaggtgcacggctaacttgttcctagacgcagaatgtgtaggagagaacaacattaacaacgaggtttgcttcatgctcaggttacaaacggatcaacacattctgcaagcacaaagcatgtccaatactgaaatcgtaatgcacacaatgctgggttacttcagccaacgcacggggctactggtgaagtttgaggacacaaagttggtgaaaatgaaggccgttaaaggaaaagagtcagtgttttgggaaacaagcatcgagtccatgattgatgattatagatacatagatggcattaacatagcgcatggtgggaggacaattgccacgctttataggtacggtgcggcgcataatcacaaacatatgattgaggaaacatggacgattgaagaggttgattttaacattgttgggttgtctatggattgctttctgcctccctctgatggtgagagagagcacgaaggtgcagagcaagcagtgggaatgggatag

SEQ ID NO: 4149 - DNA, 738 bp, Glycine max
  Peptide Sequence Number=SeqID_95834
atgactttatcatcagtcaatgcgattgtgtattatgatggtgtcatcataacaactaaacatggttcaacttctgtaagcgattcaccaaagatcgttcaacttgacaataaaatgtcatttgatgccttaaagaaggctattggaaacatgattagtctaccaaaagactcacaagcatttgatgccactgaggatcaacttcacccatacttgagtacctctgcagtagatcctacctcatcaacccaaccaaacgagtctgattttacagtagagcctgaattacctaatgaagtattcggtgcctttagtgaggacgaagacgaaattccgaatacgaccatagcttggatcgcgaagaagtccaacattcagtggggactctctttgaagggatgttttttctggcaaaacaagaagtacaacatgctttacaacagtatcatgtatggtcgtggagaaagaaacattgccaatgccaccacaaggaggtcaagtagtagagggcttcatgatattccattgtcttttttggggtttcagatcgtgtaccaatggatttcaatattgcaagcccgtggtttaggtcgatggaacatggttgtatgggagagaatcgcagtaatgcttgcatctaaccaaggttatatgcaagtactaaacaaggtcatcgaagatgcacagggaaagacaaacgttcacactgttcttgagtttgatcgatgtgacacatga

SEQ ID NO: 4150 - DNA, 1839 bp, Glycine max
  Peptide Sequence Number=SeqID_95835
gtagattctatacattctggttctatctcatttgggagatttgaaaatgagcctttatcttgggagagaaggtcctctttctctcacaataggtacttggaggaggttgagaaatgtgcaaaaccaggttcagttattgagaagaaagcatattttgaagctcatttcaagaggaagggcatgcttggttttattccatctacaggtcatgagggatcatcagatagagcaaccagtgaaaatgatggatcagagagaaatgccaagcaagaggattttgagtccaatgatggccattatgttcaatttgatgaaatgtcccaaaaggattttgagctagatgaaggtgaccattatattgaaatggaccaaagttcccaagaggattttgtgacaattgaagatggtcattatgttcaatttagtgaaattcctggtaattcaaattatcatgaagagcgtggtatggatgaatatgaaagagaagagaccatcacagaatatccaatggtttcattttcaggtttgcagatggaatctgctgtgaacaattctaatgatttggaggatgacagtaagaaaaatattactttggatgaagctcatcaatctgaaacaagtaatatactctcagatagtggcaagattgttatagaagtgaaaagggatgatgatgttactataaatactgatgaatcatcaacaaacatgattatgcctgttgatgaaccagcacggggtgttgaggaaacaatttcccatgatcctgcaaatccttctgctaaggaaacaaagctcaagcctcaacagaattctgaagacaacaatgttcgagtacggaaaagcacaccttctagatcagccaaggatcctgctaggattccaggtagagagagtccgaggagatcaaatatggaaaataatttatcaaaacttgcaactccaactacttggtcagctagcaaatccaccaaagaagtttctaaaagtgcagagaaactaattcgtgaaaacaaaagtgaaaatgcatcaagagtaagaaagggtgcagaatcccaactttctgcttcaaaaacagctccgaaaggaattcaagaagcagagaggctgaaccaagcttctgattctacaaagtccaatgttaagcctagggctgcagctttcaactttaaatgtagtgagcgagcggaaaggaggaaacaggcaaaaaaaatgcatgcaaaggaagcagagatgaatcaaatgcaagcaatatcacaggtttcaaatgagtttctgtttctgcttctgtatgtctatggtgcggaagaagcaagacacattggtgtggagaagacagaagctgatattaagaaactccggaagagcctcaactttaaagcaacaccaatgccttcgttttaccgcacaccttcaccttcacaaacacgtgggaataaggctgtgtcaaataacaccagaagtaataaagaacagatcaataaaccaaaatgtccagggagtgaagcagatgcagcattaccttcgaagtcgaaggtgggaaatgatatagataccaatgaatctgtaacaggaagagaaccatcaaccaaccatagtcatcttgctgattctatgacaagtaatcatacttctggaaagaaagaaggggcaaaggtttcttcccagaaacacagggtatctgatagttgcaaaggagcaagacaactaagcaatgagagaaatagaaatgttgaacccacaaaacagagaaatgatatgatgaggaaaggtgtggggaatgttggtttgagaaactgttctaaaagtggtaatcttgccgtacgtgttgcctcctga

SEQ ID NO: 4151 - DNA, 1035 bp, Glycine max
  Peptide Sequence Number=SeqID_95836
atgagtttgccggagtattcgccgtacatggcgatgagcagcgggatccccatcacgagcgtgttcggcaatgtggagagggagaaaatcgtaatcatccactccaggctcccgttggcggagaagttcgtccagatggcgagggcgaagagcatgatgattttctggagcgtgtccgccgcgatgaaccggaagttcatctcgtacgggttgttcatggagatgaagtggaacgagaggagcggaacggcgaagatcgcgacgaagcggtttatgccggagcattggtccggtgagaatatcttccaccaccgcaccgagccgtacgccaggatcatcgccacgtacagcggaatcaccgccgacatcaccgttgttattgaaaaagggaaagaggtgaatgagtttagggggattgggggaccactagggaacagtgtgaagttagtcgctaaccctcatggcctcactcagctcgtgccctccctccctcactcactcatgtcatgccctcactttgttcctcactcatcagtcgtcgaaggtgcctccattgttatagaggattttgttggaataaggattccactgatgccaagtccaactccaagtcaaaagaaagtgaattttcttgtgacttatcactttgttaatgctttaaagcctcattcttcatcatccagagccaaattatccatgagaaacatcttaccaaaattcggctttaagaaccgtgcaccatcgatattgcttgatgttgaaaagggtgttactattgctactcaagaaggttccttttctgttcatcaagagaagtcttcaatcccaagatcagtgtctttcacaaagatgtttactcctaagattaagagaacgtcttcattaccaatagaagaacttgggtgtgcaaatgtagaatgttttgtctggaactcttggcttagggcgatgtctcgctcagcgcacaagtccggcttagcgcaagaaggcccacgaggagaagcccaatgcatgctcagcgcgaggtcagcgtga

SEQ ID NO: 4152 - DNA, 345 bp, Glycine max
  Peptide Sequence Number=SeqID_95837
atgctccaaccatgtgggatcggcacagacttaaaggagtactcaaaccggatgacccctaaggcttacacttcgaagagtccatcagggcatctccttcctgattcaggtccaacccctaaaataattttttgcatgcagtcgcttaagcattcttcgttatcaattgtggcgtttctaatgctctctagagctcctcctccggttgctctgttagggtttccaaacgttagagagaaggagaagagattgaatcctccattccatgatcctacgtgcgatgcatctttctccttccacaaacactattttgcaaatcgcaacggtgaagacgtgcggaaatga

SEQ ID NO: 4153 - DNA, 138 bp, Glycine max
  Peptide Sequence Number=SeqID_95838
atggctggaatctgggtcgaccatgatgacaaagtaactgtcatggagagttttattctagtatggttttggcctctccagtacaccgtacattggtccaaatggttgtaccctccaagacatgttttggcgttttag

SEQ ID NO: 4154 - DNA, 218 bp, Glycine max
  Peptide Sequence Number=SeqID_95839
atggcaaaggagatggacaaagatcagtggatatatgacaacataatatttgaagaagttaatatgaatgaagacaatggagagaaacctagtgtatttgaaaatattgattgttctgattccttaagtacttctcaagtgtttgctacctgtgatgatgttttgcattgggctagctctgttgcatatgatattggttttgtggtggtgataatgag

SEQ ID NO: 4155 - DNA, 267 bp, Glycine max
  Peptide Sequence Number=SeqID_95840
atggttgccatgcaagggtgccgccagcaccaacagcgatacaacttccatgtgcacaagccgtcaacaccaatggcgagacatgcacaagccgccgacaccaatggcgagacatgtgccaacgtggatcaatctcgtcattgcttcctgctaaggcttgcagctgtgcaggggtcacatgcatacagtgttgcttgcagagggtcacatgcatgctttaatggtcagacttcgtgtaattttcctttaaatagaagtaccttataa

SEQ ID NO: 4156 - DNA, 1323 bp, Glycine max
  Peptide Sequence Number=SeqID_95841
atggagtcaacgatcataaaccaagtctttttcttcttctgcttctttctatgctctctcttagtctcagattcttcaccatctgcttcaaaaccaactccttcattccccaaagaagccctccccactaagcatggttaccttcctatcagtcccacttccacttcttccattttctatgccttctatgaagcacagaactcaactttaccactctcccaaaccccacttctcatttggctccaaggtggccctggctgctcctccatgattggaaacttgtacgaactcggaccctggcgcatcaccgaatcactcacccttcaacgcaaccttggtgcttggaatagagtctttggccttctttttcttgatagtcccattggaactggcttcagtgtggcctcaaccacacaagaaattccaacggatcaaatcggcgttgcaaagcatctttttgctgctataaccaggtttgttcaacttgaccctcttttcaagcatcgccctgtttatattactggtgaaagctatgctggcaagtatgtgcctgctattgggtactacatattggagaaaaatgcaaacttgaagatttctgaaagagtgaatttggctggtgtggctattggggatgggttaaccgaccccgaaactcaagtggttagtcatgctgtgaatgcttattatgttggattgatcaatcagaggcaaaaggatgggttggagaaagctcaattggaagcagttagattagcccagatggggaattggagtaaagcaactggtgccagaaacaaagtgttgaatatgttgcaaaacatgacagggttagctactttgtatgactacacaaggaaggctccttatgaggatgatttggttgaacaattcttgaacattgcagaggtgaagaaggccttgggggtgaatgaatcgtttgtatatgagttatgcagtgatgttgttggggatgtattacatgctgatgttatgaaaagtgttaaatatatggtggaatacttgttgggtaggagcagggttttgttatatcaaggtcaacatgatttgagggatggtgtggttcaaacagaagtttgggtgaagacaatgaaatgggaggggattgtagattttcttaatgctgaaaggaagatatggaaggttaatggagagcttgctgggtatgttcagaattggaagtctctaaccaatgttgtggttttgggggctggccatcttttgcctactgatcagcctgttaattctcaagcaatgatagaagattgggttttggaaaagggtttgtttaaaagcgtgtag

SEQ ID NO: 4157 - DNA, 747 bp, Glycine max
  Peptide Sequence Number=SeqID_95842
gttggtcgaatgacattgggcggattattggctcttgggtacattgttgtggttagttataagcgtgcctccacaactgttaataatggcaaggtttcaatgtcttttgaaaccattgatgttcttggtgagacattcatggtgatgagaggaactaatagaaagactgttggaacagaagcattaaggatgggcattaatggaccttggattactaaatcatatctggaaatgattcttgaaagaaaaggtgtacctcgtcttagtacaccaccacttgtgtctaatacaactgtgcctggtagtcaagaaaccgtgatcgctgcgccaaagccaattcgtgttacccctaaccttgttaccgggcttgatgatttacctcagccgtggactcgatctccaacaaaatctaaaatggaacctgttgtggctgaatggcatttcatatcttcagattcttccctgcctgacaactcagtcctaggtattttccttgaattggaggatgtagctaattttggagatgatttcttgcatgcttacttaagatttccattgtgtcaagacttctctcatgaagcaaccacagatccttcatctttcagggatagtgttaggcttgctccaatgcctgattcatttgacttggataggggattgcttttggcagttcaagcaatacaagcattgttggagaataaaggtgtcccagtcatagttggaatcggtaatatggatgtttcttga

SEQ ID NO: 4158 - DNA, 786 bp, Glycine max
  Peptide Sequence Number=SeqID_95843
atggcaatcgggttcatgaatgtggttggctccaccacatcctgctatgttacaacaggatctttctctcgctcggctatcaaccataatgcaggtgctaaaacagcaatgtcaaacttagtaatgtctgtgacagtcttggtgacactactgtttcttatgccattatttcaatacacaccaaatgttatattgggtactatcataataacagcagtgattggcctcattgatctcccttctgcctatctcatttggaagctagacaaattcgattttgttgtgatgttgactgcattctttggtgtgatttttatctctgtccagcttggccttgctattgcagtcggattatcagttttcaggatactcctgcaagttacaaggcctaaaacagtaatgttggggaacatacctgcaacaaccatatatagaaatattcatcattataatgaagctacaagagtacctggttttcttattttaagtatagaggctcccatcaattttgcaaacatcacatatctcaacgagagaatattacgatgggtagatgaagaagaagctactataaatgataacttatgccttcaatttgtgattctggaaatgtcagctgatgttatagaaaagctgcaaaaagcagatgaagttgatgatttcgttcgagaagattaccttttcatgacagttggagaggctgtaacttcactttcatcactaatgaagggccaatcaccaaccatggaagaagaggaggcacagaaaattgtgactgagtactaa

SEQ ID NO: 4159 - DNA, 1014 bp, Glycine max
  Peptide Sequence Number=SeqID_95844
ttctctttcacggaacgtaattctgattttatggaagtagcattggacaaagtgacaatggaccaagtacccaatgaagtgcaccaagttgttgcaccaccctacaagagctccctacagaagttcatcaccaaggttaaggaaacttttttccctgatgatcctctgcgccaatttaagggacaaccactcaagagaaaactaatccttggagctcaatatgtgttccctgtgcttcaatgggctcctagttacagcttcaaactttttaaatctgaccttatttctggtctcaccattgctagtttggccatcccccagggaatcagttatgctaaccttgcaaatcttcctgcaattctgggactctgtgagtatgttgattttgccagcaattctagttttgttcccccccttgtgtatgttgttcttggaagctcaatggatcttgcagtaggacctgtttctattgcttccctagtgctgggatccatgctcacagaggaagtgtctcccagtgaacaacctgatctttttcttcaattagctttaacttcaacattctttgctgggatctttcaagccgctcttggaattctaaggctaggatttatcattgattttctatcaaaggcaatccttattgggttcatggctggatctgctgtaattgtagctttgcaacagctcaagggccttctcggaatcaaacatttcaccaaaaagatggccctgagcataaggaaaccaaagctattctgggtctcagctggagctcctcttgtgtctgtcatcatctctactgtcctctcttctgtaatcaaggctcaacttcatggcatcagtgtgattggaaaattgccacaaggagtaaatcctccttcagtggataagctactttttcaaggaagtcatctcggtctagccatcaaaactggccttgtcactggcttattatccctcacggtacgtttcatccttctcatctatacactgttattcattggaacttga

SEQ ID NO: 4160 - DNA, 453 bp, Glycine max
  Peptide Sequence Number=SeqID_95845
atggaggtcatttacctaagcttgatggaagaagagcttaagaacacttgggaaagcttggaagaagagtggttaattcgagtctctccgaatgatcagatcatagagtatgactatgttaagggatgtacttgggttaatcactcaaagtggggacctgctgcaacctgcccttcgatgggagggcgacgcggggctcacgggtgcgtcttccaagaaaggaaaatgcacggagtcgccaccaacgtttatttgaggaaaacgttgaaaaaaccagaaaggtgtggtctacgaactttaatcgtgaaaggttcaggagttatttttacgcacggggaagggtgtttccctcgctcctacgtatcctcaattgcgatgaggaaatcaaacctacgtagttcttttagagctaaacgttggttaagttgttttgatctttttccgcaagattga

SEQ ID NO: 4161 - DNA, 3297 bp, Glycine max
  Peptide Sequence Number=SeqID_95846
atgaagctaactgacaagattggatgggtctccttgaacaacgtgtccaacaagttgtttgagttcgactcaaacgtcttttgccgcttcaaggaccgtttcttcaaggtcctggctattgatgccatggttgatggcttgccacttatgtttaatagggacaaggaatatcgcttcccgttctactggcagtctaaccccaccaaattcaagtcgtttgatgagaatctgttgacccttgttgaaagggtcgacaaagctattttggagcagttgccatcctcgctagacatgcgggtcattttgtcttttccctcgacaagcgatcctctccttgccttggacggaattatggatgacttcgcttggaggccccttgtgaaggatgccagacttgctggtgggattgtgccaccgttcactattgcccttgttgctggagaaaggggtcaacctactggtgaggttggccatgttgttggtactgtcgaggttgcccccggtcgcaagaagttaggggtccatttgagccttcgtgctctaaggcaagccgcagggttaacgcctggttcgagtcacccttcaagtttgcaagatgtgcctccagctctagtgattgtcgagacttttgcttccactgttgttgttacggttactcttgcaagatgttcaggagcgaccactagtgctcatgtgatgccgccttctgctgcttcagctccatctattccaccctttgtcgtgttagcggcgacatgtctccctcgtcttatcgtccctatgtctctttggatcacctacacacctccagcgatgttgattcactgtgggaaccttattcggttagctggggtacaaaacgctatagactctgccaaagtcttcctcaagagaagtttgatgattctggaggagaataggcaacaacaccaagaggctttgcgcaaggtgtcgtccatggagacaaaagttgccaaatggagggctactgcttgcacggtttggagacaagagcgccctaagttgttacgcacaaggtcggatggtgatgaactgtccacacactgcaagagcttgcaagaagagaaaaaggacttgggtggcaaggtgagagacattgtgacgaagagggacgagcttcctaaggtggttgttgagttaaaggcccgactaaaagaatctaagtcctggctggaggagtctgagctgcaagtggctaaggagaaggaggctagcaaggaggttgaagaggagttgataatgtgcaaaaaggatgctatggagcagcacgaaaaaggctttcaaaaggtcgtcaggcaaactgggttatacgccaaggaccttgacttgagttttttttacccttttaaggatgtgactgacaattttctgcttgacgagaaagatattgttgttgaggaggaggttggcgaggagcagggtgctgatgatgctgatgtcttgtcaaccagtttggtggtagttcgtcttgtggaacttggacctttaactgtggacttaccaagggtggaccttgggtttgacgaggctgacatggttgccgccggaggattggagccttcgaaaggggtctcgcgtatgaggccggaccgagtgctaaccatagatgtgaaagagagaggaaaaacacacaaccctccccaaaacggtgtcgttttctgggaccattttagagagaaaaagagagagagagagttgtgttgtgatgcggaaacgttgatcccaaatgcacccgtacaaccggctaccgagcagcgggcactcgacgccgtcaccgccgccgtctccgctccggtcgccgaggctccgccacgcagggcggtccaaggccgggcgggcgtttttctcttcgctcctctcatttacatctccggaatgctcctctacatgggaacggcgtcgttcgacgtcgttccggtaattaaacaccgtcccgcgcctggctccgtctaccggagccctcagctcttcgccaagctccgcctcgacatggattccgataattcctccgccgatgcggcgattgatgatgaattgtctgtgagaatgaaaggatattctaagcttgacattgagactcacaaggggtcaaacctaacacgaagtcttggtaaggaagctgggtgcaaattccgggacatttatgatgaagagttttttgtcaataccttgaaaaatgatgtacgggtggttgacaagattcctgagtacctaatggaaagatttggcagcaacatgacaaatgttcacaatttcaggatcaaggcatggtcatctattcagtattacaaagatgtggtactccctaagttacttgaagaaaaggttataaggatttcaccttttgcaaatagattatcatttgatgctcctccagctgtccagcgtcttagatgcttagcaaattatgaggctttacggttttcaagtcctatattgacaataggtgaatctttggttgaaagaatgagaaaacatagcgccattaatggtggtaaatatgtctccgtacatcttcgttttgaagaggatatggttgctttctcttgttgtgttttcgatggtggaaaacaggagagagaagacatgattgcagctagagaaagaggttggaaagggaaatttacaaaaccaggacgagttatacgtccaggagcaatcaggatcaatgggaagtgcccccttaccccattagaggttggcctcatgcttaggggaatgggtttcacgaagaacacatctatctttttggcatctggaaaaatatataatgccgagaaaacaatggctccgctacttcaaatgtttcctaatttacatactaaggagaccctagcttctgaagaggagcttgctccatttaaggtttacatttgtactctaatgatggctgctatagattacacagtttgtcttcaaagtgaggtgtttgtcacaactcagggaggcaacttccctcattttctgctgggtcacagaagattcttgtatggtggacatgctaaaacaattaagccagataagcggaagttggcattactgtttgataatcccaatattggcattactacctgcactagccaacacaacgcacacaacaacattggggtcacaaatgatgatatggtggtagtggagacacacaagggcgttgaggtcatagattcgagggagagaagagcgcgagtgatgtttggtggtttgatagttttggtggtggtgattgggggcaggtttgatggtgatggtgctagggtggtggctattatgggttag

SEQ ID NO: 4162 - DNA, 1002 bp, Glycine max
  Peptide Sequence Number=SeqID_95847
atgtctgattcatttggtagcacctttcactcttccgctccaaactccaccctcaattcccatgcacccccgaaaatcaccacattctgctcaatagcccaaccttattgcatttgcacccactgcaaccacatcctcaccttcaaccaccatgttggtaatttagcagaggaagggacaaatagcacagggtcccataacaataatgtgcagtctcagccgcaacatagcacaaggtggagtccaacgccagtgcagttactagtccttgaggaattgtataaacaaggcacaaaaacaccctcagctgaacaaattcaacaaatagcttcgcagttgcgccagtttgggaagattgaagggaagaacgtgttctactggttccagaatcataaggccagagagagacagaagcggcgtagaagggaaatggaggaaaataataataacaatgctgctgcttcttcttcttctggtgaagggttgaaagagacaggttgtggagttaaagagacaaagaagtgggcatccacttcaaactgcagtggacatgcagaggaatctgcactggatatagcagaaaagggatctaatgggtggactcagtttgaggagagaggcagcatacaagttttaaggagaaacatatcagaaaaacaagctaagttgcaagaaatggaaatgccttgtttccttcctattactatagcagctcctactacaacttcacacagaacaacaacacataacacacaacttttatcccctcaaaactataataatttatcatcttcactcatcaacagagaaagtttaaactactatggtggtgatgaaaatgcagattctcgaacccttgacctatttccacacaagagggatgaccaagatggaatttctcttgctgagaggaaatcatcatctatgctctgtgctagtgcttctatggacactgaaatcacctccaaccagttttttgagtttcttcctttaagaaactga

SEQ ID NO: 4163 - DNA, 535 bp, Glycine max
  Peptide Sequence Number=SeqID_95848
atggaagaatcgtcgaagaagcgaaagggatcatcctcctccaccgctgctgctggccatcgccgccacagaccatctgaagcacccacagcacctatccatccttccttatcatctccaagatcatccactctattttcttcagatgatcaacgtctacggtacctttctcaattttcttttaggatcattttagaccctaagtacctagacatagatttcttcaatgatgagacatttgactgttatcaagtgtttcaaaactctggcttggttgatttcatgtctttaaaattgtcttacaatcctgaacttgtcaaagtcttttacagcaatttaaaaactcaggatgacattatttcttctgaggtgcatggtatttccatgatcattgatcaatctttgttcttttctttgacaaaattacccagtcaaggtgcaccttttgagggcaccattgttaatgactggagatttgattattctagtcatgatgcttgtcgtatggtttgtaatgaccaggctgaaatgaccg

SEQ ID NO: 4164 - DNA, 513 bp, Glycine max
  Peptide Sequence Number=SeqID_95849
atggagaacattctgggtccatcgataagcttgatcaaaagaggcactaatctcaaagcttgtgatactcgtaccagtgacccatatgtcttcgtcaccatggccgaacagaaactgaaaactggtgttgtgaaagataacattaatcctgagtggaatgaagaattgacactttatgtaagcgatgttaacattcccgtacatctgacagtttcagacaaagacactttcaccgtagacgacagcatgggcgacgcagaaatagacctaaagccgtatcttcagtgtgtaaagatgaacttgagcgatcttccagatggccatgtaatcaagagggttcaaccagataggactaactgtcttgctgaagagagcaactgcatatggaagaatggaaaagtcacccaagagatgagtttaagattgagaaacgtcaagtctggggaaataactgtggaaattgagtgggttaatcttccagattcaaagggcttatctgaaattgagttttag

SEQ ID NO: 4165 - DNA, 192 bp, Glycine max
  Peptide Sequence Number=SeqID_95850
atgcgagatgattcagcccttatgactgaagttctttcagagttatggggtcttcgcacttatgtaggtgaacaatttgattctttggatggtcgctttgcaggaatggatatccgtctcacgcagcttgaagaggatgtgggttatattcgtcagagcttcgatcttccaccaccaccaccaccctcttag

SEQ ID NO: 4166 - DNA, 1422 bp, Glycine max
  Peptide Sequence Number=SeqID_95851
atggcaacatttatccgaagaatggcaatcagctatattcttctgacattgtttttctctgcagatattggattttttggacgtgttgcatcatttggaatcaactatggccaagtagctaacaatttgccgccgccagacaaagtccttgaactcttgaccaacttaaaggtgacaagaacaagaatttatgacaccaatcctcagattttgactgcttttgctaactcaaacattgaggtaattgtgacggttgaaaacaacatgctaggccagttaaacgatccccaacaagcccttcaatgggtgagtggccatatcaaaccatacctcccagacacaaagatcacagggattcaagtagggaatgaattattcaccaatggtgacaccactctcattcagtatcttgtgccagcagtggtgaacattcacaatgctctagttcagctaggcctagactccaacatccacgtttcgacgccgagttccttagaggtgcttcaggaatcttaccctccttcagctggtagtttcaagagtgagatctcagggatcatgtcccaatttttgaacttcttggccaccactaaggcacccttttggatcaatgcctatccttactttgcatacaaggatgaccctaataggattccattggactacgttttattcaatcctaatgaaggaatggttgactccaacaccaacctacactatgataatatgctctatgctcaggtggatgcagtctcatttgccattgctaaattgggttttagtgggattgaggttagggtctctgagactggttggccatccaaaggagaccctaatgaggttggtgccacagtgcagaatgctcaaacttacaacaggaatttgctgagaaggcaaatggcaaatgaagggacacctctgagtcctagaatgaggttggaagcatacttttttgcattgttcaatgaggacatgaagactggagcaacctcggaaaggaactatggtttctttcaacctgatgcaactatggcttacaatgtaggattggctgcttttgcagactcatccacttcatccacttcaatttctcttacctcctctgccactaaaacaaaggacaacatgggtggatgtggacgccctcgacggcgtcgaagaggaggagggcagtggagaccctttagtggtgccttctcgatggcgaagggtgggaacggcgtcgtaggcggtgcgaagggtgggaacggtgtctcgtccgatggcgatcggcttcaccttcgacgtctcggagtaactgaactggaactcgaatggcgctgtggaagaggaagaagcgtcgcagccatggcccttttgcatggacattcatactctgcacatggtaagggttgcgttgctactgttaaatcaatccaatga

SEQ ID NO: 4167 - DNA, 156 bp, Glycine max
  Peptide Sequence Number=SeqID_95852
atggctagagaaggtggtggcacatgccagctccgatggcgctggagaaaggtgggcttgactgacgatgaagagacgagtccagtggtgctagtagttacagcttctgcacagcgaaatatggttcgtgtgcttgctttctttgtcaaagcttaa

SEQ ID NO: 4168 - DNA, 222 bp, Glycine max
  Peptide Sequence Number=SeqID_95853
atgatgataacaaaagatgatgacaaaggtgatgacaaaaagctcaaagatcaatcaaagaacaactcaagtgaatcaagaacaattcgagagttcaagataagaatcaagaagaattcaagatctcaagaatcaagatcaagattcaagactcaagattcaagaatcaagagaaggcttaatcaagataagtatgaaaaggttttctcaaaaattgaataa

SEQ ID NO: 4169 - DNA, 959 bp, Glycine max
  Peptide Sequence Number=SeqID_95854
gtagagttataaaaagagccctaggaagagaagataatcgtgattcagacgaagctctccagcggcgaaggcccacaacattcgcatgtaggcaacaggaagttgccgctgttgttgaaaatgttcatcacatagatgacgcaaccgaagaggtcttccaacaacctcaagaagtagttgttgatgttcagggttttacaggcgggtcatgtgacacatcaattttgaccgtctatgttgatcatgttacagaacgtcttgaattgaagttatcctcccatggaaggaaggttaaaaaatttgggaggcatcctactgagattgaagggttagttgttgtcacaggattaagtcttctgatcacatgttctttggacactagcgattggggacttatatcgacttttgcggagagggccttccatagcttcgagactcttcatgtcgatgaagcggtgttgatgttagtggaattacctgaagtcagtgtagatgaagccagagctgaaacagtacagtgttatggggcatatgctattattgctgaagattattatgaaaggaaaccatgtgcttgccgctggacatctacaaaggcattaccagtgtcgatgtatcggaagcgtctagatcgactaacatctaatgatatttattggataccttacagtgaccatcgtagagggttgtgcgacagtttaggtatgttcagacggttcttccacactctagattcaagattatgcttagaagatattgatgacagatggatgcatttctctgattaccttgcagcggtgggccagatttgtcttgtgcctggacaatgtgcaccagactacatggattggttctacataatttcgcatccattcatggggccagcacaacccgggtatccagtcatacatccacttgtcatccaagatgacacatatgtcgaaccagatatgccttag

SEQ ID NO: 4170 - DNA, 333 bp, Glycine max
  Peptide Sequence Number=SeqID_95855
atgaattttgatgatgtcaaagaagaatcaaacaaggttgctacaaaggataagtattgcttcaagattaatacaagattgcttcaacaaacaaagccttgcttcaagatcactttaagatcaagccttgcttcaaaacaaagtgtttccaagacatgcaaggatctgaaacctgtgtcataccctaatttcgttcggggaccattgtttggtggcatgcaaccttcgcttgaccgcctcgatcaattcgagtctaggtccttccggaacattatggaagttgggttgcttaaggaggaagcaactgggcgacaagctcctccacgtttttga

SEQ ID NO: 4171 - DNA, 501 bp, Glycine max
  Peptide Sequence Number=SeqID_95856
atggcgttaagatcaagccttgctgcaaaaaataaggctgatacggatcaagttgatctgtatgttgatattaaacatacagatcaacttgatcctataatgtttcaagatgttgatatggatgatcaaaatgaacaagaatgtggtgtgaatgaaccacatgttgattgttcggatgcgttcaatatttctcagatgtttgacagccgagatgatgttttgcagtgggctcgatccgttgctcatgaaaacatatttgtggcggtcattataaggtctaacacaaacactggtagtagaggaaggacttcgtttgtgttaattggctgtgaaatgagtggtgagtataggtgtaggaagaaagaatttgttagaagagatacagggactagaaaatttgggtgtcccttcaagcttcatggcaaactagtggttggagggcaaggtaggatggtgaagttgatgtgtgggattcataatcatgaattggccaagtcatga

SEQ ID NO: 4172 - DNA, 1722 bp, Glycine max
  Peptide Sequence Number=SeqID_95857
atggcatttggggttcgcaaaatgccgcgttttgtggtgtgcgctggccctaagaagatattatttggcaaagagtgcagagaagccttacaagctgggattgataaactcgctgatgctgtctctcttactgttggacccaaaggacgaaatgtaattctttctgaatccggaaaccttaaagtgattaatgatggcgttacaattgctcgatccattgagctttcggatgcaattgagaatgcaggtgccatcctaattcaagaggttgcaagcaaaatgaatgagttggctggtgatggtactagcactgcaattattttggctcgggccatgattgagtctggactactagcagttgcttttggggctaatcctatttctttgaagaaggggatggaaaagactgtaaaggagttggtcaagttcttgaaggagagaagtgttcctgttgaaggaagggagcatattagagctgtagcatcgatttctgctggaaatgacgagtatgttggtaacttgattgctgaagctatggagaagattggttcagatggggtgatctctattgagtcttcctcatcatctgaaacctctgtgataattgaagaagggatgaagttcgataagggttacatgtctcctcactttattacaaaccaggagaagtccattgtagagtttgactgggttaaagttttggtaactgatcaaaagatttcaaatgtcaaagaaatagttcctttgctggaaaaggctatgcagttgagtgttccactcttaattattgcagaggatatcacaaggcaagtgttggagaccttagtggtgaacaaaatgcaaggattactaagagttgctgttgtaaaatgtccaggatttggaggtgcaaagaaagctttgttacaagatattgcccttatgactggagctgattttctttctggagacttgggtctcacacttgatggtgccacatcggaccagcttggcactgcactgaaagtgacaataaccagtaatgcgacaactatcattgctgatcctagtatgaaggctgaaattcaggctagaatttcacagataaagaaggatcttagtgaaacagataatgcaaacctgtcaagaaagctctcagagagaattgcaaaactctctggtggtatagctgttataaaggttgagcttaacacatcagtaaggtcggtgccttgccttgtgacttggaacaaggtaggtgcacatactgaagtagaacttgaagataggaaacttagaattgatgatgcaaagaatgcaacatttgctgccataagcgagggaattgttcctggagggggtgccacatatgtccacctattggacttgataccaacaataatgaactccatggaagatctagaggagcaaattggtgctgatattgtagcaaaggcactccttgaacctgcaaaatcaattgcaactaatgcgggagttgatggagacattgttgtccagaagattagaacacatgattggagaattggatataatgcaatgacaggcacatatgaagatcttttgaatgctggagtagcggatcctagtcgtgttgcaaggtgtgctcttcaaagtgcagtttctgttgctggtgcagttctaactactcaagctatattggtggataaaataaagaaaaccaagccacctgtacccttggtccctggcataactccctag

SEQ ID NO: 4173 - DNA, 894 bp, Glycine max
  Peptide Sequence Number=SeqID_95858
atgagaagcaagttgtcagtgttagaatcggtgtggggggatgctttggtttggggtgaggctaatggggatgctgacgtgaatttgtctcttcttattgtcactgctgcacagggtttggcttggattttgggagggggggttctgaacatctatgttctagtgttgttgcaaatgttgttgtcacaccagccagctcttgcatttttgtgtttggttgcaattaggggtgttacaagtataagggtttgcaggaactctgatcttcaagagccattgcttgtcaatgaggaaccggggtctctcaatgttaatccttatagagatactggactttttagtttggccactctttcttggctgaatccacttctttccattggtgcaaagaaactgctcaagcttaaggacattccacttgttgcaccaagagatagagccaagactagttataaggttttgaattctaattgggagagattgaaggctgaaaatgagaatccctctaagcagccttcgttgacttatttcaagaatagaagaaatgataaattgattatgaggaaaaagctacacaaaactaagtattttcattgtctaagcacaatgcacgtccgcaatggcgtcaaagcaaagctccaaagaccaacgcatgttgaagaagaagaggacgatgcaagaagaagcacagcgggccaagaagaggtgaagaagcacgaacacgtgagagaagaagcgaggaggcgctgggtgcacgattgggtgagagaagaagaaaagaaattgggccaagggaagtggcgtcgcgcgactgttgcgtgggattgtcgactcagggaagggggtcacaatttggagaaagtgcaagaagcatgtgatgagtgcaaaaagtaa

SEQ ID NO: 4174 - DNA, 764 bp, Glycine max
  Peptide Sequence Number=SeqID_95859
ctactgccctagtgcatatgtacgatcatttgaatgatgcttgtattagaagcagccgacaacttgctggttacatcactctcttacagtgttggatatatgagcactttctgtcagttgcagagtgcatcgctaatccgaactacgatgaggtgtcaccacgtgcatgtcggtggattgcaacaaagccgactgtgaagaccatatctatagcaatgtacaggcagcgtctggatcgactcaggattcctgatacatcgaccagagcgggtcatgcgctagttcggatactccagagtattcttgcacagtttgttgattcatgggtgtcatttgatgaaataaacgacgggtgcatgcactacttagaccatcttgcgccagcaggtgagatatgtgttgtgtcaggtcagtgtgcacttgagtacatgaactggttcttcgtcatttctcatccattcatgatcgcggcacaaccattagatccgccacgagatgcacctgcgacacatgatgcatcatttgtggagccacatatccctcaggtcccgaagccagtagcagcatcgacacatgcccgttctgatgaggcttgccatgcgattactgaaaggttgaagtgtctgctcaaccttaggatagtcacggaaggcatagcgacacacgaggtcatggaagaatgcattaggattgccaggggtgtcacagaagaccgcattgtggatgtgaggtctcgacgtaggcgtcgcacggatcagccatag

SEQ ID NO: 4175 - DNA, 369 bp, Glycine max
  Peptide Sequence Number=SeqID_95860
atggcgacttaccttctcaatattcttcctcataagttattgaactataaatctcctcttagggttctttatcataaggatccgacctattctcatcttcggacttatgatttcttagatgatggcccaaacccatacgtggtccaccatttagtgtctcaatccactactcctaatgctcaaactcctggtctagttccatttgggcccaactcccctaatattgcaaccggcccaaccattgagccaaagaagaatattgttaattgtacgaattgtccagcgactgcttcccctcctcctagtctagcccttcttcacgtcctagcccacctctttgggctgttacacgcagccaacatgggatag

SEQ ID NO: 4176 - DNA, 399 bp, Glycine max
  Peptide Sequence Number=SeqID_95861
atggcgccgcggagggagaagacaacgatggagaacggagagttgcggatcaacttgttgggtcgcacacggttgcagaagaaggagtcgcgggaagaagagaagccaattgctgggtgcaaatatgacctaaatccctatgtggatcaactaaatccctacaaactacactacaccagcaaaaatggaagcacaaacacaaaggaaagggagaagaggcttacctcgacgtcgatgaagcaacacgaacaaaagaagaacgtgcacagccgaggtgaaaagcaccacgaacacgccaacaataatgctgaagaagaacgtgtagtagaagaacgggctcaagaagaacacgcagaagaagaactcgcagtcgtagaaagaagaagaaggggctcatga

SEQ ID NO: 4177 - DNA, 246 bp, Glycine max
  Peptide Sequence Number=SeqID_95862
atgagttctagcaagtattgctctctcgatctcggtcttgctcttagcctcctttcttctgccgagagactattatctctctttctcactcttactatacatgctatcaatttctttcctcacatccctattcttgctagtattcaacaattcttgctagtattcaacaatgaaggaagggagagggcattgcgtgtgaaagcaaatgcagagccagacctcaagccatggaagcttgggatctga

SEQ ID NO: 4178 - DNA, 477 bp, Glycine max
  Peptide Sequence Number=SeqID_95863
atggttagaactagaggtcttggtcaggctttagggcgagcaataggaaaagtgttggggaagagagacgagacccgtagacagcgacagcaacaggttgttgtcgaggaccctcctacggccgaggaggaattggtcaacgaccagccaaaagcacctattgaagaaggtgctgctgatgttgagggttttccaggtggaccccatgacacatcagttttgagtgatcttgaaaatcacattgctttgaaagtgtggaatggagaggaacgtcctgagttgaagttatcttcccatggaaggaagatggttgagttcgggaggcctaccccagagattgaaggccttgtggtggctagtggactgagtcctttgatcgcttgttccctagatacgggtgatcggggactaatgtctacttttgtggaatgctggcctaaggaaactagcagtttccatttgcccgtcggagagtga

SEQ ID NO: 4179 - DNA, 252 bp, Glycine max
  Peptide Sequence Number=SeqID_95864
atgcaagaacaaaacaaaaagatagaggaagcaaaagaacatcacctagacaaagatgctctgatacaacatgacgtagctccatgtggagcttgtagaccttggatcttcttcatcaatgaaatcctttgtttcttgaagatcatggcagcgaaatggagaaggaagaaagatgattggagacgtcacttcaaggagaagatgagtcaagaagaagctcaccaccataggaagccatggataagagtttga

SEQ ID NO: 4180 - DNA, 429 bp, Glycine max
  Peptide Sequence Number=SeqID_95865
atgtctagattcaagaacaaagtcagacaagccagacagaagcgcgacaagcgagaaggaagcaccaagaacgattcacacaagtcgaacaagaggcacaagccagacaagcaccaacctctcccaaaagggcccagatttgagcattacacacccatgacaaccaatcgcactacgatccttgaggaagctttcaacttggaggtacctatcaagttatcttcgacgaaacctcttaggccgaggttagatgtgaccaaatactacagtttgttaaaagattggacaaccaccaagcaagagcgagacccagaggacaccaagaggagcaacataggagtcacgacgtggacagaagaagagatagagcaaaagattaaggtagacagagacactagcaacaaatatgtaagccaacaacctccataa

SEQ ID NO: 4181 - DNA, 672 bp, Glycine max
  Peptide Sequence Number=SeqID_95866
atggctgctatcagggatgaaaatggatcagattgtttagtagggatatttggcctcacatgtttaagcattgaaccagttcctgcgccttttctctgcttggctgtggctcgtggaagcactggcaactctaacttttgctccaatgggtgcaagccacaaagggaactcaccaagttgaagagatgctactgctcgcaaaccaacgctggctatggtggtggtggaggcagtggcttcgatggtggtggtggaggcggtggcttcagtggatacaaccacggtgacggtggatatggtggtgagggtaacgacataaaatgcggtggtcatggaagggaggcaaagacccgtacagtccttaagaactttctcgagaatgtgctttgcgacgttgttacctacatcgagcacgttaagaggaagacgagtactactatggatgttgttggtgctctcaagaggcaggttagggttctctatggttgcagtggtcgtcgtggtgggtacaatcatgatggaggaatggtggataaagagtttccatggtatcgcacaaggctggcaagtggttccgggtactctcaaaatcaatcacaagggattgagctagatgtacatagggagaaggatgccatggaaagaggtggtttagctggtggtgtggactga

SEQ ID NO: 4182 - DNA, 1971 bp, Glycine max
  Peptide Sequence Number=SeqID_95867
atgaatcagaatcgattggacttaagagctcatcattctggatcaacacaatcagaggagtcagctctggaccttgaaaggagctactatggtcatcctaacccttcctgtccttcacccttgcaaccttttgcaggaggtgctcagcattctgagagcaacgctgcctacttttcttggcctacattgagtcgctggaatgatgcggcagaggatagagccaactattttgggaaccttcaaaagggtgtgctgcctgaaactttgggtcgattgccaacaggacagcaagctactaccttgcttgaactgatgactattagggcatttcatagcaagatcttacgcagattcagtcttggcactgccattggatttcgaattagaggaggtgttttgactgatattccagctattcttgtcttcgttgcccgtaaagttcgcaggcaatggctcaaccatgttcagtgcctacctgctgcccttgaggggccgggaggtgtttggtgtgatgtggatgttgtggagttctcctattatggtgcacctgcacaaactcctaaagaacaattatatacggagcttgctgatggcttaaggggaagtgattcatgtgttggctctggttctcaggcaacccccaaagaggctgcaactaaggttgcaagccaagagacatatggaaccttgggtgctattgtcagaagccgaacaggaaatcgagaagttggctttctaacaaatcgacatgtagctgttgatttagactatccaaaccagaagatgtttcacccattaccacccagccttggacctggtgtgtatcttggtgcagttgagagagcaacatcatttattactgatgatctttggtacggaatttttgcaggaacaaacccagaaacatttgtgcgagctgatggggcattcatcccatttgcagaagatttcaatatgaacaatgtaatcacaactgtaaaaggtgtaggggagatcagtgatgtgaacatcatagatttgcagtctccaatcaacagtctcattggaagacaagtggtcaaagttggaagaagttctggtttgactactgggactataatggcatatgctctagagtacaatgatgagaaagggatttgttttctcactgattttcttgttgttggtgagaaccagcagacatttgaccttgaaggtgacagtggaagtctcattctcttgactgggcaaaatggggagaagccacgccctgttggcattatctggggtgggacagctaatcggggtcgtttgaaactaaaagttggtcaaccccccgaaaattggacaagtggagttgatcttggccgacttcttgatctccttgaacttgatctcattacaacaaatgaagcactccaagtggcttctggcactgtctatcactgttccaccaccagctgcaaatgttctgctgctggccacccctgccctttatttttgactgatgactacccaattaggatctcccaagccatttgtgtgcacacattgtctcctgctgctgcggtgctagagcaaaggaatggttctgctgctggaattgattctacagttggagaatcctctcccactgtgccaataaaagaaaagcttgaagagagctttgagcctttttgcttgaatatcccacttgctcaagttgaagatgaaccctctcaaagagtcaacccatcaataaggccctgtgattttcatataaaaagtgagattgaaacagctccaaatgtagaacaccagttcataccaagctatgcaggcaagtctccggcctgtcaaagctacctgaaagaagacatggaactgaaaagtctagccgaacttaggaatggccctgatgaagataattttgtttccttgcatttaggagagccagaaatgaagagaagaaagatttcaaattcctcgttttgcatcaaagaattaaagtaa

SEQ ID NO: 4183 - DNA, 1326 bp, Glycine max
  Peptide Sequence Number=SeqID_95868
atggtggatgtggataaggtggacttttggacttcatacgtcggattgagagtgacctttgttaggaggacaagaggaagggcctgcaaaacaaaggactctgacgctcaaggttcgaaggaactagatacttataggagtggaatggagctacgggttcttgtttgtaggggtcgttatagtccttggccagacgtccgcgcttctgtgctagggctggcatggagggtggatacgtgtctcggagtgccatgtagaatgccacatggtgacgagtttgtcaagcccccaagcatggacaagtgttgtccaggttgttttgtcaagttgtccaaggtggacatgcttttgggtttgcaggcgaagtctaacgtgttaggagagagggacgagcttgttaaagtggttgctgatttagaggcatggctaaaggagttagagtctaggttggaggagttcgagcatcgggcagccaaggagagggaggctagcaaggagctggcaatgtacaagaaaaaggctgtggagcagcatgaaaaggactttcaaaaggccgtcaggcaggacgtgaaggatggtgttctgcttgacttgggccaccatgatgaaagtgaaatctttgacggcataggaagcaagaccttgtggggtggaggcaagactttggtgggtggtgcttcctttttgctttggggagcttttcctctgattgatacctggttgaaggtcttgtcaactgatctactgataggttgtcttggcctatggactttctccactgatggttatgaggaatatgtttggcttgcccctggttggaggtcttgccaactagtctggggagttgcgttgaggcttaccaaggatgggcttgggttttgtgaacctggactcaccaaaggtgaactttggtttaacgagcttggtactcatggagtggcatgtactggagtcgtagcggcatgctcttgcacacatgtcactcatggagtggcacgtactggagtcgtagcggcatgctcttgcatacgtgtcacccgtggagtgttacatactggaggcatggtggcgtgctcttgcatacgtgtcactcatggaatggtacgtattatagacgtgcatgtcactcgtggagtggtatgtactggagaaatggtgtcatgctcttgcatacatgtcacttgtgaagtgatgcgtagtggagactttgtgtcgtgctcttgcatacgtggcactcgtgaagtgacatgtaccagagacgtggtgtcgtgcccttgcatacgcggcacttatgaagtgatgctcttgcatacgtggcatctatga

SEQ ID NO: 4184 - DNA, 897 bp, Glycine max
  Peptide Sequence Number=SeqID_95869
atggctcgattttcattggatgagatatcagacactggtgcctttgtgagatctgcttccacattcagaaattggatttcgagggacctgaattcgcaatttccaccagaatcagggaggtatcatctctatgtatcatatgcttgtccttgggcttccaggtgccttgcttacttgaatattaaaggacttaacaaagctatcagtttctcggccgtcaagcccatctttgaaagaacaaatgaatctgatgactataaggggtgggtttttcctgaatcagaaactgaggtgcctggagctgaacctgatatgttgaatggagcaaagactattagggaactttatgaaattgcaagtgcaaactacaccggaaagtacactgttccagttctgtgggataagaaactcaagacaattgttaacaacgagagctcagagataatccgcatgtttaatactgaattcaacagtattgcagaaaaccccaccttggacttgtatcccactgatttaaaaccccaaattgatgataccaacgagtggatatacactagtataaataatggtgtttataaatgtgggtttgcaaagaagcaagaaccatacaatgaggctgcaagacaattgtatggggctttggacaaatgtgaggatatactaagcaagcaacgctatatatgtggcaacacactcactgaagcagacattcgtttgtttgtcactctcattagatttgatgaggagagagaaaaagtaatcgcacaaagacagtataagtggagacttcaattccttctctatctctctgacgtttgggaactctatcggagcagtcagacaaaaaaattggaggaatctcagggaaccgctagagatgctgttatcgctgtctga

SEQ ID NO: 4185 - DNA, 369 bp, Glycine max
  Peptide Sequence Number=SeqID_95870
atggggtgttataattccaacccccttaaaaaaagttttgtcctcaaaactttgccgaaagaccgagaagagagagattacatatctggttctcaataccaagctatgtgccttgttgaagctcctttcagtgacttcgaccacgagactcctctgcacttagcgacgaaatctggcgatcctcgaaacactgatgacaatctgaaacgaacaagcagatacaaagaaacacgattaaccacatggctgactttttttttcaaacatgagacgattaaaagaaaaggtaatcttgacacatctatactcacaccactatataaatttgcacgtaaggttgagggtccgattgctgtttacgatgtctaa

SEQ ID NO: 4186 - DNA, 892 bp, Glycine max
  Peptide Sequence Number=SeqID_95871
atggtgaagaaagtgaggatgccaaggaaggggaaggagaaagatcaaggagaaacctctagggatgggtttgttggagggccaagatttggagtattaggtaatcagattgatgaggagagggcatcgataaatgataatgacaaggctattacaagaaatattggtgggattgtgataatttccaaagttgttgatggaggaaggccgacattggcaggaagagatccaaagattggccacactaaaaaggaatctcagaggggccttgatcaaggtcatccttatgctagaggaagaaataaaggcaacatgtctagatgctctattagacgtggggagaatattaatggtgttgttaaagacatggaatgtgttgctgagacactatccttatcaaatggtgtgttcttcggggctagaggctttttagggggcatttgtgtggctaggagaatggataaagtgaatgtcattatcaatttgaagcatttacactttattcatcttcgtgttagatttgaaaaccaagattggtggtggttttctttggtgtatgctagccccattaaaggtgttcgaggggagcttaggaattaccttcataatatctctacttctaatcctgataggtggtggatgatggcagatgatttcaatgatatacttattcaagaggagaagaaaggtggagctcctacttatgtgaggaaatgctttatctttcaccagagaataaatggtaataacttgatggatcttgccttctgcaatgctcattggcatatggcttttccaactgcttctattaaggttttgactagagtgtccttctctgatcaccatcctattctagtttctatgaatgatggttgcaatttttccaataaaa

SEQ ID NO: 4187 - DNA, 1158 bp, Glycine max
  Peptide Sequence Number=SeqID_95872
atgaaaaagaagaaaaggaagcagaatagcaacgaatatatggctaaccagaagaaatgggaagcttatcctggactaggctctctatcaaggcccaaggccctgtcatttttaggcctgcaaaatttatcaaaattaacaaggtttgcaccatcatctgatccatcattgactatcaagttttatgagagaactcctgagcagcaagcatcattgggataccttgttgattccactcacattgaaggaattcatgatgaaacaccagaaggaggagaagctgtgactgctgatcaagtgaggagagaacctcatgggtcaataggggcaacagctggtcatcgagccattgcacagagtaacagttcagaaattgctgaagccttatttcgatatactgcaccagaagaggtgatgacatttccatcttcttgtggtgcttgtgctgctagttatattccttacttccaagaagtaatagttatggcatccacatgtgattcctgtggttaccgcaactctgagttgaaacctggtggccgaattcctgaaaaaggaaaaagaattactcttaatgtgaagaatgttaatgacctgagccgtgatgtaataaagtctgatactgcaagtgtaaaagttcctgaacttgacttggagctggcaagcggaacccttggaggaattgttactactgttgaaggtttaattacaaaaattagtgaaagccttgagagggtccatggctttacttttggagatagtcttgatgaacagagaaaaggcaagtggatagactttaaagcaaggctaaacaagcttcttagcttggaagaagcttggactctaattctcgatgatgcattagccaattcttttgtagcacctgcaactgatgatctaaaagaggacaatcaattatcatgggcacgtgtttcaaccttttgcgtgacagtgctaagtaacctgcataattggaatcatgtgacgaatgggtttaatgagctatatttttctgtttggcaattttgtcacgatatctcttcagttgaggaatacgagaggtcatgggaacaaaatgaagaattaggtctgaatgatatagacacctcttctgccgatgttgcttatgaatcaacaaatactactaaaactgagtga

SEQ ID NO: 4188 - DNA, 216 bp, Glycine max
  Peptide Sequence Number=SeqID_95873
atgggggagggatgttgtacgcagccttacccttgcatatgcaaagaggctgtttccggattcgaacccatgaccaacaagtcaccaaggcacaactttaccgctgcaccagggctcgccctcatttcagcacaaggtcctactaaaaatagaaaagcatttgacataaaagaaaagttatccctagaaactcgggagcatttgcaggcacattaa

SEQ ID NO: 4189 - DNA, 438 bp, Glycine max
  Peptide Sequence Number=SeqID_95874
atggctaacaaacttaagctcctctctgggttaatcgatccatacatggctagctacgtggtccttataggattgaagcaaagtcaaatccatatggcctcctccaaatggaggtccgatgattcgttcaacagtgcttaccttgcaacattgcagtgcgtaagaagaaggagttggagagtgtgtgggagagggagagtgggaatgagagaagaaggaaggggaaagggtagggggtttaggcatagggggaagagagagtcgaagagggaaatgaagggagaaagagtgaaaggaagacaaaaaagattgggggtagggaaacgaatggggagtgggaaagagggaaggggaaagggtgacaggtggggaaacatatggggagagggggaagagggaagggaaagggtggagggcaatgactatggaaaagggtag

SEQ ID NO: 4190 - DNA, 1071 bp, Glycine max
  Peptide Sequence Number=SeqID_95875
atggccacttcactaaccctattcaaaacaatctttgttttcttaattatcttcactctcctcacaccccaagccacggctgattgtgaagccgaatccagaaacagttgcaacaacaaaaagaaagccctacctctaaaaatcatagccatattcaccatcttagcctcaagcataattggcatatccctacccttggtgacacgttcggtccctgccctaagcccggaaaacaacctcttcataatagtgaagtgcttcgcagccggcatcatcctcggcacggggttcatgcacgtgctcccggattccttcgacatgctttggtcggattgcttgaaggagaagccgtggcacgagtttccgttttcgggtctcgccgctatgttctccgccataatcacgatgatggtggactccttgtccactagtatttacaccaagaagtataggactactgaggttgttcctggtgagagcaaccgtgcaggtggtggggaccaattggagatggctgctgttaacttggggcatttccatggccaccaccatgctcatgagaccaagattgagggcaaagaagcacagcttctacgttatcgtgttgttgccatggtattagaacttggaattattgttcattcagtggtgataggacttggcatgggagcctcaaataacacgtgcgcaataagaggtcttatagccgccatgtgcttccatcaaatgtttgaaggaatgggtcttggtgggtgcattctacaggccgagtacaagtttttaaagaaggtcatcatggtggtctttttctccgtcacaaccccatttggaattgccctaggaattgcaatgtccacgacctacaaagagaacagcccaagtgcactaatcaccgtgggtttgcttaatgcatcatctgctggtcttttaatctacatggctttggttgaccttctctctgctgacttcatgagcccaaggttgcagggtagcattaagcttcaattaaaatcttacgtagctgtgtttttgggtgctggtggcatgtcccttatggcaaaatgggcttaa

SEQ ID NO: 4191 - DNA, 462 bp, Glycine max
  Peptide Sequence Number=SeqID_95876
atgcaaggggtgtggttatgggtgatactgagggccctccaaagtgttttgcaggggtataccaacaactgcttgcccttcagtggcatatccgaggcaaggctcgaagtcggcgagattgtggtggggcatttcatgtgtctcccccatgggttgagagacatgtgcgtgatcaaattgaggttattggctcccaatgagtataggaatggtgttattgacattctcattgggtggagtatagttcggaggttgaggccagatgggggagtcgggtccaccccagaaacagtgctgacagtggcaactgcaactgtattgacctccattatcttcttcatgctcatcaaggcctccatcattgtgcccatctattctttcatggcctccatgtcggccttcatccgctcttgcacctcgtctacttcagccattactccagctctagcatgtgtttggtaa

SEQ ID NO: 4192 - DNA, 588 bp, Glycine max
  Peptide Sequence Number=SeqID_95877
atgaagcatgcttctacaggagggctccacatccgtgccttcaaagaactcaaggtggccaactgtgcgaacacagccagaggaggaggctatcgcccagctactatgcatatcggggcaagattttgcccagatcgctgcagggagacgagtgcggatcatgtgcaccaacacatggatgatgttgctacttattctacggagtgcccatctctcctagcaaggtcatcaggccccctattaacagggccttcatcaagaagtattgcatccccaggcaggcgtagggcgaggcaccacagcaacctgtggacgaccagcagtgggcgacaggcgcactgccactacctccaaagtccacctcagctcatctacaaaggccggagcgttgcctacgacacatggccgaccagcaggcggccaaccaccagggcagaagtgctactaggaggcaacctagaattggctacgaagaagctccccgcgaaacactccaggaagggcaccattgaagagggttacagtgtggccccacaagctgacacaggctttgacaaacaccgattccaaagcgcgaaacatcagtag

SEQ ID NO: 4193 - DNA, 876 bp, Glycine max
  Peptide Sequence Number=SeqID_95878
atggtacgtggagacaaatcatggtcatccgctttcctttaccatccagagacaatcaagtccgatggtatgcgaagacaaattatggtcatccgctttcctttgccatccagagacaatcaagttcgatggcgtgcaaagacaaattatggtcattttccccctattgttgaagactacatgtcttttgaccaagactattgcagtctcctttgccatccagagacaagcgagtccattggcatgcagagacaaattatggtcatctgcctccttttgtcgaagactccatgtctttcgactgagactattgcagtctcctttgccatccagagacaagtgagttcattggcatgcagagacaaattatggtcatctgcccccttttgtcgaagactccatgtctttcgattgggactattacaatctccattgccatccagacacaagcgagtctattggcacatagagacaaaaatgttcattttcccctcttgtcgaagactcaatgtctttcgaccgagactattgaagttccctttgtcatctagagacaatcaagtccgatggcatgcagagacaaatattgtcatctgccctcttgtcgaagactcatgttttcgaagactattgcagtctccctttgtcatccagaggcaatcgagtctgatggcacgaagacatcatgagacaagcgagtccattggcacacggagaatatcatggtcatccattttcattgtttttgagactattgaagtctcccttgccatccatacacaagtttcgctgattgagctagtggtcggtcgggcggagaggtcgatcgaactaaatcgttcttcgcttcacctgagtttttggaagaacatatag

SEQ ID NO: 4194 - DNA, 363 bp, Glycine max
  Peptide Sequence Number=SeqID_95879
atggctgccattttgagtgtgtggacagttgaagactggcatttgaacttgctgcatcatgatgaacccgcgcgcacgcttcagcgtactgtggagtggatactacccacgcctacaccatactgtctagtggagccagtccaagtgatcgaggtgacatcatccgaggaagaccctgaggaggatcccgaggagctacctcctgagcctgctatggatgctcttgactttctagagggtgatgaggacccactccctgaggtggattctcccgaggacgtcatgtcggcatctgaggcagactctacggaggatagtggtcctggagagatggcgatcagtggaggctcttcatcattgtag

SEQ ID NO: 4195 - DNA, 144 bp, Glycine max
  Peptide Sequence Number=SeqID_95880
atgagacgaataaggttatctaggaagaacactggagaacaaggtgatccaagaagtggatactatggaggaatcagaaaacttcacaatgaggatgagattgaaaaatggaagaagctcttcccaagtcaagttcaggcttag

SEQ ID NO: 4196 - DNA, 246 bp, Glycine max
  Peptide Sequence Number=SeqID_95881
atggctgaggttcacattccccaggtcttcaaacaacacaattttcttgaaagaaaatcagcatgcaacagggacaggcagattctcatagctaggttccctaaccctaactatggtgtcaaaacgggtttttcaaaggaactcaaactagctaggagaaggcttagaagtcaagattacctcagagaaactatgaaatggaggattgaaggattttctccatcgaatcttcaaggaggattctaa

SEQ ID NO: 4197 - DNA, 333 bp, Glycine max
  Peptide Sequence Number=SeqID_95882
atgatgataacaaaagatgatgacaaaaagctcaaagatcaatcaaagaacaactcaagtgaatcaagaataattcaagagttcaggataagaatcaagaagaattcaagaatcaagagaaatttgaggaacaagcacaacaacaatgggagaaatgatgacaaaaagcccaagagaatgacttcaagattgagtcaagaacaattcaagaatcaagagaaatttgatttcaagaatcaagaatcaagtttcaagtttcaagaatcaagaataatcaagatcaagactcaagattcaagaatcaagaaaagactcaatcaagataagtactaa

SEQ ID NO: 4198 - DNA, 417 bp, Glycine max
  Peptide Sequence Number=SeqID_95883
atgaccacgtcgggcacttggcacaactctgccatgtcaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 4199 - DNA, 63 bp, Glycine max
  Peptide Sequence Number=SeqID_95884
atggccggtaaactggctgtcatcgtggcccagcggttgccattccgtaacgctggcgcgcag

SEQ ID NO: 4200 - DNA, 1338 bp, Glycine max
  Peptide Sequence Number=SeqID_95885
atcaccattaaaggacccattgaagctcaaagatccagcctccatagatgccccacaagcaagcttctatcactacacgtcctcgccatcagagggctgcacgccctcgccatcagagggctacacgcccttgccttcagaggattacacgtcctcgccatcagagggctgcatgccctcgccatcagagggctacacaccctcgccttcagaggactacacgtcctcgccttcagagggctacacaccctcaccctcagagggctacatgccctcaccttcagaggactacacgtcctcgccatcagagggttgcacgccctcgccatcagagggctacacgccctcgccttcagaggactacatgtcctcaccttcatagggctacatgccttcaccttaagaggactacacgtcctcgccttcagaggactacacgtcctcgccatcagagggctgcacgccctcgccatcaaagggctacacgccctcgcctcagagggctacacatcctcaccttcagaggactacacaggactacacgtcttcaccttcagaggactacacgtcctcaccttcaaagggcgaaacgtcctcgctttcagagggctccacatttgcgcctttagagaactcaagttcctgggccacccccttgatctcggaggagggccaactatgcgagcacaactagagagggaggctatcatgcagttactatgtgtaccggggcaagatttcgcccagaccaccatagggagacaagtgcggatcatgctcaccactacaacttcaatctccccctgccaaagtggatcgcgcccacaagacacccaagtggactcggaggagtccaacagggccctagggtttccagctctggttacggacctctatcagtcctacagggtgcccgtccccccagcaggggatcgcatccgtaagacacccaatggacccggagaattccaacagggtcctggggtttccaactctgattacgggcctctggcgagacaccacaacagccaggggatggctgacagtgggcaacaatgcaccaccaccacctctagagcccctcagctcatctacaaaggctggagcattgcgtatgacccgtggccgaccagcaggcgaccaagtccaaagccaaaggcccgtgatcgacaagtcatcgcgcgtccaactcaagacgttaaagaagcgctactaggaggcagccaagaattggctacgaagaagctccccgcgaagtggtccaagaagggcaccattgaagaggattctagtgtgaccccacaagccgacacaggctttgaaaaacaccgattctag

SEQ ID NO: 4201 - DNA, 219 bp, Glycine max
  Peptide Sequence Number=SeqID_95886
atgagtacaccgattttcagagaggagatagctcgcagacattggagctcgctggctactcccatggctaagtttaaccctgaggtagtcctggagttttacgctaattcttggcccacagaggagggagtgcgggacatgcgttcatgggtgaggggaattaatgaagcattgggcttgaatctagaattgggcttggacttgaagagggcagactaa

SEQ ID NO: 4202 - DNA, 342 bp, Glycine max
  Peptide Sequence Number=SeqID_95887
atgccactgaagggcaagcagttggtggtataccctttgaaaacactttggagggccctcagtatcatccacaaccacaaccctcacgttccacagtggttaaaaaccctcataactatggcagaaatgggaaagctggatcatctagaggaaaggctcagggccattgaaggaggtgaagattattcctttgctaacctagaagaattgttcccaatacccaatatcatcacccctcccaagttcaaggtgctggactttgacaagtacaagggggactacttgccccaagaaccatctaaagatgtattatcggaagatgggggcatgcgcaaaagatga

SEQ ID NO: 4203 - DNA, 1026 bp, Glycine max
  Peptide Sequence Number=SeqID_95888
agggctacacaccgtcaccttcagcggactacacattatcacctctagagggctacacgccctcacctttagaggactacacgtccttgccttcagagggctacacgtccttgccttcagatggctacacgcactcaccttcaaaggactacacctcctcgccttcagaaggctacacgtccttgccttcagagggctacacgtcctcaccttcgatggacttcccgtgctcgccttcagaggactacacggcctcaccttcagagggctacacgccctcaccttaaaaggacaacaggtccttgcctttagagggctacacaccctcgcctttagaggtgtacacgccctcgccttcagaggactacatgtcctcacctttagaggacaacacatcttgaccttcagagggcaacacgccctcaccttaaaaggcctacacgccctcaccttcagagggctacacacgctcaccttcagaagactactcgtcccttccatcaaaggactacacgtcctcgccttcagaggactacacttcctcgccttcagagggctacacgtcctctccttcagaggactacacgtccccgccgtcaaagggctacacgtcctctccttcagaggactacacatcctcagcttcagaaggctacacgactccacgccctcattttcgtggggctacacgccctccccttcagaagactacaccttctcaccttcagagggctacacgccctcagctttagaggactgcacgccctcgccttcagaggactacatgtcctccccttcagaggagtacaataactcacattccgaggacaacacgtccttgcctttagaggactacacgtgctcaccttcagaggactacacgtccttgccttcagatggctacacaccgtcaccttcagagggctacatgtcctcgccttcagaggactacacttcctcgccttcaaaggactacacgtcctcacctttagaggactacacgtcctcaccttcagaggactacac

SEQ ID NO: 4204 - DNA, 851 bp, Glycine max
  Peptide Sequence Number=SeqID_95889
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatatttatgcccaagccagtacctaatgaggtctcattctgtcatccaggctggagtgcaatgcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 4205 - DNA, 419 bp, Glycine max
  Peptide Sequence Number=SeqID_95890
atgaccatgattacgccaagctcgaaattaaccctcactaaagggaacaaaagctggtaccgggccccccctcgagaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcg

SEQ ID NO: 4206 - DNA, 627 bp, Glycine max
  Peptide Sequence Number=SeqID_95891
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgattccggcagtttctacacatatattcgcaagatgtggcgtgttacggtgaaaacctggcctatttccctaaaggccaatccctgggtgagtttcaccagttttgatttaaacgtggccatatggacaattcttcgcccccgttttcaccatgggcaaatattatacgcaaggcgacaaggtgctgatgcgctggcgattcaggttcatcatgccgtttgtgatggcttccatgtcggcagaatgcttaatgaattacaacagtactgcgatgagtggcagggcggggcgtaa

SEQ ID NO: 4207 - DNA, 537 bp, Glycine max
  Peptide Sequence Number=SeqID_95892
atgaaacacaccgtcgacgtgatgatctctgagcaggagatcgcaacccgtattgccgaactgggcaagcagatcagcgagcactaccgcaacagcggcagcgaaatggtgctggtcggcctgctgcgcggctccttcatgtttatggcagacctgtgccgcgccattgatgtcgcgcacgaagtcgacttcatgaccgcctccagctacggcagcggcatgtcctccacgcgcgacgtgaaaatccttaaagatctcgacgaagacattcgcggcaaagatgtgctgatcgtcgaagacatcatcgactccggtaacaccctaagcaaagtgcgtgaaattctgcagctgcgtgagccaaaatcgctggcgatctgcacgctgctggataagccggagcgtcgtgaagttgaggtgccggtcgagtttgtcggctttaccattccggatgagttcgtggtcggcttcggtatcgactacgcacagcgctaccgtcatttgccgtatatcggcaaagttacgctgctggacgaataa

SEQ ID NO: 4208 - DNA, 257 bp, Glycine max
  Peptide Sequence Number=SeqID_95893
gacacgctttacggcgcccttaccgaactcgtgctagagctagagtaatgggtgaagcggaggaggccataaaagagcaaaaggccacaatgatgaaggccatgatgagcatgaagaagatgatggaagccaatgcggttatagttgtcgctattagcgctgtcgctaaaggtgaacccgatgctcccatctggcctcaagcaaatgaatcatccaacctcaaatatggtaggcaaagatttgggaagtacggatga

SEQ ID NO: 4209 - DNA, 437 bp, Glycine max
  Peptide Sequence Number=SeqID_95894
ggagcttatggacaagctccaaaggcttagacaagggagtatgagtattgaagaatatagacaacaaatggaactactccttttaagagctagacttagggaggaggaaagaacaagcatagctagcaacaacttaaaagaaagccttcttcaaaatcttacggctctcactcttatcccaaggaaggaccaagcccatgaaattttgggggctgtaccttcaaaatccaaggaagataagggtcacattgcctctcaatgtcccacaaataaaaccatgatcatgaggggtcaagacatttatagtagtcaagaggagactacttcttgcccttcctctagtggaagtgaagatgaagtaaggggtgtagagtctagtgaggaagtccacccccatgaagattgtgacctcttaatggttagaaggctccttggag

SEQ ID NO: 4210 - DNA, 228 bp, Glycine max
  Peptide Sequence Number=SeqID_95895
atgaggaagaaccacggattggaagcagggaatgcagcacagaagcataaaccaaagagggtggagagtgtcaatgctgatgcagaagcctttggtgatcactggaaaacaggagattcaactgtgttgaagataggagattcggctaaagttgtgataaaacaagacatgaagggaggagagcataaatatgggtataacaacaataagcgtgagaagccagagaag

SEQ ID NO: 4211 - DNA, 699 bp, Glycine max
  Peptide Sequence Number=SeqID_95896
atggcttctggtaatcgattaccaaggctatgtaatcgattaccaggcttaaagatgggatcaggaagtcgagatggcttctggaagtcgagatggcttctgagtaacaagccactggtaatcgattaccagttatgtgtaatcgattacacagtgcattttacaggttttcatgttctgaagctgtgtaattcatgtttggcctctggtaatcgattaccaaggctgtgtaatcgattaccagagatgaaaagccttgagattgtgatggcggcgcaagtaatccatgatcaagtggagatggagtgcctagagggagcttgggagaccctcgaaggcaatgcgaggtgccgatttcggggcacgattcgattcacggctacttcattggtgcatccaaaggaacccgcgtgcatgcttcagcgcactgtggagtggatactacccacgcccacaccatatcgtctagtggagccagtccaagtgatcgaggtgacgtcatctgaggaagaccctgaggaagacccagaggagctacctcctgagcctgctgtggatgctcttgactttctagagggtgatgaggacccactccctgaggtggattctcccgaggtcgtcatgtcggtatctgaggcagactgtacggaggagagcggccttggagagatggcgactagtggaggctattcatcatag

SEQ ID NO: 4212 - DNA, 273 bp, Glycine max
  Peptide Sequence Number=SeqID_95897
atgaccattgtgtcgcaaattgcccttcgcgggcgagcgaaggcgaggctcacgggtgcgctttccaaaggaggaaagatgcgcggagtcgccaccaacgtttatttgtgggaaaaacgtcggaaaaaccgaaggaaaccggtcaaaatgaaaattctaagttcgggagttgtatttacgcttgaggaaggtcgacaccaagcggagcttttgctcctacgtaccctcctttggagaggaaatcagacctacatagttctttcttatgcgtga

SEQ ID NO: 4213 - DNA, 618 bp, Glycine max
  Peptide Sequence Number=SeqID_95898
atgggtgaagtagaggaggtgcaagagcagataaaggccaacatggaggccatgaaagagcaaatggccacaatggtggaggccatgatgagcatgaagaagataatggaagccaatgcggttacagttgccgctaccagtgctgttgctaaggtgaagtcgatgcccccatctggcctcaaccaaatgaatcatccaacctcagttatggtaggcaaagattttggaagtatgagcggcccctattatgtgcaaattcaaaacaagcacaccttcccaccatatggcttgcctctcaactatacaccacccaatatggcatacactcccagtgaggatgtcaataactctactcccatactcattgaaagccgacaacctcaaactgatcatgcacatgtctctcaacccatgggggagacacatgaaatgccccaccacaatctagccgacttcgagccttgcctcggatatgccactgaagggcaagcagttggttatatacccctgcaaaacacattggagagccctcagtatcacacacaaccgcaccccttgcattccacaccgggtaaaaccctcatgctatggaaaaaatggaaaagttggatcatctag

SEQ ID NO: 4214 - DNA, 324 bp, Glycine max
  Peptide Sequence Number=SeqID_95899
atgcacacacgaagtttcacaattccacactttcctaaaataggcctaactcacaaaaacagtccccagtggagtcaccaactgtcgcaaccaacccttttgcgggcgagcgaggcgaggctcacgggtgcgtcttccaaaggaggaaaatgcgcggagtcgccaccaacgtttatttgtggaaaacgtcggaaaaaccgaaggaaaccagtcatgaagaatatttcagattcaggagttgtatttacgtttgaggaaggtcgacaaaagcggggctcttgctcctacgtatcctccatcgaagaggaaatcagacctacgtag

SEQ ID NO: 4215 - DNA, 188 bp, Glycine max
  Peptide Sequence Number=SeqID_95900
ggttaagggaattttacggaagcattacgggtgtcctggaagccccggaatcccatttttcaacaaaacggggggtgtggtggccacctagcgagctaggttgcttcaaccttaagcaagaaattgcccagaaacctctagaagggcccagattcaaaaattactatttgcacctccctttttactaa

SEQ ID NO: 4216 - DNA, 1023 bp, Glycine max
  Peptide Sequence Number=SeqID_95901
atgacaatcctcaatcacaccctcggttttcctcgcgttggccttcgccgcgagctgaaaaaagcgcaagagagctactgggcgggcaaggccacgcgtgaagatctgctggcggtaggtcgcgaactgcgcgctcgtcactgggagcagcagaaacaggcgggcattgatctgttgccggtgggcgattttgcctggtacgaccatgttctgaccaccagcctgctgttgggcaacgtgccggctcgtcatcagaacaaagacggcaccgtcgatatcgatactctgttccgtattggtcgcggtcgcgcgccgaccggcgaacccgctgccgccgcggaaatgaccaagtggttcaataccaactatcactacatggtgccggaatttgtccagggccagcagttcaagctgagctggacccaactgctggatgaagtggacgaagcgctggcgctgggccacaagattaagcctgtactgctggggccggtaacgtatctgtggctgggcaaagtaaaaggcgaacagtttgaccgtttaagcctgctgaacgatatccttccggtttaccagcaggtactgggcgagctggcgaaacgcggcattgagtgggtgcagattgatgaaccggcgctggtactggagctgccgcaagcatggttggatgcctttaaaccggcttatgaggctctgcaggggcaggtaaaactactgctgactacctattttgaagggatcgccgacaaccttgatattatcaccgcgctgccggtacaggggcttcacgtcgatctggtgcatggcaaagatgatgttgctgaactacataaacgtctgccggccgactggctgttatccgccgggctgatcaacggtcgtaacgtctggcgcgccgatctcacggaaaaatatgcgcaaattaaggcgattgtcggtcaacgcgaattatgggtcgcctcttcctgctccttactgcatagcccgatcgatctgagcgtagagacccgtcttgatgccgaa

SEQ ID NO: 4217 - DNA, 276 bp, Glycine max
  Peptide Sequence Number=SeqID_95902
atggctaaagcacatcaaaagggggtacggaaagtaaatgaaacgagaataaaagaaaataggggaggagcttgccacccagctcgcccaggcgagccagaggaacatcctgaaaggctcaagtgggcctggttacggaaccttacgggtcatgtaattactccttttttagctttcggaatgttacgaaaacttacggattgcgtaacaatacttccttttgatttccggcatgttacggaatttcacggattgcgtaacaatgcttccttttga

SEQ ID NO: 4218 - DNA, 198 bp, Glycine max
  Peptide Sequence Number=SeqID_95903
atggaggttaatgaaccttggttggggttatggctaccattgaattatcaagtagatatgggagcaagtcagcataggacaccaaaattggggtaccaggtagtccccttgtacttgtcaaagtccagcaccttgaacttgggaggggtgatgatattgggtactaggaacaactcttctaggttagcaaaggaataa

SEQ ID NO: 4219 - DNA, 81 bp, Glycine max
  Peptide Sequence Number=SeqID_95904
atggaagaatcgttgtcataccctaatatcgtccggggacctttgcttgatgacatgcgaccattctttggtcctcgtgag

SEQ ID NO: 4220 - DNA, 851 bp, Glycine max
  Peptide Sequence Number=SeqID_95905
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataaagtgccttgtgtaagcagacagtggtgggccagccggtgcattcagcgcactgtgactttgttaccctggggcaactgtgaccagtgtccagacgggaggctatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 4221 - DNA, 183 bp, Glycine max
  Peptide Sequence Number=SeqID_95906
atggagaaaggtacaagtcttcctatggagaaaggaaaagctctccaatggcacagtgcgtatgtgaagaatatgggacttgataaattgtcctcatggaatgactatacgaaaatcttgattgaaagattcggtgaagtttacgaggatccaatggctgagctgatgagacttcgacaatga

SEQ ID NO: 4222 - DNA, 378 bp, Glycine max
  Peptide Sequence Number=SeqID_95907
atgggctccacgatcttgtgcgtcagacttgagcgaggcatccatgctcctgggaaagggctgacaaggaggattgatgtgcacattggagcaccacgagatcatcctgtgtcgagggtagtagccttgacaagtaggagggtctatcaagccccccagcctaaacaagtcttatccgtgctacttctattaagttgtccaggtggatacggttttcgctttgcaggtagagtcagacgtgtcaagcaagtgcatcgcacgcttgttactcttgcatacatgtcacccaaggagtgggcacgtactgaagatgtggtgaagcaaccagctcacctaggcgagcaagttgcttctggaggaagcaaccagttcgcctag

SEQ ID NO: 4223 - DNA, 219 bp, Glycine max
  Peptide Sequence Number=SeqID_95908
atggattccctggcgatgggtgttaagcgtcccggagtgatcaaccaagggtatgacaataggttcgcctttactttgaatgggagtcaagagcttccacgactgctagtcaaggtcaaggtgatggcagatgtgtactcggcccccgaggaagttcacaggctcctcaattatttccaacacatgattgatctgatggcccacataattaggagctaa

SEQ ID NO: 4224 - DNA, 524 bp, Glycine max
  Peptide Sequence Number=SeqID_95909
atgccattgggatatatcaacggtggtatatccattggaacctcttacgtgccgatcaaggtctcatcttcgccaaaagttggcccagggcttcccgggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatgtcgacgggatccaggaattcgatccacgaggcacgcgtaacaatgatgatttggaaacaac

SEQ ID NO: 4225 - DNA, 531 bp, Glycine max
  Peptide Sequence Number=SeqID_95910
atggggacaaatcaaaacggcaaaaggttttatcaagtcaaggttaaaagtctagatgtcactagcctcaaggaattgggacgattgatgggacctctccaaaggcaacccttccgcaaagtgtacgggaagattctagatttgaccgcagtggaggtatttacggaagctgtcgaatccctcgcccaatactatgaccagccgttgaggtgtttcacgtttggggacttccaaatggtaccgactattgaagagtttgaggaaatattaggatgccttcttggggggagaaaaccgtatcttttctccggctttcttccttccttgagcaagattgcagttgtggtcggagattcagcaaaagagttggatcgcatgaagcaaactcggaacggcgtagtgggcctgcctcggaaatacttggaaggcaaggcaagggatatggcgagccaagagaagtggggcccgtttgcggatattttagctttgttgatttttggggttgtcctctttccaaacattgacggttaa

SEQ ID NO: 4226 - DNA, 219 bp, Glycine max
  Peptide Sequence Number=SeqID_95911
atgaacgcgttccgtggcttgtctaatgtggcacaagccacattgagtcaggtcgcgccaggcatcgctgaagctttggtggcaactgccattggcctgtttgcggcgattccggctgtgattgcctacaaccgctttgcggcaggggttgaccgcctgtctgtgcgctacgagagctttatcgaagaatttaccaacattttgcaacgtagagcctga

SEQ ID NO: 4227 - DNA, 201 bp, Glycine max
  Peptide Sequence Number=SeqID_95912
atggtggtgaatactatggcagatatgacggttcaggtgaacaacatccggggccttttgccagctaaagcaaggccttataagccaaatgaaagaaaattagactctcgaacagtgagtagctactttattggttattctgaaagatccaggggctataaattttatgatcccaaattaaagacaatttttgagacatga

SEQ ID NO: 4228 - DNA, 729 bp, Glycine max
  Peptide Sequence Number=SeqID_95913
atgggacccctccaaaggcaagccttccgcaaagtgtacggaaagattttagatttgaccgtggcggaggtatttacgaaagttgttgtgtccctcgcccaatactatgaccagccgttgagatgcttcacatttggggacttccaaataccgaccgttgaagaatttgaggagatattaggatgccctcttgggggaagaaaaccgtatcttttcttcgggtttcttccctccttgagtaagattgcagctgtgatcggagattcggcaagagagttggatcgtatgaagcaaactcgaaacggcgtagtgggcctgccgcggaaatacctgaaaggcaaggcaagggatatggcaagtcaagaaaagtgggtcccgtttgcggatatactagctttgctaatatttggggttgtcctctttccgaacgtggacggtttggtggacctagccgcaattgatgctttccttgcatatcaccatagcaagaagagcctagtggtggcaatcttggcgaacttatttgatacattcgaccgaaggtgcgagaagaacagcgcacggatcgtctgctgcttacccgctctttgtgtgtggttggtttcgcacctattccaacaagacataagacacccgtgtccgcttcaaatttatcactcgtgcgtcgagaagagaagagtcgattgggaccaacacttagctgggataggaggcagcacaatcaattga

SEQ ID NO: 4229 - DNA, 424 bp, Glycine max
  Peptide Sequence Number=SeqID_95914
gcttttcgtcttacagacagcaaaaaagaatgtttatacggataaccactcgggtatttccgcccgtcaacgtgactcaaatgtcagtatgacagatcttgtgagcgcggaagatgacacagcaaaaaagaatgtttatacggataaccactcgggtatttccgcccgtcaacgtgactcaaatgtcagtatgacagatcttgtgagcgcggaagatgacacagcaaaaaagaatgtttatacggataaccactcgggtatttccgcccgtcaacgtgactcaaatgtcagtatgacagatcttgtgagcatggaagatgacacagcaaaaaagaatgtttatacggataaccactcgggtatttccgcccgtcaacgtgactcaaatgtcagtatgacagattttgtgagcgcggaagatgac

SEQ ID NO: 4230 - DNA, 270 bp, Glycine max
  Peptide Sequence Number=SeqID_95915
atgatgatgaaagaagaaagaagaaggttcctctttagccccaaaatgctgagtgcgatcaacttgggcacggggagattcaattgtcctatgtttaaaagaagaatggaaaaattcgacaagataaatttcaaagagaagaaagaaaagaaaggcaaacgaaggccacatttctcccccaagaaaagtgaatatgtgatatatggagacaacaaacaaaggccacttgatcaacaaccccaacaaactgttcttgatgattgtgattga

SEQ ID NO: 4231 - DNA, 459 bp, Glycine max
  Peptide Sequence Number=SeqID_95916
atggctcccgaccggactcagctgcagaacatggttaagagggaaagcgagtcccttaaaaagtatgctcagcgaggatcggagcaactggggcaaagaagacggaaggagatacccatgtcgtcacttcaacgcccgcatggatcaacgcctaacatcacccaagcttcttggctcacgccggggactcctccaactcagcactcgtacaagctagggcactcgcgcccatccagagggagccccccaagctccggctccaaccccaactcgcgcggccagcaatatccactttggcgccggttccaacacgacaaggaactttcccccaaggccaactccgagattcaccccaatcccaatgatgtacgaagacctcttaccatcccttatcgccaaccagatggctgtgatatctcccggaaggatctaccagcctcctttcccaaagtggtataa

SEQ ID NO: 4232 - DNA, 257 bp, Glycine max
  Peptide Sequence Number=SeqID_95917
agtggtacctggagatatgtcgcgggggtcaggagaccttggggacgtcaggcaagctcctggcagtcaacagataaaaggaacaaagaccacaaagcaaggaggcttgtgtggtggttggccagctgtgaatcttgaggctaagatggtctctggtaatcgattaccacagggtgttgtgaaggcctctggtaatcgattaccagtctgtgtaatcgattacacagaggaatgggccactggtaatcgattaccag

SEQ ID NO: 4233 - DNA, 341 bp, Glycine max
  Peptide Sequence Number=SeqID_95918
gtggcttggccaggagcccagccttctcctctggagggggtggggcctccgcagcccaggagcctgcttctgaggagccaacagtagtagcaacagagggggaggatgagctcacccctcccgagccttcttattttgatgcaggtatacacatggctaaggaggaggatgcttctacagaccagatcccagagccatccccaacacccatacctgatgatgccacaccatttgcactagcaccagacttagagcaacctatctctcaggattcaccaactgctcaggtgttggaccttaatgatgcacaggagcaaccacaggatgagcaggacatttaa

SEQ ID NO: 4234 - DNA, 291 bp, Glycine max
  Peptide Sequence Number=SeqID_95919
ctgcgtcgccagtcgctcgatccgcaggacctgctgatcggccatatcggtggcatggattgctgcgcccgtggcctcaaggcggcggcgaagatgatcgaggacggcgcattgtcgaagccactcaaggagcgctacgccaagtgggattcgccggaagcccagaagatgctgcgcggcgagctgaagctcgacgagattgcggcattggtcgagcgcgaggatatcaatcctgagccaaaatcgggtcgtcaggaatatctcgaaaacgtggtcaatcgttacgtttga

SEQ ID NO: 4235 - DNA, 567 bp, Glycine max
  misc_feature (122)..(122): n is a, c, g, or t
  Peptide Sequence Number=SeqID_95920
acctccagcggtcttcagccctttgaagtcatcgtcgtcaccgatccggaagtgcgcgccaaaatccgcgagattgcctggaaccaggcgcaggtgaccgaaggctcgcatctgctggtctntgcggcgtgggataattacaccgaagagcggatcaaccatatgttcgatctggtcaatgaagagcgcggcatcaagaatgaaggctgggaagcctatcgccagatgctgcttaacacctatccgcagcgcgatcagcaggtgaatttcgagcacgccgcccgtcaggcctatatcggtttcggcatggctgtggcgcaggccgcctttgagggtgtggattccactccgatggaaggtttcgatcctgccaagctcgatgaaatccttggcctgcgtgagaagggcctgcgctccgtcaccatcctgccgctcggttatcgccagccggaaggcgactggctggtgaacctgaagaagataattgaaaaaacatccctgttaaaaggtggcgtgtgcgggcaagtatgcgccatcgaattgccgatccccggcatttctgagtga

SEQ ID NO: 4236 - DNA, 591 bp, Glycine max
  Peptide Sequence Number=SeqID_95921
atggggacaaatcaaaacggcaaaatattttatcaagtcaaggttaagggtctagatgtcactagcctcaaggaattgggacgattaatgggacctctccaaaggcaagccttctgcaaagtgtatgggaagattctagatttgaccgcagcgaaagtatttacggaagctatcgtatccctcgcccagtactatgatcagccgttgaggtgcttcacgtttagggacttccaaatggtaccgactgttgaagagtttgaggagatattaggatgccctcttgggggaagaaaaccgtacatgttctccgggtttcttccctccttgagtaagattgcagttgtggtcggagattcggcaaaagagttggatcgcatgaagcaaactcagaacggcgtagtaggcctgccgcagaagtacttggaaggcaaggcaagggacatggcaagccaagagaagtggggcccgtttgcagatacactagctttgctgatttttggggttgtcctctttctgaacgtggacggtttggtggacttagccgcaattgatgctttccttgcatatcaccatagcaaggaaagtccagtg

SEQ ID NO: 4237 - DNA, 120 bp, Glycine max
  Peptide Sequence Number=SeqID_95922
atgtggcaggtggaaagaccctgtggatcgttcggtcctgccgaccaatctttttcggagccccatgaattgccttttcgttcatgtgtcctccgccttcgagtttggagctatgcgtag

SEQ ID NO: 4238 - DNA, 351 bp, Glycine max
  Peptide Sequence Number=SeqID_95923
atgcagaagttcacacgcgatgtctatcttggagcctacctaaatgggttccactgcagcggacactgtgctatcaagggtcttgatgatgcaccacaacctaaatcaaaggcttctgctaggtggattgtcgtcaagtgtaatagacaaaaaggaagtactgagtgcggctactatgtgatgcactggatgtccaccatcattataggaacttttaggaataattgggaagcgtattttaacgatcctagaccattggagccagagagatcaggcctaggatttagggacattatcttttgctttaatttactttggtttaacattttttacattttctatgtaacatga

SEQ ID NO: 4239 - DNA, 558 bp, Glycine max
  Peptide Sequence Number=SeqID_95924
cgcggccatgcggcagtcttgctaccctttgacccagtgcgtgacgaagttgtgctggtggagcagatccgcatcgccgcttatgacgtcagtgaaagcccgtggctgctggaaatggtggccgggatgatcgaagaaggtgagtcggtcgaggacgtcgcccggcgcgaggcgctggaagaggcggggctggtggtgggccgcaccaaaccggtgttgagctatctggcaagcccggggggcaccagcgagcgcttgtccattatggttggcgaagtggacgccacgacggcggaagggatccacggtctggcagatgaaaacgaagatattcgggttcatgtggtgagccgggaacaggcttatcagtgggtagaagaggggaaaatcgacaacgcagcaaatgatgcgcctgtgcgaaaccaatttcgcacaattgcgccgcctgctgccgagaaacgacgcacccggcgaaacggtaagctatcaggtgagcaatgcgcagtatcggttaacgataacagaatcaacgcgctacactacgctggtggagattga

SEQ ID NO: 4240 - DNA, 205 bp, Glycine max
  Peptide Sequence Number=SeqID_95925
atggctactggggcaattcaattaccaatgccattttttccgggtcccgagctgcatgtagaaatccctaaacagggatttggtcaacagcagcagggggcaacaacagctggatcttctacttttgcttcggggacaaagggaaaacttcaaagttttgttggctctcctgaccccgggaataatttggatccaggttttggaa

SEQ ID NO: 4241 - DNA, 1629 bp, Glycine max
  Peptide Sequence Number=SeqID_95926
atggttaccaccaccgttgattcttcctctaaccattactcacccactgctgctactgctgccgctgacacctctaataatttcccgcgaaaaaacctgccatccccgtgggcccaggtagttcgcggtgctgacgctgaacctaaccatcaatcgccgccatcttcttcctcttcctcgttctcgtccctcgattccattaattctaacggtcccgccgttcaaacaagcgataccaccgtgaaacctgcgtggaagaaaccggagtccaatggcgtctcggaagttgggcctgtaatgggcgctcattcttggcccgatttatctgagtccaccaagcccaccgctaaattgacatctgactcctctgttaagactgctgctgatgaagaatcactcaccaccactcctcaggatcctgttaattcagactcccctcagaaacaagccattggtaatgcaaaccctagtcctactcctgcaatgaactatggtatggctaatcgacaaagatcaatgaagcagcgtggagggtcaaatggctataatgttgggtctggtcctgttcagaacaacttctccggtgctacccagaatcttcctccaccgccaccaccgcccccctttcctgtgcttccgatgcctccaagaacatttgcccatgggataccaggggttccagttcctactccaagggatccttacaggaacaataactgggatgcaagacctccgcatgggggttttatgccaccaatgagtgagcatcggagtccctctcgcaggggcaatgctgggcaccatccacgtggagacggtccctatcataacagttatggcagcaggcgtgatcaggatcgtggaggttatgcaaatactagagatgctcatgtaaatcaacagaggatgcctccaaggggattaatgaggcccccgccacctaatcctgctccatttatggggcctcagcctatgcgaccttttgcaaaccctgctgggtttcctgaattctattatttcccaacgctacaatttgaaccctttgggggcatgccatttttcacacatgcacctcctcctgcaatgttcttcccagttgcagaaactcctctcaccaatacaatagccaaccaaattgattattactttagtgatgctaatttagtgaaggatgagtatttaaggtccaacatggatgaacagggatgggttcctattactctgattgcaagcttcccaagggttagaagtttgacaagcaacattaagttgatattggattcattgagaacttccactgtcgtggaagtgcagctttcactgatcacactttctacacatctcatttctgttcattgccatgttagcgatgcagtggagggggacaagttaaggaggtgcaatgagtggatgaagtggcttccctccgcccagcttcgggccaactctggttcaatatcccctagcggatcaagttctaataacctagcagctgattttgaaaagatcacagtggatgaagctatttcacataaagttaacactgagcctaccacaaatgaagatgctgcaggagagtcctcaactcagtcccaagtcccaaatgatgctactgtgagcagcaattaa

SEQ ID NO: 4242 - DNA, 681 bp, Glycine max
  Peptide Sequence Number=SeqID_95927
atggagatcagaagatttatccgtgaaaaagtctaccgattgagtggtggtgctgattacataccgccttcaaggttggatgggttcgtctaccaaaatgggtacttagatttggatactgttttgatagaagcgttttatgatccggtgtgcccatacagcagggattcatggcctccactcaaacaagctcttcatcactattcttctcgggtttcgttcctccttcatctcctccctttaccttaccatgacaatgctttcgtcgcgacccgtgctttgcacattgtgaacacattgaacgcatctgcaacgttccccttgctggaatggttcttcaagcatcaggagaaattttacggggcccaaacacggaacttatctagggcttctattgtagatgagatagtgaagtctgcaacagaagcagctgggagctcttattataacgccataaagcatggcttcaatgacacaaaaactgattatcagaccagagtttctttcaagtacgctgcttcgagaggggtgtatggaacgccttctttctatgtcaatggattcttgttgcctgatactggagctaccgctgactacaagacttggaggaaggtcattgatccattggttggtgtgaagaagagtatccagaatgaagagtcccttcgtttcttcttgtaa

SEQ ID NO: 4243 - DNA, 504 bp, Glycine max
  Peptide Sequence Number=SeqID_95928
atgtcttgcctagtgatcataactccgaccttcctctgccgaagtgtcagctggtgtatgccacccaccaggcaccctctagacccggataagtctaacagggccctggggtttccgacattgatcacgggcctctaccagtcattcagggttcccgtcactcctagtaaggtgatccgaccaccgatcacccgggccttcattgagaagtattgcacgcctaggcagacgcagggtgatgcaccgcaggctgcagacgcatcgccaccacctcatcaggctgatcccgctgggtcattaggcatggagcgttatctacaacacttggttcgccagcagggggccaaccaccaggggcagaacagtttagggctaaggtcgcatggccccgaggcccaggcaggggaggcgcctgcagaagctcccggcgatgcaaaggaggcccgcaaggatgaggagatgacggacttgctcggtttcttgggaggaagcagagccacatga

SEQ ID NO: 4244 - DNA, 192 bp, Glycine max
  Peptide Sequence Number=SeqID_95929
atgggtgccatggataactcagtcatgcacaagagattcatgcaaaaatcattactcaatgttattcgttctctcataattaacgatcacactttcactgggttgcggctaatgcgttccttcacaatcaatctgacaaaccaactaacatcgttcagtcatgatcataattccatgttctttctcttctaa

SEQ ID NO: 4245 - DNA, 927 bp, Glycine max
  Peptide Sequence Number=SeqID_95930
atggtgcagctcaacggcaagagcggcgtgctgagccaaaaggtgacgcaggatccggcggggacgccggtagccgacgcgctgctgactttcgtgaaaactcacggtaaacagggggagaacgggcggcagaagctgccgccgtcactgcctcaggcagaccggccttttgtttcaacgcggccatcacttccgctgattggcgcgatactgcgtcaggccattggcgcgcaggttgcaggcggcgcactcgccgcagccgtcacccttgatgccgttgtagcaggtcagcgtatcctggcgcacgcgatccagctggtggtaatagtccgccagcgcccaggtctcggccttgttcagccacatcagcggcgtttcgaagcggatatcgcgggcgatgcccagcgtcaccgccttgttcaacgctttaacgaactcgtcgcggcaatcggggtagccggagaaatcggtttcacacacgccggtgatcaccgcttccgcttccacctggtaggcgtagatcgccgccagcgtcaggaacaggatgttgcggcccggcacgaaggtgctcggcagcgcatttttctgattggggtcgtaggcgggaacagggatattgtcgcgtgtcaggctgctgacggccagctcgttgagcagcgttacgtccagcaccttgtgcgccttggcgccgagggccaccgacagctcctgagccacttcaatctcggcgcgatggcgctggccgtaatcgaacgtgacgcagtgaacttcgtcatactgttgcaatgcctggatcaagcaggtcgtggagtcttgtccaccgctgaaaacgacaaccgcgcgcttcataaaatcacctttttgggctttggcctctcccgatacacattcgggcggcaggataaaattgcgttgcggcgacaatag

SEQ ID NO: 4246 - DNA, 279 bp, Glycine max
  Peptide Sequence Number=SeqID_95931
atgggatcaagtcaaaagccttctcttaaaaagaggttttatcaagtcaaaatcaagagcttagagatcaccagtttacgaaagttggggcaattaatgggtcaacttcaacggcaagccttctgcaaagcctatggaattagaccgccaaaggcaagtcgaaaatggggtggtcggaataccgagaaaatatttggagggagtcctctttccaaatgtggatgggttggtggacctggcagcgatcaaagtgccttgcgaaacatgtatgttggatag

SEQ ID NO: 4247 - DNA, 291 bp, Glycine max
  Peptide Sequence Number=SeqID_95932
atggccaagtttgaccctgagatagtcctggagttctatgctaatgcttggcccacggaggagggcgttcgggacatgcgttcgtgggtgaggggtcagtggattccctttgacgcagatgccctcagccagttcctgggtgacccactagtttggaggaaggccagcaagtgtgggttcagccagaggaggaacagggctaacggggaggcgggtgcagatcatgcgcaccagcatgaccactttgacccagacatggatgacactactactcagcaatgtcttgcctag

SEQ ID NO: 4248 - DNA, 210 bp, Glycine max
  Peptide Sequence Number=SeqID_95933
atgaaaattctaagttcgggagttgtatttacgcttgaggaaggtcgacaaagcggggcttttgctcctacgtaccctcctttggagaggaaatcagacctacgtagttcttccttatacgtgaatcaagtgattcttttttacttgaagggtgatcattttaaggcgttggaccttaaaaatgatccattttacttagtaagaaactga

SEQ ID NO: 4249 - DNA, 276 bp, Glycine max
  Peptide Sequence Number=SeqID_95934
atggtggagaagaaggaagaagaaaaacaacgtggaaggagaggaagaagcttcacttgccacaagtcccattttaagtggagcaaaaggggcccacctttttcccttgatttgacttcatactcagtcacaaaggagaaaaatttgaccttttggatgctgaaatcctgcctcggtttgcatgccgcctctctggttccaattcctcgcgtttctctgcacccgttggggcccgtttttgaaagtaggcaatatatatcaaaacgctcagaatga

SEQ ID NO: 4250 - DNA, 489 bp, Glycine max
  Peptide Sequence Number=SeqID_95935
acttatcaaggtaatccttgtggcgtctaccctgacttatcttccttcattggaagtggcgtctaccctgacttatcttccttcactggaagtggcgtctacccagacttatcttccttcaccggaagtggcgtctaccctgacttatcttccttcactggaagtggcgtctaccctgacttatcttccttctccggaagtggcgtctaccctgacttatcttccttcactggaagtggcgtcatccaaaacctccgtagcctgtatcaagtgatccgccccgtaagacttatcaaggtaatccttgtggcgtctaccctgacttatcttccttcactggaagtggcgtctacccagacttatcttccttcaccggaagtggcgtctacccagacttatcttccttcaccagaagtggcgtctaccctgacttatcttccttcaccggaagtggcgtcatccaaaaactctacagcctgtatcaagtga

SEQ ID NO: 4251 - DNA, 726 bp, Glycine max
  Peptide Sequence Number=SeqID_95936
atgggaaaccccgttaaggaaagatcaagaaccttaggggcattcgtaatggcatcatttggtggttaccatgaatggctgaaagttcatatacgaggtttagattggcttgccaagttaaaagtcgtcggcgaagagagttttgaagcaccggaagaggacgaagaagtccaagctctcaaaagcgagttaggaaaggcaaaacttgccaaggagaagttcaagttggccgctacacatatccggaaggagtgtgtaggattacgggaagagaatgcaactaccgcaagagcccttgaacaagagaccaagagggctcgcaaggaagagtatggccgtaacaaatttcgcggagctctgtggggtagcaacagtgaactcaagttgcgaagggaagagagggaccagtcgcgagcacatagcatggtcttgaaagaggagttagttgcctattcaaggtccaaaaggagcttgtctcagcgtttatgcgagatggagaccaacatgctagctatcatcgccaagtaccaagaagagttaggtctagccacggcccacgagcatagggtcgtggacgagtatgcccaagtatacgtggaaaaagaggctagaggaagggtgatcgactctttacaccaagaggcaaccatgtggatggatcggtttgctcttaccttgaacgggagtcaagaacttccccgattgttagccaaggccaaggcgatg

SEQ ID NO: 4252 - DNA, 1052 bp, Glycine max
  Peptide Sequence Number=SeqID_95937
tgaccttcagaggactacacgtcctcaccttaaaagaactacacgccctcgccgtcagagggctacacaccctcaccttcagaggactactcgtcccttccttcaaaggactacacgtcctcaccttcagaggactacacgtcctcaccttaagagtgctacacgcccttaccttcagaggactacacgtccccgccttcagaggggctacatggataaatggcctcaccttcagagtactacacgtccttgcttttagaggactccacgccctcgctttcgtagggctacacaccctcaccttcagaggactactcgtccctgccttcaaaggactacacgtcctcactttcagaggactacacgtcctcaccttaagagtgctgcacacccttaccatcagaggactacacgtccccgacttcaaagggctaaacgtcctctcctttacaggactacacgtcctcaccttcagaaggctacacgtcctcgccttcacaggggtagatgccctcaccttcagagtactacacgtcctcgctttccaaggactccacgccctcgctttcgtggggctacacgccctccccttcagaggacaacatgccctcaccttcagaggaataacggtgctgaccttcagagggcaacacgccttcaccttaaaaggcctacacgccctcgccttcagagggcaacacacgctcaccttcagaggattactggtcctgaccttcagagggcaacacgccctcagcttaaaatgcctacatgtcctcgctttcaaagcactacacgtcctccccttcagtggagtacacgtcctcaccttccgaggactacacatcctcgccttcagaggcctacacatgctcaccttcagaggactacacctcctcgccttcagagggctagattccctcaccttgagagtactacacgtcctcgccttccgaggactctacgccctcactttcgtagggctacacgccctccccttcagaggactacacgtcatcaacttcagagggctacacgccctaaccttttga

SEQ ID NO: 4253 - DNA, 204 bp, Glycine max
  Peptide Sequence Number=SeqID_95938
atggttagtaaagcaaagagcgttggagatgatccatggaaactgagaagaatcatatgccaaactgccaaaacttttcggagctttgcaatcttatgttcccaggattgtggtcgctgctcaaacagaatccttgttgcgcatacatggagaagatgcactggtgacatcttggggatattcgtgcgaataagccaagtgtag

SEQ ID NO: 4254 - DNA, 87 bp, Glycine max
  Peptide Sequence Number=SeqID_95939
atggctaggagactccaagaagattgcgccagagatgcaagagaaggtcctagggttttcatgagccttaggggctccatagtgtag

SEQ ID NO: 4255 - DNA, 210 bp, Glycine max
  Peptide Sequence Number=SeqID_95940
atggaggattgccttgagggtcctcacttaggcgatcatgaaactcagctccaaagtcgaaaatggaggacacatgaacagcccaaagcaataacattcatgtggctccgaaaaagggtgagaatggaggattgccttgagggtccttacttgggcaatcatgaaactcagctccaaactcgaaagtggaggacacatgaacagcgctag

SEQ ID NO: 4256 - DNA, 507 bp, Glycine max
  Peptide Sequence Number=SeqID_95941
atgccgcacctcaacttctctcttccacctcgcatatcaacaatctgcctcttctcctcaccttcaccttcgtttccccttcttcccttcgtcactcctctccttcttcctccctctcccccccaagctcccttcctccttcgcctccgcctccaccgctccctctcctttcccttcaaacgaatgtttcttcatgtcggactcagccaacaagttgtgattgcgaagcataaaggttatgtgagtggtagcttgtcggatgaggggaaggttgaacttggaggagattctggtaaatcagaaagttctttggagaaaggcttagttgatcgcagtgacgcttcacatgttgatgctaaagtagataacatggcgaggtgtttcagaaccaaccagaggatactggtattgtcagcagccaaagttgccaaaaagatgaagctaaaatttactaaagaatggattgcatatcttagattgcctcttccaattgatgtttacaaagag

SEQ ID NO: 4257 - DNA, 237 bp, Glycine max
  Peptide Sequence Number=SeqID_95942
atgcaggttagcacgcctgggcgagcaaccccagcacgaaataagttgaaaagggggaagggggaaggtttctgcaccaaaaactctcccccccccccctcattcaaaaagaaagctacgggaatcaccaattttgcagcccctaggtcaccatttttcgcgtttttgattccattttgctctattattcatctccaacgagggatggccttaggcctagggcgcgttctgagataa

SEQ ID NO: 4258 - DNA, 738 bp, Glycine max
  Peptide Sequence Number=SeqID_95943
atggcatccaggaagaggaagagcactgcttctagacccacaactcactcagagaaccaagcttctaaacaagctagagtaagaggacatctgattaagatcgatgcaaaaaggttgaatgaatttcttcagactccagtggtgttagaggagggggaatctttacccacctactttagattttgcaggttaaggactaaccaccaggagattgtagccaggctttgtattccccgcaaggggtttattttgaatgctgacagccagacacggaaacttctcaaaaaagatctgacgacactggcccagacatggagtgtcttctcttactccaacatagctcccacatcccacacctcagatttgaatatggatagagctaggttggtctatggcttggtgactaacatggacatgaacatcggagcccttatctcaggtcagatttcttctattgctcagagtaactcctctaggctcggatttccagccttgatcactaccctatgcagagctagaggagttacctctaatagtctgacttgtgagagcctgagcccggccattaacttggcctacattaagaaaaaattttggaatatgaatgatctaacagttaacttcagaggggcaaggaaggcaagggttcgaccagctgatgttccttcttcttctactccaccagctccttccactagctcctccaggcccatccgctcaggactctcagcactttga

SEQ ID NO: 4259 - DNA, 273 bp, Glycine max
  Peptide Sequence Number=SeqID_95944
atgttggtgaaaggtttgatgctttggaacaacaagtggacatgcgattttgatgcaatggactcaaggatcacaaaggattgtcatcatcaaaaagggggagattgtggaagcaatgtcttccaaggttattttgatgatgccaaagaatcaagagtcaagcaaaatccaaagattcaagaatcaagtttcaagaatcatgattcaagaataatcaagatcaagattcaagactcaagattcaagaatcaagagaagactcaatcaagataa

SEQ ID NO: 4260 - DNA, 693 bp, Glycine max
  Peptide Sequence Number=SeqID_95945
atgatcactatctcaaaatttgagtatgagtatctaacaaatcatgcagcctcagtagaagaaattgctgataaaaaagtagcagcagctgaggcatggattgaagctctcaaggccagcgagaaggaaatactgatggaaacaaaaatagctcaaagacaactcaaagaatcaaaattggagcaagagctggaggtatacaccaaagagaagatgctttcaagaagagttagtagtagtgaggagcttcacaattcatatgcatattttacacttaggtggcaccatccagtttttagtttacaattacacgaaccccagaaaaagatgcaggacaccatggtttggaaagctgatcctagtggtttttattccactaagtcagcatatagtctattgatgactttcaacagacctgttcctcagaggaggattttgcagactattgaagcatgcaatgcacacaaaaaattctctatagagactaaatggggcactatgatgggcagctatcctttttcagaagaacaaccaattccggttggatgggaggaaattctaatagaagttgctgcagagatcctagctgatccatcattttcacggcaagaaacttctctttctatgttatgttctataagggagaatgagaagctaataacatcttattatttgggttctgaatacaactaa

SEQ ID NO: 4261 - DNA, 264 bp, Glycine max
  Peptide Sequence Number=SeqID_95946
atgaggcttcactgtcctcaagggagtcagagacccagcatgaccacagatcgacctccattccttatggctcacatagacccgggtatagggcctaatatctcaatgtgtctgcgaggtgtaggtgtaatgcttaactctttaacgtccccagtggagtcgccaactgttgcaacctatccttcagcgggagagcgatgcaagactcacagatgcgtcttccaaggaaggaaaacatcggagtcgccaccaacgtttatttga

SEQ ID NO: 4262 - DNA, 408 bp, Glycine max
  Peptide Sequence Number=SeqID_95947
atggtgggttacacaccttccaactttgcggatatggtcttcaccgacgaaaggatcaaagtgggtctgaaaaaaggcaaatttagtcatcctgcttggacgaatgagaaaactggggcaaatgaagagggtgaggatgaaggagaagcccgtgctgtgactgccattcctatacagccaagtttcccaccaacccaacaatgtcattactcagccaataacaaaccgtctccttacccaccgcccagttatccacaaaggccatccctaaaacaaccacaaagtctgtctaccgcacttccaatgatgaacatcacctttagcacaatccaaaaacaccaaccaagaaatgaattttgtagcaagaaagcctgtagaattcaccccaattccagtttcctatgctga

SEQ ID NO: 4263 - DNA, 311 bp, Glycine max
  Peptide Sequence Number=SeqID_95948
agctggaaaccccagggccctgttggacttcttcaggtccactgggtgtctttgtgggtgcgatccctggaaactgtagaagaatattgctaagtagcaatgtcatctatgtaagagtggtcatgttggtgcgcatgatctgctttcgtctctttgcagcgcacggtgtgaaatcttgtcctggtatgcatagtagctgtgtgatagcctccctccctggttgtgctcgcacagttggtcctcctccaatatcagggggtggcccaggaaccggtgtggatatggagcccactgaaagtgaggacgcgtag

SEQ ID NO: 4264 - DNA, 177 bp, Glycine max
  Peptide Sequence Number=SeqID_95949
atgaaggcccaagtggagaaggatgaaggcccagagacttatcaaggtaatcctcgtggcgtctaccctgacttatcttccttcactggaagcggcttctatcctgacttatcttccttcactagaagtggcgtcatccaaatctctgtaacctgtatcaagcgatccgccccgtaa

SEQ ID NO: 4265 - DNA, 1194 bp, Glycine max
  Peptide Sequence Number=SeqID_95950
atggactattgcttgagagagctagaaggaaagcaagcacatgaccctctattcctacagaaaatgaagaattcatcatcacaaagcactactactagtagtgagagatgtgtgtgggtgccagggccagtgattgtgggagcagggccttcagggcttgcaacagcagcatatctcaaagaaaaaggattgccaagcctaatcctagagagatccaactgcatagcatccttgtggcagctcaagacctatgataggcttcaccttcacttgccaaaaaacttctgtcaactccccttgatggggttcccttgtgatttccctacataccctacaaagcaacagttcatagagtacttggagagctatgctgagagctttgacattaggccaaggttcaatgagacggtccggcgcgccgaattcgacgccacgctcggcttctggagggtgaagagcttcaacaagaaggaggtagcaacagagtttgtgtgtaggtggttgattgtggccactggggagaatgcagaggctgaggtgcctgagattgagggaatgggagagtttggtggggccataaagcacacaagtttttataagagtggggaagagtttagagggaagagggtgttggtggttgggtgtgggaattcagggatggaagtgtgtttggatctttgcaaccataatgctactccttctcttgtggtcagagatacagtacatatcttaccacgagagatgctgggaaaatcaacttttgggttgtccatgtggttgctcaagtggctccctatccggtttgtggattggttccttctcatagtgtcatggctcatgcttggtgacacggctcggttcggattggaccggccaaaattgggtccccttcagcttaaaaacttgtccggaaagacaccagtgctagatgtgggtacccttgccaagatcaaaagtggacacataaaggaagatgatatgttctctaaggaagatgggttccctacgaagccattcccagatggatggaagggtgagaatgggctctatgcagttggtttcaccaaacgtggactacttggtgcatcaatggatgccgagagaataggtgaagatattgaaaggtgttggaaggaaaagcatagtagcacttctttttctctctcacttaatgtgccacaatccaattcatga

SEQ ID NO: 4266 - DNA, 270 bp, Glycine max
  Peptide Sequence Number=SeqID_95951
atgagtgaaatagaggaggtgcaagagcggatgaagaccgacatggaggccatgaaagagcaaatggccacaatgatggaggccatgatgagcatgaagaagataatggaggtcaatgcggctgtagttgccgctactagtgtcgttgttaatgtggatatgattcccccatctggcctcaacaaaataaatcatccaacctcatatatggtgggtcagggaggcaaaaagttgggaagtacgggcggcccccatttcatgcaagtttag

SEQ ID NO: 4267 - DNA, 511 bp, Glycine max
  Peptide Sequence Number=SeqID_95952
ggtttgggtttactacttgtgcttaatttccacttatttgattcgggtacggcctcgatcacctgggatgcccactgggaggaaggaagcctatcttttctctgggttctacccctccatggctagagttgccaaggaataccaaggaagtgtttggaagaaaaggcgaaggccttggcaaatcaaggcgaatgggcttcctttattgacatcttgcgcgcttttgatctttggagttgtcctctttccaaatgtggaaggattagtggacctagcagcgattgacgccttccccacctttcaccaaagcaaggaaagcccggtcgtcgctattttggccgacatgtatgacacgttcgaccggagatgtgaaaagaatggcacaagaattgtttgttgcacaccggctctctatgtgtggctggtttcgcagctttttcaccaagaaggtaggcccgtttgtccgctacaaggtcaccgctcatgcgctgagaaaggaaaggcgaattag

SEQ ID NO: 4268 - DNA, 726 bp, Glycine max
  Peptide Sequence Number=SeqID_95953
atggaagctgttgagaaggacctcactactctggcacagacttggagcgttctaccttatttcaaccttgcccctacatcacacactttagatctgaacttggacaaggcaagaggagtcacctcagattccttgagttttgagtccctcagcccaaccattaacttggcttacataaagaagaactactggaacttggacgaccccacggtcagctttccaaggacctgcaaggctagggctaaaggacttgagagtccatcttttgctgctccccagacatctactgcaccagctcctattccttcagcaccagttcccgctacttctggtccctccactcagagcacagacctcatgatggcgatgctgcagagcattcaccagggtcaatacctagtgatgcaaagtttgcatagtttggctcaacatcagccaattatgagcatggaagagttttctttgcaagtggcctggccaggagtccatccttcttctcatggaggaggtgaggcctccgcagctcaggaggatgatttagaggccactcccccagagtcatttgtgccagaaactgatccagttattgcggaggctagtccacaggcatcaccagtatctacaccagtgctggagttgaacaccccgcaaggatcaccagcaggcacgcctgtgctgcttttgaccgatgatgaggccatggatcaggacccaccgcaggactag

SEQ ID NO: 4269 - DNA, 75 bp, Glycine max
  Peptide Sequence Number=SeqID_95954
atggctccaaaaacttgttcgaacccagcaagtgcaccagatcgcgcaagtagtataaaatggtatgtaaactaa

SEQ ID NO: 4270 - DNA, 1365 bp, Glycine max
  Peptide Sequence Number=SeqID_95955
atggcctccaggaagcgtaagagcattggggcaaggccaactgctcagtatgatactagacggttccattcgcttgatgcttggaaccgttatacagataatgtcttggggaggagcattttgccagagaggaaggttgaaatataccaaacagagttcgatgacttcaagacagagttggagaggcgtaatcttcacaaacgcctcaccaacttggctgatgggactattgatgttgctttggtgaaagaattttatgctaatctctacagctctgaggatccttcaccaaagcaagccagagttagaggccagttggtgaagatagatgttgacaactttaacatatttctagagactcctgtagtcctagaggagggggagacattacccaccaactctaggtactgcaggttacccacagaccatagagagattgaggttgctctttgcataccagggagggggttcattttgaatgttgagggccatccagggaggactctcttactccaacttggaccctacatctcatacatcagatcttactgtggacagagccagttgatctttggcttggtctctcatatggacatgaacatcggcgctctcatctcaggacagatgacttttattgcccagtctaactcttgcagacttgggtttcctactttgattaccgccttatgccaagcccgaggggttgtctctgacagcctcacatttgagcgcctaagcccaaccattaacttagcctacatcagtaagaactgttggaaccttgatgatctaacagttgctttccgggggactaggagggcgagggagaggccagctgatattccatcttcttccgcagctccaacacctacttctgcagctccttcagttccaacccatgttgactcacagcacaatgaagccatgcttcaaagatccatcctattagtggagcagttcttagaaagggtagcctggcctagggcccaaccttctcttgatagggaagatgaaggtcccacagctcaggtaccccaacaggtacaagatgcttcctccgagaccaccattccagagccattcattcttcatcctaaggcagaggaagaacaggcaagaccagagactactactactcctgagagatcacttgagggcacatcagagcctcctactccagtagcagacctctcctcaccacagcctgcagttgacccttccactcctatacttgacatactaaaggaccagaccacaccagtcctgacactgaacacctctcctccagctactccagtacttcacttgacaaatgaggaggatgctcagacacaggacacccaggacctgtctcagggattttaa

SEQ ID NO: 4271 - DNA, 228 bp, Glycine max
  Peptide Sequence Number=SeqID_95956
atggtcctattagcagctagccctagccttggcgattgtaacacccttaattgttcacttctcgatggctctcgtactacaacacttcacacgatgacacttcactcaacttatcgttggtcgaaatcctccaccgggacgcatttgtcagcgagttacacattcagggacaaaagtggctatttacacattcctattcctagagagtgggaagaagaaaagtcatga

SEQ ID NO: 4272 - DNA, 1014 bp, Glycine max
  Peptide Sequence Number=SeqID_95957
atgcctccgaaaaagctttccacaaagaggtctagaaaggaagccacgggagaaggctccagtgctgccttggagtttgatagtcactggtttcagagcgccgagcaccaacagcgcttcgaggccatcaagggatggtcattccacagagagaggcatgccatcagtcagttcttgggcgacccgttgattctggatgaggaccaacagtgtgaatttagccagagaaggaaccaggaaaacggttttgatgaggaagccatcgcccagctgctttgcataccagggcaggattttgcccaaaccgctgcagggaggcgagtgtggattatgtgcaccagtatgactaccctgacccagatttggatgactctgctgctcagcaatgtcttgcctaacgaccacaactccgacctccctctgcctaagtgccaattggtgtatgccatcctgacacggatgagcgtccacgtggcccaggtgattgttgatgccatttatttatttgcaggaatggcgcctactaggcacccgttgaacccagagaagtccaatagggcattggggtttccggctctgatcacaggcctctgccaatccttcggagttcaggtcacccccagcaaagtaatccgaccaccgatcacccgatccttcattgagaagtactgcacgcctaggcaggcacagggtgacgcacctcagggcacgggcgcaccgccaccacctcggcaggcagatccggttgagccgctgggcgtggagcggtatctacagcatttggtttgccagcaggcggccaaccaccgtggacaagtgcagatacacgagtgtctctatcggtttagccgcagtcagcaggggcagggttcctccccttttgtatgccctaccccggagcagtttgcggttgaggttgcatggcctggagactggcccaatgcccaggtcgaggaggagcctgtagatcccccgatgggatggatgaaccccacatggacgaggatatgctaa

SEQ ID NO: 4273 - DNA, 381 bp, Glycine max
  Peptide Sequence Number=SeqID_95958
atgcatctacatgatcaaggcagaaagcatgataaaaagatatttacatcaagaacttacaaggaagatccaacagaggttttagctttccataactgggaagcttcctttacaacaaagagaagagaattgaaagattatagaaatacaagtagtggggatgtctcctccacctctaggacctcacaatcactcacaaactcatctcaagctctcaagacagcttcctcttctagctctggtctctgtagatcttcacacaacaaattctctcaaactctctggaacttggacctttctctctctagaactctccaaatttgcagaagcttcaagaaaaggccaaactcccctccaaaatcagatttcaggctaaaatag

SEQ ID NO: 4274 - DNA, 193 bp, Glycine max
  Peptide Sequence Number=SeqID_95959
atgactaaagcacgtcaaaagggggtacggaaagaaaatgggggagatgcttgccacccagctcgcccatgcgagcaaggtgacttcctccagaagcaaccgccttctggaggaatcttctggagggcccaagtgggcctggttgctatttgcacccccattttctctaaatacaccccctgccctttttttg

SEQ ID NO: 4275 - DNA, 228 bp, Glycine max
  Peptide Sequence Number=SeqID_95960
atgcatctattcataaatgaagaaccaaaagtgaagctgctaaacaacaacaccacatcacttacttctactgctaactgccaagttaaatggaaaattttgctcaacggaggaaacatagaaaacacattttgcaacaaagaagacaaagttttgccactccaaatccagatttacatagtgaaaagcgtagacgaacctcatcatgtgaaacacacccttttgtag

SEQ ID NO: 4276 - DNA, 303 bp, Glycine max
  Peptide Sequence Number=SeqID_95961
atgggggatgccacattgctcccattctcttgcaatttatgtccaaacatgcgcccaccaagtagcataagaggcctttcaaaaaatgtgcccattccaaaatggcacaagaatgcttcccaaatgaatatacgatgtaggattgctcctcaagagttaggtagatggcatgaaggtttcttttcaaatgcaagtgtgtgcgagacgaaatggccccgaggaagctcgcctcaaagagatctaggaaggataaagcggctgaaggaaccagttccgctcccgagtatgatagtcaccgtttag

SEQ ID NO: 4277 - DNA, 90 bp, Glycine max
  Peptide Sequence Number=SeqID_95962
atggctatttataggaaagagccaagaggtgctgagaaattcgcccaggcgagttggttgcttatgactgaagaaatcttattagcccag

SEQ ID NO: 4278 - DNA, 432 bp, Glycine max
  Peptide Sequence Number=SeqID_95963
atgggtttaggcaaagacaacggcggcataactagcctgataaatactcaaggaaatcgtgggaagtatggtttaggctataagcccactcaggcggacatgaaaagaagcatcgcgggaaggaagaacagtggtcaaagctcgcgttggagacaagaaagtgaaggaagcccgccctgccacataagtagaagctttataagcgtgggtctgggagacaaaggtcaagtgtttgcgatatgcgaagatgatgttccgagtgctttggatttggtacgaccatgccctcctgatttccagctgggaaattggcgagtggaggaacgccccggtgtcgcaacctacccttcggcgggagggcgacgcgtgactcgcgggatgcgtgttccacgaaaggaaatacgcgcggagtcgccaccaacgtttatttga

SEQ ID NO: 4279 - DNA, 501 bp, Glycine max
  Peptide Sequence Number=SeqID_95964
ggatacaacaagatgaagccttgtaaggtctcataccaaaatataaaacaaaaaatgaagtttggtaatcaagaactgcctgtacttacaaacgagtttcactaccctggtagggaagccgtcaacaacaaattcaattgccttattgataatatttggaatattccaaaacatacaaacaataatgagcaatttgtgtgttcagtaaaaaaaggcataatttgtgctttatacaatttctgcatagtagataaccaaggagtccctctccttacaaaagcctccccttttgggaaaggttatacagcttttgtcctgttatcaagaccccataaaggtgtttataccaattttaaagatctttgccttgaaaaggagggtattcaaagcccaatttacaaaggattctattcaagggaagaagcagaaaaagcccttgaactaaataccacagacatcaataaaataaaaaggcccttgagccagaaaacacgactatag

SEQ ID NO: 4280 - DNA, 222 bp, Glycine max
  Peptide Sequence Number=SeqID_95965
atgggcgacctcaatggcctgcgccacttctgccgccgtgctttgcgtcagttcgcggatcactttgccggtcgccggatcgtagaccggaatggtttcgttgctggcgctgtgcgtgattttgccgccgataaagtttcctacgatagtcatgtcgttgcctctttgatgtgtaagcggcctggatcgcatttttccgccagcgttagcggactggtgtaa

SEQ ID NO: 4281 - DNA, 492 bp, Glycine max
  Peptide Sequence Number=SeqID_95966
atgggttctccacctgcctccactcctcctcctccttctcctcctcaatctcttcctacttcaaatgcatcggcttcgacgtctgccgtgaagcggacacgcaaagcctcacgtctacgatcgttgtccactagaccacctggtgttaagagaccagtggtgcatgttgatcctgctacagggaaggccgacggtccccacaagaagaaattaagaatatatttggggattgtggcacgtgataaggtggacatcacctacgataactggaaggaggtccctactactcagaaggacctgatttgggaggatattcaggatgtgcgcaacaaggcacaggccatccagaagcagaatactgccccccacgttttgtctcgtgggggttatgattatttggagcagaagctcctggctgagaagaccaagaagaagctgcaggaagctgcacagttaggaagcgttgatggcatcatcgaccctccatccccg

SEQ ID NO: 4282 - DNA, 355 bp, Glycine max
  Peptide Sequence Number=SeqID_95967
gcttggacatgcgcggcctatccgactcgacggcattaactactccccctctatgattggcgagcgggtttattttcatgttgggccgatcctcttgaaacgtcagccatctggcgtctatcaaatgttggaccttgtatttaagggccaagcatttttcggtggcgatgagggatggcaagagggaatgtttctcatcgcattggaatcggcaccaaagtgggcattgccggccaggcgagtcgtggttggagccggagcttggggggcctccctctggatgggggcgggcactctaggatgtacgggtgctgaattggaggagttcccgatgcgagctaagaagcttggatga

SEQ ID NO: 4283 - DNA, 1469 bp, Glycine max
  Peptide Sequence Number=SeqID_95968
atgttcgcgctggtattggccatcggcctgctggtggacgatgccatcgtggtggtggagaacgtggagcgggtgatgactttcgaagggctggcgccgaagccggccacgctgaaggcgatgggccagatcaccggcgcgctggtcggcatcgtgctggtgctgaccgcagtgttcctgccgatggcgttcttcagcggtgtcaccggcgtgatctatcgccagttctcggtgacgatcgccgcggcgatgatcctgtcggtgctggtggcgatgaccataaccccggcgctgtgcggcagcatcctgcaccagattcccaagggcggccatccgcatggcgaccacggtggcgagccgagcctgctgggcaagttcttcatctggttcaaccaccgcttcgagcgcacctccaacggcctgcgccatcgcgtggatggtttccttggccagcgcacgctgggcgtactgttctacctggtgctgagcgtggccaccggccttctgctgtggcacctgcccggcgcattcctgcccgatgaggaccagggcatgctcaacgcgctggtgaagctgccagccggctccaccctggagcagacccgtgcagtgatggatcgcctcagtgccgctgcggtgaaggacgacagcgtgctctcgatccaggccaccgctggtttcagtgtcaccggcagcggccagaacgtcggccaggccttcatccggctcaaggactgggatgaccgcaaggacgacgccgataccatcgccgcgcggctgaccgccgccatggccagcgtgcccgatgcgcaggtgttcatcacttcgccaccggccattctcggcctgggcgatgcgggcggattctccctggaactgcaggacgaaggcggtgccggccatgccgccgccgtggctgcgcgcaacaccctgttgaaggaagccgccaaggatccgaagctggtcaacgtgcgttatgccagcctggaagacgcgccggtatacgcggtgaaggtggatgacgccaaggcgcaggccatgggcgtgaatccgcaggacatcaatgacaccttgaatgcggcgctgggcggcgacttcgtcaacaacttcatctacaagggtcgcatcaagaaggtgttcatccagggcacggccgaagcacgcatgcagccgcaggacatcgagcgctggagcgtgcgtaaccaggccgggcagatggtgccgctgtcgtcgctggtcagcacccactggaccagcgcgccggccgcattgcagcgctacaacggcatctcggcgatggagatcaccggccagccggcgcccggcgtcagctccggcgaggcgatggccgagatcgcgcgcctggccgatacgctgccggaaggcttcagccacgcgtggtcggacatggcctaccaggaacagctgtcgggcaaccaggcgccgatgctgtacgccatctcgctgct

SEQ ID NO: 4284 - DNA, 208 bp, Glycine max
  Peptide Sequence Number=SeqID_95969
tgaagtatttgaagatttggtggtcccgtgttccgtatttgaagttttattagtggctgttgttcctattttgtcagaggtccggaatgaccacttccggatgaaggtcttccggaagttacgaaagccaattccggaagaagtgcttccggaaactatttccggaagaccttcttccggaattgggcttcttaacttccggaagaag

SEQ ID NO: 4285 - DNA, 288 bp, Glycine max
  Peptide Sequence Number=SeqID_95970
atgggatctttgtcaaccaagcaaaatattgcaaggaactcatcaagaaattcggaatggagaactccaaaacacttggctactcctatgagcattggttgctaccttgataaagatgagtccggtcaacccgttgatgaaaagcaatatagagaatacatctttgttggtagttgttgtgcacagattctgtggatgaaacaacaactatctgattatgggattgtattagaccatattcccataaaatgtgacaacacaagcgccattctagaatcaagcacatag

SEQ ID NO: 4286 - DNA, 489 bp, Glycine max
  Peptide Sequence Number=SeqID_95971
atgtcgatcttcccctgtggaaggatcgcgccccctacgaggagtcccttggacccgaagaagtccaacagggccctagggttcccggctctgatcatcaggcccccattaaccaggctttcatcgagaagtactgcacccccaggcaggcgtagggcgaggcaccaaagcagcctggggacagacagcagcgggcaacaaagtcactgccaccaccttcagggtccacctcaacacatctacaaaggctggagcgttgcctacgacacgtggctgaccagtagacgaccaaccaaccaggcaggtacgagcaggcgtctgactcaagacgttaaagaagcgctactaggaggcaacctagaattggctacgaagaagctccccgcgaagcggtctaggaagggcaccattgaagaggattctagtgtggccccacaagctgacacaggctttgacaaacaccgattccagagtgtggaacatcaatag

SEQ ID NO: 4287 - DNA, 186 bp, Glycine max
  Peptide Sequence Number=SeqID_95972
atggagtggatactatccacgcctacaccatatcgtctagtggagccaatccaagtgatcgagggtgatgaggatccccttcctgaggtggattctcccgaggacgtcatgtcggcatctgaggcagactctacggaggatagtggccccggagagatggcgatcagcggaggctcttcatcatag

SEQ ID NO: 4288 - DNA, 237 bp, Glycine max
  Peptide Sequence Number=SeqID_95973
atggctggtacattcttccttttgaaacagcaaaatagtttagagattatgagcgggacgccacaattggtggtatcagagcaaaagttggatcctagtgaacctgttatggtcttgctgtgtgaatgttgtgtatctttgaaacttggaagtaggtttcggggagtgacgttaagtcacacgttgtgtgtatttctgccttcttgtcttgagcatgaatgtgtgactgattcatag

SEQ ID NO: 4289 - DNA, 540 bp, Glycine max
  Peptide Sequence Number=SeqID_95974
atggtggcgcgtgttatgctcaggaacggatttgagcccggaatgggtctaagcaaggactgcctcgagaatgccgacgtggtcgatatcaagggaaatccatacaaatatggattagggtatgaacccgggatgccagggaggaggaacgtgctgtcaagatttcgggcgaatagggtatggcccggccgtattagccagtgtttcaccagcgctggaatggtgtccgaggaggaggtggccgcaataaaagaggtgttccctcaagacccaccaagttttgtgcaaccatgccaccccggttcccaagtggggaactggcgcgtgataagccagtcagaagtctataccgctgattcaatttcctccttgtcgcaacgtgcccttcgcgggcgagcgagggcgaggctcacaggtgcgctttccaaaggaggaaagatacgcggagtcgccaccaacgaaggtattagcacctcttacgtcgacaaaagcggggcttttgctcctacgtaccctcctttggagaggaatcagacctac

SEQ ID NO: 4290 - DNA, 306 bp, Glycine max
  Peptide Sequence Number=SeqID_95975
atggccccaaggaagctgcctcaaagagatccaggaaagacaaagcgactgaaggaaccagttccgctcccaaatatgacagccatcgttttaggagcgctgagcactagcaacacttcaaggccatcaaaggatggtcattcctccgggagtgacgcgtccagctcagggacgacgaaggagggtgtgcgagatatgcgatcttgggtaaggggtcagtggatcccttttgatgcggatgcccccagccagttcctgggataccctttagtgctggaggagggccaggagtgcgagtatggctag

SEQ ID NO: 4291 - DNA, 456 bp, Glycine max
  Peptide Sequence Number=SeqID_95976
atgatgacaatgatagtagacacattaccggtattctactatgaaaagatggtgagctacacaccttcaagctttgatgatatggtcttcacagacgaaaggatcgatgtgggtctaaaaagaggaaaatttagtcatcctgcttggacgaatgagaaaactggggcaaataaagagggtgaggatgaaggagaagcccgtgctgtgactgccattcctatacagccaagtttcccaccaacccaacaacgtcattactcagccaataacaaaccttctccttacccaccacccagttatccacaaaggccatccctaaaacaaccacaaagtctgtctaccgcacttccaatgacgaacatcacctttagcacaaaccaagagcgccaaccaagaaatgaattttgcagcgagaaagcctgtagaattcaccccaattccagtgtcctatgctga

SEQ ID NO: 4292 - DNA, 96 bp, Glycine max
  Peptide Sequence Number=SeqID_95977
atggagagggagaggaagaagactttgaagccgaaaattaaggagggaattaacaacaagggccaaaaccaaactaattggaatttgaaagggtga

SEQ ID NO: 4293 - DNA, 762 bp, Glycine max
  Peptide Sequence Number=SeqID_95978
atgttgtggcaccctgccactcctccagggttgttgtattgcgcctggccagagcagccagagcacgtgtttcacagccaaaattgcagaaaatcaactagaaagctactcttagattgtaataagtttcctggtttaactgtaaatcagggccaacagcaacatgatttcccattggttgatgagtgcaaacgctcctccatatgtgtcaccgctgaacaagatctgcaacttgtgccatccctgaagagccgctgttctgcaacttccagcgaggcaaaatggttgggtgcggaggagatggcggctgatgggagaaagaagctagggtaccgagctattacaagtgcatattatcgaggagctgttggtgctttactagtttatgatgttacacgtcatgttacttttgaaaatgtggagagatggctaaaagagctgagagatcacacagatgccaacattgtggtgatgcttgtagggaacaaagcagacctgcgtcatctgcgtgcagtttccaccgaagatgctagaactttcgctgagcgagagaacacatttttcatggaaacatctgccctcgagtccttgaatgttgaaaatgccttcacagaagtgctgacccagatctatcatgttgtaagcaagaaggcccttgagattggagacgatccagcagctttgccaaaaggacagacaattaatgttgggtcccgtgatgatgtatcagctgtgaagaaatctggatgttgttctgcttga

SEQ ID NO: 4294 - DNA, 687 bp, Glycine max
  Peptide Sequence Number=SeqID_95979
atgccacatctgcggtggagcacacgagccagggcaatgcatagcccaagaagattcttccagggaggctacaaccaaggaggaccggcgggattcaaccaagggagaaatttcacacagggctcaagctggaggaatcatccgaggaaccagttcatcaaggagcaaggaagtcaaccagctcagaattccaaccaagggatagatctttatgagaagactagcaggcttgaggagatgcttaataagttcatacaggtatctatgtctaaccatatgagcacagaagtcgccatcaagaacttggagatacaagtgggccaattagccaaacaagcggctgaaagacccactagcagctttgggttcaatactgagatgaagcccaaagaggaatgcaaggtaattttcactgagaaaggagagaaggaaaagaaaattgaggatgatgtgcgtgataaggaaggagaaaagaaagaagagagagaaagaaatgaggataaaacacaacaatgggagaagtgctcacaagtagaagttcaacaaaaaattattcttcaagtcaatacccctccccatcaattgattgttaaggaagaaagacatggagaacatgatagatctttaagtgtcattctttccttgatcaccaacacttctcttggaatgtgcttccagaatatatga

SEQ ID NO: 4295 - DNA, 819 bp, Glycine max
  Peptide Sequence Number=SeqID_95980
atgtaccagagtaggtgtcgggccaggcagtgggttgctgcagctcggacgtgcctccttcatttggttggttgcactcttttcgctaacaagagtgcaacccatgtccatgttgtgcacctgcaggcattcagggacctgggcctggcagaggcattctcttggggagcggccgccttggtccacctgtatgatcagtttaacgaggcgtcgcaggcccctccacggcagatggccggttacatttcactacttcagtgctggatttacgagcactttccatcggtccatcggtgtgtcgttgatgatggttatgttgaggctagcccacatgcctgtaggtggcttatgggtaaggcccagatgaccgggattaagggagccccgtacagagcatgtattgatgccctgacagtgaccgacgtctgttggatgctgtatgctgagcatcagggagttcggggctatgagttgatctcctcgtacacgggacaagttagatggggtcagatcatcgtctacattcgaccagagagggtggttcgacagtttgggtacattcagaccgttcctccaccaccggttcgtgattcgttgacaggtactgatatagacgaccggtgggtacacttttcagatcatgtggtgcctataggggagctcagtgtagttcctgggcagatttcgcacccttttgtgacgccgacggaagatactgctgagccgagacctgttcctccccctctccctcatgatgatgacttcgtcgagcactgtcccgaggttcagtcgcgtcgatctcctatgcatttgtggtag

SEQ ID NO: 4296 - DNA, 366 bp, Glycine max
  Peptide Sequence Number=SeqID_95981
atgaaagaaagggaatggaaaatcttcagaccagataaattctcggcaagattgccattctcgactggcgatatcccaccccacatgaacaaagaggaaaagaccgaaacacccagcttcctctccaaaaacactaccctcgagaaaatcctattggtccgtgatccgttgttcatgtgtcctccaccctcgagtctggagcccctcgaatgtcattgcctagcgctgttcgccatcattttaggaacttttaggaataactgggaaacgtattttaacgatcctagttcattggagccagagagattaaaggcattgcggatccagtgggcacactattatctccgagttagagatcagacctag

SEQ ID NO: 4297 - DNA, 273 bp, Glycine max
  Peptide Sequence Number=SeqID_95982
atggagagggagatgataaccatgatagtagacacattaccagtgttctactatgataaaatggtaggttatatgccctctagttttgcagatttggtgtttgcgggcgagagaattgaagtgggcttaagaagggggaagttcgattacgctgcttcagcaagtacaagcaataggaggtccggaatgggtggagctaagaagaaggagggagacactcatgccataacttgggctcccacatggccaaaaatcccaacaaacccctcataa

SEQ ID NO: 4298 - DNA, 264 bp, Glycine max
  Peptide Sequence Number=SeqID_95983
atgactggcggcattgtgttccttcctcgtcctaccgtatttgggggaggatggggcgcggtagctaggagagttgggtctgcttcggcagccgaactgacagcggcaacggtggacacatttttcttcatgagttgcctcattcctagcatggcctccatcatagaagccatttgttctttcgaagcctacatgtcggctttcatctgttcctatgtctcctcttggtcacccatcgttctagatttggatccggtgcgatag

SEQ ID NO: 4299 - DNA, 156 bp, Glycine max
  Peptide Sequence Number=SeqID_95984
atggttgctcacatcctagatccaagggttgatccttctcaatatcgtgatttaaaaataagcaacatcaacaaaaggagccgctcaaaatacgaggacttgcattgcatgggaaccaataatcttccaagacggattcatgagatgataggatga

SEQ ID NO: 4300 - DNA, 567 bp, Glycine max
  Peptide Sequence Number=SeqID_95985
caatgtcttgcctagtgatcataacttcgatctccctctgcctaagtgccagttggtgtatgccatcctgacacggatgagcgtccacgtggcccaggtgattgctgatgccatctatttgtttgcaggtatgccacccaccaggcaccctctggacccggataagcctaacagggccctggggtttccgatgttgatcacgggcctctgcaagtcatttggggttcccgtcacccccaataaagtgatccgaccgtcgatcacctgggccttcatcgagaagtattgcacgcctaggcaggcgcagggtgatgcacatcaggccacagacgcactgccaccacctcggcaggccgatcccgctggatcactaggcatggagcgttatctacagcacttggttctccagcaggcgaccaaccaccgtgggcaggtgcagatacatgagtgtctctaccggttcagcctcagtcagctggggcagggatcccctggtgaggcagaggaggcccgtatggatgaagatatgactgacttgctcggtttcttgggaggaagcggagccac

SEQ ID NO: 4301 - DNA, 432 bp, Glycine max
  Peptide Sequence Number=SeqID_95986
atggcgaggacatgtagtcctctgaaggcgaggatgtgtagtcctctgatggcgaggaatcataatcctctgatggcgaggacatgtagtcctctgaaggtgagggcgtgcagccctctgaaggcgaggacgtgtagtcctctaaaggtgagggcgtgcagccctctgatgacgaggacgtatagtcctctaaagattgactgtccttttgaaagaggtgataattcatgcaaccttgtcctatcttttgcaaatctttccgggaactccctcagaggcctctgccggtcattcgggattctcgtcacacctagtaaggtgattcgactgccgatcacctgggctttcattgagaagtattgcactcctaggcaggcgcaggggaatgcaccacaggctgcagatgcccgtgatcaatgctggaaaccctag

SEQ ID NO: 4302 - DNA, 1048 bp, Glycine max
  Peptide Sequence Number=SeqID_95987
atgacgaagaaaagtgctgaaacatctcgagctgacatgagacccaagaaacctactggggtgaaaattcaagaagggaaacaagaagagaaggaagaagaggaaagaccactcataagaaaaagaaagttacctacaacttcgaccaagtctgctgaacaaacagagacaggcaattcccaggctcaaacgcctaagaagaaaaagaaagtgaagcaggtcgagactgaaccttctgtggctgtcgagggtggtgagccagccaagaagaaaaaaaaaaagaccaagtctttaaaagaacaaggtgacaatcaacctgttgacgtccgcccaccttcgaccgatattgacggcaccgaagtagaagctgctccttctattgctgagatgggcaaccctgtcgaacaaccgaacttaccacaagaacaacctgccgtcgaggtacaacaaaatgtttctgcagaaaaactaccctcgtgtgctcgaacatctcccgctcctgaggcggatgcagtgaatgttgaggaatggggtgaaggtcaaggtattggatccagtcatcctcatggttgggcagaggtcgatgaccatcatgaaccgaaccagtcagataataccactcctcatgaatcgagtcagaaaagttcatctgaagaaaacttttttgatgaagacgccataaaagaggctgaagctggaggttcggacatttacctggtgtcttcaacatctaagctttccgctagcatagggatcgcagaagatacattcattcaaatgcaagacgaagaccctgctgcagcccttcgactcctgctgaacacaagtcaaaccaacaactcaagtgacaagattcctggtgcttcgtcctcatctgatgctgaaataaactcttcagtacgccaagattctctgctcttgaagttatcaatggaatacgcacagaaagatgtgcttaaatccattgaagagaacccctctgctgcctttgggcatctgaactttttgaagaaattgcacaacccccttacctctgatgaaactttag

SEQ ID NO: 4303 - DNA, 351 bp, Glycine max
  Peptide Sequence Number=SeqID_95988
atggtcattctgcgccctttgtcattcagaagcagcgagtcgagtgataaacgcgcagagacaaattatggtcattctacgccctttgtcattcagaagcagcgagccaagagcagtgagtcgagtggtgggcagagacaaattatggtcattctgcacaccttttcgtcatccagaggcgatcatgtccgatggcatgcagagacaaattatggtcattttgcgcctttccatccaggcccgatcgtgtccgatggagtgcagagacaaattatagtcattctgcgccttgtgtcaaccaagaggaacgaattcggtagtatcaggatgatgttggtcgttcggtgctga

SEQ ID NO: 4304 - DNA, 723 bp, Glycine max
  Peptide Sequence Number=SeqID_95989
atgcgcaccagcatgaccaccttgacccagacgtggatgatactgctgctcagcaatgtcttgcctagcgataataactccgatctccctctgcctaagtgccagttggtgtatgccatcctgacacggatgagcgtccacgtggcccaagtgattgctgacgccatctatttgtttgcaggtatgccacccaccaggcaccctctggacccggataagtctaacagggccctggggtttccggggttgatcacgggtctctgccagtcattcggggttcccgtcacccccagtaaggtgatccgaccgccgatcacccgggccttcatcgagaagtactgcacgcctaggcaggcacagggtgatgcacatcaggccgcagacgcactgccaccacctcatcagaccgatcccgttggatcactaggcatggagcgttatctacaacacttggttcgccagcaggcggccaaccactgggggcaggtgcagatacatgagtgtctctaccggttcagccttagtcagcaggggcagggtttcgctccttttgcatgtcctactccaaagcaatttggggctgaggtcgcatggcccggagattggcccgaggcccaggcaggggaggagcctgcaggatcccccggtgaggcagaggaggcccgtatggatgaagaaatgacggacttgctcggtttcttgggaggaagcggagccacgtga

SEQ ID NO: 4305 - DNA, 671 bp, Glycine max
  Peptide Sequence Number=SeqID_95990
gatgctcctgacatgactgaagacttacatgcacatgctgaagaagctgttgatgatgctgagggatttctagtcaacgaacgtcctgaattgaagctattcttccacggaaggaaggttcagaaatttgggaggcctgctcctgaaagtcaagggctagtcgctgtcacaggattaagttctttgatcgcatgttcagtggacacttgtgatcgggaacttatattcgcttttgtggagaggtggcataagaaaactagcagtttccatcctcctgttggagaggtgaccatcaccctagatgatgtgacctctctgcttcatctttctattataggcgcattccaaagctttgagactctgcatgtcgacaaagcggtcttaatgttggtggagttacttgaagtctttggagaggaagctagagttgagacagcacaatacttgagtcatcttggaagctatgcatggggagctgccgccctagttcatatgtatgataatttgaatgatgcttgtaagagcgacaatcgacagcttgctgtagtggggcagatttgtgttatgccaggacaatatgcatcagattacatgcagtggttcttcatgatttctcattcattcatgacaccaacacagcctgctaatctggctagacatccacctgtgat

SEQ ID NO: 4306 - DNA, 201 bp, Glycine max
  Peptide Sequence Number=SeqID_95991
atgatatgtccattacgatgtcatgaagagatgcatgatgtgatcaaggaacaagccataggactatcagtgacaatgcatcagctaaagaggaaaactctagatgaggcttcactgttatcaagcgagtcggagacccatcatgaccacagatcgacctccactccttatggctcacatagactcgggtatagggcctaa

SEQ ID NO: 4307 - DNA, 200 bp, Glycine max
  Peptide Sequence Number=SeqID_95992
gtggtctagtagacaacgatcgtaggcgtgaggctttgcgtgtccgcttcacggtagacggcgaagctgatgcgtcagaaggagcaggaggaggaggtggcgaggcaggtggagaagccatgatcctgtatacatcatcaaaatgcaaatttcaattacagacaaatatcgacatcaatagttccttaaataaaatgtga

SEQ ID NO: 4308 - DNA, 366 bp, Glycine max
  Peptide Sequence Number=SeqID_95993
atggcagagaacacacacagtcaagcttccctttgtgagatggaagaacgtctcagcagcagaatggaatcaagatttgttgagctcactgcttccatgcaacaaacaatacatgaaatgtttcagcagaggcaacaagattctccagcagcaagcaatccacctagaggtgagagatccaggccctattcttgtggcactcgattggctaggttggactttccaagattcaatggtgaaggaataaaacaatggttgatccagtgtgaaactttttttcggtcgataatacacctgatgaattcaagatcccatggtggatttaatgaagctcaggcagacaagatctatcatagagtatcatga

SEQ ID NO: 4309 - DNA, 177 bp, Glycine max
  Peptide Sequence Number=SeqID_95994
atgttctgtttgttccagcatatcacaagtaaagtaattatattgcttaaaggtttttgtggcaagtcacttgcttctttccctcgaggaagtttctactctactggtgttggaggattgagatgctatgagaatccaaagaataagattactgcagtacctgccgaggaagagtaa

SEQ ID NO: 4310 - DNA, 561 bp, Glycine max
  Peptide Sequence Number=SeqID_95995
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatcaattctgccgacgttttgatggaagaagacgagcctgaatctgcaaagcttcttcgaagcgatccttccaaatggaaggatcaggatcactacgatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 4311 - DNA, 645 bp, Glycine max
  Peptide Sequence Number=SeqID_95996
atgaattcattgcctagcgcttttcatgcgtactccaccaatgagtctggagccgcgcgaattgattgcctagcgctattcgccaattctccattctccacttttatgcggagccccatgaattcattgcctagcgcttttcatgcatcctccaccaacgagtctggcggcccgcgaattgattaccaagcgttgttcgccagttcttcattctccacttttattcggagccccatgaatttattgcctagcgctgttcatgtgtcctccaccttcgagtctggagccccgcgaattcattgcctggcgaagttcgccaattctccattctccacttttattcggagccccatgaattcagtgcctagcgctgttcatgtgtcctccaccttcgagtctggagtcccgcgaattgattgcctagcgctgttcgccaattctccattctccacttttattaggagccccatgaattcattgcctagcgctattcatgtgtcctccaccttcgagtctggagccccgcgaattgattgtctggcgctattcgccaattctccattctcctcttttattcggagccccatgaatatattgcctagcgctattcatgcatcctccactaatgagtctggaggcccgtga

SEQ ID NO: 4312 - DNA, 252 bp, Glycine max
  Peptide Sequence Number=SeqID_95997
atgttgctaagtagcaacgttatccatatctgtgtaagagtggtcatgttggtgcgcatgatccgcactcgtctctttgcagtggcatgggtgaaatccttccccggtatgcatagtagctgcgtgatagcctccctctctggttgtgttcgcacagttggtgccctccaatatcagggggtggcccaggaactaataaaaggaaactactcgccctttaaccgagagtgcaagtcttggttaagaatttaa

SEQ ID NO: 4313 - DNA, 441 bp, Glycine max
  Peptide Sequence Number=SeqID_95998
atgcttgttctttcctcctccctaagtccagctcttaaaaggagtagttccatttgttgtctatattcttcaactcatactcccttgtctaagcctttggagcttgtccatatgctccctctcatagtaggagggaatgtgtctcttcctaagggcactcttaagatcattccaatactctactggaggatccccatgaatcctccgttccctaacaagggaagtccaccaatagagggcatacccttgaaagctaagggtagccaatggaaattttctctcttagctaatatgatggcaagcaaagagttgttcaaccttcatttcccaatctcaataggcctcaacattatcttttccatggaaatatgggaggctaatgttaacctcttgaggccttctatccttttctcttcttcgggagtgatgtttagtatgtga

SEQ ID NO: 4314 - DNA, 197 bp, Glycine max
  Peptide Sequence Number=SeqID_95999
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaccctgagagcatactgtcgggcccgaagatggtgactatgctgagcgggcgagcagaggaactctg

SEQ ID NO: 4315 - DNA, 171 bp, Glycine max
  Peptide Sequence Number=SeqID_96000
atggcaatgtcaaactgtgaaggtattccgattggtgtcaatcccaaaagaaaggtggtgtgggatcctataattagcaaatttcaggataggctgaacaggtggaagatgggtagggctaaccaaatcctgtctcggaagatgcttgggttgaggatgggattcccctga

SEQ ID NO: 4316 - DNA, 402 bp, Glycine max
  Peptide Sequence Number=SeqID_96001
atggggacgaggggttgcatcaattacaatctcgtcctcgctataagacaacttggttaccctatgagagggacgccatcagaggaaggcctcataccttttattacacgaagtttcaatagcaccaacgtaggggtgcttcagagggtccacaaggcatgggaaatgtcgcaaaggaaggacaaggaacttcgggggtgtagcaacgggcccatcggtggttaccataggtggttgaaagcctatgcacaagatctggattggctcccgagtttgaggaccacaaaggggatggagggtgaaactccgaaagaagatgaagaggtacaggccctcaagacagaacttgagaaagcccaaacagtcaaagaaaagttcaagtcaatagctgttaggatctga

SEQ ID NO: 4317 - DNA, 429 bp, Glycine max
  Peptide Sequence Number=SeqID_96002
atggctcgtgctagccatcagtggtcgtgggtggtggagaagaagatctcgcttagcgagcttgtctcgctaagcgagagtctacttttcgcggttagggtgacaattcacgttgagcgcaactcctcttgtgctaagcgcgaaaattcttgctcagcgcaattccttttcggggtgttacaactctcccacccttttagaaatttcatccccgaaatttacctgactcaaataaggctggataggctgctcgcatctgactctaattcccacgtggcatcttcttctgatgcacctccccagatcaccttgaccaatggaatttccttccctcttaggtgctttgtacgcttatcctcaatcctcaaaggcaatgtttcatatgtcaagttctccttcacttatacgtcatccaattcgatcacatga

SEQ ID NO: 4318 - DNA, 297 bp, Glycine max
  Peptide Sequence Number=SeqID_96003
atgaacctggaggtgcaagcggtgcacttagcgagtttgactctcgctcagcacacctgtacaggtcatcttcttccaggttcttctatgcgctcaaccaatcatgctgcgtccagcggatcatgcgctcagccagaagaggatggctcagcgaactgcaaaaatcacacttcaccaaacttgcttattttacctgaaattgaaatgggaagttttgcttgtcctcaagcaaataaagagcagctcactggtccccaagtgataaaacatgcagtgattgtgtacaaaggtgtgtaa

SEQ ID NO: 4319 - DNA, 559 bp, Glycine max
  Peptide Sequence Number=SeqID_96004
gcaatgggaagctgctgctattgctcaggatgttcatcacgtggatgacacaactaaagaggtcttccaacaacctcaagaagcagctgttgatgcccagggttttcttggcgagtcgcgtgacacatcagttctgactgcctatgttgatcatgttgtagtcattgtttggaatggagagggacttatatcggcttttacggagaggtggcataaggaaactagtagtttccatcttccagtaggagaggtcaccatcaccctcgatgatgtggcctcttttctgcatctgcccatcataggcaccttccatagcttcaagactcttcatgtcgacgaagcgatgttgatgttagttgaattacttgaagtcagtgcagatgaagccagagctgagacagtacagtgtcatggggcatattacgactatcatggctacgagacatttatcataacaaattgcaacacatgtgcatgtggtgctcttgggcagctttcgagacctcacccagagtggaatctacgcatggggagttgtcgccctagtgcatatgtatga

SEQ ID NO: 4320 - DNA, 381 bp, Glycine max
  Peptide Sequence Number=SeqID_96005
atgcctagacaatgttcaccagactacatggactggttttacatgatttcgcatccattcatgaggtcggcacagcccgaggatctagtcagacatccacctatcgtgcaagatgacacatatgtcgaaccagatatgcctcagtacccggtggcggcaatagctatggaggtagcacatgcgcatgcaccttctcatgtggagcagcctagacatgcaatggaggcttgccaagcaatagctgaaaggttggagcggttgctcaacttaaggatagtgactaaaggcacagaaacatacgatgtcatgcaagactgcctaaggatcgctagaggtgtgattgtggatcgcaatgtatatgtgcggtcgcgacgaaggtga

SEQ ID NO: 4321 - DNA, 176 bp, Glycine max
  Peptide Sequence Number=SeqID_96006
atggcttctacaagtggagatgctactccactatctccaaaaaacgcaaggagtagtgaagctttaagtgtgaggattgaaaatatagagcgaagaagagaggacaaatcatctaagtcttctcatggagaagatgaggggtatgaaaaagatgaggaaggaaggaggaatgagag

SEQ ID NO: 4322 - DNA, 258 bp, Glycine max
  Peptide Sequence Number=SeqID_96007
atggtgattttccaccatggagatgcagcggaagataaaggagaagaggtggctgaatctttgagcttcaatgaggtccttcaatggaaaagaggtgagaggaggcgccatccactagggaataagctatggaagaaggagctttgccaccaaaaatgtgccttggataagaagcttggagatgatgcttcaatggaggaaaagaaagagagaggggggagcacgagattgaaggaggaaaagggggagagaagttga

SEQ ID NO: 4323 - DNA, 327 bp, Glycine max
  Peptide Sequence Number=SeqID_96008
atgtgtgtggacgtggcaccggaaggttaccttcactttctcttctgtgataatcaaagtgcagttgctatagctcataatcctatccttcatggggaaagttctgaccaagcagctagttttgttcatcatattcctgctcttgatcagttgggcagatgctctcaccaagccactctctccaagcagattcatttacactcagtaagaattctgttaatggaagccaacgagggaggcatcctcatcgttaaaatttcccccgatggcgtggttgcactgccatgttcatctggcacgatggagctttccaagggagtgtgctaa

SEQ ID NO: 4324 - DNA, 828 bp, Glycine max
  Peptide Sequence Number=SeqID_96009
aacgctcacgagaggcacgccgagatgaagggtcaggaggagacaaacgacaacgtcaccatcccgacggaaacgacggccatccacagaccgccgggaatcgcaggccaaaaccaggcgacaaacgccaaccaaaccagtccgtcggaaatggcggaaaaccaccgagcgtcgggagacgaagcccacaaccaggcgccgagatctgctggacacgacgaccacctcgacccagcggacaaacacgctgaccgctgggtttgcgtgccagaccaaggaaaagataagcagactttggggacttgtacctcggatggaaggagagagaatatgcatgagaaaggaaagtgggaggcagagaggactgttggggtggtggggaagggtgctttatgttcagaaaagccacgtgaccaagaagctgaagatactagcagcccatcatcaagcaaggtgggccaaaataactattacagactgttttacagaaaacgtaggtgcagaaagcaaaatgctacctttccggaagatgctatgggccaacaagtaacaccaacaccacccaatatgcaggggagtgaacataggccacaaagggtccgtgaacaaaaggaccattacctctcatcacaacaatcagcacttgaggaagcacttctggtcaacaacaagatgcaagaggcagagaaattatgggagatgacaaaagaattaggggttacaggagggaacgttcagaggaataaattgcagcaaataataattgacatggaagatagagacatcaaagaggctgccagattgggaagcaagaaaaggaccccatga

SEQ ID NO: 4325 - DNA, 456 bp, Glycine max
  Peptide Sequence Number=SeqID_96010
atgaccctcaaaaagctattaccccagttatactatgctatgacaaccattaaacagcaacaaacaaaagcaaaacagtttcccataccagttcccaagttagattactctacgttatgtaatgcagatcttaccaatgccaatctagagggagccgtcctagaaggagctaatttgaagtatacacttcatacatactcctccatagactcctcagtcctcactgatgttgtctactatgtaataaattcttcccttatgtttgatatcacattgacctcttctaacaaaacattagggaaggttattatgccaagggagggtgcaaaactgaacaaagcaaacctgaagggtgcaaaccttcaacgagcttatctttgtcgtgtcaatcttcgagatacagaattggaaggtgcgaggctcgatggtgcaaatttgcacggagcaattagataa

SEQ ID NO: 4326 - DNA, 366 bp, Glycine max
  Peptide Sequence Number=SeqID_96011
atggctgaaagacctaccagcagctttggagccaacacagaaaataacctgaaagaagaatgcaaggcgttgtggactagaggcccgcagagaactgaagaagaccagtctgaggaaggaaaagcaaacaaagacggagaagaagagaagaaggaagaagaagaaggagagaagacggtcttaatccctaagaccaaaagccagttagcccgagaggctaggaaaaaagagccaccagtccctctaaaggagcccccatatcctttagtgccatcaaagaagggtaaggagcgctacttcaagcgtttcttggagatatttaaggggctggagataaccatgccatttggggaagccttacagtag

SEQ ID NO: 4327 - DNA, 120 bp, Glycine max
  Peptide Sequence Number=SeqID_96012
atggagaacggggaaaagagggaggtggttgccgcccagctcgcccaggcgagctgggttgcttccattagaaggcaccgccttctggtggaacatcctggaaggcccaagtgggcctga

SEQ ID NO: 4328 - DNA, 641 bp, Glycine max
  Peptide Sequence Number=SeqID_96013
atggttatcggttcaaggacgcaaggtgcccctgctttttcagggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggatgcggactacctgcacctgggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcacccattaaagcg

SEQ ID NO: 4329 - DNA, 396 bp, Glycine max
  Peptide Sequence Number=SeqID_96014
atgacttctcaacgtataaattcaggtagatacacaatattcaattccaaactaatagagcacatcttgcatgacactgatgacgaactcgatataacacagggagacattgttacaaattattcatttgacgatatagcaactgaggattttgctcataccgattatgatgacaatcttgaagctccatatgacaatgaaaataccggtttttacattcactgtgcaaattatgttgaattgtccttcattacctttgataatgtgcaagttacaaagatattggagatcctatttggcaatgcaagcaatgtaaagcgaagatgtggtatgatgagaggattaacaaagataaacagacaaaaaatccaaagttttcattatgttgtggtgatg

SEQ ID NO: 4330 - DNA, 339 bp, Glycine max
  Peptide Sequence Number=SeqID_96015
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgcagttcgctccaagctggactgtatgcacgaaccccccgttcagtccgaccgctgcgccttatccggaaactatcgtcttgagtccaacccggaaagacatgcaaaagcaccactgggcagcagccactggtaattga

SEQ ID NO: 4331 - DNA, 117 bp, Glycine max
  Peptide Sequence Number=SeqID_96016
atgttgcacttagcgccaccctcgcgcttagcacaagttagcggatttgagcttagcgccagtcatgcattgggcttggctaaaggcaaccatcgtgcttacttttcaaagatatga

SEQ ID NO: 4332 - DNA, 390 bp, Glycine max
  Peptide Sequence Number=SeqID_96017
atggtctctggtaatcgattaccaaggggtgtaatcgattaccaggctcaaaaacgaggtcaggaagctaagagggcttctggctgtgtaatcgattacacagaggaacatgccactggtaatcgattaccagttaggtgtaatcgattacacagtgcatttttgcagatcgtgatggcggcgcagctaatccatgatcgagtggagatggagtgcctagagggagcttgggagaccctcgaaggcaacacgaggtgccgatttcggggcacgattagatttacggctacttcattggtgcatccagatgaacccgcgtgcacacttcagcgtactgtggagtggatactacccacgcctacgccataccgtctagtggagccagtccaa

SEQ ID NO: 4333 - DNA, 114 bp, Glycine max
  Peptide Sequence Number=SeqID_96018
atgtgtgtatatgatctttgggtagcaggaatacttcaagaaatggcttcgaaaaagctttctacgaagaggtctagaatagctaaaaaacaacatgcttgtgaaaggagataa

SEQ ID NO: 4334 - DNA, 252 bp, Glycine max
  Peptide Sequence Number=SeqID_96019
atggctctagaggaggagaagtctacagaccagatcccagagccatccccagcacccatacctaatgatgccataccatctgcaccagcatctgatttttatatttcagttcttttaaatttcagcacttttagttgtttgctgccattagaagagaatgagcatgttattggaagtatgactgaaaatgttagtcagtttgtcagattgattgtgaaggaatgcattaaccgcatcccggtgagagtgtga

SEQ ID NO: 4335 - DNA, 895 bp, Glycine max
  Peptide Sequence Number=SeqID_96020
cctcaccttcagaggactacacgtcctcgccatcagagggctacacgccatcagctttagaggactacgcgtcgtcaccatcaaagggctgcatgccctgaccctcagaggactacacgtcctcgccatcagagggttgcacgccttcacctttagaggactacacttgttcgccatcagaggactgcacgtcctcacgttcagaggactacacatcctcgcattcagagaactggacgtcatcaccttaaaagtgttgcatgtcctcgccttcagaggagtacacgttctcgccatcagagggatgcacgccgtcaccttcagaggtctacacgtcctcgccatcagagggctgcacaccctcaccttcagaacactacacgtcgtcacctttagagggctacacgccctcatcttcggagggctacatgccctcaccttcagaggactacacgtcctcgccttcaggggactacacgtcctcgcctttagtggacgacacgtcctcgccttcagaggactacacatcctcaccatcagacggctatacgtcctcgccatcagaggactacacgtcctcgccattagagggtcgcacgccctcaccttcggaggattacacgttctcgacatcagtgggctacacgccctcaccttcagagttctacacgtcctcaccattagaggaccgcacgtcatcgcggactacacgccctcatcttcggagggctacacgccctcgactttagaggtacaacacgtcctcgcctttagaggactacacgtcctcgcctttagaggactacacgtcctcgtctttagaggactacatgtccttgccatcaaagggttatacgccctcgccatcagagactacatgtcctcgccatcatag

SEQ ID NO: 4336 - DNA, 363 bp, Glycine max
  Peptide Sequence Number=SeqID_96021
atggtgaaaagttggaacctcttacgtgccgatcaacgtctcattttcgccaaaaagttggcccagggctttcccggtatcaacagggacaccaggatttatttatttttgcgaagtgatcttccgtcaccaggtattttattcggcgccaaagtgcgtcggggtgatgctgcccaacttactgatttagtgtatgatggtgtttttgaggtgctccagtggcttctgttttctatcagctgtccctcctgttcagctactgacgggggtggttgcgtaaacggcaaaaagcacccgccggacatcagcgctggcaagtgtagcggtcccgctgcgcgtaaccaccacacccgccgcgcttaa

SEQ ID NO: 4337 - DNA, 333 bp, Glycine max
  Peptide Sequence Number=SeqID_96022
atgggttctccacctgcctccactcctcctcctcctcctcctcctcctcctcctccttcagacgcatcggcttcgccgtctgccgtgaagcggacacgcaaagcctcacgtctacgatcgttgtccactagaccacctggtgctgagagaataatggtgcatgttgatcctgctaccgggaaggccgacggtccccacaggaagaaattaagaacatatttgggattgtggcgcgtgataaggtggacgtcactgatcgaggccgtacccgaatcaaaagccattctcttatcctgggttatggagaattcgtccctaacagtcaaccactaa

SEQ ID NO: 4338 - DNA, 489 bp, Glycine max
  Peptide Sequence Number=SeqID_96023
atggccgacggtgagctcgacgcgttgatgtggtcgttcgcgccccggggctcggcctcgcccggcatccttcgccgacgttcccggccgtcaccgcaagtcgacggccctgagcaaggagttgcgtcgcgagtcccttcgtcggccgaccaccatgtacgcccgctgatgcagtccgccggcatggtcgacatcaatcgtcggtgtgctggcgggcctgaccgcgggcacgatcgggcttcgcgcccggcgccgcagcaatggggaaatctgcccatcgagcactgtatctccgggacacggttaggatgtacgcggtgctccgtgggccgtcgggccctgtgtgggagcgaactgagagtgtcaccctgggggggaaccgggcatgaaggcgttgtcatggatgcgcgcgcgaccgaagacgttggcgtccgccgccggcgtcaccgtcggcgtcatcgccatcaccacgatggccttcacgtatga

SEQ ID NO: 4339 - DNA, 288 bp, Glycine max
  Peptide Sequence Number=SeqID_96024
atgaaaacttctaccattacacactacaccagcattgccaggaccctagtccttacccttggcctactcccgagcagtttagagccactattgcatggcctagaggcaagcctattttttaggaggaggcaagacctgcagatgctcggggtgctgcccaaggagatggaggaagagctgaggatgatgaagacatggtggatttggttcattatttcattggaggagactgagctcctcaaccaggatcttcaaaaattcgtgaacttgtctttacctagtcaataa

SEQ ID NO: 4340 - DNA, 204 bp, Glycine max
  Peptide Sequence Number=SeqID_96025
atggttccaaaaacttgtacacagtccgacaagtgtaccggatcgcacaacacgacaactcaccctgcactatcaaggactttagagtcagaccagtttccactgttgaataaccctaacaaagcatgcatctacatgatgaaggtacctacagggaagatcccaacagaggatttagctttccataccaggaagccttcttaa

SEQ ID NO: 4341 - DNA, 387 bp, Glycine max
  Peptide Sequence Number=SeqID_96026
atggctaagtttgaccctgaggatggagtgcgggacatgcgttcatgggtgaggggtcagtggattccttttgacgcagatgccctcagccaattcctgggtgacccgctagtgttggaggaaggccaggagtgcgagttcagtcaaaggaggaatagggctaacgggttcgacgaggaggccattgcccagctattgtgcacaccggggcaggatttcgcccggaccgctgtcgggagacgggtgcggatcatgcgcaccagcatgaccaccttgacccagatgtggatgacgttgctgcttagtaatgtcttgcctagtgatcataactccgatctccctctgccgaagtgtcagctggtatgccacccactaggcaccctctag

SEQ ID NO: 4342 - DNA, 516 bp, Glycine max
  Peptide Sequence Number=SeqID_96027
atggtttataatagcaatgacacagctcaaaatgttaacattcaaaatgacgaacttaaagaatatctagactgcagatacatttctccctgtgaagctgcttggagaatatttgcttttccgatccacgggagaaagcctgctgttgagagattgcattttcatcttccaggtgtcatgagcaaacctgaagaagtttggaaccaatgttggcatttgctggctgatgacattgcatatcgacatagcagatcaacaatgaacccagaattgcatatcaatgacgatactcttagaaatttgacattgattgaaattgaacaactattgcacataaatcaaagatcactgaaagactatcctacaatgccatatcctcagggtatcaatctgacatcctacctagagaacaacttgatattatcagagcttgattacaacgatgatgcaaccagatcagaatttgagcatctttttgcatccatggcagacaatctacctattcatatattataa

SEQ ID NO: 4343 - DNA, 601 bp, Glycine max
  Peptide Sequence Number=SeqID_96028
ggctacacgccctcaccttgggtactagttaccctcaccgttgagaggactacacgtcctcgccttgagaggactacacgtcctcaccatcagagggctgcacgccctcaccatcagaggactgcatgtcctcgccttgagagggctacacgccctcaccttggaggactacacgtcctcaccatcagagggctgcacgccctcacctctagaggactacatgtcctcgccttgagagggctacacaccctcaccttgggtactagttaccctcgccttgagaggactacacgtcctcgccaacagagggctgcacgccctcacctccagaggactacatgtcctcgccttgagagggctacacgccctcaccttggaggactacacgtcctcgccttgagaggactacacgtcctcgccttgagaggactacacgtcctcaccatcagagggctgcacgccctcacctccagaggactacatgtcctcgccttgagagggctacacaccctcaccttgggtactagttaccctcgccttgagaggactacacgtcctcgccaacagagggctgcacgccctcacctccagaggactacat

SEQ ID NO: 4344 - DNA, 102 bp, Glycine max
  Peptide Sequence Number=SeqID_96029
atggcccagtctaactcttctagacttgggttccttgctcttatcaccgctttatgcttccttgtatggaaagctaaatcctctgttggatcttccctgtag

SEQ ID NO: 4345 - DNA, 643 bp, Glycine max
  Peptide Sequence Number=SeqID_96030
gtgctccagtggcttctgtttctatcagctgtccctcccgttcagctactgacgggggtgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatattacaggtctagagcagtgtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 4346 - DNA, 549 bp, Glycine max
  Peptide Sequence Number=SeqID_96031
atgtacaatcatcacgagaaaggaagaactcctgatcttgaaagtgtattggcagacttcatgacatatcaaactagctctaaagaatggcaaccttgttatcagaatgaagcagaaggattgtctaatctggatgacttgttaatgcaattcaagggtacaatagattcaatgcaacaagcatttaaaagagctgagactcagattggtaagttggtggatgacatgactaaggttgtggtcagaagagaagaagagtatgcaaagattgaaacacatcatgaaagtattcttcaagttaacacaatccatcatcaattgatcaccaaagaagaaaaggatgaagtctccattattccagaatattcctgcatggcaactactggctatgttgtaggcaaagataaagaacttgatcatgtgacagactacctagcttgtgataaagagcttgatgatccaaaagataactctgttggtcatgtggagaatgagactaaacccgttataattagcagctccttgcagaagaaagaagatgatcaactg

SEQ ID NO: 4347 - DNA, 324 bp, Glycine max
  Peptide Sequence Number=SeqID_96032
atgggtgccaagtacctcgaagtagtcaaacgagggtcacatcccaaccacggatggtcctcggacgaaattagggcgcataatgaccataatttgcctctgcgtgttgttggacacgatcgagcctgggtggcaaggcgcagattgaccataatttgtctctgcgtgccaccggacacgatcgcctctggatggcgaaaaggtgtgcggaatgaccataatttgtttccgcccacctatcgacttactgtccccgaaagacaaagggcgcagaatgaccataatttgtctctacgcgtttatcacttgacttgcgaaatctga

SEQ ID NO: 4348 - DNA, 387 bp, Glycine max
  Peptide Sequence Number=SeqID_96033
atgaaggaaggaataggtcacatcttagacctcactcccataggagagaaaaggaaagaaagcctcaagaggctaacattaacctcccatactttcatgggaagaacaataccaaggtcaagcatcttaggggtgacgccttctaagcccaaagatgataaggggaagacaatagaaaaacaaccccttaaggctagtatgcaagagaagactagctccatgaagtgctttaaatgtcttggaagaggacacattaaatctcaatgccctaccaagaaaatcatgattatgaggggccaagacatttatagtagccaagatgaggctactacttcaccttcctctagtgaaagtgaagaagtaaaaggggaagaatttagtgaataa

SEQ ID NO: 4349 - DNA, 192 bp, Glycine max
  Peptide Sequence Number=SeqID_96034
atggcaggagctggtgacaatggtggtgtatatcatcaactggacggatttcatcgcttattactggacgcgatgactacacaagtgcaacatttgttgaaacgtaacaatgaagagctctacaggcgaatagaaggactagagcaccaaatgaatccaaatgttgggagaccttatgatggcaacagaagg

SEQ ID NO: 4350 - DNA, 282 bp, Glycine max
  Peptide Sequence Number=SeqID_96035
atggcaaagggcgcagaattcgtctatgcacgtttaccactcgactcgctgctcctgaatgataaagggcacaaaatctgtccctgcgcgtttgtcgcaacctacccttcggtgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacacacggggaaggtgttag

SEQ ID NO: 4351 - DNA, 315 bp, Glycine max
  Peptide Sequence Number=SeqID_96036
atgtcatgctctcgtccgtcgtcatcacgttggaccagccttaatgaggaattggagcaatttcttgcgactgtgcccaagcacggagaatggagggaaatggcaaacatgatgcagaatgtcgcggttccaccaaatactattttccagaccgttcacgccagggaccaaattttcggtgaagttagtaaggtatatgctctcaggtggaaggacgtacttgacggcatatggcatttggttgacaaggacggaaattatcataatgttgtctacaataaagatttggaccaaccagccattgtagtagggtga

SEQ ID NO: 4352 - DNA, 471 bp, Glycine max
  Peptide Sequence Number=SeqID_96037
atggcttctatgatggaggccatgctgggaatgaaacgactaagggagagtaacgcggccaccgttgccaccgctagcacgactgccgaggatgagggagaagcacaccggggcatgtcagcaacccctatccggggtaaaaccgaggtgcttacccctacgatttaccacccaactacacaccaccagccatgcatgaagacgtgggtcacgttactcccttcatcctcgaaggggagcctcctcggcatcctgacggggtccacgagaatcctcgagagcgcgctcagggagacatcaactcttactccctgtttccctctgagggtccagtgcccaatgcactacctcaaccaaacatcacgggagagcctcgaaacaacccaacgcagccaatgtttctatccgtgggagggccgccctcggcagcggaaggaaaggaaaaactcgatctcatcgaagagagattga

SEQ ID NO: 4353 - DNA, 309 bp, Glycine max
  Peptide Sequence Number=SeqID_96038
atgacacaagtgaatgaaaaacaaactcctttacacagtgttaacattaatattgcaagccaatttgaagggagtgctaaattgcagaatacagttggtgatgttaaaactgtaaagtgcattagatgcatgtttctcgctccgggatactacttgtttgtgtggatgcgaaatctaccggcaagtgcaccaggtcgtcaagtttgttcaataagcaggcatttgcaaatagaaatcatgattgtgaatgaaagtaaaaatatgttctattctaattacaaagcaataaacgtgagcaaactcaagtaa

SEQ ID NO: 4354 - DNA, 909 bp, Glycine max
  Peptide Sequence Number=SeqID_96039
aggactacacgtcctcgccatcacaggacttcatgtcctcaccttcagagggttgcacgccctcaccttcagaggactgcacgtcctcaccttcagaggattgcacgtcctcaccttcagagagctgcacgccctcgcctttagagggctacacaggactacacgtcctcgccttcagaggattgcacgtcctcaccttcagaggactacacgtcctcagcttcagagggctacacgtcctcgccatcagagggctgcctgccctcaccatcagaagactgcacaacctcaccttttgaggatagcacgtcctcaccttcagagggttgcacaccctcaacttcagagagctgcacgtcgtcgccttcagaaggactacatgtcctgcactttagaggtctacacgccctcacctttagagggctgcccgccctcaccttcagaggactacccgccctcgccttcaaagggcgacatgtcctcaacattagtgggctacacgccctacccattagagcactacacgtcctcggcacatcagagcactagaggactacacgtcctcaccttaagaggattgctacatgtcctcaactttagagggctacacgccctagcctttagagggctacacgttgtcatctccagaagggctgcatgcccttacgccttcagaggactgcacctccaaagggctgcatgccctcgccttagaggactacacgtcctcaccttcagaggattgcacgccctcgccttcgaagggactacacgtcctcgccacagaggactacatgtcctcgccttcagaggacttcacgtcctcaccttcagagggctacacgccttcgccttcgtaggacttcatgtcctaaactttacagggctgcacaccctcacctttcagag

SEQ ID NO: 4355 - DNA, 255 bp, Glycine max
  Peptide Sequence Number=SeqID_96040
atgatggcacatcaagctactaccactcctgagaaatcccttgaggctacttcagagccttctgcaccagtggtaaacttaccctcacctcaacctgcagcagacccctccactcctcttctacaaatgctaaaggacccaactacaccactcctagttgtggacacttctcctcccactactccagtgtttcagctgacagatgaggaggatggtcaaacacaggacacacaggaccaatcacaggaattttga

SEQ ID NO: 4356 - DNA, 273 bp, Glycine max
  Peptide Sequence Number=SeqID_96041
atggtcgtcattttgcctaaggaaaatgttgtcatcgggttttgttcattgcacaataagccatacaactacctaaaagaaattattaacagtgctttgaaaggatttgacgaaactccacaaagtaaatccaaggttgctgctaggtggattgttgttaaagcaagtcatttaaacaattatttcaatgatgctagaccattggaaccagagagattgaaggcacttcgcatccactggacaaactactatttgaaagttaatttggagtaa

SEQ ID NO: 4357 - DNA, 237 bp, Glycine max
  Peptide Sequence Number=SeqID_96042
gttgttagaaattgcagacactaaaccatacacttgtgagcagaggaaaacaccagccttatgcggaaaggaccactggaagaaggaggaactaaggccattgatagcgttgaaacactcagaacttgcgctaagcgtgcagctaactgcaggcgctgagcgtggcgttaagcacgaagcgcgcgatctgaacgcgctaagcgctaggtgtggcgctgagcgcgactacgaaggccc

SEQ ID NO: 4358 - DNA, 69 bp, Glycine max
  Peptide Sequence Number=SeqID_96043
acgataaaaagagagaagagagtaagaattctcaggctttaggtagtaatgagagtgctcttagacttg

SEQ ID NO: 4359 - DNA, 123 bp, Glycine max
  Peptide Sequence Number=SeqID_96044
atgaaacagggacaggcaaatattctcatagctaggttccctgaccctaactatggtgtcaaaacgaggtctctcttgttcacgctcgttcgtccaaacgcaagtctctacatgccaaaatga

SEQ ID NO: 4360 - DNA, 460 bp, Glycine max
  Peptide Sequence Number=SeqID_96045
gctgccgtcccttgggacggacgtgtggggtgctaataccttccccgtgcataaatacaactcccgaacctttcacttaaaagttcgtagatcgcgtcttttccggtttttccgacgttttcctcaaataaacgttggtggcgactccgcgcgtattcctttcgtggaacacgcatcccgcgagtctcgcgtcgccctcccgccgaagggtaggttgcgacagttggcgactccactagggaaggagagtatgttgatgaaaccccccataaccataaatgagattttggatgttagcatttcgtttctaaatgaccatttagaggaaacactgggttcgacaaaaatagaagaaatccactcaaagtgtatcaaactcgcacagggtaaggtttatggtgagtcaggattttggctcaaggcttgtagaatggctagacctgatacatatcagggtttg

SEQ ID NO: 4361 - DNA, 550 bp, Glycine max
  Peptide Sequence Number=SeqID_96046
atggcttcccgtaagagaaaaaccacaactttagtgtctcaggccggttatgatagatcacgatttgtatcacaggaggcctgggaccgttactccgataatgagcttgccagaaacattctgccagaaagaaatgaattttatcaaaatctatatgtcctagatgacaaatttcctaagaaagttagggttcgagggcacctgataaaatttgatgttgattccctcaacacctttttggagattccagtggttatggagcaaggggagagcttgccctcttactccaagtttgttagattgaggcctgatcctcaggggcttgtagcccgactgtgtatccctgggaggggatttgttcttaatgtcaagggtctgccgtggaagctcttgaggaaagatcttaccactctggcccaaacctggagtgttctatctcattctaacttggccccgacatcccatacttttgatcttaatctggatagggccaagttagtgtacgggcttgtaatgaagatgaacatgaacttaggttcacttatttctg

SEQ ID NO: 4362 - DNA, 246 bp, Glycine max
  Peptide Sequence Number=SeqID_96047
atggaagcaaaagcgcaaaaatggtggcctaggggcaaaaatctgcaaaacccatgggtgctgcgtttttttaatgagggaggggagttttgggtggagagaaactccccctcccctcgtttttatgtttccaggatactaggctacctcccagctgcgcttcccgcttgtccagagctgggcatgggacgacgatccatcgatcatgggcctagcctctactcgcgtccgtccctaagtacctga

SEQ ID NO: 4363 - DNA, 480 bp, Glycine max
  Peptide Sequence Number=SeqID_96048
atctcccacaagcaatttagttcctctggacttaaaaattgaagctacattgagaaggaatagggccgagaggagaaggaaacttctgcaagacagaacagtcgcatccattcttgaggaagaaactcatttttctgattcattatcacctgattcaccatcatcaagggaatccgctactcaattgcctgaagccgctatcatggcagacgagcaacaccagaggatcacccttgaggattattcaagcagctcagtgccacaattctttactagcattgcacgtcctgaagtgaaagctcacaacatcaactacccgagcatcactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaag

SEQ ID NO: 4364 - DNA, 477 bp, Glycine max
  Peptide Sequence Number=SeqID_96049
atgtccaagcaacttgaagctttaactgaaacactaagttgcacactttgtggtggagctcataggtcaggcttgtgtattcccattgaagaaacatctcatgaagtggattttctagattgcaacatggccaaccttactaggaacataatcaatggagaactcaccctggtgccattgactaatcataagagcacaaagtcagccataaaaaatctaaaggtccaggtagggcagctagccaaacaacttgcagaaaaatcttctagtacttttggagctaacactgagcagaatccaaaagaagaatgcaaggttgtgatgatccgaggaaggaaggtagccatggaggaggagaaaaagatgcagaaaatggtggaggatgacaaacaacaactggtaattgaaccaacacttgaaccagtgcaacccttttgtgaacttatagaggaagaagaagaaggggatgatgaatag

SEQ ID NO: 4365 - DNA, 213 bp, Glycine max
  Peptide Sequence Number=SeqID_96050
atgggatcatcgacggtgttgtcataccctaatttcgtccgggaacctttgctcgatgacgtgcgaccattctttgcacccaggcccatttgggccctccagaaggttcctccagaaggcggttgcttctggaggaagcaaccctgctcgcctgggcgagctgagctcgcctgggcgagctgggcggcaagcatctcccctattttgctataa

SEQ ID NO: 4366 - DNA, 567 bp, Glycine max
  Peptide Sequence Number=SeqID_96051
atggctccaaagaaattcacctctaagagagttaggaagaccactacaggagaaggatcttgcacagctacacctgtagaatttgaagttgatggacaccgctttcgtagtgaggaacatcaatgccactttgaagtgatcaaagattggtctttcctcaaggaaagaagggtccaattagctaaggatgagtatattgaattcaaaacagagattgctaggaggcactggacacagcttgtagagcctatgcctaaatatgaccctgaagttgtcatggaattttatgcaaatgtttggcctactgaggaaggtgttattgataagcactccaaagtgcagggccaatggattccttttgacacatatgccatcaaccaatttttagggaatccattgatctcagaagaggggcaacaatgtgaatacactacaagaagaagtcaaactacgggttttgatgaagaggctatagatgctatccatcagtttgttggtactgaacctcctaggcacccagtgaaccaccacgagccgccaccgcttgtcgttagaccactgcaatga

SEQ ID NO: 4367 - DNA, 587 bp, Glycine max
  Peptide Sequence Number=SeqID_96052
ggtacatccacttggttgttcaaagagaaccaggaagggtacatcccttgtggatatttgcttgtaaaggattttacaaggttgaaaagaaaactcaaggaccgcagatcgcttgggaactggatgtaggcacagagcttccatgggaagctaccatggggagtgatgctgacttgggtgcggaactaggtggcttgggtgtggggcatggaatcataggcgacataggaaggggaggaggaacgtcggagtgtgcggtcgatagaggagctgacgacagcggcgccggtggctgcaccgacaaaggaaacgaaaaacgttggcggaatatcatggtatgcagttgttggctaatgagatcgagtttgaagagcatggaggcgtggaacaagtcaagatggaggttggcttgggctgcggcgaggttggccatgacggcttcgaggcgatccaggttggcggcggaagctgcggcatctgtcattgaagagcggagaggaggacaggcatcagataatggtgttctaccatataagatatccccccctgctcaaaacatcctccgctgggcaaaaaagaagaggtga

SEQ ID NO: 4368 - DNA, 875 bp, Glycine max
  Peptide Sequence Number=SeqID_96053
acaaagttttaggaaaagccttagggagacaggttagtggtgattcagaagaagcccctcaacgtcgaagcccgacaacatctacatgtagacaatgggcagctgcagttgttgaccatgtggattatgctgctgacgagttggcctctcatgggaggaaagtggagaaatttggaaggcctgcacttaaggttgaaggcatattggctgctacaggattaagagaggtgactataaccctcgatgatgtggcatccttgttacatctgcccattataggtgtcttccataccttcgacgctcttgatgtagaccaagtcgtagagttgttagttaagttgattgaagttgctacacaagaagcaaaagatgagagttgtacaatctttgctaacaagagtgtcacacacatcaatatggtattcttggatgcatttcacgacctcagccaatctggaagctattcatggggagtggctgcactagtccatatgtatgacaatctgaatgacgcgtcaaagcatatgacaaaacatcttgcaggatatatcactttgtttcagtgttggatatacaagcatttccctacaattgcttccattgttgctgatgaggattaccatgagaggaaaccatgtacttgtcgatggaagtttgggaaggcattaccagtgtcaacgtatcgtaagcacttagatagattgacgccagatgttgtgtgttggattccttacgtccaacatagcttagggagcctcctagacatggagcatgatgatacatttattataccagatcctcttctgcagcttgtccacgttgtagctatgccagaaccacatgcacctacagctgctgatgcagacatgccttga

SEQ ID NO: 4369 - DNA, 265 bp, Glycine max
  Peptide Sequence Number=SeqID_96054
aggactacacgtcctcgccatcagaggactacacgtcctcgccttcagaggacaacacgtcctcaccttcgccttcgtagggctagacgccctcacttttagaggactacacgtcctcactttcagagggcggcacaccccccgccttcaaagggctacacgccctcaccttcagaggactgcacgtccttcagagggctgcacgctctcgcctttagagggctacacgtcctcactttcagttggctctatatccacaccttaa

SEQ ID NO: 4370 - DNA, 413 bp, Glycine max
  Peptide Sequence Number=SeqID_96055
atggtcattgaccaatccctcttctatgatttgacccaattgcctagtgaaggtgtaccatttgaaggtacactggatgatgattggaaatttgatttttctgtgcatgatgcccgccggttggtttgcaccaaccaagcggatatgaccggaaggctgcttgccgattcattggctcttgaaagccacatccttcactatcttattgttcgtatcttactctcaagatcttcaaaccttgcacaggtttctgaagaagatcttatagtcatatctttcttgatcggtgctgctgtggttgcgtcctttggttaccgcaaagagcgtgatggctcttgggtaaaaaagggtactcaacctaatgatgatgaaggacaattaccggttgaaggcgactcttctctgcttcaaga

SEQ ID NO: 4371 - DNA, 86 bp, Glycine max
  Peptide Sequence Number=SeqID_96056
ctttatctgaagaactcactaagtgcacttactgcgccaagcgagttcatcctttgtcgggatcaattctcagtgcatttcgatag

SEQ ID NO: 4372 - DNA, 396 bp, Glycine max
  Peptide Sequence Number=SeqID_96057
atggtggtgacggttaaaaagctcgtagttggaccttgggttgggtcgatcggtccggctccggtgtgcacccggtcggctcgtcccttctgccggcgatgcgctcctgtccttaaactggccgggtcgtgcctccgacgaacaactgcgaaagcatttgccaaggatgttttcattaatcaagaacgaaagttgggggctcgaagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 4373 - DNA, 789 bp, Glycine max
  Peptide Sequence Number=SeqID_96058
gacaggacaacaccaccaattctagaggaacctcaatcatctgagtcatcttccatctttccacaaccaagggaacctgaattaggtgcatctgaggctaacataatggctgcatatcaacctaggagagtgacccttgaagactattctagttctgttgtgccgcaattcttcaccagtatagcacggccagagggcaatttgtttcatgacctaccgaatgaagacttgtatgcacacctagcgacttacattgaaatctacaatacagtcaagattgcagggaacaatcttaagacttgggatgaagtggtagaaaaatttctgaagaagtattttcccgagtctaagattacagaaggaaaggcagccatctcctcatttcaccaattcccagacgaatctttgaggggaaagattaaattgaagaccccagaagaagccatggaactcattgaaaatatggctgcaagtgatcatgcaatcttgcatgatcggacgcacattcccaccaaaagaagcctaatggagctctcatctcaggatgcattattggcacaaaacaacatatgtgggggagcctatgagtctgaatgttgtattcccatagatgacacagctcaagagcatggttcaaattataaccaacatcaagggcaatggaggtcccatccaggaaatcaattcaacaaggaccagggcggaccatctaataggcctaagcaacaagggcctagcctatacgacagaaccactaagctggaggagacacttgctcagtttatgcag

SEQ ID NO: 4374 - DNA, 285 bp, Glycine max
  Peptide Sequence Number=SeqID_96059
atgagcgcgtgtgcaatttttggtaccccgaaatgctttgagtatgcatgtatgaaatggccccgaggaagcttgcctcaaagaggtccaggaaggacaaggcagccgaaggaactagttccgctccggagtatgatagtcaccgctttaggagtgctgtacaccagcaacgcttcgaggccatcaagggatggtcgtttctccgggagcgacgcgtccagcttcagggacgatgagtatactgatttccaggaggaaatagggcgccggcggtgggcatcactg

SEQ ID NO: 4375 - DNA, 516 bp, Glycine max
  Peptide Sequence Number=SeqID_96060
atgtcaatccttaccctcggaagcaaaaaagaagagaaggaaaatttccaatcaaaggaaaaaaggaagcaaggaaattcccaatcaaagagtgggagaaaggaaaaagaaaagaaagaaaattcccaaccaaagaatgggagaaatggagaaaacactgagactttttcaagtctcacaagttatccagaactacgtaggtctgagttcctcattggaggatacgtaggagcaagagcctcgcttttgtcgaccacaccgccttttgttgccatgacccaagagctggtagcccgcggagacaccttacggttatccgcacctcgtcattcagtcaccccaagtgtgattgacgagcagaggccaatatggtcatctgcgccctttctggagatgtcagcattttccgatggagacttttcaagtctcacaaattatctagaactacgtaggtctgagttcctcattggaggatacgtaggagcaagagctttgcttttgtcggccgccccataa

SEQ ID NO: 4376 - DNA, 357 bp, Glycine max
  Peptide Sequence Number=SeqID_96061
atgactgcagtgatgagtattctctttggttccatatctctcacttatgtagcaccaggcatgcaaaaatttaatcaggcaaaagctgcaggatacgaagtttttcaagtgattcaaagaaagcctctaataggtgacattcaattacaagaagtttactttttctacccatcatggctagagaaagcaattcttcaaggattgtccttgtcaattctagcaggaaagacaatagcactagttggtagcagtggctacgaaaagagcactgttatttccctggtagagcatgtgagtaagggaggaccattaatggctagacctattgccataggcaagctgaagagcagggtgtga

SEQ ID NO: 4377 - DNA, 207 bp, Glycine max
  Peptide Sequence Number=SeqID_96062
atgaagaagcatgataaaggcaaaggatcattaaagaacaatccagaagaaggacatttccaaaaggattgcctaaagtgtaagtcttggttcgaaaagaatggtgagcttaatgctcatagattccttacaatccaaaccataagcccaaatgagaagttcatttttcatggggaatggagtgaaagctccagtggaaacagttga

SEQ ID NO: 4378 - DNA, 769 bp, Glycine max
  Peptide Sequence Number=SeqID_96063
agggctacacgccctcaccttcataaggctacacgccctcacctttagaggactatgtgtcctcgccttcgtagggttacatgccctcaccattagaggactacacgtcctcaccttcagaggactacacgtcctcaccttgagggagctacaggtcctcgccttcaaaggactacatgtcctcaccttcattgggctacacgccctcacctttagaggactagacatcatcaccttcataggactagacgtcctcgccttcaaagggctgcacgccctcgccgttagagggctgcacgtcctccccttcagagggttacacgccctcgccttcatagggctacacgccctcacctttagaggactatgtgtcctcgccttcgtcctcaccttcaaaggactacatgtcctcaccttcagagggctacacgtcattaccttcaaaggactacatgccctcgccttcagaggactacacgtccttaccttcggaggactacacgtcctcgccttcagaaaactacacctcctccacttcagaggactacacgtcctcgctttcagagggctacacgctcttgccttcagtgggctccatatccacaccttaatagaatttaaggtcctctgcccggcgccaactgtgcgaatacaaccagagagagaggctatcacgcagctactatgcataccagggcaagatttcacccgtgccactgcaaagagacgagtgcggatcatgcgcaccaacatgaccactcttacatag

SEQ ID NO: 4379 - DNA, 375 bp, Glycine max
  Peptide Sequence Number=SeqID_96064
atgaagttaggcataagacagtgtcgcaacctacccttcggcgggagggcgatgcgagggctcacgggtgcatcttccaaggaaggaaaatgcgcggagtcgccaccaacgtttattcaaggaaaatgtcggaaaaaccgaaaaaggcgtggtctacgaactttaagtgtgaaatgttcgagagttgtatttacacacggggaagatatattttcactgaacaaatgtcgtttaaggaattggaccattaaaagattttttgtttttgaaaggagagaaatgttaaggcgttggaccattaacgatctcttggagtggtcgacaaaagcggtaaagttacatgttgattttatgcttttgaacggtccatgttaa

SEQ ID NO: 4380 - DNA, 222 bp, Glycine max
  Peptide Sequence Number=SeqID_96065
atgaaaggcgcgatgatttcctccgacggtgcacctctcatagggattataattaatacaacccctcgtcccatcaaagggacatttgggaatccttcacatgagcattacactcctgccaatccttctttccaccatggaaaccaactaatggacactcccatcatgccagccaagagttcttcccaatttgctttgcccttttcggagcacatgcgatga

SEQ ID NO: 4381 - DNA, 396 bp, Glycine max
  Peptide Sequence Number=SeqID_96066
atggattcccctggcacctctcttccacagcttggcacgtttaaagaaggtgcctacactataatgagggacaaaagagagatgctttctatcagtcaaaagcagataccgcccccccctcatgctcccacggtccgcttaccgaggaatagaaagggaggaccgggggccagagcaagttgggttgggcgcgtttggatccgcgaaggcaatcgctcggatgttcccctaacccaacccgggaacggaccggagggaaccgcagcatggggaatgtccgcgtctcgtcgcaaggctcatttttcgtttttggtcatagggcgggcggatttatctgatcagggccggggcacaagggtcctggtactatccaggtgcgaagaaccccggaggtga

SEQ ID NO: 4382 - DNA, 180 bp, Glycine max
  Peptide Sequence Number=SeqID_96067
atggagtgcccatccccccaacaaggtcatgccatcgtgacatacgggccacgcccgcaagacaccaagtggacacgaagtagtccaacagggtcctggggtttccaactctcattacaggcctctatcaattctacggagtgcccgtcgcccccagcaaggtcatcaggccccctatga

SEQ ID NO: 4383 - DNA, 279 bp, Glycine max
  Peptide Sequence Number=SeqID_96068
ccgaggaagcttgcctcaaagagatctaggaagaacgccgcggccgcagggactagtgccgctcccgagttcgatagccatcgtttcaggagcgctgagcaccagcagcatttcaaagccatcaagggatggtccttccaccaagagagacgtgtccagctcagggacgacgagtacacagattctcgagttttacgccaatgcttggcctacagaggagggcgtacgggacctccggtcatggaagtaggaatagtgggggcaagatatgcgggttag

SEQ ID NO: 4384 - DNA, 842 bp, Glycine max
  Peptide Sequence Number=SeqID_96069
gtcagctggtgcttcgcaaagatgagttttttgcctccccctcgcaggcggtggcggtggctgaccgttacccgcaaaacgtcttcgccgagcatacccatgaattttgcgagctggtgctggtgtggcgcggcaacggtctgcatatcctcaacgatcgcccgtggcggattacccgcggcgatctcttttatattcgcgcggaagataaacactcttatgcgtcggtcaacgacctggtgctgcagaatattatttattgcccggatcggctgcggctcaattttgactgggcggcgcatattccgggattattcggcacgccgtggcagccgcactggcggatcggcagcagcgggatggcgcaggtcaggcaggtgattacccagctggagcacgaaagcgcgcggcaggatgcgcaggcggatagcatggcggagctgctgttcgcccaactggtgttgacgctccagcgctatcgctacgccactgataacctggcggcgacgcaaagcgaaacacagctcgataaactgctaacggcgctggccggaagtctgaatcgcccctttaatctggatagcttctgtctgcgtgaaggctgcagcgaacgtgcgttacgccagcagtttcgccagcaaacgggaatgacgataactcactatttgcgccagctgcggatctgccatgcgcagtatttactgcagcataccgagcggctaatcggcgagatcgccatgcagtgcgggtttgaggacagtaactatttttcggtggtgtttaatcgggaaattggcatgacgccgggacagtggcggcagcgcagtcgcgccgccgcgtaa

SEQ ID NO: 4385 - DNA, 1068 bp, Glycine max
  Peptide Sequence Number=SeqID_96070
atggcgcaggaacaggttgcccgccaggtagaaatggcgaaagtccgcaaccagatgtaccacctgctaacccctgagcagcaagcggttttaaatgctaagcaccagcagcgtatggatcagttgcgtgaggttgcaaggatgcagaaaggctcagccatgatgctttccagtagtagcagtaccgtgcaacccaaccgccgcatgcccgttcatcttccgggtaaaagttcaggttatactaagcgcatcgccggaaaaggagcgtttatgaatcaatcttatgggcggctggtgagtcgcgcggctattgccgcgacggcgatggcctccgtgttacttttgatcaaaatttttgcgtggtggtataccggttcggtgagtattctggcggcgctggtggattcgctggtggatattgccgcctcgctgaccaacctgctggtggtgcgttactcgctacaacctgctgatgaagaacatacttttggccatgggaaagcggaatcgctggcggcgttggcgcagagcatgtttatttccggttcggcgttgtttctgttcctgaccgggatccagcatctgattcgccctgaaccgatgcaggcggcgggcgtcgggatggtggtgacgctgatcgccttgataagcaccctgatgctggtgacctttcagcgctgggtggtcagaaaaacccagagccaggccgtgcgtgcggatatgcttcattatcagtctgatgttatgatgaacggcgctattcttatcgccctcggcctctcctggtacggctggcaccgcgccgatgcgctgtttgcattagggattggcatctatattttatatagcgcgctgcgtatgggttacgacgcggtgcaatcgttattagaccgtgcgcttccggatgaggaacgtcaggaaatcatcagtatcgtgaacagctggcccggcgtcagcggcgcgcacgatctacgaacgcggcagtcagggccgactcgctttattcaaatacatttggaaatggaagataacctcccgctggtgcaggcgcacgtaatcgccgaccag

SEQ ID NO: 4386 - DNA, 270 bp, Glycine max
  Peptide Sequence Number=SeqID_96071
atgaggcacatgtccgcttttcttgggagaaatatgagtgaatttcgatgcatctcccttcatgtgtctaaagcatccgctatctatgtaccaacttttcttcaaggaaacctatatgaacatgtttatgacttcggcctaggatcttcttcatcaagggattcctttgcatcttggaagatgaatgacaacagaatggagaaggaagagagagaggagatgccacttcaaggagaagaagatgagtctagaagaagctcaccaccatag

SEQ ID NO: 4387 - DNA, 243 bp, Glycine max
  Peptide Sequence Number=SeqID_96072
atggcatccaggaagagaaagaacactgcttctaaaccttcagctcagtatgataccaggcgattccaatctttggaagcttggaatagatacacggacaacattcttggccggagggacacaggtaaggcaggaggctgctactccagagaggtcaccacagatttcactagatccaccctcgctagtggtggatcaatcttctcctcagtagctagcagaccctcctacaccagtgcatga

SEQ ID NO: 4388 - DNA, 90 bp, Glycine max
  Peptide Sequence Number=SeqID_96073
atggacattctcaccctgggtcaaggtttatgtggttcagggaaaaaggagatgtcccacattatttccatgatacacatgcaacactga

SEQ ID NO: 4389 - DNA, 313 bp, Glycine max
  Peptide Sequence Number=SeqID_96074
atggaaagggaagaaagagagagggtgatagaatcattgcatgcagaagccatgaaatggatggataggttcgctttcactctgaatgggagtcaagagcttccgaggttgttagccagagccaaggcaatggcggatgtatattcagctcccgatgaagttcatgggcttttcgattattgccaacacatggtgcaagagcagatgaaggccgacatggaggccatgaaggaccaaatgacctccatgatggaggccatgataagtatgagaaggatgatggaggacaacgcagccgcagttgccaccacca

SEQ ID NO: 4390 - DNA, 429 bp, Glycine max
  Peptide Sequence Number=SeqID_96075
atgacgactgctgatgtttgttggatgccttatagtgaccaccgtgcagttaaagactttgacttgatttcatgtttttctggacatatccgttggtgtcctgttattgtcatacaccgaccgaagagggttgtgtggatgtttggatggatgcatttctcttactaccttacaccagtgggccaaatttgtgttgtgcctgaacaacgtgcaccagactacatggactggttctatatgatttcacatccattcatgaggctgacacagcctggggatccacccagacatccacctgtcatgcaagatgagacatatttcgaaccagatatgcctcagtactcggtggcggcaacaactatgaaggaaacacctagccatgcaccttctgatgtggagcatcctagacatgcagtggaggcttgctaa

SEQ ID NO: 4391 - DNA, 420 bp, Glycine max
  Peptide Sequence Number=SeqID_96076
atggttttgaccacacaaccggaccagccggttaaagagtatatgttaccggctatagcaggtcaccttccaccaccaaaaacctctttagacccattcttaaccctcaactcaacccaaccccttttgcttgtgttccctggtgccacgtgtaagcctcactcttccttgacaggattagaaaacatgagggatttggctttccctaagaaggatttagagtcaagaataaagaataatgccactgatgactcgattttcaatcaatggacccctcctttgcagtttctggtttctctcttcattgctcaaggaaagtacaaattagattacaccaaaaaagttagtacgggaagcacaatatgcaaccataaggagaatttcactgaaatatgggtccaatggtacttgaatggttaa

SEQ ID NO: 4392 - DNA, 3927 bp, Glycine max
  Peptide Sequence Number=SeqID_96077
atggcggttgttggaggtggtaagccacctggccaaatttttctgagactgggaagggccccgtgtaaagcttggcaagtggtcatgatcgaatatgctacttcgaccgaagaagaaccttgtaggtattgtggtatcaaaggtggaggcttgccatatgtaatctcgaaaggaaataactcggtgctggagtgtatgaattattctgttgagaacctcagtttgtccatcagtttccgggtggctgcgaggaaagccatgcaatttgcatatgatttctataaaaagaagggcgaccatgtcggcagagtgtcgcggtggcagggccctgaaatgagatcctttagagtatctattgacgacaagcagaggttgaagcaaatcgatgggttttcggttgtcgtttttcatttgttggcatgtgaggcaattggtgacatagcaacagacgagtttggacaaataatgttgctgctcaagggtctagatgatctaggtcatgagctctttgagactctaatcataagtaaggatcacaaagtggtgacccaagaggttatagggtgtgcttgttgtgacaggaccccgcccatcacgacgccaaaagcatttgtttccagcgagaaagggatagagaagtcagggggtgtcagcactgttggtaaggggtgtcgccatgactgcatacccacagatgaaatgctagtagagtccagtcaagcccaagaaacctcgcaagtcagtgaatcaagaagcagagcccaactcgtcgatgagctcatcaatggttggcatgggaaatatgtctttgatgaaaggactgtggcttatgcggataagtctggtatcgagcatggtgaatgtgatgggttgtcaggaatgagtgagggagataaagtatggttagtgacgggaattggggtgatttggaaaaaggtcgatatggcttgggtatgtaacaggcgtttaagttggtgggctgaagtaaagggtgggctgaaggaaatattcactaacagctggatggggtggcccaaatgggtgaaggtcatagaaagtgaggtcagtagtgaattggtgtccttggatgaaaaatggaacctgaggatggaggaactttgcgacacaggtttgtacaaagttatgtgtgttgtcgccgtcaacaagaatggtgaatttgtggtggcaaatgacgtcatacacacaaaaggtttcaggggcagacatttctggcattgcatagagactgagctgaagattgggcttgatggggtgtggttgttggtgtttggggatgagggttttgtcgcggataatggtgtgtttggcggtgattgcgacgacgatcgaggattttatccttctacaatttggcaagagcaacaacctgaggcagagacatttggctacagctcctgcacttctcaacgaagttccagagtgaggtcggaaataaagcagttcaatagaaatgggggagcaagctccacaatccggatggggcaaagtgagactccagtgcctggagcatggcgggccaagaagtcaggaacccgttcctcgacatccactggaaccatctcacgtgtggtctgtaaggggctggacgatggtggtttaggagaaggaggggttgagcttatcgacaacttcctcgagacgctcgagggaagtctggcaagtggtatgctctggcatggtgttgtagagcacagagcagccgtttctacttcgcccgatccgtatagtagttcgggttacccgactgggacggagctcaccatgtctgttacttatgttgttcaacatgcagaggttgtagtgtcgccgaaacacacaactaaagccacttcttcttcagtttcaccgacacaatgcctttcatctccaaaattcagcgccaaaccgattacaccctctttggttccgccactcccatcgtcatcgacaatggcgcctcctatttccgcattggatgggcaggagagactcaaccccgtgttgttttccgcaacattgtccaaaggccacgccacaaaaccaccgattctggactttggatttgacaggttgggtgctacaggatcagagcagattgatcatcctgtcctgatcacagaatgtgtaagcaacccagttcagtctcgtagtaagatgggagaacttctttttgagacttatggagttccatctatagcctttggtgttgatgcggcatttagctataaatataatcaacaacaaggtgtttgtgataaagatggtcttgctatgtgtcctggattcaatacaactcatgtgattccgtttgtagatggggagcctatttataaaggatgctgtcgtactaatattggtggattccatgtgactgattatttaaagcaacttctttcactcaaatatcctcatcatatgactagatttacatgggaaaaggttgaagacctgaagatggaacattgttatattgcaccagactatgcttctgaagctcggttgtttctgaaaggagctagggaggctgaagaaaaaaccagatgttggcagctcccttgggttccacccccaactgaggagcctccttctgaggaagagattgcaagaaaggcagcaataaaagagagacaaggtcaaagattacgagaaatggctgaggcaaagaggtcatctaaaataaacgaattggaaaatgaattgcatggtttggaatttcttttaaaacagcttgagcaagttcaagacagtaatgttccgtctttcctagcagagaccggttatgtctctaggcaggagatagaatctgcccgtactaaagttacacaatccttacggaaagcaaaaggtgaaccaaagaatgaacaagctgaaactgataaagccagccctaatgctaatgaaaagtattctcttataaacatccctgatgacatgctcaccccagaccagctcattgaaaagaagaaacagttatcactgaaatccatgtctgaagggcggcaacgattaaaacagaagcgttatgaagaggaattggagcgacaaaggaaacaactgctagaggaggagacacgcttagagaacccagagctttacttggaacaattgcgtgctagatacaaagacctttcagtgaaagttgaccaacgaaaacggctcaagacaaatggaggtcattctaacggaaataacttggccggtgccattggtcgtggtgagagactcaatgctgttcaaagggagagaatgcgcctcttgacaactgctgcctttgatcgcggcaagggtgaggatacatttggtgccaaagatgaagattggcaactttacaaattgatgagcaaagatattgatgatggtgatgagggaccagatgaggatgatgcagagctagcccgcatctcttcaaggctacaggacttggatccaacatttgtgcccaacaagtcagaagcaggtagctctcaacctgctgctgaggcccaacgcgcccgtcctctcaccaaagaagattttcagattgtttttggtgttgaaaggttcaggtgccccgaaattttgttcaatccaaactggattgcggttgatcaagcagggttacacgagatggctggggtctcaataagaaggttatcatgtaaggatgaaggcctggaagagagactcactagctccatacttgtgactggtggaagttctcttttccccggcatcactgaacgcctcgaagccggaatccggatgattcgaccatgtggagcaccaataaaagttgttagagcactggatcctgttatggatgcatggcgtggggctgcagcgtttgcatctgccccacaattccatacacaaactttcagtaggatggattatttcgaaaagggtgaagattggctccgcaattatcagattaaatattcatcgtaa

SEQ ID NO: 4393 - DNA, 780 bp, Glycine max
  Peptide Sequence Number=SeqID_96078
atggtattggttcaatggaaaggtctcgcccctgaagacacttcgtgggaggactgggcaaccttgcaatcagattacgacctcgaggatgaggccgattttcctggggagggtgttgatagaaacaacataagggacaataataggctcgggaggcttttcaagagacctattcttggtgaatgttttcaagagaaggtattctttgttgcaaacactgaacacaagggaccaacgttccttgggttcattgcaagaagcaaaatttacttcttggttgatcactggactcaaaagaccaatgtcttttgggttcattacaagaagtgggcattacatgttccaccaccattcaccaatgacttttggcgacagtatagtactatacctcatcactttcacttgtctccatcactcaacaaagcccagccttcaaacttgaacggtgacacgttattccaaggtcataatcatcagctctcaacaaccaactctttgatctgctcttcaggtttgttcacactgagtttctttcagcttgatgactctgaagatttctaccttggaatcagactctcagctgttaattctagttataactgggttgccaatagagacaagccaatccatgaagacccttcagtggctttcacaattgatcaatatgcaaaaagttataaaaacaatggtaactttgtgcttcatgaaatgaataaccaagatggatcagtgaagaggatattgtggcaaagctttgattatcccaaaaacatgctttaa

SEQ ID NO: 4394 - DNA, 1046 bp, Glycine max
  Peptide Sequence Number=SeqID_96079
atgccacgacccatctggtttgcgtacgagcagtactggcaacgagaatggactcgtgttggattggatgaggccctgaatcaggtggatatggtggtccgtgattcgtgccgacagcagagtctgtggctgttggaagagaagtgcgaacttggaaagcaagccatgaatctccgaggaaatggtacctggatcaaggatgaaggtgttgtcctgaatgcacaccgccacatgctcacagacactcgtacattccaagtgttggccattccccaccatgacccgaaagggtgtcgaggtcgtccggcgaggcaaacccagggtggtgaccacctgaggttggacgaagttatgcgtgctacctccatcaacaaggatggtaacacagtggtggcccgaaagagagttaagacttatttggtcctgaaatggtattgggctatcgagcgggtctgggttcagatgcaggttggttggttctatatgaggccaagagggttgatcttcttccgtgataaggagaagaaccctagaggcacaacgatgccctctgtggtacttctcgttgcaggtgaaacacaagctgcgctcggcgtaacggaagaggtgtcagggtttgcgggcgcagtcaaggcggcggacgacaatctgacaacttctcttcctggagacaagcgaggccggtggcctgaaccaggaccagagatgaaacaggctaggaggaatggtgggggcaagccaatgatgcagtttgctaagttctcaaattctgacaagtattccgcaaccgaacctttttgtgtgagtttgaataatgcaccgatccatcctaatgggtctgtgccagtgaagcgtgaggatggtgttgatggcgaaatgtgggtaaggatttcatccattttcaagttcatggcttggatggtgtcgcccaaacgggcgagaaccttggttagttggggtggaggcttagccgtggaggcaatgagagcaccaaatgatagggatgagcgtgtactggtttttgaggaaccaggaacctctaacaa

SEQ ID NO: 4395 - DNA, 426 bp, Glycine max
  Peptide Sequence Number=SeqID_96080
atggacctttgggtactagtaccctcacctttagaggactacacgtcctcgccttcagagggctgcacgccctcaccttcagaagactacatgtcctcaccatcagaggactacacgtcctcgctttcagaggactacacatcctcgccttcagaggactacacgtcctcgccatcagagggctgcatgccctcaccttcagaggactacacgtcctcgccttcagagggtcatgtaccttcaccttcagaggactacacgtcctcaccatcagagggttgcacgccctcaccttcagaggactacacgtcctcgccttcagagggtcatgtatcttcaccttcagaggactacacgtcctcgccttcaaagggcttcatgccctcaccttcaaagggctacacaccctcaccttcagaggactag

SEQ ID NO: 4396 - DNA, 372 bp, Glycine max
  Peptide Sequence Number=SeqID_96081
atgtaccctcccttgttctctttgaacaacctagtggatgtacccttctctagaactgatccacaagagatgtaccctctcttgttctcactcacaacaacccaagtaaatgtaccctctacttgtaccacaaaggatgtaccctccaatgtgttaagacaaagttctcaggcgggaagaatcaaaagaattctcagactgtgtcgttttgaattctttgacaagggagacaggagacacaaaagaattctggcggttagtcctttgttcttttggaaaagggagaagagagacacaaaaataatattaaggcggttagtccttggcgaattctttttggcaaagggagaagggaatgaaaaagatgaatag

SEQ ID NO: 4397 - DNA, 423 bp, Glycine max
  Peptide Sequence Number=SeqID_96082
atgggatcgactcaggcgccttcgtttaaaaagaggttctatcaagtcaagatcaagagcctaggagtcgccagtctaaaagagttaggacaattgatgggtcagctccagcaacaagcctttcgcaaagtttacggtaagatctgggacctaaccatggtagaggtctccacggaggccattgactccctcggccaatattatgaccagcctttgagtcaaaatctcaacacgggaattagaccgcgggaagcaagtcgaaaatggggtggttggggtaccaaggaaatgtttggaagcaaaggcgagagtcttggcaagtcaaggcgaatgggccccgttcatggacatcctggcactttcgatctttggggtggtcctctttccaaatgtggatgggttggtggaccgagtagccattga

SEQ ID NO: 4398 - DNA, 2070 bp, Glycine max
  Peptide Sequence Number=SeqID_96083
atggcgcagcggaaactggcgttatgtctatcggacggacattcgcgggggttatgcctgcaatggctcaattacagcgtcgacgatggcggtgatatttacacgccggaaaaaggaatatgccgcggcagtgcgctcagccccaagccaggtatcggaggctgccgagggcagaaactgaggcgttggtgcgtgagtatgaagaccggtggagtgtgtgggcaagccgggggcgccgtaccatggcctgtcctcatggaccctaaaatcgtcagttgcgatgaccagtataagaatccatgctcagccaacgttcagtactactcagctggggtaatgatgatcgatgtactcgcagtagggcagcccaacgccgcaaatacaggcacgttagtacacccggtcggggttcattgcaatacagggaacgcgctcgtcgggaacttgccatttaaaaactgtaaatggctttccgatgatactcaccggccgccgctagtgggcaagtgcgaactcaagtcgccgaactcatggacgctcacgtctgattccgactgctctgtgcggtcgaccttgctgtgggggcactatggggcgggtcctggaggcgaatgcgttgtattcacgaataccatatatccccaggcgcagggggtcgtgaatactccatggggggcaatcactgcaacacaagctgctaacagcgggaatcgtttttgttctaaacccctgccaccgaacgtgacgtgcgaactggacctaccgaacattattgaccatggtgaggtacgtgcgggtgactcgtccaaacgggtcgatgagggacagattaagtgtggtcttacaccgaaaatcgacgtgcttgtgaacggggatcgggacacagagggggttcggatatccacaaccccgctcatcgtgaatccaacaaccgttcggatcaccaccgagatcaccgtgagtaatagtgctgtggcgggagaacacagcgccacctacgtgttcgtagcgagtccgtactatcgacccagatcagtactgggtccagggggtgataaaggcggtatcacactatctggacacgactactggagtgaaagccaaagaatcggctgtgacaatactacagcgtcgggggtgtatgtagggatcgcgaatggcgacacgctacaaatggcaagggacaaatttctgaggaagtaccctggcgtcggaacgtggaaactaacgccatggtttaagggtggccccacctgtgaaggattgttgatctggcagagccaacagcaagcaggaaacccgtctggggtgccagtgccaggcacgtactgtgggaaaattccgcccaccaacgtgtcgtgtgaccttgaaggcgacatccggtatgagtacgggacagtgagtgggatggcggtgaatgggatggcaaagaccgagtacattaccattaactgctcacagtcggccgacgttatcgttacggtcggaggaggggggagggtatccatggggggcggggtgacctcacggttgtatattaacggtacagacctgggcggtggtgctcgcctgaccgcacccgccgggacacgtcgggtaccagtcgaggcagtactgtattcgcaggctgaaccaaagccagggacttaccagggagcaacgggtcgttgcatattgcccattgcgggcgcggcgactggggcaccccacaagcgcgcaaccgctcttcattacagatatggccgaggcccggccgccagggtggatttgcgcgtagttgtcgcccaacaggtaccacagggttgcgccagactagctctacccctttcatttaacaaacagctgccggccgtaggtaaagggcgcacagaagatacctacttcaaccctctatggggtgcgcagcggagcatggcgcggatggcgcagcgaaacagaacgtcgggcagaggggcagtgttgttgaagaacggcgacagcggggagtgctgctgttcggctatccatctcagtggccttggggccacaactgctgcaggctttggatttgcagctcggcagcagaagcgg

SEQ ID NO: 4399 - DNA, 420 bp, Glycine max
  Peptide Sequence Number=SeqID_96084
aggatcccccctccgggggacgaagaaatccagctggattttggcaccatcgtcgacaagtacctgtaccagaacacccgtacactggggcagccgttcgagatacggctggcggagtgtgacattagcctgggcaagacggtgaaggtgaccattacgggcatggaaaatgcggcgttacccggcctgctggccatcgatgccggcagtggagcgaaaggcattgccatcgggcttgagacgctggagggcaaaccgttgccgcttaacaaatcgagtgacaattatgtgttgcaggcaggcaataatctgattgcgctaaaggcctatgtgcagggggagccgcaggcgattgccaatcgaaccattggttacggcccgttcaacgcggtggcgacgttcagcctggagtatgagtaa

SEQ ID NO: 4400 - DNA, 540 bp, Glycine max
  Peptide Sequence Number=SeqID_96085
atggcctctaggaaaacaaaatcaaccgcctcccgacctcaagaaccctacaacacgatgagatttttttctgaggtcgcatgggaacgttatgagcagaacgttcactctaggagaaacctcccgaagaggaacgttacattatatgtgacagagtacgacgagttccgacgggagctcgagaggcgcagatggcataaagccttgactaggcagcctgatggtcacattgatgtggccctggtcaaggagttttatgcaaacttgtatgacccagaggataagtcccctaggaaggttcgagtatggggcaagctgattaagtttgatgaggagacactgaatgcctttcaggagacccctatggttttggagctaggggagtactactcggcctttttcaggttctaccatacacacccagaccctcaggagcttgcttccaagctctacattcccaagcacggttttgttcttaacgctgaaggagcgccctggaagctcctgaggaaggacctcactactttggcgcagacctag

SEQ ID NO: 4401 - DNA, 153 bp, Glycine max
  Peptide Sequence Number=SeqID_96086
atggtcatttctccgggagtgacgcgtccagctcaagacgttaaagaagcgctactaggaggcaacctatcatattggacgcacctagttgctcatgatcctgggaatttaaataaaacaagcgcaagctcggaaggtagaaagataccttag

SEQ ID NO: 4402 - DNA, 438 bp, Glycine max
  Peptide Sequence Number=SeqID_96087
atggaagggaaaaaaacgattcagattaaacgtggaattagtttcaatgctttgaagaaaaaaattggagataaggaaaatatattgccttgcaaatttgtgatgacgaagacgttgaaacgatgctggaaagttttaaacaacaagaacaaatatgatggtgatgatgatgatgattatcttgtgtctaactcatacgttgaagagtctttagacgaagatgacagtgttgacgatatatttgatatagacgatgaagtcaccgacatgattcaaccagaattgaaaatccattttgaaatgatgctttgcattataacaatatcaactggagttatcctgatgaggaggacatttgcggtttggagatgccgtcaacctttaatgttggccaagaattatatgttggcatggaatttcatagtaaagatgcggtaa

SEQ ID NO: 4403 - DNA, 279 bp, Glycine max
  Peptide Sequence Number=SeqID_96088
atggtggcggatgcatctggcggcacctctgtcgatgcgcataaatatgccatggaccgcatggtgcaggcgggcgtcatccccgtcacctggcagcaggtgctgctggaatggcagcgcgactgggcgcgcaaggaaacctatgacgccgtcacctcgctggtgaaggaacattcaggcgcttacggcatgggcatcgattatgcggtcacgcatgttcatggcggcgcagagcgcgtcaagcacggcaagcgcatcggccccaaccccgcgaaataa

SEQ ID NO: 4404 - DNA, 1032 bp, Glycine max
  Peptide Sequence Number=SeqID_96089
cacgccatcagaggaatacacgtcctctcctgtagaggactacacgtcctcgccatcagagggctacacgccctcaccttcagaggactacacgtcctcgccatcagggggctgcacgccctcagcttcagaggactacacgtcctcgccatcagacggttgcatgccctcaccttcagaggactacatgtcctcttcatcagaggactacacgtcctcgcctgtagaggactacatgtcctcgccattagagagctagggctgcacgccctcaccttcagaggactacacgttctcgccattagagggctgcacgccctcaccttcaaaggacaacacgttcttgccatcagagggctgcacgccctcaacttcagaggacttcacgtcctcgccatcggagggctgcatgccctcgccttcagagaactacacgtcctcgccatcagagggctgcacgccctcgcctttagaggactacaagtcctcacaatcggagggctgcaagccgtcaccttcagaggactacacgtcctcaccatgagaggactgcacgtcctcgccacaagagaattacacgtcctagccatcaaagggctgcacgccctcaccttcagaggactacatgtcctcgtcattagaggactacacgtcctcgcctgtagaggactacatgtcctcgccattagagagctagggctgcacgccctcaccttcagaggactacacgttctcgccattagagggctgcacgccctcaccttcaaaggacaacacgttcttgccatcagagggctgcacgccctcaacttcagaggacttcacgtcctcgccatcggagggctgcatgccctcgccttcagaggactgcacgccctcgccatcagaggactgcaagtcctcgccatcagagggcagcacgccctcgcctttagaggagaacacgtcctcgccatcagagggctgcacgccctcatcttcaaaggactacacgttctcgtgatcagaggactgcacttccttgccgtctga

SEQ ID NO: 4405 - DNA, 879 bp, Glycine max
  Peptide Sequence Number=SeqID_96090
atgtttgctaacaagagtgcaaccaatgtccatgttgtctacttggaggcccttcgtgacctcagtatgacagagaggtacgcttggggagtggctgctttggttcatatgtacgaccagctgaacgatgcatccatgagccacagtcgacaacttggcggttacatcacactgctgcagtgctggatttacgagcactttccctcagttccggagtccactgctgatcaggactacgatgaggcttctccgcggagcgcctggaccgactccggattccagatgtctattggaccccgtatagggagcatcgagaggtccgggacttccacgtcagatcatgctactccgatctcttgcgctgggggcctgttgctgtttaataccgaccggagagggtcgtgcggcagtttggttacacgcagaccattcttgctcctcctgtcgattcatgggtctcatatgatgatatacacgacaggtgaggtgtgcgttgtgccaggggcgtgttccagtgactacatcgactggttcttccgcatctcccatcctttcttgacaccaggcaacgcagtagatcctctgcctcatggtcacgccccgcagccccgagtcgtccctcaggcccctcagacggacatccctcgcgtgccggagccaggagcatcgtcgacatctgcggaggagcccagacatgcagtggaagtttgtgatgacattgctgagaggttggagagcaatctgagtctaggggtggtcacgcctggctcatcgacacatgaggtgatcgaagaatgcctcagattggccaggagtgtgacacaggaccatctagtatacgttaggtgtagacgcattgtacatgaactcatttcatga

SEQ ID NO: 4406 - DNA, 1353 bp, Glycine max
  Peptide Sequence Number=SeqID_96091
atgggaacaaatcaaactggaaaaaggttttatcaagtcaagattaagggcctagatatcaccaacattaaggagttggggcggttgatgggacctctccaaatgcaagccttccacaaggcgtacagaaagattttagatttggccatagcagagatatccacgaaagtcgttgtatcactcacccaatactatgatcagcctttgagatgcttcacatttggagacttccaattagtatcgattgttgaagaatttgaggagattctaggatgtcctcttgcgggaaggaaaccatatcttttctccgggtttcttccctccttgagcaagattgcagttatggtcagggattcggcaagagagttggatcataagtgggtcccgtttatggacttattagcattgctaatctttggggttgtcctctttccaaacgtggatggtttggtggacctagccgcaatggacgctttccttgcatatcaccatagcaaagaaagcccagtggtagctgtcttggcaaacttatttgatgcatttgaccgaaggtgcgacaagagtagcgcacggatcatctgttgcttgcccgctctttgtgtagaacaatcagctggtttcctcgatggaagggagggagtccttttcttatgtggggagtacccaaacattccgttgatagggatgaggggttgtattaactacaatcccgcacttgctataagacagttaggggcgtgggaaagcccgttaaggaaagataaagaacttaggggcattcgtaatgacatcatcggtggttatcatgaatggctgaaagtttgtacacgagggttagattggctctccaagttaaagattatcgacgaagagaacttcgaagctccggaagaggatgaagaagtccgggctctaaagacaaaactaggaaaagcaagacttgccaaagaaaaattcaagttggtcgctacagacgtccggaaagagtgtgccgggttacgagaagaaaatgcagctaccgcaagagcccttgaacaagaaatcaagagggctcgcaaggaagagcatggtcgtgacaaatttcatggagctttgtggggcagcaatagtgagctcaagcttcgatgggaagagagagaccaatcacgagcacatagcatggtcttgaaagaggagttagccacttgctcaaggtccaaaagaaacttgtctcagtgtttatgcaagatagagaccaacatgttagccatcgtcagcaagtaccaagaagaattaaatctagccacagcccacgagcataaagtggcagacgagtatgcccaagtgtacgcagaaaaggaggctagaggaagg

SEQ ID NO: 4407 - DNA, 346 bp, Glycine max
  Peptide Sequence Number=SeqID_96092
atggcttcttcgtcgtcatgctcatcaagtatacaaactaggtctggtccaattgatagtgacgtgttgtggatgcaacccaagcatgtttcagaacatgtttggaatggggaaccagacagaaaactacacatcaggcgagcagtcccgacgtatcaaggtgaagaacaaataccggaggaaattgttcctttgcttcggcaatgtgggttttattggatcatgaggatgggatacctaaagataaatgcggccttaattgaaagatggaggcccgaaacccacacgtttcacctgagatgcggagaggctaccattactctccaagatgtgtcagttttactag

SEQ ID NO: 4408 - DNA, 534 bp, Glycine max
  Peptide Sequence Number=SeqID_96093
gaaggatgccactagagaaggttccagtgcggccctgcaggcaaatatggactttgatggacacagggacgaggagtatgctgagttccaagaggagatagcccgtaggaaatgggcccaacttgcatcacccatagctaagttcgatccggagatagtcatggagttttatgctaacgcctggccgacagaagaaggagtcacagacatgcgctcttgggtgaggggccagtggattccctttgatggcatgccatcaatcagtttctggggcatccactggttttggaggaaggccagcgttgtgagttctcctagaggaggattcagacctccagctttaatgaggagtttatcagtcagttgctatgcgttccgggggattacgcctccgagacacccagtggactcggagaagtccaacagggccctaggctttcctgctctgatcataggcctcttccagttctacagagtgtcggtcacccccaccaagctcatccagccttccatcaatagggttttcattgagaa

SEQ ID NO: 4409 - DNA, 204 bp, Glycine max
  Peptide Sequence Number=SeqID_96094
atgaagcacagttcttcatttagacgcctatgggtgtggataaattcttccgactttgaagaaggatacgagaatctacagatttcctgccagaaagagggtttagggttgggggttgggggttgggggttgggggtatggggtatggggtatggggtatggggtttggggtatggggtttggggtttggggtttggggtttag

SEQ ID NO: 4410 - DNA, 369 bp, Glycine max
  Peptide Sequence Number=SeqID_96095
atggccaagtttgatccagacatagtcctcgaattttatgccaatgcttggccaacagaggagagcgtgcgtgatatgaggtcctgggtgaggggtcagtggatcccgttcgatgcagatgctattggccagctcctgggatatcctttagtgttggaagagggccaggagtgcgagtatggccagaggaggaaccgatctgatgggttcgatgaggaggccatcgcccagttactatgtataccggggcaagattttgcccggactgctgccgggagacgggtgcggatcatgcgcaccaaacatgaccaccctgactcagatatggatgactttgctgctcagcaacatcctgcccagcgatcataa

SEQ ID NO: 4411 - DNA, 246 bp, Glycine max
  Peptide Sequence Number=SeqID_96096
atgagtgaaccctcatctagagtttttctctttgataacatattgttgctagtagtccctactgccacaatattttcttcgaaggggatgatacctgtcgcaacctacccttcggcgggagggcgacgcgtgactcgcgggatgcgtgttccacgaaaggaatacgcgcggagtcgccaccaacgtttattcgaggaaaacgtcggaaaaaccggaaaagacgcgatctacgaacttttaagttga

SEQ ID NO: 4412 - DNA, 384 bp, Glycine max
  Peptide Sequence Number=SeqID_96097
atggaatttggtgatattgttgttcattttaacattcttgatgccatgaaacatccatctgaggatcattctgttttttgtgctgtgatacttgatcagattgttgatgattatatgtttgattttgattctcttcatggaagtacatatacttcttacttgctttatgaggtacaggctgaggaaccttcctcttctcttaccctagtttctcccactgttcagccaccacccacaccagagttgaaacccttaccaacaaacctcaagtatgcttacttggtggacaaggaaaaattttcagtgatcatctctgcctcccttgctgctaagcaagaggagaagttgttgctagtgctcaagaagcacaagcaagccatttga

SEQ ID NO: 4413 - DNA, 327 bp, Glycine max
  Peptide Sequence Number=SeqID_96098
atgcggcgtgccctcccatccgcatcgcggcgacaagctcaccggcgccgcgccgatggttcgagccgatcgctgacgtacaggcgcatgcggcagcgggtgcgggtgtctgcgacgacggcacaccataccggcgagcagcctgacgggctgaccagctcgacggccagcccggcggcatccgcgcgggtcagccgcaggtgtaccggatacaccccgccccactcgctccgcattcacagtccatgcgccagctgtcaggcagctgcagcgcgctatgcaccaggccgcacatacgcagccgtgcggcttcgccttgcccgctaa

SEQ ID NO: 4414 - DNA, 2224 bp, Glycine max
  Peptide Sequence Number=SeqID_96099
atgccggtaagatgctgtacggttgccattacgccgcttgtccgcgagctcattctttatcttgctgagcagaatccctgctattcccctgatgataaaaccggcagaattgctgccgtgctcctggagcaaattcctggcgcacccgttgaaatactccatctgcccgtatctgatcaccctaaaatcagacaaataaccgaggcgctttttgctgacccgggagaccgggcgacgttgcagcagtgggctgttcgtctggcaaccagtgaacgctcgctggccagagtggtaaaaagtgcgacgggaatgagtttcgggcgctggcgacagcagcttcatctgatgattgccctgaatcatctggcggaggggcagcccgtgcaaaacgtcgctggtaccctgggatatgattcggtgagtgcgttcatcacaatgttcaggaaagcactgggggcagaaactcagcggtgtgctccccttcttgccggccgctcgttatccaggccggcctgtcattacggcttaagaagcaggcttaacgtaggatattttccttcttcaggacgcctctcaactgaatcggcatcagaagcttctggtctgccgactgccggaatcacagactcagacaagcataatatcccgggatatactaaaggggcagatattatgcagattaactccacggaaaaacagatagattatatcggtaatattgtctatcgccaggtcaaaagtatgcgttcagtcaggcagttacatatgtctgttctcgttccgcgtaccagcgatttgaaaccggcaatcatctattttcccggcggtgggttcacaacggctgagcacgacaagttcatagagatgcgtctggccctggcgaaagccggttatgtcgttgcggcagcagaataccggacaatccctgacacattcccgtcaccggttgtcgatgcaaaagcggcggtgaggtacctccgtcagcatgcaactgattatggtatcgatcccggacgcattggcgtactgggtgattcggccggaggatggcttgttcagatgctggggacaacaaatggcgataaatcttttgatacaggtaattttctcagccagtcctctgctgttcaggccgtagccacgctatatggaatttcagatctgcgtagtatatgtgagggatttcctgagaatagactgaaagttcatcagtctccggctgtgactgaagctctgctggttaatggtgtggctttcagggactttgccggcgcctccctcatatccacaccccagaaagctctcagcgcgagtcccgtcgggcgtctgaggggaagcaatccccccttcctgattatgcacggcagcagggatactctggtatcgcccgagcaaagtgcaacactttacaacgcgctcaggaaatcgggagggcgcgcagattatgtgcttattaacggagcagaacacggagatcatcactggtatcagccagcagtcatcaacagagttgttgactggtttcgccagattctggggactccggaaaaacaggacgccatctgttcggcatcatctgccttaatgggaaaacggcgacatctgaatggcttccatctatcggggaaggcgaaacccgatagagcattgagcgtaatgaagctgccgcaggttttgtccgtgaaatggattaactggagtgtcgccgcgacaacgccaccggcgggtgcagactttgctttctgtcaaccggcccgcgcgctgagaaattatcagtgccgggctcagagtgtattactgaccggccctgttattgaacgcaccctgagcgggttactcactcagggagtgttctccatgaaattaccattttactacctcgcagcactgttccttaccgccggaacccattccggcactgtcatttataccgacagcgcccacccggtaaccgaccgtgcctacagcgggtttaacgttctcctgctctggatggccgctgaagaatacggatatacgtccgaacgctggctgactttcctgcagtctaaaactgcgggaggtcacgtcaggaagaatgaaatcagcacgctggccattatctacaaatcgtttgagaaacaagcccgggacagcattgataatctgctgttcagggacggtgagcgggttatggagcagctggccatgctgaagcaactgcagctgttcaacgtagaacagt

SEQ ID NO: 4415 - DNA, 558 bp, Glycine max
  Peptide Sequence Number=SeqID_96100
atgaaacacacactcattgcccctctgcttttagggccagcgctggcagttttcaatgcgtcagctgtcacatcaacgcccgttgttgtcaatggaggtagcattcattttaccggccaggtcgtcaatgcggcctgctctgtcaatgcatcctcagccgacatgacggttcagatggggcaagtcagaactgtcaccctgagttcagcgggcgccaccggcagcaccgtgcccttcagcatcatcctggacaactgcgataccagcgtatccggtaacgtttcggtggcattctccggcaccaccgtttcaggcagcccgaccattctgtctctgggaggctcttcaaacagcagcgccagcaatctcggcgttcagatccttgacagaacaggaactccggtcacgtttgacggggcgacctggagtgcccagaacgtgctgcataacggccggaattacattcccttccaggcccgctacatcggtgtcggctccggcggtgccgtagccggtgacgcagccgcagacgccaacttcagtgtccagtaccagtaa

SEQ ID NO: 4416 - DNA, 1053 bp, Glycine max
  Peptide Sequence Number=SeqID_96101
atgacggtaagtcttggtgacatttacacctccacgctcgtcggagccggtgctgcaacgccatgggtgccctttacgctgagcctgaccgcctgtcctgatggtacaaacggcgtgaccgccgtattcagtggtgccacggacagcaacggcaacttcagcaatcagggcacggccggcgacatggctgtgcagttagaaacccagtccggcacgctactgacgtcaggaagcagtctccagaccgccgtcgaccagtcacagaatgcggcgttcagtcttcaggcccgggcaataacgtccggtggaaagataatacagaatgacaagatttacggagataatatgaaacacgcaggcacaaacataaaatccataccaaaacttcttattggtatactgcttttactgtttccgctcctgacctgggccgggcatgcccggatttcgtgtacgcctccacctgcccatgatgcaggcagaaactgggttgacacctcagtatccattccagtggcattgcccgatactatggagccaggagtcataaatcccggagatacgctcttcactatggcatacggcagtaaagtgcgtttagcaagtaccagtgatagtagcgtcaatgtcgttattcctttcgttgcagctaatcgttcagtgattgttaaccgaaactgtgatttcagctcacaaagtgcctcagtgaccttacctgaatattctgtggcaggaacatccgcattctcggtgcctctgagtctctcctgtacagcggggggcaacatatatgggacaatgagccttacgggaaccacggcatccggcgataatacagtgttcacatctgacggttcagcgcagggggttggcgtgcgtttttattataattctcagccagtcgctgccaaccagggtctacagtttggtcccatatccggaaacaacataccaacccccctcggtctctccgtcgcttatgctcgtaccggtggacgtcttacagcgggaactgttcagtcccgtgtaaatctcaactttacttactattga

SEQ ID NO: 4417 - DNA, 342 bp, Glycine max
  Peptide Sequence Number=SeqID_96102
atgcgcatcgataatcctgcgcaaaccgtcagccgcggcatccagtgccgtctccatgctgacccgctggtgatgaagctgaggatgcagcaaccgtccggcctgtgtcagggtttcgcccagtgccgcgccctttacgcacagccgcccggcattcgccggatgacgggtatcgccactgacctgagccaacgcgctctgcggctgcgtgacctcgacgccgcagcccacaccgcaataagcgcaggtggttttcatgatgcctgcgccatcaggttaagcggacggttcgcgacccagacctggccgtcctccagtttgaccggccagcaacgcagctga

SEQ ID NO: 4418 - DNA, 1608 bp, Glycine max
  Peptide Sequence Number=SeqID_96103
atgtcgaacaaagagcttcaccgcctttccgtcattcaggctgttattgaaaaacgtcttcgccgccgtgatgcggcctcccagcgaacgtcaggttcagcggctgatgaaccgctaccgcaagtctggtgcagccgatttcacgcagcgacgtcagcggtcagaacgtggccggatccggcgccgcgctactttgactacgaaagcgcgctggcgctgcgcaaccttgccaccgcgtacggcatcgatatgccgcgctacctgcacgcccccgatgtggccgtgcagctatcgaaggtgcccgacatgaaaaagcgcctctttattgacgcgctgtggtacaccggtggccggctcaacgagatcctgccgctgactagggaggatctttgcactggacgatccgctgaccggcgccccgctttcctcaccgttcgtggtgctgcgcacgctcaagcagctaaagctagaggaggccgcgcgcagccgccggcgcggccagccaacgaaggaggaacagctggccttgtaaagaagcgtggcatcgggcggcgctcaggctgggcgcacttttcagcgacaacttccgccatggccaaggggatatcccgcagcaaagtagcttatgaaaaaccaaccagcttgcccggcgatctgattaccagactgcgcgagcgcgaactggtcatagaggacgagcacattgccgaaaatgcgctccgcttcgtaggctactaccggctgcggggctacttttatcctttttaccggatgacggaagagcgcgtgccccgggtgcacgaacccaaacgttttctttcaggcaccacgctcgggcaggtcatcgatctgtatgaatttgaccggcgcctcaggcttatcattctggagcagatccagaaggttgaagtggccctgcgcacctgcctgtcagagcacatgtccgcccgctacggcgcccactggtttatgaatctcgcaatcatgcgacctgactacgatcatcaggaatttttccgccagatagccggtgctaaagaggtcttcatccagcactatcgcgaacgctacagcacgcccgtgtgtccgccctcgtggatgatcaccgaggtcatgacgttcgggacctggtcggcgatgtatgccagtattcccgtcagcgatcagcgcgcgattgcgcgcatgttcagcctgaacagccatgacgtccttggctcctggttccacactctttcgcacctgcgcaacctttgcgcgcaccataaccggatcaggtttcctggagtgatggacttaaagagcagcttgatacgcttatggcacagccgccagcctgcgtcacgtgggaaaaaatgggctttcccgaactctggcgggacgatcctctctggacccggcccgttaatccgcccggttcgggtgctcagccggatcagaccgcaggcggctgtagtgagaattaccgaccgacgccatggagcgtgccccgcacgcccgctttctgacttccctgcttatggcagcgggtttgactcgcggctgtacctggaacgcttttttaaccggtcgggaacgctatcttatatgtcccttctttcggcacggtaa

SEQ ID NO: 4419 - DNA, 1803 bp, Glycine max
  Peptide Sequence Number=SeqID_96104
atgatgccacgcagacatcaggccgcagcacgcatgtttattgccggtgcactgtggttgtgcgcctctcaggcgcacgcggacacacagtatcagctggagaaagtcgtcgaacttagtcgccacggaattcgtccacccacgccgggtaaccgtaaggatatcgaagccgccacgcatcgcacctggacaacctggaccacacacgacggtgaactcaccggtcacggctatgccgccgtagcgaacaaaggccgctgggagggcgaacattatcgcgagctgggtctgctgacttcaggctgcccgcaatcgcgggatatttatgtgcgggccagcccgctgcagcgcacccgcgcaacggcgcaggcgctggttgacggggcgtttcccggatgcggcgtggaggttcatcgggttgagggagaagacgatccgctgtttcagacagaagcgtttcccgcaaccaataccgatccggccaaacaactggcagcggttaaagccgtgacaggtgatttagctgcacgtcagcgggcgctgcagccggcggttcttgcgcttaaacgtgcggtatgcagctctgatgctgactgctcctacttcgacaagccctggcagataaagcagaataaaagtggcaaaacctccatcgacggcctgagcgtactggctaacatggttgaaaccctgcggcttgggtggagtgaaaacctgccgctgagccagctggcgtggggcaacatcacctcatccgcgcaaatcacggcggtgctgccgctgctcaccgcaaattacgatttgggtaacgatgtaatgtataccgcgcagaaacgcgggtctatcctgcttaacgccatgctgcagggcgtcgaacagggtgtttccaggacgactgacaaactgccggacacccgctggctgctgctggttgcccacgatactaacatcgccatgggtgcggaccctcatgaactttacgtggacactttctggctatacgcgtggaaacattccgccaggaagcatcttgatgacctgcggcgtctgcaggcaatcgacaaagaacatccgctgctgcgcgaagagtggcgtcagtccgactgtcgtgttactggggtgggtacattatgtccgatgaagacggctctgaaagcactcagccgcaatcttgatcctgttgccatcacgcctgtgaggattgtctgggcaacactttgcgctgaccaccttccattcggagacatagagcagcttgccgaactgtccggactgagtgtccgcacggtaagcatttcggatctttcgggccatgatgcgccgggcgatgacgcgctcgaccagagaattgccgaagcgaagagcaacctcgctgaggaaggccgtttttatcggtcagttattacagctatcgttgtttgtgcgctgctgcttgttcttaaccactttacgaacccggccagcactgatcagccgctggcaacagaagcggctacggcagatgctgcggcgcgacgcactttacacagctctggggcggccttagctccggggaaaggccgaaatgagccagccgcggcagctactcgccagaacgtgaacttatctattgataaagagttacttaacaaagcgcgcgatgcggggatgaatctttcacgtaccctgtccatggctattgatgaagagttacgtcgttatgctgcctcacgctggcaggaagaaaatgccgaagggatcaatacgctgaaccgtatcggtgaagaaacgggatgcttttcagataactacaggaatttctga

SEQ ID NO: 4420 - DNA, 924 bp, Glycine max
  Peptide Sequence Number=SeqID_96105
atgcgtcagggaggttccggcagtgaagcggcgcctgatccgccgcagcgggcgcgccacacttccgggaaagtgctatattggccggaaagcggatccggcgccgagcgtgaagctgtcaaagcagggggcccgttgaaagatggagagttctttgatgaattgcgggacctttatctgcgttactgcgaaatcacagaccatcgcttgggcaaccgggaggttcattcattcagcgtaaactatgaaactcgtcataccgaccagaactacggaaatggagtaaaaatgatgatgaaggcagatggtatagtccgcggcattacgggtccggttgctcacccgctgaccgtccgggtgagcagtccgcgggcagggatccggggacgcctggctgccggtctgattgccggagtcattgcgtctgcaggtgtcgtgcctgccacgcctgccgcgacgcgggatgaagtcatacacctgaacgccgcctatccgtccggctccgttatggtatgcagtaagaatctgccgggcgacggaaaaatgatacagccgaccgtactgcagatgcggggaaccgtggttaacaggaagcaggacagcgcagtgtatgaggtctcatcgacatggaccattccgggtaaaagcagcagttctgacctgacgctgaagctcagaatgctggagcggatggatgataaaggcagctattcccgcatcgttcctgacagcatgtcggtatcgatgccgtccgtcggccctgcgggtgaaaagtccgtccttgaaggattccgccggcgtctgcctgcaggcgaaatctttacgccattcagtaatatagaaatcacggattttccttcctacacggtgcacccccggggggaacccacgtcctactgtcacagagaatccgctgggacctga

SEQ ID NO: 4421 - DNA, 504 bp, Glycine max
  Peptide Sequence Number=SeqID_96106
atgaatatacggtttgtgacgagcaacacagtgaagtttacagatgccgcccgctacttctctgccagtggtatagggctggagcaggcggaactggctgtacccgaaattcaggcggattcagctaacgaagtctgcagggctaaagctgactatgtatcagggcgtctcagcgggccattttttgtcgaggatagcagcttccatattccttcactgaacaacttccctggtatttatgcgcgctatgcactggccacgctcggaaccgaaggattgttaagattaatgaaaggactggcgagccgggaatgctatttcagaagctgcgttgtatttcgcgataaaaataacacttttcatgagttcagttttgtcagggacggtttatttattacagagcacactcataaaaatatcaccgggtggtcagaactttggggaataattggtaatgcaaatctgaacaagcctttcagcgaactatctcccgaacagagatcg

SEQ ID NO: 4422 - DNA, 345 bp, Glycine max
  Peptide Sequence Number=SeqID_96107
atgtttaagaaaactctagtcacgatgattgttgctttgactgcaagcagtgcatttgcagcacagcaaaacagcattcgtttcaaaggaagtgtgtcggctcagacatgtaatatcagcgtcaatgactcaacttctgcagcgcctgttatccttctgcaggccgcaaaagtcagtgaccttactgcggcgggtaatacttcaactccaacaactttcagcatgaagctgacaggatgtgcgaatccgggaaccgctggggaggatatcaaaatcaactttgtatctaataatgttgatgcttctggcaacctgaaaatatgccaccacatcccctgcgactaa

SEQ ID NO: 4423 - DNA, 771 bp, Glycine max
  Peptide Sequence Number=SeqID_96108
atggacgaaagcggattcactggcgaagacctgctgcacaggccccagccctttcagtgtgccaccacgctgagtataagcccggatgatgcacgtcacctcatccgccagcattttcctaaactgaaggcgcctgaactgaaattcagttcgctgatcaagcgtgacaccaatctgaagcccctgtacgagctgcagcgggatcttctggccaattttccctgcgtcagctgcgttgcagacaaaaagtttattctgatcctgctttttgtcacgcatgccgtggagccctggcaccacgctcgcggcagaaatttactcagcaacggcggtcattttctgctcgcctccagcaccttctttgccggtccggccctgctcgggaatgactttgagttgatactgcgctgcttccagcacgcaatgaagctcaagacttatgagtcagttcaggaactgattaccacagtaaggggagttaactggtttctgatggaggattttctggggccgattgcaacgggagatcccgactgcataaatgaaatacttgatgagaagacctctaccgacgccgcctttatcattctgaacgcgctgatttccaagactgaaatgatgtcagctgatgcgtaccggattgagcatgaccgctctaaaaatctgctgcagtatcacgattatctgatgcggtttataggctgcgatcagcccgccgaatttaggctgtctgatgatgcctctgtcagctacccacttaagctcagagag

SEQ ID NO: 4424 - DNA, 1494 bp, Glycine max
  Peptide Sequence Number=SeqID_96109
atggctcaacagcagcacggggagctggagagggtttacaccatgatcggcgccgtggtcatggccatggccggcgatggtcttgaaaccacgcggctgcggattgccggctttatccgcggagaactggccagaacgcaggcatggtcgccggagatggaaacggccatgctgagtgcgatcgagacgctggaaatctatcccgaccaggaggtcgtggagaggcaccgtgatggcggcgactggcgccgtcctgaatggtttctgacgcctccatgccgctcatgcggcattcaggggccggctgcgcactgcttgcctgcttctgtcaaaatcctcgttataaatggctgtgcaacacaaccgcaatcttctgctcccctctatctgaaaacggaaatgcagtctcctgtttcaggaaaagcaggatatacagatccggtacttagctacatcaaggaggacaatgtccgtcacatccgcctctattccctgtcgcctcttccgggaaaacaattccacgatgcgctggaaagaaaatataacgcgaccattctgtatatcgatcttgttgaaaatcatgggggttacaaagcagaaatttccggtgttatcaactactacgatacccagagatatgtgaacggcaaactggtaggcgacgtcattgaatcagttccggttcctacagtggctgttcagcttaactctgaaaaaagtgtaaatattgagctgccaagagggcgggctgcacactgcccgtcagtcctcaaatgggggcggatgctcaacaaagcgaaaactgccgcggaggattccggatatgcgaactgtgaaatggatgaagctctactcgctatgatgcgctcaaatgggcgcaataaggcctgggcagaaacgatggtgaatcttgaagcccgcaagctgattgaaacagctaaccgtgtagccggatttcacataagggatggactcacacgacttcagtttgtgcaggaaataagagatgtcattgaaggtcagtttgcgatcgccagacgggcaaagactgacgaagaatgcatggcctgcataaagaaccttcgtgaagaatctgagaatctggctgagcaggacaggttactgaggatcaagacggcgcaactgtacgcgaaggtcgaatttgtctggcagaataacaaaattgttggttacaccctgtctgctgtccatattgcgatatcgggtattgctctcttcaccgggctggcgatgataacctcaatgcctgcaatcggaatgttagccggtgctgtactggtaagcgacggcatcaatgggctctctcaggaaatcattaaccatttttcaccgccagggagtgctcattccgaaggtatattcggagatgcggcaatggccggcgctgaatttttaggattcaggcctgagacgggaaagccggggcatggcgcctgttcagatggatgcccagagactattaccgcaaagtag

SEQ ID NO: 4425 - DNA, 722 bp, Glycine max
  Peptide Sequence Number=SeqID_96110
gggagaccgcagataaagcacagcaggttccagcaaaccatcgtgagggccgagagcacgccgcctgccgtcaggaccagcaggaccagcagcgcggtgattacgcccggcggcatcatatcgccctgcatcatgcgggtggcaaggtcatacgtatagagctggctgtgggtcatgagggttctgacgatatcaggcccgaactgccacagcacgaccgcgctccaggcaaaaaacagggtaaaccagacaataagggtgcgtgccgcaccgctgaacgtgagcatgggaatatccttcagagagttaagaacaggggggagtcccgtgagggaggaggggcagcacccgtggtggtggtgatgctgcccccggtgtccgctgcccgggggcacagacggaggtcggcaggcgccccgttgtcaggagagtgttctcatttcccccttaaggcgcgtgccgccggttctcaccggtcgttaagtaataccagcatcgcggccagcatgaaccggcagaactctcccgaccctgccgccccgggcgcggtatcaaagcgccgtagcccgttaacgaaatgccaggggagccagctgtccgttacgttcacgagcagcagggtgatgatggcggctgtcagcatcagattcatgaagccgggcagtgaagacgccagccgttcaatttttctgcgcatggcgcctcccgcacctgtcagctga

SEQ ID NO: 4426 - DNA, 516 bp, Glycine max
  Peptide Sequence Number=SeqID_96111
aggcatcccccggttcagtcacttgacgtgccggaagctgtcagcgggggagctgtccgcacggcatcccatgccagccagcagctgtctgcggagagacgcggcagcggcgtcacggaggaaagcttgcagagacgtgaacgtaatctgaccgcgccggcaggtgccccgtcgcaggccatgagcgaagattttcgcagtggctcacaacgcgtgggtgagaaggcgtcgggtgccggcattgaaagtaacgtggccaacaaggttgcagcacaaagatctggcctgatggaaacaatcagggaaaatgacggtaaaatcgctgaaaataaaaccactgttcagacgtccagtgatatactcaggaatgagcatcagggggcggtcagaagtcagcagataggccgtactgaagaggatatcaggcagactaagccaaaaattgatgatgcagaaacagagcaattcaggcataagcttgagaagttgaggtcttcgcagcaaaaagcctcttaa

SEQ ID NO: 4427 - DNA, 1620 bp, Glycine max
  Peptide Sequence Number=SeqID_96112
atgacggaacacacttttacgctctcgcgaaccgagacggcgctgctgctcgtctgcgcctcaatgctggcggcggccgggatttacgcctggcttgcctgcgaccttgcccgcctgcccgccggtgtcgcttacggcaccgacgcgctgctgctgagcgggctgcagctctacccgctgctgtttctgtttgcccttgccggcggctttggctgcggcgcgctgggcggcatcatgaaccttcgtcagctagttatcagcgctctggcggcgctgaccatcagcagcccggcgctggccgacgtgcagggcgacctcaacggctactttggcagcctcggctttgacggcaacgtttcgaaagcacaggcgtggcaggggcaggccgcgggctacttcaccggcggttcggtttatctgcgtaaccccgtcaaacaggtgcaactcatctcgatgcaggtgccctcgctgaacgcgggctgcggcggcatcgatgcctacctcggggcgttttcctttatcaacggcgccgagctgcagcggttcgtgaagcagattatgagcaacgccgccggctacgcctttgacctcgcgctgcagacgatggtgccggagctcaagcaggccaaagacttcctgcagaagctggcctcggacgtgaactccatgaacatgagttcctgtcaggcggcgcagggcatcatcggcggcctctggccggtgtcgcaggtgtccaatcagaaaatctgccaggacattgccggtgagagcaacatcttctctgactgggcgtcatcgcgtcagggctgcacggtgggcgggcagggtgacagcgtcaccagcagggcgtctgacaaagacaaagaccaggtgctgaaaaacaaaaacctcatctgggacgcgctggggcgtaaccacctgtttgacggcaaccggcagctgaaggagctggtgatgagcgtggtgggctccatcatcttcaacaaggacgggcaggtcaccatcctgaccccgctggtcgacaaccgcgacatcatcaacgtgctgatgcgcggcgggaccgccaaaatctacggctgcgacgagcaggatctgtgcctcgggcccatgcccgccagcgtgacggtcagcagcgacgtggcgctggtgacccaggtccgcaacctgatgatttccatcgacagcaagctcagcgccgacaccggcctgtcggataaggaaaagggctttatcaacaccacctcggtgccggtgctcaagtacctgaccaactctcgcagcatgggcatgagtccgacctacctgattcaggtcgcggacttcatcgcgcaggacatgatgatccagtacctgcaggagctggtgaagcaggcgagccagtcgctggcgggcaaaaacttcccggagcaggccgccggcgaactgcgcaacaacgtgcaggccgcgacctcgctgctggcgcagatgaagctgcagtcgaccgccgaccagaacgcgctggacggcattgaccgcaacatgcagtacctgcagcagcagcgttctggcagggcaatgcacagcggggtatccgtcatgactgaagtctggaccatttacggcggtgacatgtggcggcag

SEQ ID NO: 4428 - DNA, 1572 bp, Glycine max
  Peptide Sequence Number=SeqID_96113
atgaagcgactgctactcatcctgctgctgttctccgtcgccggggcccgtgctgacgccgtcagcgatgcttataacgccggtgcggggtatgccggcgcgaacaaaggtcagggaacatcagcagcaaaaggcacagacccggcgtccgttattccgggctacacatcaagcccgtcgcagagcggctactacggtggggtccagggcggtgacgggggcatcagcgacaaggggcagaccgagctcagccacaacgaggcggggctggccatctccgactcgtccacgaagaacccggcggtgaccatcgacccgaacgccgactttatccagaacggcaaaaacgccgaggcgaacagcggctccatcgtggacggcacaaaccagcagtgcaccaccaaagtggtgtcaaagtcggtgtttgagaactacagctgcgaccgggacgtggcacaggtgcagacgtgtgcacggaccggaagcattcagatcacaggatcaaaggagtattacaacactgaactggtacttgattcccacaattcaacagcagtaatcctggatgattactgggtacgttttgactttaccgtgccggatgacggggtagtcagcactggtacatgggatttccgctatcccagaagtccaaattatcacggttcggatggcaatcgtctttggtacacgatgaaagccttcgacctcacggttgatcatatccagctaaataatggcgggcaggccgcgatcacaccgcagcgcgtaacaaaaggccagacagtctcattatacattcactaccacacggacggtcactacagtgaagggcgtgacggaatcattaagaacgcccgggatggcacgtttgtcatgaaaatgacctttcccttaactgccgaacgtgacacgaccagctcacaggttgtctggagtgagtcctgcggcttcgataaatcaaaggctaccggcacggcaggtacggtgtgtaccgacccgggcgggagccggacggtaaatcagaacggcaaagactatacgcagagcgcctcctgctggcagtactcggacgcctatatcgtgccggtcagctcaaccggcaactgcagcacgctgatggccaacaaaaactgcacggtctcagcccgcagctgtactcagacagaaggcggcacctgcctgcacgagcaggacacttaccagtgtcagaccacctacagctcagaagggctgctgtgcggcggtcagtacttctgccggaccggtgactgcagcggaaccgacggcgcgggcgacagcggttttgataccgcggtggccaagcttgccggcctggcctcggccggcgacgacgtcaaagccgatcaggtaaacgtgaaggcgttcaccggtcaggcgctctactgccgcaaggcaatggccggcttttccagctgctgcgtcgacaccggctggggcaacagcgccgggcttgccaactgcaacagcgatgagatggccatcggcaaggcgaaagccaaaaaggtcacggtgctggtcggtgaggcctgcaaccgggcggtgctcggc

SEQ ID NO: 4429 - DNA, 859 bp, Glycine max
  Peptide Sequence Number=SeqID_96114
tcacaacgcacgggggcagacggccccgcagaaagtaaaacgccacaacgcacaggtgcgtctcgatgacgacgacaaatccgggctgcgccgcatgaccgccgagttcccgctgtactcggagtcgatgatcctgcgcgcggcgctgcagacgctgctggcgtgcagcggagaggtccggtcggccatcgtgctggcctcactcacggacaaagatgtcggcgaggtcatgcgtcacgccagccgtgcagccggtctggcacgcgcccgcgcccgcgtgtcgcgcggaaatttcgctttcgccagcgagtattcgcgcactcggagagctgacggatcatctgcccgcggccggtttactccttatgctgctggtgctgcggatcgggctgatgcattcagcgttcgccacggaacgtcggttcccgtgccggcgccgttcggcagtccggcgatggctgcacgtgcgcttgcgcatgaggaaaccgcgtactggcagcagctgctggccgctttcgcagccgccattgaggcggaagggtacaccttcggcaccgatgcacgggcaaaagtggcgttacctcacgccgtgcgggcccgtgcgggtggggcaattgtgaaagcgcgctcgcggcacattacgccgctgcggagtgaagcggcgctggaagatttgcagctgcaggcagcggaggacggctacgcgggcagctgggcggactggtgtcagcggggcgcagaggcggccggctggtatgtcatcaggcgtgaggtgaaccagctgtctgacggtgcggtaacggcgactgatgagcctaaacctgacaacaggatacagactgatggactcttaccctga

SEQ ID NO: 4430 - DNA, 3174 bp, Glycine max
  Peptide Sequence Number=SeqID_96115
gatggcctcgctgattttatccagcgcctctgccggactggccagcacggcgagcagccccttgatgcgctccgcggagcgcttgatgctggtgacgttggcaaacgggttaaagcgcagcgtggcaccgtccagatagacgccgcccgcctgccggcagaagttttcatagcttcgccccatgtcgataacccagccgaagccgccggagttgagtgcctgtcgcagcgtctcctgaatcaggaagcttttgcccgccccggtggtaccggtcaccgcaatgttggcgtttgtggtgccgttctttttgctgaacatatcaaaaaaagccagttgcccccggtaggtgggcagcgggctgccgaagggcgacatctgccgctctgccaccaccggcatcaggttcaccgcgttaaagcttttgcagcgcagggtggcccccatgtgccgcatgtcgtcccacagcccctcctgcatcaggaacggcagcgtggtgagccagttgcgcagctgctgatagcggggcgccgacatttccagttcgttcttacggaacacgttgatggccgcgtcctcgcatttctgctgcgcactcgcgctgtcgggcgtaaacagggtcagattcagcgacatgtcgcacatggcaatttcgttgttcgccagctcctggcgcagcccccgccactcctggtaagcgcgctccgtgcccgggaacagcttcgcgtaagaggtgccggccttcttgcccagatcctgctctttgctgaacgcggcgttctggcttttcacctggtcctccacgcacaccgtccagctcaggataaacggacagggaatgccgagatcggggaagcgcatgttctgcaggttgtcggacgcctgccagagcgcgaactggagcggcgttttggtcatctgcaggctcacaatgcgcgtgctggtgacgtcagactccccttcctcacccagcgtccggtcttcgcgctgacgcgccgtggtgagccgcaggtagcccggatggacctcgagctccgtgctgggatccacgcactggcgatgcagttcctgatcgccattccagtgacggctgctggagaccacctgcccctggcgatagttcagctgttcacgcaccaccgaaagaaaggcttccggtccgacgcgcagggagtccatctttgcggccagcagcgacacgcgtacggtttcacgcagctgcaccgcctcgtccattgcgcgtatcccgccccgccccgcctgcccgtaaaccagaaacacgcggcggggcgccatgctgccctgccacatgtcgcggctgagtcccttgtccagcatctcgcccacgcacttgctggccaccatcagcacgcgctgaccacctgcgtggcgtcaggggcgcctacctccagtagccccggaccggtgttgccgcgagctcgcgcgggtctgcgctcagcgcctgccagggacggagcaggccacgctcagggcgccgcaggctttgctccttctgcgcggtcaaggtcgtccaggcgttctgatgccatgctggcctccatcgacatggtcggtggcggtgttcacagtcaaagtcagagtttgccgcagccggtgcggcgcaagcagtgcgcacgcgatgaatatccgtggcggccgggccgcagcggtatgagtgtgcgggttaatcggatggtgcgggttgccctggtgaaggcacaaaaattcgcgattcagtctgtatgcttctttttcataaaggttggcaccatctgcaggtccttaggcgcatcctcgctcatagcgcgatggctgctggcagcgggtacgttttttaccggtgcttttatgcgcgcccagacatctgcgcgcggtgtgcccggtgaaacctggcggatgacgtcagcaatgtacgccgccagccgctcaatcgtgatgtccgcgagtgcgggtacgtgcccggaattcattaccagcgggcgaattgccgcatccggaaccggtagggtattaagcctttcaagccggaacaccatattaccggcgggatgcgtcacgcggatgagcagcgcttccggcggagtgactgttttatcgggaaccataagcacctcagataaccacgttgctgttttacggatgtctgcctctgaaaagtgccaggattacgcgcctggccgcggaaatataatgagcgaacttaatgcagtttccggcaagccggttatcacattctcctgcgacgataagcagatttgtgaagaaatcattgcacttaaaacctttgtcttcagcctgctcaggatgatgcctgaagacatctccctggacgttgtcaaaaacctcagcggaaacggtgataatccccctctcaacaggctttgcaccgaaatggttgacgcaatgattgccacatccacacacgacgttcgtgtactgacacatccggatctggggctttctgacgtgactgacttttcgcggttttcatgcgttactcctgatgactcagagctggtgcaggataagcgttataccggcggtgaagcaggccagcaggctgaacagcgccagtcgctgaaaactcagctgcatacggcctccgcctgcgcgcttattggtaagagaggtacgttcatgatgatcgtatggtcgctgggcatagcgaagatgaggaaagatacccacagacctcccttcaaaggcaagtgtgctaataatgataaatccgctgaacaacgtagccatagcagcgtccccctgcggccacctggcggcttccagccgtacgtagaggaggaggtcggtcagcccgacaagggctgtactgaaaatgacggtccgccatccataaagtgctctcagcagacagaccataaatacccccgtaacagcaacaagaaggatgcccggaaatgtgggcagtctttgcgtcagatcaccgcagccgttaagcagagtgcagaacttcacgctcatcagattgatcaactgaatatcctcagtagtagccgggccacgtcggtgataatacggataggcacagtgacgctgatatcggccgggaatgactcagcagagctgatgcatcatcagcgttatcccggcggtgaagcaggccagcaggctgaacagcgccagtcgctgaaaactcagctgcatatggcctccgtctga

SEQ ID NO: 4431 - DNA, 702 bp, Glycine max
  Peptide Sequence Number=SeqID_96116
atgaatcttttaaggatatccctcatttttgatctgaaaccacggtgcggccatctttatgccgagttttttggcagcggcgctgcgtgcgatgacgcagccgtcattgttactcagcaccaccaccggcctgccgcgcaggtcagggcggaagagcgcctcgcagctggcgtaaaaggagttaacgtcggccagaccaaacatgggcatgatcacctccggcgggcacggcagcgcgagcctgggctgcagctgcaggcacttgaccgtgaactcgccgttgacctcggcaatcacgatgtcgccgtgagcggcttcctcggcccggtcaaccaccattacgtcgccgtcgcagaggcccaggtcccgcatgctgttgccgctggcgcgcacgaagaaggtagaggcgcgccggcggatgcacagttcgttcagatcgagttctttctcgacgtaatcctgtgcaggggaggggaagccggcggcgcacggatcggcataaagcggtaccctgaccctcggcgtaaaaatgggtggccagagcagcgtcaggccggcggtagagctgcccgggtcagggccggcagacgtggagaggcgtttccggtataccgttacagcccggcgctctgtggccgggctggttttgtgaaatgcagaataagcgtaacgtgcgtaagcagttcatgccggcatcggtga

SEQ ID NO: 4432 - DNA, 3758 bp, Glycine max
  Peptide Sequence Number=SeqID_96117
atggctttaccattagaagggctgcgcgttattgagatgggccagcttattgccggccctatggctggacgaatgcttgctgaatttggcgctgatgtcataaagatagagccccctggcaaaggcgatcctttacgcaagtggcgcatgttgcacaacggaacgtctgtctggtgggcagcgcagtcgcgcaataaacgttcggtcacggtggacctgcggcagccagagggtcagcagattgccatgtcactgctcaactctgctgatgtactgattgaaaactttcgacccggaacgctggagaaatggggacttagctgggaaaccctgcatgcgaataacccgaggcttatcgttttgagtgtttcaggttatggacaaacgggtccttatcgcgatcgccctggttttggcgtaattggcgaagcgatgggaggcttacgtcatctttcgggcgaacccaacagaacgccagtgcgcgtcggcgtctccatcggagactctctttccgccctgcacggcgtcatcggcgttttactcgcccttcaaagccgggaaaagaccaatcagggacagcaaatagacgtggcgctgtacgaatccgtgtttaacatgatggaaagcctgatccctgaatactctgtgtttgatcatatccgccagcccgccggcagcagcctgcccggcattgcgccaaccaatgcttatcgttgtaaagatggcaaatacgctctggtagccggaaatggcgactttatttttcagcgtttgatgcagattattgatcgcccggatctggccgccgatccggcactggcacacaatgacggacgtgtgaagcaggtcgaaatgctggacgcggcgattggagaatggaccagtcaacgcagcctgcaggaagtgctggcctcgttgaatgagggaggcattccggccggaaaaatctatgacgctgcagatattgctaatgatccgcattataaagcgcgcgacatgctgttaccggcgcagttatctgacggcacgccggttaccctgccgggtatcgttcctaaactgctgtctactcctggtagtgtcaggcatgcggcgccagaactgggtcagcacacggaagaggtgctgtctgagctgggtattgatgcgaaacagcgcatggtgctgaaagaaaagggggccgaagtctgcccacgtgatggcttacagaatgaggccgtttttgtagaaacgcaggacaagattgcgttaatcgatcgccttagtcagtgtggttttgtgaaggtggaagtcacgtcatttacctcgcctaaagccataccggctctgaaagatgctgaagccgtaatgcacgggatccgtcgaatgcccggcgtcgaatacagcgtgctggtgccgaaccagcgtggcgcggaacgtgccatggcctgccggattgatgaagccaatctggtcatgtctgcgagcgaaagccataacaatacgaatctgcgcatgagcagagaagcctctttctcgcagctgagccaggtggttcacgagctgagtaatacgcctgttgcgatcaacgtttctttgtcagcggcttttggttgcccgtttgaaggcgatgtaccgcaaaatacggtcctgaattttgtcgatcgcttcgccagcctcggcgttcgcggcgtgacgttatgtgataccacaggaatggctttcccgactcaggtcgcttcgctgagccgtatggtaaaacagcatttcccgcatttagagattaccttgcactttcatgatacccgcgggctcgcgctggctaacaccgttgcagcgctatctgaaggtattgaccgatttgattcatcaacaggtggcctgggtggatgcccctacgccccgggcgccagcggcaacgtctgtacagaagatatggtgcatatgcttgagctgatgggttatcagactaacgtcgatctgcctgctctcctcggtctatcacgtgaccttgagtcgcttatcgggcataaagttcacggcgcagttgtaaaatccggcatgagactgaaccagtttggtaataacagaattgcttttaccttcggtcagcaaaaaataaatgtccatgaatatggaaaagaaatagatcccaaagcgcatctccctgtgccgggttctcttgatatctgcctgataagctcttatccagttgaaaaaataaaagcgcacctcgagcagtttgatgtggcgcttgttgagggaccggtaacccgcacgggggcgtgcggtcccatcactaaccggggccgctatgaaaattgtgacactggatgcggggacgttgcccgttcagttagaaaacctcagagctgcgataactgggtttaccgggaaagcacgcgcgaagaggatgtcgtgtccgtactggataacgcgaaaattgttatcacaaataaagtcccgttacgtaaagccgcgctggaaaaattgccttctctgcgctttatctgcgttgcggctacaggctatgactgtatcgacacagactactgccgggagcgtggaatagtggtcagtaatgttccgggttactcgactcgtagcgtttccgaaagcgtgattgcttctgtctttgccctaaggcgcaatctggttgagtactgctgctcgtcacataccgagtggagtctgtcctcgcatttttgtctgcataagtcgcctatcggcgacattcaggaggcaacgctgggcattatcggacgcggcgatattggctgtgccgttgcccgcctcgccagagcgctcggcatgaacgtgttgtttgccgaacggcctgggcaaaacagtgtgcgggagggctatacgcttttcgatgacgttatctcacagagcgatatcctgacgttacattgccctctcactcctgaaacgtatcagatcatcaatcaggatgtgctggtacgcatgaagcccagcgctctgcttatcaacacggccagaggtgcgctaatcagtgaggacgatctggccgatgccctcaccagaggggaaatcgctggcgcagcgctggatgtgctggctaaagagccgccttctcctgaaaataagctccttcatgttcgacataaaaacctgttgattaccccccatattgcctgggcgagtcagacaggagtgaataaccttattaaaggaattaactacaatctggccggcatcgggcatttttatcccaatgttggcgtggatttaaaacccttaggggatacgtttatcaagctcattcgactgctgatcgcgcccattattttctgcacgatagtcagcggcattgccagtatgaaaagcctgaagagcgtcggtcaggaatgcatatcaatcccgcgtcgctggatggcggggccatcgcttcctatacaaaagcggcgcatgagcagtctgttaccggctttcttgacgcatattattcctgaaactgtctttggtgcgtttgctgaagggaatattctgcaggtgctgtttatctcgatcctgtttgcttttggtcttcagttactgggtgatttaggcaagccactgcttaatactattgatttagttgcgaaaacgtttttccgcatgctcaagattgtaatgtatgtcgccccgctaggtgccatgggcgccatggcatttaccattggtaaatatggtgtggcatctctctcctcatacggtgcgctgctgcctatggcgcttcctccgctacattcgcgaagagctggcactggtattgg

SEQ ID NO: 4433 - DNA, 841 bp, Glycine max
  Peptide Sequence Number=SeqID_96118
atgacgccgttccgacatgaagacgtcgcctcacttgcagcagatactgatgcccaagtcaccggtcaactcgcgatatgtaagggaagctatggtccggatatgaaaagtagatgtttttctggatttgaatttgcattccacataaaccactcgttgtctaacagggtcatgatggcactggaggaaatgacgccgaaggtcgagcagtactctattgacgagatgtttctcgatttaaccggcattgatggctgcgaggactttgagcacttcggccggcgcctgcgcgcccacttccgcggggtgctggcactgacgccggataatccgaagcgtaccgcgacgctgctggaaaaccagcccgtagaggagatatggggcgttggccggcgcatcggcaggcggctcaatctgatgggcattgaaaacgccctgcagctggcgcgcgcgcaccctgccctcatccgaaaaaacttcagcgtggtgctcgagcgcaccgttcgcgagctcaacggggaatcgtgcattcccctcgaggagtttgcgccggcgaaacagcagatcgtctgcagccgctcttttggggagcgcattacgacaaaagtggccatgcaggaagcgctgtgtcattacgccacccgggcggcggagaagctgagaaatgagcgccagttctgccggcgcatcagcgtttttatccggacctcgccgcacgcgcagggagaagtcttctacggcaacagcgccggcgagaatctcaccctacccacgcaggatacgcgcgacgtgatcggggtggccatgcgatcgctcgaccgaatctggcttgacggacgac

SEQ ID NO: 4434 - DNA, 144 bp, Glycine max
  Peptide Sequence Number=SeqID_96119
atggtgtgccctggtaccaggcaacagggccggccagtcaacccagctgacgcaggagccgtcttggggacagtggcgatgggtatgtatatcgccggctgcatgataatagccgttaagcttgagaaattcataacctactga

SEQ ID NO: 4435 - DNA, 909 bp, Glycine max
  Peptide Sequence Number=SeqID_96120
cagcggcgtgacctgacgtttctgcacgtggcctactctacacttctgcacatcagcgagcttggccggctgcgggtgcgtgaagtctcgcgcgcggcggacggccggatcatcctggacttggcatggaccaaaaccattgtgatgaccggagggctcattaaggctctgggcgatctatcctcgcagcggcttacggaatggctgacactttccgggctggccggagagcccgctgccttcatcttcggtcccgtccaccgtgtgaaccgggcgatggccgtcactgagaagccactctcagcccggacactggaagatattttcgcccgcgcctggcaggaggccggagatgccggcgctgtgcggccgaataaaaaccgctaccgtacctggtccggtcacagcgtccgtgtcggtgccgccattgatatggctatgaagaagtacagcaccgcgcagatcatgcaggagggaacctggaaaaagccggaaacggtgatgcgctatatacgccacgttgacgcgcatgcgggcgcaatgatcgacctgatgaagcagcaccagccagtacgatcactttctatcagcgcccgtataatgaagcatgagagaggtatgacgctcactcctgacgttaacctggtggtatcggacgcggatcggtctgacagtgcgatgagcgaagcaaaacggcaacacatcggcccctctatctgttggcctccggacgccatatcactcagtaataaagtttctgcaccaggctcactgcactgcaggagtgatgaggcccgtgatcatcacaggcccctatacgcgggatgtgatcggggtggcgatgcgatcgctcgaccgcatctggctaaacgggcaacgctacatggaggccggcatgatgctcaatga

SEQ ID NO: 4436 - DNA, 441 bp, Glycine max
  Peptide Sequence Number=SeqID_96121
atggaaaagtttcctgtgaagcttcagaccaaatttagagaagatccaacggttaacaaaagctgggcagcgtttttaccgaggaagcttcatgtagcttcctcaagaagcttcattaagaggcttcctcaaaaagcttcattaagaggcttcctcaagaagcttccccggtgttacacaaaatttcgtgctccttttctccctctccctccattcatcttctcccaccttcaagctcttatcatggctttctatggtggcgagcttcttcttaactcatcttctcctagaagtggcgtctcctctcaactcttcttcttctccattcccctgccattaaaattcaagaagcaaaggactccattgatgaagaagatccaaggcctacaagctccaaatggagctacatcgtgtggtatcagagcatcttcatctaggtga

SEQ ID NO: 4437 - DNA, 63 bp, Glycine max
  Peptide Sequence Number=SeqID_96122
atggaagttggaggttggaagttggaagtggaagttactagaagttggaagttggaaatggaa

SEQ ID NO: 4438 - DNA, 159 bp, Glycine max
  Peptide Sequence Number=SeqID_96123
atggtgatgattcctgacaagattaggtctattgatggatcaaaagagacgcttaagcttgctgttaggatcaccgatctttggttcattgggactcccaacaagtctgagcaagcggaatggtttttgttgattctgagtttgcatatttcagggtga

SEQ ID NO: 4439 - DNA, 462 bp, Glycine max
  Peptide Sequence Number=SeqID_96124
atgggtaaagtaggggaggtccaagaccagatgaaggccgccacggaacccttgaaagagcaaatggccccaataaggggggccttgataagcataagggagataaggggggtcaatggggttgtaatagccgctcccagcccctttgttgggggggccctgcccccccccccccccctatatggcctcaaccaaataaatcatccaacctcagatatggtaggtctagaaggcaaagagttgggaggtataggcagccctcatttagtgcgaaaaacaagcatgccttcccaccatatggcttgcctcccaactatgcacctcctaatgtggcatacactcccaatgaggatgtcaatatctccgctcccatactcattgaaagccgacaacctcaaactgatcatgcacatgtctctcaaaccatgggggagacacatgaaattccccaccacaatctag

SEQ ID NO: 4440 - DNA, 516 bp, Glycine max
  Peptide Sequence Number=SeqID_96125
atggctccaaagaaactctccacgaagaggtctagaagagacgccacaggagaaggatccagtgctgcctcagaggaggatgagtatatggactttcaggaggagatagctcgcaggcgttggacactgctagtgactcccatggccaagttcgaccctgagatagtcctagagttctatgctaatgcctggcccacggaggagggagtttgggacatgtgctcatgggtaaggggtcagtggattcccttcgatgcagatgccctcagccaggccgacagtttcgatgaggaagccaccgcccagctgttatgcataccggggcaggatttcgctcggaccgctgcagggaggcgggtgtggatcatgcgcaccagcatgaccactttgacccaaacatggatgacactgctgctcagcaatgtcttgcctagcgatcacaagtccgatctccctctacctaagtgccagttggtgtatgtcatcctgacatggatgagggtccatgtggcccag

SEQ ID NO: 4441 - DNA, 432 bp, Glycine max
  Peptide Sequence Number=SeqID_96126
atggcagcgcagttcatccatgatcgagtgaagatggagtgcctagagggagcttgggagaccctcgaaggcaatgcgaggtgccgattccggggcacgattcgattcacggctacttcattggtgcatccagaggaacccgcgcgcacgcttcagcgcactgtggagtggatattacccacgcctacaccatatcgtctagtggagccaatccaagtgatcgaggtgacgtcatctgaggaagaccctgaggaagacccagaggagctacctgctgatcccgctgtggatgctcttgactttctagagggtgatgaggacccactccctgtggtggactctcccgaggacgtcatgtcggcatctgaggcagactctacggaagatagtggccctggagagatggcgactagtggaggctcttcatcatag

SEQ ID NO: 4442 - DNA, 384 bp, Glycine max
  Peptide Sequence Number=SeqID_96127
ggagtttgggagaccctcgaaggcaatgagaggtgccgattccatggcacaattcgactcactactacttcattggttcatccggaggaacctgcacgcatgcttcagcagcctgtggagtggatactacctacacctactccatatcgactagtggagccagtccaagtgatagaggtgtcatcctccgaagaggatcctgaagaggacccagaggagttacctcctgagtctgctgtggatgctcttgactttccagaggatgatgaggacccactccctgatgtggattctctagaggatatcatgtcagcatctgaggtagactctacagaggagagcggccctggagggacagcaaatagtgaagactcttcatcatag

SEQ ID NO: 4443 - DNA, 108 bp, Glycine max
  Peptide Sequence Number=SeqID_96128
atggtttcgcctaagcagaagcaaatcggagtatatggaatgggatgtgaatcatcgcattcaagcaggatggatgaaatggagaaaagcatcgggggtgttatgtga

SEQ ID NO: 4444 - DNA, 615 bp, Glycine max
  Peptide Sequence Number=SeqID_96129
ggctacacgccctcaccttgggtactagttaccctcaccgttgagaggactacacgtcctcgcctggagaggactacacgtcctcaccatcagagggctgcacgccctcacctccagaggactactgtcctcgccttgagagggctacacgccctcaccttggggctgcacgccctcaccttcagaggactacacgtcctcgccttgagagggctacacgccctcaccttgggtactacttaccctcaccgtagaggactacacgtcctcgccttgagaggactacacgtcctcaccgaacttcagagggctgcacgccctcaccttccagaggactataaaggactacacgtcctcgccgtcaaagggtcatgtgccttcacctttgtagggctacacgccctcaccttcagaggactacacgtcctcaccatcagagggctgcacgccctcacctccagaggactacacgtcctcgccttcaaagggtcatgtaccttcaacttcagaggactacacgtcctcgccgtcaaagggtcatgtgccttcacctttgtagggctacatgccctcaccttcagaggactacacgtcctcacctttagaggactacac

SEQ ID NO: 4445 - DNA, 282 bp, Glycine max
  Peptide Sequence Number=SeqID_96130
atgccagtgtcggccgaaacacaacttcggttgagctcgcacagaaaaacaacgccgacctatattacttatcaaggtaatccttgtggcgtctatcctgacttatcttccttcaccggaagtggcgtctaccctgacttatcttccttcaccggaagtggcgtctacccagacttatcttccttcaccggaagtggcgtctaccctgacttatcttccttcaccggaagtggcgtcatccaaaacttcgtagcctgtatcaaacaatccgttcctaatcag

SEQ ID NO: 4446 - DNA, 189 bp, Glycine max
  Peptide Sequence Number=SeqID_96131
atggtatggcatcatcagggctcaggaggagtgagctcatcctccccctctattgttgctgctgctggctcaggcttctgggctgtggaggacccaccccctccagaaggagaaggctgggctcctggccaggccacctatgcgtcaaactcatccatgctcataatggatggcaagcccaagccctga

SEQ ID NO: 4447 - DNA, 150 bp, Glycine max
  Peptide Sequence Number=SeqID_96132
atggctgaccagcaggcgaccaagtccgaagccaaaggacatcccctttatccccgaaccgctggccaaaccctgacatatatcatgaccagccgttctacaagccttgagccaaaatcccaacttatcataaactttgacccagggtga

SEQ ID NO: 4448 - DNA, 267 bp, Glycine max
  Peptide Sequence Number=SeqID_96133
atggctctattcgacacaggggctgactcaaactgtattttagaaggattaattcctacaaaattctttgagaaaacctcggagaaacttagtacaacaaatggctcaaaattaaaaattaactttaagttatcaaatgcaattattgaaaaccaaggtcttaagattaacacaaactttcttctggtaaaaaaccttaagaacgaggtaatcctaggaactcccttcataagagctttatttcccatccaaatatctaatgaatga

SEQ ID NO: 4449 - DNA, 933 bp, Glycine max
  Peptide Sequence Number=SeqID_96134
atgttgtatcttgtattcttgaatcattgtcttgactttagagggctacacgtcctcgccttaagagggttgcacatcctcaccttcagaagattacaggtcctctcctttaaaaggctgcacaccctcgcctttagaggactggatgtcctcaccttcagaggagtacatgtcctcgactttagagggctacacgtcctcgccttaagcaggctgcacgttctccccttaagagggctgcacgtcctcgccttaaaagggttgcacgtcctcgccttcagaggactacacatcctcggcttcagagggctgcatgcccttgccttcagaggactgcacgtcctcgccttcagagggcttcacgtcctcgcctttaaaggactgcacatccttccctatagagggctgcatgtcctcgcattcagagggttgcatgcccatgccttcagaggactgcatgtccacgcctttagagggcttcacgtcctcgccattagaggattgcacgtccttccctttagaggactgcacgtcctagcctttagagggctacgcgccctcgccttaagagggttgcacatcctcgccttcagagggctgcacgccctcacattcaaaggacttcacatcctcgccttcagagcactacatgtcctcgactttagagggctacacgtttttgccttcagagggctgcacgccctttccttcagaggattgcacatcctcaccttcaaaggactacatctacttgactttagagggctacacgtcctcgccttaagagggttgcacatcctcgccttcagaggactacagagggctacacgtcctcgccttaagcgggctgcacgttctccccttaaaagggctgcacgtcctcgccttaagagggttgcacgtcctcgccttcagaggactacacatccttga

SEQ ID NO: 4450 - DNA, 321 bp, Glycine max
  Peptide Sequence Number=SeqID_96135
cgcccaatacgcaaaccgcctctccccgggggtcggccgattcattacagcaggtggcacgacaggtttccagagtggaaagggggcagggagcgcaacgcaattaatcgagttagatcaatccttaggcaccccgaacaaaacactttatggttcccccccgtatggtgtgcggaattgttaagggatatcacaatcacgcaccaaacaggcaatcctccattctcaccaagctcgaaacccccctcacgaaagggaacaaaagctggtaccgggccccactttgaggttgggggtatcgttacgcgtgatcccaagtga

SEQ ID NO: 4451 - DNA, 321 bp, Glycine max
  Peptide Sequence Number=SeqID_96136
atgggtaagaccaacgactggctggattctaaccagctggcggaagacaaagtgcgtgacgcgctaaaaccgccatctatgtataaagttatgttaatgaacgatgattacacgccgatggaatttgttattgacgtgctacaaaagttcttttcttatgatgtagaacgtgcaacgcaactgatgcttaccgttcattatcgtggcaaagctatctgcggcatcttcacagccgaagtggcggaaaccaaagtggcgatggtgaacgactatgcgagggagaacgagcatccgttgctgtgtacgctggaaaaggcctga

SEQ ID NO: 4452 - DNA, 159 bp, Glycine max
  Peptide Sequence Number=SeqID_96137
atggaagacgtgcaactattcaaactgcaagaacaaggaggaatccaagaagacccagataactgtcaattttttcaatgggttgaagaagaaaaccaagtttctaatccttcttctacaacaagagaatcaatgatagtggctgatttgaacctataa

SEQ ID NO: 4453 - DNA, 186 bp, Glycine max
  Peptide Sequence Number=SeqID_96138
atggacattgaagaggatgttgaaatccctctgattttgggtcgtcccttcatgctaaccgccaattgtgtggtggatatggggaaagagaagcactcacttgacctgaacgtttgttccaagatggatgaagtagagaacaagatggttctgatggccaaagccaagcttgctccagacccttga

SEQ ID NO: 4454 - DNA, 818 bp, Glycine max
  Peptide Sequence Number=SeqID_96139
atgggttggcttcaacgccatgctggcgctcgggttgatgctctccgttgtcgcgaccgtatcgattatcagtatctcagtgcgtgttcgccgtgtacgccccctactcagcagataaagttctcaggcagggtgacaggaacatcgcgatacgtgaccctggttactgattttcccccttcgctggaacccttcccaaacgcttgctataggtcaattacccctgccgaaacatggcataacaacaggcaaccggtggttgctataacgcatgcgcacagggagacacaccgcaatgcacccattactcaaacgttcgctgctgtttgtcggcgccattctggtggtcctcgccctcctcgtctggggtattgggctggagacaatcagggcgcgccaggtagacctgctctatctcggccaacagcacatgattctggttttctcgtcgatgttttttgccctgctggtgggtattccggccgggatcctgctgagccgcccggcggcgcgggggatcgccgaatacgtgatgcaaatcttcaacatcggcaatacgctgccgccgctggccgtgctggcgctggcgatggtgcaaacgggattgggatgacccgatggcagcgtctgcgtcaggtcgagctgccgaacgcctggccggtcatgctctcggggatccgcatcgccaccgccattaacgtcggtaccgcgccgctggcgttcctgattggcgccagcagctactgcgagctgattttccccggcatctatctgaacgatttcccgaccctgatcctagacgcggcggccaccgctct

SEQ ID NO: 4455 - DNA, 342 bp, Glycine max
  Peptide Sequence Number=SeqID_96140
atggataaagttgatatctttgttcctcatcctctcacaaacgcatctttgcttattcaactttcaccggaatgtgggtgcaagccattggtctatttgcttaagcgacctgtgctcctgagtttggacttccaagaccgttcaatcagagattactcgtcttgcacgttggtggggggacaacccttcccttgtgttcaagaatcccctacaacaagagacccacggtctcttaatcccttttcagaaataagaataagagaagaagaggtctctcttaaaagagatggattgtacaatgaagatcaatcaaaattctttattgaatatgcaagtggttga

SEQ ID NO: 4456 - DNA, 420 bp, Glycine max
  Peptide Sequence Number=SeqID_96141
atggaagggttagtggacctagcagcgattgacgctttcctcacctttcatcatggcaaggaaagcccggtcgtcgccattttggccatgtatgacacgttcgaccgaggatgtgaaaagagcggcgcaagaattgtttgttgtgcaccaactcttggctaccccatgagaggagcgccattagacgaaagcatcacgcctttcatcgcacggggttttagtgaccataacgtgagggtactccaaggagttcgcaaggcatgggatgcggcgactggattggctcccaaaactaaagacttgagagacgatgagtttaaagcttcgaaagaaagtgataaggtacaagccctaaaggcggagcttgaaagagcccgggtagtcgaagagaagttcaagtccatagccatcaaagtctga

SEQ ID NO: 4457 - DNA, 574 bp, Glycine max
  Peptide Sequence Number=SeqID_96142
agttgtcctctttccaaatgtggaagggttagtggacctagcagcgattgatgctttcctcgcctttcatcatggcaaggaaagcccggtcatcgctattttggccgacatgtatgacacgtacgatcggagatgtgaaaagagcatcataagaattgtttgctgtacaccggctctctatgtgtggctggaaggaagaactgggattctgtccttgtgcaaaggatttttgaatgttcccttgatgggaacaaggggttgtattaattataatcccatcctcaccaaaagacaacttggctaccccatgcgaggagtgccatcggaggaaagcatcacgcctttcatcgcaagaggtttcagtgactccaacgcgagggtacttcaaggagttcgcaaggcatgggatgcgatgcgaacgaaggacaaagagcttaggggaagcagtaatgggatcatcggtgactatcgaaagtggctgagagtctggacacaaggattagattggctcccaaagctaagggctgcgagaaacgaagaggctgaagctccggaagaaagtgaggaggtataa

SEQ ID NO: 4458 - DNA, 297 bp, Glycine max
  Peptide Sequence Number=SeqID_96143
atgaatttcttgacgacacacgataaagggtgggaacatgagttaagtccttacaatcaatatgaagaagaaagaactcttaatcttgaaagtgtgtttgaagaattcagggcataccatgctaactcaaaagctaatcaaaattcaatgaaaaatcatgaaatttattttgaaaaatactttgtagaagttgaagctcaagagaaaagccctgtaaaagagcatgagtcaagagaaaaagatgaggaacaagcacaacaacaatgggagaagtactcaatagtagaaaaccaatag

SEQ ID NO: 4459 - DNA, 156 bp, Glycine max
  Peptide Sequence Number=SeqID_96144
atgttgcttttgatgaaactaacccaattaggccaagaaaggaaactcttgatgatatttcagattcttaagaaggtatggatattcatggtgaagagcagaaaggcacaggaaagggaaatgatgaagactttcaaattgatgaaacaaaaacaa

SEQ ID NO: 4460 - DNA, 417 bp, Glycine max
  Peptide Sequence Number=SeqID_96145
atgaaaggttacaagtcattcaaggcacatgtaatcgattaccaatggtttgaaagccacaaggtccaacaagctttaggtgtggcaaagccttcaatagctagttacattagccaggagatactggcagagcaagaagctgatagagtgcatggattacctaggcagcctatggtgaagttcgacaatatggtggttatatcactgtcaatgaaactcaaggaagagcattgttctattggttttttgaggccactcacaaaccagaacaaaaaatcgttctcttatggcttaatggagctatgtcaaagcttagagggcaatgttggtgcactcacaaattttgaggtccttgatttcttacgagctaaaggagcttcaaaggatccaacaagagttattgccaaagtagcatag

SEQ ID NO: 4461 - DNA, 303 bp, Glycine max
  Peptide Sequence Number=SeqID_96146
atgaggatttttacattgatgttgtctatgttctgtttcttttttgttccccagaattcagttggaggattgagatgttatgagaatccaaagaataagattattgtagtacatactgaggaaaaggaaatctggggtgcattcttcaagaacagagaatcagtgatcagtcccaatagtaatataacgttaatgtcagttgagactgcatcaggtaccaagggaaaatgtgaggtaatcttagagcttaagaagttagagttgaatatccattatgtaactaggattgctagttgcaactaa

SEQ ID NO: 4462 - DNA, 243 bp, Glycine max
  Peptide Sequence Number=SeqID_96147
gaggtgcaagagcatatgaaggccgacatggaggccatgaaagagcaaatggccacaatgatggaatccataatgagtatgaaaagagtgatagaggtcaacacggctacagccattgccgcaagtactgccactaaggttgcgacacatggcaagcctcctacgacattgacaacaaggaatgtctacatcaatgcagctgtaggtggttctggcatagccgcaacgacgaccggttgctaa

SEQ ID NO: 4463 - DNA, 435 bp, Glycine max
  Peptide Sequence Number=SeqID_96148
atgaaaatctttattcaatcaattgatcttggtgcatggaatgtcatcattaaaggtcctttcattcctactaaagaaatgaatggtgaattaatacctaaagaatgggatgaaataagagatgatgggaaaagaaaagtgcaagatgaacaaaaagcaaaaaatattctaacttctggtttatcttctgatgatctcttcatacttcaaggtgcaaaagtgcaaaggaaatctagaatatggttgaagtcactcatgaaggcacaacgaatgaaatcaaaggacaaaaaattcttcaaatcctccaagaaggttgacaactccaacaacaacagctacacatgttttgaatgtggtaagcaatgccacattaaatctgagtgtcctatctaccttagaacacatgatggtgaaaataaaagggaagaaggatag

SEQ ID NO: 4464 - DNA, 198 bp, Glycine max
  Peptide Sequence Number=SeqID_96149
atgtctccttcacctctaggatctcacaatcactcaaactcatctcaagctctcaaaccggctcctgcttcaagctctggtggctttgttcgtgctcgtgcgcttagcgcaattatggaacgcttagtgcacattagtgaatttcggcttagagtgtgcctttctcgcttagcggatgaactgaagcggtgcgcttag

SEQ ID NO: 4465 - DNA, 465 bp, Glycine max
  Peptide Sequence Number=SeqID_96150
atgtcttcatttggaagcgttaatggccgtaggatagacgacatgagtgatgtgtggtggctgaggttgaagacgaaggtacttccgcgagaagaaccttcttctgcgcgtgtggaaggggaagttggatattgtagcagaagaaggggttcttccacgggatcctgtggaagaaaggtaagaaggcttttccgcgggttccggcggaagaaggcgaagaaggttcttccgctaggtccagcggaagaaggttctgcaaattcttctataggatccagcggaagaacctgcggaaccttcttccgcaggcaacatttcctggtcgcggaagaacctgcggaaccttcttccgcaggctacctatccttctcgcggaagaacatgcgaaacttctttcgcggaccatgttttgctatttttttgttttttttcttgaaaattttgtctgaaccaccaatttattga

SEQ ID NO: 4466 - DNA, 507 bp, Glycine max
  Peptide Sequence Number=SeqID_96151
atgccctatggtgaacaccggggagtcaaggcctttgacttgatatcgtcgtacaccggccagctcagatggggtcagattgtggtgcacgttcaacctgaaccatttggtgccttcaggggagttctgtgtagttcctggacaggtagcgccagactacatggagtggtttttcggatatcgtacccattcatcacgcggaccgaggagactgctgcgtcgagacatccacctcctcctcatcatgaggagttcgtcgagccacccatcctcgaggtttcagtcgcgaccgatctccctacgcatttagtggttcactgcgaaggatgtcaggggatggctcaggatttaggagcgattgttgaggatttggagcgggtcatcaacctcatgatggtcactgagggcactgacttacatgacatcatgactcgttgtctgaggagagctagaggtgatgccgcagatggaagtcttaggccgtgccagagacgccacatagattag

SEQ ID NO: 4467 - DNA, 406 bp, Glycine max
  Peptide Sequence Number=SeqID_96152
atgaggaagagggggaatggactactgaggatcttgcttgatgatatggtggggactgagtgcttgtgctgtgcgatttttgtcggtgctggttgtgcttgtgctttgctttggtgtgatatttgtcaactaagtctcgcggaagacgtcttccgtgagattcaacggaagaaggtttcttccgttgttgaaattacacctgcagaagaatgcttcttccgtggagtctcgcggaagacgtcttctgtgagactccacggaagaagcattcttctgctattgacattacaactgcggaagacagcttcttccgtggagactcacggaagacattttccgcgagcactcatggaagatgtcttccgcagttgtgatatcaacagcggaagaaagcttctttcgtgga

SEQ ID NO: 4468 - DNA, 336 bp, Glycine max
  Peptide Sequence Number=SeqID_96153
atggttactggcagaggtgtgggcagaggagatcgtgatgattccgatgatgctccacagcgtcgatggtctactgcatccgcacggaagctgcgagtcactgtgactgcgacacacgatgagccagtggtccctgcgcctgatgttgagcctgatgtatttccggatgacccgatggcaccaactgattctgagaacattgtgacagacattcctgcggacacaggcacagaggctgttgaggatgagcatgagggatttccaggtggtccgagtgacccatctgtgttgacccaatatgcggatcacgttgcttgcagcatatggacaggagaa

SEQ ID NO: 4469 - DNA, 744 bp, Glycine max
  Peptide Sequence Number=SeqID_96154
atgaagaacagaagagcagaacctcgtggaagaatggaagaagcgcactcgaaggagggagaagcagtagctcgctctggagaagcacaaccacctcgcgccgaagaagcaaagggactcgcggaagaaagaaggagaagaggctcgcggaaaagaaagaagaaagaagcagaagaggctcctggggttataggaaaagcctcagtgagagaaattagtggtgatgcgaatgaaggccctcaacggcaaaggcccacagcatctgcacgtaggcaacgagaaactgcatttgttgctgaggatgttgagcatttggatcatgcagctgacaaggcaactgctgatgatgtagttacagatgccgagggttttctaggtggaccctacgacatattagttttgatggactatgttcatcatatggcaatgatagtttggaatggagagttgtcctcctatggaaggaaggttgagaaatttggaaggcctgctccagcgattgaaggcttagtgaggtggcataaggaaactagtagtttccatattctagtaagagatgtcactatctccctggatgatgtgacatcattgctacatctgcccattataggcaccttccatagctttaaggctcttcatatggacgaaatcgtctttcggttagttgaatttcttgaagttagttcagaagaactaagagctgagacgttacaatgtcatggagcatatgttcagcaatcctag

SEQ ID NO: 4470 - DNA, 330 bp, Glycine max
  Peptide Sequence Number=SeqID_96155
atgagtaccacaaattcaatcaccgatttcattcactcaaaacatgggagtgataaatatgtaaagtatgatgttcatattgatgatgatgaagataatttgagtgaaccagatcagacagagtttgtgggaacttttgttaatttgttccatggacaaggccataatatcaaagtaactagctttaaggtagggatatcgaaagtgatcgattgtttagaagctgaagaagacgatgttgtgctagttactttggtgcctaaggttggaaaaggagatgtcatcataggaggcatcaaagttgagtttattccaaagtacaaggattag

SEQ ID NO: 4471 - DNA, 150 bp, Glycine max
  Peptide Sequence Number=SeqID_96156
atggttagggcggaggaagagacgagagagaaggttggggagaaagagagagagattgaagagatgagacagagaattgaagatgtagagaaagttagagttgtggaaatgaaagagaaaggagagagtggatggaatatctgtgagtga

SEQ ID NO: 4472 - DNA, 516 bp, Glycine max
  Peptide Sequence Number=SeqID_96157
atgtggacaagcttacggagcggggcaagtgcacatgttgggagtgtacatgcagcgctcgtgggtgattgtgaacgccaccgcgatcctgctgtcgctcctctacatcttcgcggggcctatgcttacagctataaggcagacagaggcgatttcggcagcggggggggggggggggagttcgcggtgtggatgatcccgcagctgttcgcgtacgcggtgaactacccggcggcagagcaggatcatggtgatggcgtggatcgcggcggcggcactggtgctgcacactttgttcagctggttgctcattctggagttctggtggggtctcgtcagcgccgtcgtggtgctgaacgcgtcgtggtggttcatcgacattggacagctgcacactttttcttcaatcttatagaagacgacacaagttcgccatcagagcttgaagatgagagggcaaagagtgtttcttctctctcccgcgctcactatgacggcaatgaagagtcaggatag

SEQ ID NO: 4473 - DNA, 1344 bp, Glycine max
  Peptide Sequence Number=SeqID_96158
atggaggaaaagaaagagggagagaaagagagaggggggagcacaaaattgaaggaagaaaaagggagagaagttgaactttgtgttgtgtctcacaagactctcattcatcaaagctcatacttagctcatgggctcgaaatctaccctaagactcatgagaaccctagggccttcccttggatctctagcccaatcaacttggagtcttctacccaatgcccttacggagtaggattgcatcactttgtcgatttccagctagtactcatgcttgaggagtttgaaaagattgttggatgccctctgggaggaactaagtctttcttccctttgggacactctacgtccatgcctagattatccaaagtgttgggaatttcggtaactgaactcagggagaaggagatgaatgggaatggagttaagagcttcccgaagaaattcatggaggataaagcgcgagaatgtgcaagtaaaggagaatggggtactgtggttgccatccttgctgatgtgtactgtactttggacttgagctgggagaagaaaaacactagagtcatctgttgtttgcccacactctatgtatggatggtgtctcattttgtgatgcacaatggtaggcctacttttccattagaagatttctgcgtggcgccagataagagcaagattaattgggaggagcttttggctagcatgtcaagttcaacaatttgccggttcccaaggtgggaggagatgcctaatgtgttatatcgatgtggagctttccctaacgtccctctgatgggaacaaagggttgtgtcaattataaccctatgcaagggatcaggagggacaaagagttaaggaagagagatgagggtgttgtaggtagctatccacagtggttggagaatagggtgcgagaagtcaagccgcctaagaagacaaatggtgaaagggtagagataaatgtacctattgagatgggggaggaaagcttgaaggagaagctaggcatgatggaaaagaatatgctagtaattgtcgatcaatatgagggtgaaagagaagcaaatgaggaagtgatagagctactgcatcaggaaagcatgaagtggatgaataggtttgtgctcacgctaaatgagagtcaagaactcctgaaactgctagctagagccaagatgatggatgatatgtactctactcccgatgaagttcatagtctcttcgattattgccagcatatgcgagcatccgttaagcgcaacactcctgggctaagcgcgaggaagaatctagaagaagatgagctgtataggtttgctaagcgcacggcttcatctctctaa

SEQ ID NO: 4474 - DNA, 483 bp, Glycine max
  Peptide Sequence Number=SeqID_96159
atggcccatgggctgaatgcagtaactgcacctaatgtggcctatgggcggaatacgaatgatgtaagattggacgcaaaaaattttcttccgaaaagacattacaactggggaagaaaaaaacttgtttcgaggagtccacggaagacgtcttccgtgagattccacggaagaagctgtcttccgcagttgatattccgcgagactccacggaaaaaactgtctttcgcagttgatattacatctgcggaagacaacttcttccgtggagttgagatggacgaagatcaatgggcatattacagtgcgatgtccgaagaagttgatatggattttcaaaatgaagaagaagattgtggtgtgaatcgagcacatgttaattgttcacatgcttttaatacttctcaagtctttgaaacccgagaagatgttttgaagttggatctcgcacgcttgcccatggaaatggttttgttgcagtaa

SEQ ID NO: 4475 - DNA, 189 bp, Glycine max
  Peptide Sequence Number=SeqID_96160
atgaagaaacaacaatggaagagaagcagaagacaaaggagaagaggtgagaggagacaccatccactagggaataagccatggaagaaagagcttcaccaccaagatgagccttggataagaagcttggagaggatgcttcaatggaggaaaagaaagagggagagaaagggagaggggggagcatga

SEQ ID NO: 4476 - DNA, 1008 bp, Glycine max
  Peptide Sequence Number=SeqID_96161
atggctcctactactgttgctactcctactcctttgcctccccctgctgttgttgttcaggaggccactcctgttgctactgaagttgttgtaccaactacttatgttggttttgttgtggcacctttactaaatgttgatgtcgcaaccactagtgctcccacagtgctgcctccttccttgttgactctgatggtttctccctctgttgttttggcagcagtggtgtcgccttcttcgtcctctcaccttcatgtcttccttgatcactttgttgatgtcgcaaccactagtgctcccacagtgctgcctccttccttgtcgactctgatggtttctccctctgctgttttggcagtggtggcatcgccttctttgtcctctcgccttcacatcttccttgatcacttgtacacctctatgatgctgactcactgtggggtgcaacttacaagccggagtagaagacccgaaatgctattgactcagccaaagtctttctccaaaggtgtttggcaatttttaggagaatggatagtgacaccaagaggctgtgtagaagctggcgtccttcgaggccgtaaggtcaaaccgccaattgacttccaaagtagagaagaagaacttgggcggcaaggtggagagcttggcggttggaaggatgagcttgccaaggtggttgaagagttagaggccctgcttgaggagttagagtctagtttcattgcaaaagaccttgacttaggtctctttgatcccttcaaggatatgaaggatggtgtcctgcttgatgaggaagacattgtagctgaggatgaggctattgatgaaggggcattggttagaagactccaagtagattgggctagagatccaagggaaggccctaaggttctcatgagccttagggaggtgagcttagctattagagagcttctcaaggaagttttctcaaagaagcttatcaaggaagttttctcaagaaagcttctcaaggaagctacctag

SEQ ID NO: 4477 - DNA, 189 bp, Glycine max
  Peptide Sequence Number=SeqID_96162
atggcctcctatggtgccttgacgatgacaatttcccctatcagagtagggaatttcatcttcaaatggggtgtggagactacggctccaagctcgttaagtgtcttctatccaattaaggcaaagtatgatgtgtctacgtcaaccaatagatatctaatggtgaagctcctggagaggttgccctga

SEQ ID NO: 4478 - DNA, 114 bp, Glycine max
  Peptide Sequence Number=SeqID_96163
atgaccgatgttgaagatgtttcctctagtgcaaagcctctggtgaacgaggtagaagcctccctctttgacatgctcgggttattacttgttgattcaaaacttgtagtttag

SEQ ID NO: 4479 - DNA, 273 bp, Glycine max
  Peptide Sequence Number=SeqID_96164
atggcagacgagcaacaccagaggatcacccttgaggattattcaagcagctcagtaccgcaattctttactagcattgcacctcctgaagggaatttattccaaagattacctaataaagacccctatgcacatttggcaacgttcattgaaatatgcaacactgttaagattgtcggtgtgccagatgaagctattagactcagcctattctcattctcattggcaggagaggccagaggtggcttcacttgtttaagggtaacagtttga

SEQ ID NO: 4480 - DNA, 318 bp, Glycine max
  Peptide Sequence Number=SeqID_96165
atgaggtcctttaatggtgattttccaccatggagatgcagcggaagacaaaggagaagaggtgagaggaggcgccatccactagggaataagccatggaagaaggagcttcaccaccaagatgagccttggataagaagcttggaaggaggcttcaaaggaggaaaagaaagagggagagaaagagagaggggggagcatgaaattgaaggaataaaagagggagagaagtggaactttgaagtagcttccttgagaagctttcttgagaaaacttccttgagaagcttctttgagaaaacttccttgagaagctag

SEQ ID NO: 4481 - DNA, 402 bp, Glycine max
  Peptide Sequence Number=SeqID_96166
atggagtcagggacgacggtggtttcttcctctgatgctattgtgagtttcgggcttggatcgttgagtcccttctctctgcagaaagctatctcttttggggttcgttggacaaatggaggttttggtttttggtttaagttggtagggtggcttgatggggacgaaaagttgttggggcgtgccaatacctctcggcgtatctctggtgccaagctgaaaatgaagcagcttaacataaatggaggaggcaggactatcacgcgattggctaatcgctcaaactcaatcaggtattcgttaaccgttccatgctgtgataacttgaaaagagccccctttggatcttcacaaaatgatggcgcaaacttggattcaagagcctgtaggaagtcagactag

SEQ ID NO: 4482 - DNA, 189 bp, Glycine max
  Peptide Sequence Number=SeqID_96167
atgattaacagtgctttgaagggattcaacaataatcacggaagtaaatccaaggcaactgctaaatggattccagttaaatattttactgatccaagaccatttgaacccgagagaataaaggcaattcgcatccagtggacaagatgtttactaagagttaaaaatgatgcactaagtagtgtttaa

SEQ ID NO: 4483 - DNA, 543 bp, Glycine max
  Peptide Sequence Number=SeqID_96168
atggcttctacttgttcttcctctttttccgttaccaaaaaatatgatgttttcatcagctttagaggagaggatactcgcgctgacttcactagccatcttcatgctgctctgcgcagaaacaacatcgatacatacatagactacaggatccacaaaggagacgagatctgggtagaaatcatgaaagcaatcaaagagtccactctcttcttggttattttctcagagaactatgcgtcttctagttggtgcttgaatgaactcatccaactaatggaatacaagaaacatgaagatgttgatgttattccggtgttctacaaaatagatccatctgaggtacgcaaacaaagtgggagttatcacatggcattcgcaaaacacgagaaggatagaaaggtgacggaggacaagatgcaaaagtggaagaacgctctctatgaagcagccaatttatcaggcttcctttctgatgcgtacagacaaagtgatgtagtgaaacgtaagggaaaaggaaatgaggattcaacgtctcgctga

SEQ ID NO: 4484 - DNA, 432 bp, Glycine max
  Peptide Sequence Number=SeqID_96169
atgcataaggcattgcgattaaatgctcctttaccatatccacatctagtcactcgtttccttcaacactttaacatccctcttgattttgaaccttatgttccaatcaaaagatccttcttgataggtgctgctgtgattgcatcttttggttaccgcaaagagcgtgatgactcttgggtaaaaaagggtgctcaaatcaatgatgatgaaggacacttaccagtaggagaggattcctctctccttcagagtattttggacaggtttgatggacttcaaacctatgttggtgaaaggtttgatgctttggaacaacaagtggacatgcgatttgacaagatggactcaaggatcaccaaggttgaaggagatgtcacttacatccgcacatgctttgatctaccaccaccaccaccatcatcatcttag

SEQ ID NO: 4485 - DNA, 447 bp, Glycine max
  Peptide Sequence Number=SeqID_96170
atgtcatggttatccgcacccttgctatccagagaaaatcgagtccgatggcacgcagagaaaactcatgaggcaaacaagtctgatggtatccgggatgatgatggtcgtccgtttctaatttggagattttttccgccccttttgtcatccagagacaatcaagtccgatgtcgcataaaggctctcttttgctatccgaaagacaatcaagtccggtggtatgcagagacaaacatagtcgtctgcttccctggtcgagaaactcaatgtgtattgaccaaggctactggagtctcccttgctatcccgagacaagcgagtctgatagcttgcagaggccgtcacggttatccatttctttttatcgctttcaaggcaccaaggcttttgctgatgcacctgatgtcctttatgctatttcttttgataggttttgttgattga

SEQ ID NO: 4486 - DNA, 221 bp, Glycine max
  Peptide Sequence Number=SeqID_96171
atcctagaggtgaaggagacatcctcaccacttgtgtttttgcagtctttcatcttgttcttctctttgttgtaaaggaggttccggactatggaaagctaaatcctctgttggatcttccctggtcattcaatagtgggaactggtctgattctaaagtccttggtagtacaggactaatttgttgtgctatcacgagggatcggggtacaagaacttag

SEQ ID NO: 4487 - DNA, 255 bp, Glycine max
  Peptide Sequence Number=SeqID_96172
atgacaattgaggaatcaatacatgttgcttttgatgaaactaatattacctctctgagaaaggaatttcttgatgatattgcagattctttggaagatatgcacaatcaagaaaggaatctaaaaaggaagagagatgaagaaaacaaggatgttcaagatgatatagcccaagaaaatgatgatctccccaaagaatggaaaacctcaagaaatcatcctcttgacaacatcatcagagatatctcaaaaagg

SEQ ID NO: 4488 - DNA, 243 bp, Glycine max
  Peptide Sequence Number=SeqID_96173
atgacaataaaattttggatctctcatgggttgtacgaatggttgggagaggaagggataacgaaatcaaacattcttcaatggagagggtttatgagactaaaaaatacagatgcaaacaatggcgataatggagtcctcataggagcaaagagtaagggagtagaggttcgtcgctgtcgaagcaaaggacaaagcaatggagtcatcgtaggagcaaagaatgagggaggaaaggtttag

SEQ ID NO: 4489 - DNA, 234 bp, Glycine max
  Peptide Sequence Number=SeqID_96174
atgcatcaatgttttctgaaaccttatcacccttatcagcaattgaagaaagcttttaatggaagtcaagagcatgaaaatgtgccgataatagaaaaagcttgtgacagtgtcatcgggatgctttttaacattcaaggaaagatgaaagatggtttgaatactcgtcaagatctagttgagatgggtatacaagaccagttacatccaagttctggtggtaagaaaatatag

SEQ ID NO: 4490 - DNA, 162 bp, Glycine max
  Peptide Sequence Number=SeqID_96175
atggttacgatcatcatctccatatcaactatgctaaaggcccaagtggaggaggatgaaggcccaagtggagaaggacaaagcccccaagtggagaaggatgaaggcccagaggcagagacactatcaagactattaattgttgctgaaggcccaaactaa

SEQ ID NO: 4491 - DNA, 405 bp, Glycine max
  Peptide Sequence Number=SeqID_96176
atgaacaagttattactccaaagccatgcttcatattgttctatgagaccaagctggttttcagctgttgatcaagagctactgcaggccagatcagagattgaaaaagcaccaattgtaaagaaggatccaaatttttatgctcacatttatcataatgtttccatgttcaagaggagctatgaattaaaggaaaagactctcaaagtgtacgtatacagcgaaggagctagaccaataatgcactcaccatttttcacaggactttatgcttctgagggatgctttatgaagcaaatggaagctaacaagagatttgtaactagggatccaaacaaggccaccttgttttacttacctttcagttctcaaatgctagaggaaacattgtatgtgcagaattga

SEQ ID NO: 4492 - DNA, 735 bp, Glycine max
  Peptide Sequence Number=SeqID_96177
atgagagtttccacccagaataattccgagacggagagtagttctacctcattcttaccaccatcaccatcaccatcaccgtcgtcaccaccgtcatccgaattcaagacggagaaacgcaaccgcgagtcgaacaagcaccccgtgtaccgaggggtgcgcatgcggaactggggaaaatgggtgtccgaaatccgcgagccccggaagaaatcgcggatatggctgggcacattccccacgccggaaatggcggcgagggcgcatgacgtggcagcactaagcataaaggggaacagcgccattctcaacttccccgaactcgcggcctcgctccctcgtccggtgtccttggctccccgcgatgtccaggccgcggcagccaaggcggcccacatggacctgccttctacttcatcttccatttcatcgtctttggttccaactactcagtccgcgtcctcgtcatcttcttctctatcgtcgttgacttccgctgacttgttgcccactgcctccgaagaactgagcgagatcatcaagttgccgaggctggaaacaacgagttacgagctggggaacgagtttgtgttcatggactcgcaggacgcgtggatgtatcagccaccgataccgtggttgcatactacctacgacggttctgatgcagatgagtttgtagtgccagagagtggggttgtgactagttttgagagttttctgtgggactactga

SEQ ID NO: 4493 - DNA, 1734 bp, Glycine max
  Peptide Sequence Number=SeqID_96178
atgagaaaaatagtgaaaaaagagggagtcaagaagaccaagagtgagcttgctcgtgagaaaaagaaggaggcagttccatatacagggaaagaagtgccatatcctttgatgccactctattcaaaatttctgaaagatctgttaaccaagaagagcaaatacattcacagtgacaatattgttgtggaaggaaattgcagcgcagtgattcaacgaatccttccatcgatgcacaaagatcctaggagtgtcacaattccatgctctattggttctggaaacttcatgctaacatccaattgcatggttgatatgggaaagaaaaagctggaaatgggaatagctaatcagaagatcagctttgatttgtttgatgaagacaagcatttgctcagccagaatgtctgttcagagccatccactaagcaaatctttgttcatgcgctgagcgagtcacttctcgcgctaagcgcatcaatccctactcattggctgaaagggcctctccgagcgagcccttgggtcagcccgctaagcccaaatccctctcaggtttggagttgcgctaagcacgagtctctcgctaatctaagaggatttttgtcttctgttggtgctaagcgagttagtctcgctaagccacccagcctttgtaggttgaataagcctgggctaagcaagcttagcaagcctgctcgcttagccattgtgttgtgtcagctaagcgaatggcctccaggaagaggaagtccagtgtatcccggccccaggagccttatgacaccaccagattcatctctgaggctacctagtagaggtattcccaaaatgttcactcctgatacatccttctggagaggaacgcatatggatgggcacatagatgtagccctgggggagctgatcaagttcgatgcagcctctttgaatgccttcctggagacaccattggttattcagccaggggagcagtacacttcttactctctcttctgtaggacgggcactgatcctcaggagcatacctccaagctgtgtattccaaggcgtgagttcgttttaaatgctgaaggagtgccctggaagctcctaaggaaggatctgacgacactagcccagacctggagtgtgttatcatactccaacctcgcccccacttctcatacatctgatttgaatatgtacaggtccaactcctcacggctcgacttcccagcccttatcacagccttgcgcgtggcccgaggagtgatttcagattctctgacttttgagtccctcagccctgccattaatttggcatacataaagaagaactgttggaacctggaagatcccacaattgtatttccagggacccgcaaggctcgggctcaaggatctgagggcccatcttcttctgctccccctgctcctacttctacacctcctgctccttctctagcaccatctccctctgctctaccatcatcagttccaacacctaccgacacctccgctccgagctccgatgtcacagtgccgatgttgcggagcctccaccatggcttatgcctgccaggagtccagccttctcctttagggggaggtgaggcttccacagcccaggagcctcagccagagcctcagtcggaggtctctgaggatgaagaaggcaccgaggacacagattacacagcaaatttacaggaggcgcaaagtacctgggatccctggcctacagctgcatag

SEQ ID NO: 4494 - DNA, 204 bp, Glycine max
  Peptide Sequence Number=SeqID_96179
atggctgaagatcaacctagaagagtgacccttgaagactactctagttctgctatgccgcagtttttcactagtatagtgcggccagaggttcaagcacataatattacttatcctcattctatgattcagctaatacaggacaagacccgtgtgcacacctgccaacttacattgaaatttgcaataaagtcaagcttgcag

SEQ ID NO: 4495 - DNA, 69 bp, Glycine max
  Peptide Sequence Number=SeqID_96180
atgaatctctcacacgcaagaggggtaagggactacctctatgcccttactggaaatgatatgctctaa

SEQ ID NO: 4496 - DNA, 441 bp, Glycine max
  Peptide Sequence Number=SeqID_96181
atggaacttcaacgcctcaaccaaaataaagagaccgacaaaaggaaaagaagcatagcactcaaagtctcctcctcaatgcaagaagaagaagaatctgatgatgaagaggacttctcactttttgtgaataagtttcataaatttgtcaaaaatagaagaatggagagaagccataacttcaacaatgggaagagatcccaagaagtttctcctacacttaaatgctacaagtgcaatcaacccggtcacataaaagcaaactgccccacaaatgagtcatggcccaagaagaatgagaagaaaagctataaagaaagaagatccaagaaggcgcatattgcttgggatgacaatgactcatccgatggtttggagaaggagatcaaccttctatccaaagactatgaaagcgatgagaacatcactcaagaagattaa

SEQ ID NO: 4497 - DNA, 174 bp, Glycine max
  Peptide Sequence Number=SeqID_96182
gattgtcatcatcaaaaagggggagattgtggaagcaatgaatttcaagattattttgatgatgccaaagaatcaagagttaatcaagtttcaaagaatcaagattcaagaataatcaaggtcaagattcaagactcaagattcaagaatcaagagaagactcaatcaagataa

SEQ ID NO: 4498 - DNA, 81 bp, Glycine max
  Peptide Sequence Number=SeqID_96183
ccttatgagtttggcaaacaaacattggagctatacttgatgttattgtatgcaacaaggaaaggcattattacgttgcag

SEQ ID NO: 4499 - DNA, 606 bp, Glycine max
  Peptide Sequence Number=SeqID_96184
atggtgcacgatgaaccagtggtccctgcgccagatgttgagcctgatgtattttcggatgacccgatggcaccagctgattatgaggacattgtggcagacaatcctgcggacacaggcgcgaaggctactgaggatgagcatgagggatttccgggtggtccgagcgacccatccatgttgacccagtatgcggatcacgttgcttgcagcgagcgtcctgagttgaagttatcctctcatgggaggaaggcccatagtttaggcaggcctgtccctgccattgagggacttgttgctggtataggactaagtcctctgatcgcgtgttcggtagacaccggcgatcggggacttttgtcctcatttgtggagcggtggcactgggagacgtctagtttccatctccctgtgggagagctcaccatcacgctggacgatgtctcctcgcttctccatctgccaatggttggcgacttacatgcctttgagcccttgcatgtggatgatgcggttgagatgctgatggacttattgatggtctttacagagtctgccagggctgagacagcccagtgtcgtggaccgtacgtacacctgcaatgg

SEQ ID NO: 4500 - DNA, 708 bp, Glycine max
  Peptide Sequence Number=SeqID_96185
atgatttttcagtctcatcttctccaaaacgccgcccaaaccctaacacctccttctccatcacccacgaccaccggtggccaccacgagccaccattgcttgccgccaaacccccacaccaagaggaacatcttaatcagagcagaatcctcataatcctcctcaaggattctgtggagaaaattcccccaatcctccctttcaaagcttttctgagcatctctagagggggatggcttagagcctttaattatccacggtcaatgcatttgatggaatacttgtacttgggggcatgttacttggtttggaactcccttgagactcaggctgatcaccatgggaggggagttgcctatgcacgacagggtgacctcgacacttatttcctagttttcctaagtgagagtgtcgtgtggacacgcttaggctatttccttggggatggtaccacattgcatttgagagttgagatgcaatcccaaggactcatactgcctcctaagcaaaaagttgctcctattgctacccatgtcagcacaaagggaagttgcatcgatccctcaaggaaagatccagacaagggtgaatcaaacaaatgtgggttgtatgttgatgacaatcatccctacctggttgcccttggaagtgtttatgaagagttgacaatcgtcaataaagtttctttgagcaatgatcaagtgaag

SEQ ID NO: 4501 - DNA, 234 bp, Glycine max
  Peptide Sequence Number=SeqID_96186
atgtcaaaccataagagcacagagtcagccattaagaatctggaagtccaatcggcagttgagccgacactggaaccagtttctaatcttgttgaacttgaggaagttgtggaagatgaagatgaccaacaggagagagagacaccaataaaagatagtcaagaaggaataaagatgacggaagaacaagaaaaagaaaaacaaaaagaggcaatagctaagcaaggaagatag

SEQ ID NO: 4502 - DNA, 555 bp, Glycine max
  Peptide Sequence Number=SeqID_96187
atgatgattaataatacattcttagctaatcgattcccttttatcaacatacataaaaagttatatgatttaggacatggcttaaaaagtaatatatatgcaaaagaaactacttcaaaaagtagaacaatatttcaaaaaggcggtcacagacccctttcttgtgctctgctagggtttagtataggcaacataagcgcttatcaccccaataaatgttttctcttccttggtgtttccaaggtctctgtactcccacggccaggggagggttcagagccggcttcatggcttataggaagggtcatgatgaacagaggtgtcaaccttatagtgtttaaatcgaccattctacaagcatggaatgttaaaaatagggtggaagttagagatgtggcaaggaatcttttcttttttaggttctttgatagaagggacatggagagagttatggaagcggggtcgtggaactttgacaggagacttattgtgttgaaggagatgaagggggatgaaaaccctaaaactgttagcaccacgaactgcaacttctag

SEQ ID NO: 4503 - DNA, 53 bp, Glycine max
  Peptide Sequence Number=SeqID_96188
atggctgagagtacagaatggggattaaagagtgtggaagcaaaggaacaaag

SEQ ID NO: 4504 - DNA, 627 bp, Glycine max
  Peptide Sequence Number=SeqID_96189
atggggttgatgagtatttctaggttttgtttttatgatcctggtgttggaagttttaagtcctgttctgaaaatgttccacttgaggaagtttttcagaggtgtgattcaaatgggctaacaacagaatctgttgaggagaggctggtcatctttggccacaacaaacttgaggagaagaaggagagcaaggttttgaagtttttaggatttatgtggaatcctctttcatgggtcatggaagctgcaacaatcatggtcattgctttggccgatggagaacttcttcttctcttccgtgaacctgcttcttcttctcttcttcgtgaacctgcttcttctccgcgaggcacgcccaaggttgtcttattcttctccgcgaacagggtagaagacgagaggggagaagacgagagtacgccggaaaaaatggggaaaatggctgacgacggagtcttccggaagaccctaaccaaacgtcttccggaagagtacttcttccggaagactcccggaacacctcttccgaaaactttctggaagaagtggttcttccggaagaattccggaagacgcgcttttccggatgacctttcaaatttccggaagaaccacttcttccggaaa

SEQ ID NO: 4505 - DNA, 549 bp, Glycine max
  Peptide Sequence Number=SeqID_96190
atgcaacatgcttctggaacctcccacagagatgaagagagaggaaaaatgcacgcgtcaacaaatgaagccagggcaaaatgcacgtgtcaacaaatgaagcaagggaaaaatgaccaaaagaccaacaaatgtgccacatgtggcaatgtgagtggtggtggttatgcaaatgagccgcctgatggcgatgaggaatatactccacaacctaggctaaactttaaacaactctttgtgaaggaagttgtgacagatagacctaaggttgatcttatcaaagaaaaccttgagcgtattgaatacgaagaaggcaacaaacttaaaccaaaagtaattttggcagattcaattctagagggactttgtgccccatggaaggaattttttgttgtgaagctattgggaaagaatatagggtttactaccatgcatgatcgtcttgctagagcttggaagatgcctggaggttttgaggtcttgggtttgggcaatggatattttatggtcaagttcgacaaggatgaggatcgaaaaaaaagtcattga

SEQ ID NO: 4506 - DNA, 225 bp, Glycine max
  Peptide Sequence Number=SeqID_96191
atgaggttcttgagaaccctagggccttgtttagcagctctaacccaatcctcttggagtcttctacccaatacccttgggggatccccttttagatctatattgatgcaatcctacccctcaagggcattggatagaaaactccaagaagattgggccagagatgcaagagaagaccctagggttctcatgagccataaggtagatttcgggcccatgggctaa

SEQ ID NO: 4507 - DNA, 204 bp, Glycine max
  Peptide Sequence Number=SeqID_96192
atggaaggtgctaaaccaatggaaactcctatgcatgcttctaatcctttgagcaaagacaaatcaggtattactaaccaaagtttgttttacaagaaaaatcaagaatttaggtgtatagatagaaggggaagcatgttcaaaaaagataaaaaccttttgccttctcttaagagattgtgccgcccttttaaccatgattga

SEQ ID NO: 4508 - DNA, 213 bp, Glycine max
  Peptide Sequence Number=SeqID_96193
atggtcttacggcaagcaatgatagctcatggtggtcaccggtggtcggtggtggtgaaggaagaggttgggagtgttggacttgtccaggaaaaattttactcgcctgggcaagctgatccagctcaaattagcctgggtgatttctgctctaacaaattttactacttcactgaaaatatcatatctcatactccaaatgttattttgtaa

SEQ ID NO: 4509 - DNA, 441 bp, Glycine max
  Peptide Sequence Number=SeqID_96194
atgactgttagagtttgtggtcttagttcctttgtcccacatcgcttggtttgtaaaaacttatgtctcattagtgttatatatagagacaccttagcttttggttactccacgggatttccttattttaaaggaattagtgggagtcttctcagtttagaggaggcagtgggagcaatggcattagaagatgggaaggtgaagatcgagaagtttgatggtagagatttcagcttttggaagatgcagataggggattatctatatcagaagaagttgtatcagcccttatcaggggttaagccagacgacataaagcaagaagaatggaaccttctagatcgacaggctcttggcgtgatcagattgacattagccaagaacgttgcgttcaacattgtaaacaggaagactactgcaggcttaatgaaggcgttataa

SEQ ID NO: 4510 - DNA, 132 bp, Glycine max
  Peptide Sequence Number=SeqID_96195
atggggcagtcagctcctccctttgtgtgtgaatttctggaaaaaggctgtatttctgagagtataatcgacacagccatagctctcaagaacaaagagtttctcccaccattgcctgaaccgattctctga

SEQ ID NO: 4511 - DNA, 231 bp, Glycine max
  Peptide Sequence Number=SeqID_96196
atggaggagttgataaacaaaatacaactctctcccaaaataatgccaacgtcgtcacgtcggctcggcggcttctcaccagaatcttactccctgcatcctgctactgtcattctgctcccacgaacaatggtcgtgatcatcacaggaaatagcctaagcatgtccacacgacactctcacttaggaaaccatgcagagttcgtcgagaccacccggttgtgcacgtaa

SEQ ID NO: 4512 - DNA, 336 bp, Glycine max
  Peptide Sequence Number=SeqID_96197
atggtgggatacatgccttcaagctttgtagatttagtgtttgctggtgagaggattgaagtgggtctgagaagaggaaaatttgatcatcctgctttgatgaataggaagcctggggcaaatgtagagaataagaaggagggagaaaactgttgtgactgtcgttcctacatgaccaaattttccactagctcaacaatatcaatactcagccaatatcagtccttctcattacccaccaccctatcagccaagaacacccaatcatccacaaaggccacccctaaatcaaccacaaaacctgcctgctgcacatccgaggccagacaccattaa

SEQ ID NO: 4513 - DNA, 81 bp, Glycine max
  Peptide Sequence Number=SeqID_96198
atggtggtgcactattctcttgagatacaatgtttggatgagtttctctcagcctcccagaaagctagagtaacaggataa

SEQ ID NO: 4514 - DNA, 264 bp, Glycine max
  Peptide Sequence Number=SeqID_96199
atggaatctatagctgctcatcttctttggaaacaacactttcatagatctagaaaaatcccagaattgattctttctttggttcaagctgggtttttagatgttgcaaagctcggacaagttaaaatccacgacgctttagtgactgctttggtggagaggattgattggtggggtgttaatgccaaaagatcagggaacagagttcacctaatgtatctgcccctattagcagatcctgctcaggttcgctggtacaactag

SEQ ID NO: 4515 - DNA, 870 bp, Glycine max
  Peptide Sequence Number=SeqID_96200
atgggtgccaagtacctcgaagcggtcaagcaaaggttgcatgccatcaatggatggtccccggacgaaattaggggcaatctgggtgtagcagggtctggggttaaaggggtggtggaaccagaggggctcatggtggtgcttttgcacgaaaactgcaatggtggtccgtcaatttatcttcctagaatttggccaacgccactacttggggaagagataaaggctacaaagcctgcacctcgcagcccattcgaattccgtaaggtattcgttcacagtgccacgctgctggagcttgaacaaggcaccttgtgggtcatcgtagaaggaggttggtccctccatgtagaaggaggccactgtgagcctctggtggtcaagaatagcctggtaatcgaaaactgggggggtggggtagatatggttgatgatttgggggaaaaagggattgtggtcacgattgtgagatgttcgagtatggaatcaattttggaagagagggaggactatgtttgggttaaattggcttgtgtttgggctagtgaaattgagaaattaaagatcagtgagttctcagagagtagcgtccttctaggtgtaaatttggacttcgtctttgggctctttgcctctgatgacaaagtcttccatggaatgggtgaaagggaggaggaggaagagggcctcttggtggtggaggcaatgctcttccaccttgtcattttcctctgtcttcttcttcgtcaaattgggattaggattggaatcggcgaaagcagcaatgatgaaaggcgaggtcttgagagtggtttcggcatgacaacaacggtaacaatagtgatgacaatggcagggatgagaggctag

SEQ ID NO: 4516 - DNA, 485 bp, Glycine max
  Peptide Sequence Number=SeqID_96201
gtatgccacccaccaggcaccctctagacccggataagtctaacagggccctggggtttccagcattgatcacgggcctctaccaatcattcggggttcccgtcacgcctagtaaggtgatccgaccgccgatcacccaggccttcattgagaagtattgcacgcctaggcaggcgcagggtgatgcacctcaggccgcagacgcacagccaccacctcatcaggctgatcccgctggatcactaggcatggagcgttatctacagcacttggatcgccacctcagtcagcaggggcagggtttcgctccttttgcatgccctactccagagcagtttggggctgaggtcacatggcccggagattggcccgaggcccaggcggaggaggcgcctgcaggagctcccgacgatgcagaggaggcccgcatggatgaggagatgacagacttgcttggtttcttgggaggaagcggagccacgtga

SEQ ID NO: 4517 - DNA, 759 bp, Glycine max
  Peptide Sequence Number=SeqID_96202
atgggggcggcagaaacgtctggtaacagggacgaatttgtcatacatgaagctagggtaccaattttgggtgatgttatcgatgctgacgatggcggcattggtgttgcagtgaaattgaagcatgtccttgacgagatcaacgatgatgacaccagtgctgtagcccatgtcaccaagattgaagcttttgatgttgtcacagagcttgtacttgttgaccatcatggcagagagggaaggggtagggttgaagaggctagagttgatgacgaggactctgatgtctttaagcttgtcgttggtgttggagaagaggttgtcaagggcgccaaacatgacctgctcggcctcttccctagcggtggccttgaaggggcgagtagggatggagtgcatggcttgggggacgtaggtgtgttcacaaaggccgaagcagaggagaatcttgcgttggaagtcaaaggaggaggggaggaagttgccgatgagggtggagtggtccatgaactggccaaagaggacgcgaaggtgctgagggggaagggtggagtcgaggaccgggatggtggaaaaagcaatggcattgtactggaggtgggcccagaggtgttggatgtcgtggcctttcatctaggaggcttggaggagaattatggacatgagagggagaaggcaatatgtgtgacatcaagtattgttaccctagcttcatgttctttcattaacggtaacgggcagaagttaactgatggataa

SEQ ID NO: 4518 - DNA, 525 bp, Glycine max
  Peptide Sequence Number=SeqID_96203
atgacactgtctgtgaaaagtacgatattagcaaagaaaagtggcaacaattttgtcaaatttgtagagatctttcatgataggattcctttgaagagcagtcaacataggaaagctttgtcgcccatggacggactcctattgcctcctaagcctgaggttagtccttctagtgcccatttcagcataaagggaagtagtgtcaaactttcagggcagaacccagacacaggtgaatcagacaaatgtgggttgtatgttgataacaattctccccgcttggttgcccttggaagagtttatgtggggtcaacaactatccacaacattcctttgggcaatgatcaagtgaaggtcgatgttgatgtagttccatatgctaatgctcgcgtccctatacccactcaagtggataaacataaagctgaaggaccaatgaaacctgtagaaaggctagaacctaatgatgatcccttataccagatggcattgacgatcccagagcttttcctcaaacctatgtag

SEQ ID NO: 4519 - DNA, 402 bp, Glycine max
  Peptide Sequence Number=SeqID_96204
atggtggatagcagctacaaggtcaatatgacatctcagccttcggaccagcaagtccagcagttgaagaaaattcaagctgaactttgggaaaaggctaatctccatgaatctatcatgagacagaagtctagaaccaaatggattaaagagggagacagaaacagcttggttttcttcgagcgaggacagtgtgggttctgtggggttcgagcgacgacaatgtgggtttttcggcagtgtagggggttctgtgggttccagcaaggacaatgtggatttttcggcagtgtagggggttctgtgggttcgagcgaggacaatgtggatgtcgagggagcggtttccgaaagatttcaggcgggaggagaaacagaagagcgatttcaggcaggaggatga

SEQ ID NO: 4520 - DNA, 93 bp, Glycine max
  Peptide Sequence Number=SeqID_96205
atggcagctcgggtcaacgccgtgacaaattttcttgttgctggaaatgttgatgcacaatattggagatcttgttcaccagctggtgattga

SEQ ID NO: 4521 - DNA, 936 bp, Glycine max
  Peptide Sequence Number=SeqID_96206
gtcgactctagaggatccccatgtccagagcaccctggagccggtgtcaccatcaagcaatactttggatcaactccacggacgtcccgcagctcttcctccctgcctcctaaagaattgcagcagctgacccagcaaatcagggaccagctagaggagtccatcacagagagagggacgcgcgatcctgagacgggtgactctgataagtgcggcttgtacatagaagcagatcctgcccgcctggttgccatggggagagtttatgagggatccactgttgttcataacactcctttgttgcctggccaagtaaaggtgagtgtagaggaggttacagatgcagatgctccagttcctctacccactgatgaggtttccttagtggggcaggcacttcacaccttccttgattggccgacacatctggtcaagtttttatcacagcagttagctgtgtctccggcaaaaccacctccaaagcctgatccggaggtcgatgatccgctttatctaatgacattgaccatcccagagcatttcttgaggccttatcaggttagatgggatgccaccgtgttcagggtcttaaatccagatttccccctctacataaagcacgaagacctctccaaaattgcacacagtggtcaatgtctcagcatatcagtgttacagttgtggattctgcatctcactgaaacatgtatgcgagcgaggaattctgatatctatggattcctcgagccacagttcattcagagtgctttaaaaggtcttgatgatgctccacagcctaaatcaaaggctcctactaggtggattgtcgtcaagatgtccaccatcattttaggaacttttaggaataattgggaagcgtattttaacgatcctagatcattggagccagagagattaaaggcattgcagatctag

SEQ ID NO: 4522 - DNA, 534 bp, Glycine max
  Peptide Sequence Number=SeqID_96207
atgacactgctgctcagtaatgtcttgcctagcgatcataactccgatctcccttgccctaagtgccagttggtgtatgccattctgacacggatgagcgtccacgtggcccaggtgattgttgacgccatttatttgtttgcaggtatggcgcctaccaggcactctctggacctagataagtccaatcgggccctggggtttccggcgctgatcacgggcctctgccagtccttcggagttcccgtcacccccagtaaagtaatccgaccgccgatcacccgggccttcatcgagaagtactgcacgcctaggcagacacatggtgatgcacatcaggccgcagacgcaccgccaccacctcggcaggctgatcccgctagatcactaggcatggagcgttatctacaccacttgcccgaggcccaggcaggggaggagcccgcaggatccctcgatgaggcagaggaggcccgtatggatgaggatatgactgacttgctcggtttcttgggaggaagcggagccacgtga

SEQ ID NO: 4523 - DNA, 672 bp, Glycine max
  Peptide Sequence Number=SeqID_96208
atggcagctgtaccagcaattcttgaccgtgttcgtgatggagtgttcaagaagaggagtttattcaaacaaagcctaatgaggcaagacttgggacttaaaaagcttgtcaatgcagttaatggtagttggtttggagcttggggctttgaaaaggctctttgggattttcttgtgttcagaaaggttcgagcaattctcggtggtcgtatccgttttatactgtccggcagtgctcccctttctggtgataccccgaagttcatcaatatttgtcttggtgctccaatcggtcaaggatatggtctcacagagacttgtgctggtgggacattctctgatgttgatgatacatctgttggccgtgttggaccacctcttccgtgctcatttattaagctaatagactggcctgaaggtggatatttaacaaatgactcaccaatgtcccgtggtgaaattgtaattggtggtccaaatgtcactcggggaggagagaaggttgatgaaaggggaatgaggtggttttacaccggtgacattgggagagtgcatccagatggatgccttgaaatcattgatagtaaaaaggacattgttaaactgcagcatggagaatatgtctccttgggaaagttatggatattacttttgtttttctttagaatttaa

SEQ ID NO: 4524 - DNA, 588 bp, Glycine max
  Peptide Sequence Number=SeqID_96209
atgtctttcattatgtggcttgctaaaaggaactggctgcttactcttgacaaagttgcttttttgaacaagggttccctctgccctttatgttcaaatgagtctgagtcaaatgctcatttgatcttttcttgcaggaaatctctccaagtttgggctcacattcgtgatttgggtcttttctgcaggcgtttcacttctttacagcgcattactgactctttaattaggggcagatccgcatcaggtgttcaaggaaaattacgttgtctggctatagcaattacagtctactgcatctggctgtctaggaacaagctgatttttgaagattatcaattttctataatagagatatccctacccttgttcatggaggagctcacaaaggatcaccgccatgagaagcaagggaaaacttctcctttgaccaccatcaatgaccacaaacgacaacaagacactagtaacccagcaaggaaaaccaccataggggtaggcatttgccatactcgaaacgactatcatgaggaccctcggaaacgggagtctcacaaccatggtggacctctcgcgccaagtgcctaa

SEQ ID NO: 4525 - DNA, 351 bp, Glycine max
  Peptide Sequence Number=SeqID_96210
atgtttgggaaacttgactcaatatgggtgcagcaggtcctttatcattactgggaaatggtgggggcggatgcaaggaagcttagcacatggcaaccggtaattgaaaaggtgaggaagaaattgacaccttggcgaaggagacatctctcctttggaggaaggatttgcttgtggagatgggacctcttatggaggagaccgtggtttacatgggaacaatctttagtgcaaaaactaatgggtgttattggggaatttgggccatacaaaaatggtagggacggatggatgtcgagtaacaatgcggagaaaaaatgtggtcaaacatgtttatggagagttgattaa

SEQ ID NO: 4526 - DNA, 1041 bp, Glycine max
  Peptide Sequence Number=SeqID_96211
atgtctttttctgaggaaggttctgcttgctccgatgatggccgaatgttgtcgccagaggtccgccctataggggagagctccaatgatgaccacacccaccctcatggtggttctgacgttgctagcaaccaagtctccgacatttgcattggtgatgttgttagtggcattgtgattcctcttgacgttggtcctgccatccctataggtggtgttgccactaggaaagggccacatccctatttcggtgtgcgtcttactcttatggaggatgaggccgaatcccctcggccaaatcctcctcagaatgttatagatttagacttggagaccacaattattcaagtgcttctgcgtcaaccgtttgtgcccccttttcctcttcttagaaagaatatttcagctaaggggtttcctcccattgttttcttgggttactcctgggttcatgaggaagttggattcttcgcgagtagtttcctaacttacaagtccattgtcgagttccttgagttggtggttctaatgtttcctttctactggattttgtctcctacgaagttcataaaaaaggctgttgtttacatgtccgacacaaatcaagaggacatggttattctccacaagcttcctagaggccttcactgtaaaaccttggctcacgccgagaaggctgagaaggttcctacggagaaggacaaatggaagcaaaaagaaaatccccaagatgattgggtgcctcctcctcttcccgttacaatcggtatcattatctgggaaggtcatgggccttctggtgggggtcctttgaagaagaaaaggttggagtctatcctgatggttgttccttttgccatagagagccatcttgcctttttattaatgaaagagggggtctcttatccatgggggaagaactacaaccccaaggctcgtattcaagcttccatgcttagccagtccaaccaagatatgctaagggaggttggtcatcgtgtgccaatggattccattgctcgcttcactgcaaggtcttag

SEQ ID NO: 4527 - DNA, 393 bp, Glycine max
  Peptide Sequence Number=SeqID_96212
atggaagaaagtttgatccaggtcagtaagacagatgaatcatttatagttgaaaaagtaagagaagaagtagcttgtcttacaaaagactttgggtggttttttgaaagctcaaacacattaaccatgcttttaaaattccaccttcattctcatgataagtctggcctaggtttagaaaaaggggcatcatcttccaagtcacaatctgatttagataaatgtgacttctgtgctaagtctggacaccctaagttcaaatgcatccataagaagaaaaaaatgtctaaagtactaatgttgctagacccaaaaggatttggggttaagtggtggatggacagaaatatagaaatgacaataactgaagctacagggctccaaatgaggtga

SEQ ID NO: 4528 - DNA, 447 bp, Glycine max
  Peptide Sequence Number=SeqID_96213
atggaaactctaaataccctcaaagacagcagtgttcacttggaggctaattcaggacagattaccaacaaagacaaaccttcgaaggagacaaatagcagtagaggatatgttatcaaaaccctccccttatggtgggaatcaatgtcctgggttaatcttaccacaacaatgccacaaaatcctagggaccattttctacaacatggaaatgagctagcaaagggagtcaagtctaaaagatggaaatgctggtggattgccttaacctggacaatatggcagcatagaaataaggtggtgctccaaaatgcaacttttcacggaattaaactgttggacgatgccttactcctactatggtcatggatcaaagcaatggacaaggattttactcttcattttaaccaatggtcctccaatctgaaggaaggattctgtaattag

SEQ ID NO: 4529 - DNA, 495 bp, Glycine max
  Peptide Sequence Number=SeqID_96214
atgacaatattgtttgctttcctgttgcatatgaaagaccaatgggccttggaagaagaccttttagtcaacagatatgacgaatttccaatggtcaataaggattcaaattcgtcgggtttggcggatagggactgtacttcgttttcccaaggtgagaaggagtctgtagctacttggaagatgggccaggagaacaaaagcccagttagaaaagagggcatctccaactctgtttttaaagtatatagcagaaggacatgtcaaatagcaaagtctatggcccgattaaatcttggcccagttttaaatgaaattggaagtgaaaaggaagcaagggtgatggaagatcagcattgggagatagcccgacaactgggtttagcttctgatgaatttttcaaaaacaggggtaaggagagcttggatgaggataatataagtcacttaaatgcagtaacagcagagatgggaaacaagacaattgatccatga

SEQ ID NO: 4530 - DNA, 942 bp, Glycine max
  Peptide Sequence Number=SeqID_96215
atgatcgtgttgttgatcgtatcaaccctgattatgaagcctaggaagtccaagatcaaacactcctggtatggctgcagtcaactctttctaaatcagtgttgtttttgggataaaattcatgagcattttagtcttcacacgaaaactagagcaagacagctccacactgccatgagagcagttactcttgacgacaaaataattaaggagtacttgcaaaaaatcaaagggtttgtggatgaacttgctggtgttggtgtccctgttcatcatgaggaatacgttgatgcgctgcttgaacgactatcgtcggattacgcgtcggtggtttctgttattgaaagcaaaaagcaacctatcccacactctactggttcagtcagaacctcaaacacctgggttaatccgaattctacgatttctggtccaagtcatagtcaactcagtgccatgatcactagttcaacctctcaagggaatgggcaagctggtaccacctggattccaaattctagagccagctttcatgttactggagactcacagaatattaaacaattcacccactttgatgcaccagatcagatattcataggcaatagtgaagggcctcaaataatatatatatatataataatcaaaatgaacacagcagcaccagaggagaccaataagatccttcttaaaggagttgttggtgctgatggattttactcctttcataatctcaagcttcaagagagtccttcactgctgatgtctactgcttcaagtgttgcctctcctagttcagctctcactattaataataatggttctactgtaatgtctgattttgtttcttcttctctcagtattgctaatctctggcatgctaggttagggcatcctaatgatcatgtaatgaaacttgttctcagtcattgtaatatttcttaa

SEQ ID NO: 4531 - DNA, 279 bp, Glycine max
  Peptide Sequence Number=SeqID_96216
atgaagaggggatgcgtcataaaaatgagtaacagcaagattttggtagtccaagagacagaatatcctcataaagttttccaaagaggagctgaaagaaaacgagcttacgacgtcgtaggacgacgagcacagttctcaacatgtgaaggaaatgcgagaggtagaaaacataggaccagaagaaaacacgaccacagggacacatcccaagggggaaacatagcagccactggagcggggtcttgtagcgccgctagagccaccgcgtctctttga

SEQ ID NO: 4532 - DNA, 675 bp, Glycine max
  Peptide Sequence Number=SeqID_96217
atggacgatgcaaaaaccctagcgcaaaaacgtgaaaggttggcacagaaagtgagagggagagtgagaataggaagagctttacaaaaaggagttagtcaatactgggatggtattgatgagaagagtttaatttcgggtgttagccatggaacatctatcatgttcttgaaagatgcatgtgttccaaattatacggcgctggaggacaaagcaacaattgatggtgatgcttgccagggaaattggggaggttattatggccatggttccccctgtgtgatccactactcttcaagggaatctagaaatggcgtggacacgagagaatatggtgccatgcgtggaagtggggatgtgcagttttggatgagcaagaattgtaggtactcagtgatgcatggtggtatgaggcatgattacaataacaagcaaatagcttgggtgccacctatgacaggtaagtttaaattaggatgggcagtcatggttagtggtattgctgcatgcaaggggactgtatgggatcattatggagaagttattcgttcttactccttcaagttgggtagatgctctattattccaagtgacttttgtttttggtgtcatgtctataagaaggctaatcaaatggtcaacgcgcttgtgaagtttggtctctctatgatgtga

SEQ ID NO: 4533 - DNA, 1114 bp, Glycine max
  Peptide Sequence Number=SeqID_96218
atgtccgattcgaaggtcgaaaccatcgccagattagcccaatggaaaatcgacaacttcggaccctgctcctacaagaaatcagaccctttcaagctcggaatttggaactggttcatgtccatagagaggaacaggtacctctacatacacatctttccggagccttctcggcttactaaggaacagccacccgtggcacgcttcatcctgcgagtctccaacaactctggccctacccgcaaattttacatttcccctgttcatgaaagggtgcttaggacatgtgaagactttgtctggcctgttgatactgcattccttggtcgcttcgttattgatattgaatttcttgacctgaggacctgccccgtgaatggtgaaaccagatctgtatggccatctgatggaaaactgcaaactgttgcagctcaaagcactcttcgatgcttgtcccgtatgcttgatgaggctatacatgctgacctcaccattatcactgcagatggtaccctgagggctcataaggcagttttatctgcaagttctactgtgttccatagcttgtatcttcacaatggtgatgagaaagagacatctacaatccacatagaagatatgtctcaagaatcctgcatggcccttctgagttacttgtacggcactataaagcaacaagatttctggaagcacaggcttgcattgcttggagcagccaataaatatgagattggtgatctcaaagatgccagtgaggaaagcctactggaagatcttaactcgggaaatgttctggataggctaaatgatgcgaggctttaccagttgcacaagttaaagaaaggatgtttctcatacttatttgattttggtaagatatatgatgttagagatgaaatagatacctttttccgacatgcagatagggagctaatgctggagatggagaaaaaggaatcgcatcaagatagtacaaatggaggcttcaatcccttctcattctctctaaagtttgggaatcctatcagagcaaccagagaaaaaattgagaaatctcaggaacttgctagagatggcgctatcgttgtcggaagacacgtgaacccgcttagag

SEQ ID NO: 4534 - DNA, 582 bp, Glycine max
  Peptide Sequence Number=SeqID_96219
atggacgaatcctcgctgcaactcgtctccgaaattggaagacgcctcgctcaccgaactcgtcccaacaaggacttcatagtcaaatccctcgcaaaagctgcaaatgctttgtctttgataaagcagtcttctcaaccgcgaacggccaaagaagtacaagctgctaagaaacaggaagatactttaaagcccctggcaaatgctgtggtttgtggtggtctgcttcaacatgcagataaggaagttaggcttctggttgccgtgtgtgtcactgacctttttagaatcatggcacctgtaccgccttttgaagacaagcatttgagggatgtatttaaacttattattagtttgtttgaggatctagctgataccgcaagtccattcttttcaaaaagggttaaagtattggagacaatggctcaattaaagtgttgtgtgataatgctggagattgacagcatagacctggttcttgagatgttcaatattttcttctctgttgtcagaagccattccttagaaatatgcagtccatttatgattgttgactttagtggaatagtcgatgacacctaa

SEQ ID NO: 4535 - DNA, 288 bp, Glycine max
  Peptide Sequence Number=SeqID_96220
atgacacatccagttccaatagagctacaccttgctagcagatataggtggccaagcatatatgtgtgtgtgcttttgttcttattggtagttgagcagtcgtcatcctacatagtagaatatatggaagataacaaaggcacacatgagacttgtgatgtggaagaagggtctgatgaagaatctcaagaacatggtgaagaagagtgtgaaaaagagatggaagaacatattaatgaaagggatgaagagacttgggatgtggaagaagggtctgatgaaatatga

SEQ ID NO: 4536 - DNA, 1107 bp, Glycine max
  Peptide Sequence Number=SeqID_96221
atggtttggctaccactccaagatgtaccagggtccaatagttttgtatcaatgatgggtttttctttgtgcacccagcagaattgctggtgcacccaacaattgaagtcatcctcccatggaaggaaggttgagaaatttgccaagcctactccagagattgaaggcttagtggttgccacaggattaagtcatttgattgcatgttccttggagattggcgatcagggacttatatcggcttttgcagagagctttgaggctcttcatatggatgaagttgtcttcctcttaattgaattgcttgaagttagttcagaaggagcaaaagctgagatatatgagaatttgaatgatgcatcaaagagcagcgtcaggcaacttgcaggatatatcacacttttacagtgttggatctatgagcattttccttctattgcttcgtctattgctgctgaagattgtcatgagaggaaaccacgtgcctgccgttggaagtttgggaaggcattaccagtgtcaacgtatcgtaagtggatagatagattgacgtttgatgttgtgtgttggattccttatgagggttgtgcgacagtttggtatgtacaaaccattcctccacaccctgctgctccaacgttatgcatagaagatattgatgatagatggattcagttttctaaataccttgcatcggtgggtcagatatgtgttgcacctggacagtgtgcagcagactacatgcagtggttctacatgatttctaatcccttcatgagttcggcacaggctagggatcctcctagacatccacgcgtgttgcgcgatgacatatttattgaactagatattcctcagcaccaggtggcggcaacagctatggacaaagcacctgcagattcacctgctcatgtagagcaacctcgacatgcagtgtttggaacggttgctcaacctaaggatagtgagaaaaggtacaaaggcatacactatcatgaaagactacctaaggatcatcagaggtgtgactgtgaaacacaatgtatatgtgcggtcacgacgaaggcggcgtatggaagatgcatgaagacctttaggatttattag

SEQ ID NO: 4537 - DNA, 408 bp, Glycine max
  Peptide Sequence Number=SeqID_96222
atggagaagttagaacatcacattacaggggtgcactgggcctggcccaacagaggctacgcatggccaagtgaagcgcttattggacatagcccaagtgaggaccttcttccaccttcaactccaagataccaccaacctatcaaacactaccaccaccctacctcttctaaaactcggaagcaagagatcgagaaacaagtcgaggcatactccaaagaaacctcattcgacccaaccgcagtcttattcttcgccaggtggaccttgcacaaggtttccatcaaattcggatggtggaatccgacatctccaaaatggtgttccgcacccatcaagggcattacaagttcgttgtcatgccgtttggactctgcaatgcactgttcactttccaagccacgatga

SEQ ID NO: 4538 - DNA, 2394 bp, Glycine max
  Peptide Sequence Number=SeqID_96223
atgggaaattcaattgcaagcgatggtggtggacagatgtttggagtaggagatgatgatggaggatcagtaagtggcgctgctggtagtgcctgtatccgtcggtggtatgtgagtagtggcggtggagttggagcaggagcaacgagtggtgccgaaacaacagataccgttgaagttgaggagagaagcatcggtaacccttctggagattcgagtgcccaaggcgttgatgtgcgagagctggagatgcagatgagacacagccacaggcaatcggaggcgcactggaatcaagaatctaaggtccaagagaggaggactaagaaacaaaggctacaggattaccagactgagccagaggtaacatgtgatgcaagttttgttggctgctcgaagctagagaagctcattatactcagcaacagagatatcttcttcaacatgaacccagttcttgcagtagtggcagtgaatacctcgaccatcaccacgtcctccatgatgagaggagtgagagacaaaggcagaggaatccccagtagaagtggaaaagggtccgaaggtagtgaatacactgtagaaacgatggacatcgttggagtaaactttcttggccttggtccgcacatcatagcaggctgtaaaagcctagtactatgcctgaaggtaggcgagtttgatggaggggttgccggcgagttagtacgccagatagtggatcacggaggaaactctaggggtgtggtcatgtcggggttattggatcacactgagagtccacataagaaaactgtgaagttgcttccaagtccagctttgcctaatggtatagaagctgaggagatgggtgatggggtgattgaactgataaccatttccgatgatgaagcctgtagtcttggtggaacctctccaaggttacgtggcaaaagtaatgtatttacatgtggtagtgtccaaactctaattctagttgaggatgtggacatcctttttcctgaagatcgtggatgtattgctgccatacaacacatttctgagacagcaaaagggccaattatattgaccagcaatagtaataatggtggcctaccagatagttttgcaagactacatgtttctttctcattgccattgccagatgagttactttgccatatgtacatggtttgtgtcacagaagaagtcaacatcaatcctcttttactgaaaaattttatccagtcttgtgatggagatattcgtaaaaccattatgcaacttcagttctggttccagagtaaaaaatataaaaaagacaggaaagtgcagaaggtgtatggctcacttccttttgatcttgaggcttgtcatcagataataccaaagatgctaccctgtgattatccctcagagttatccaaactaattgagaaggaaattgctaactcaataaccataatggaggacaactcatgctcgcaggggttagttaataaagagctagacataaatgaaaggaaaaatgatttagatgtgcaatttatgaagactgattatttagaggccaaggttgagaggatcaagagatctcttacagactgcagtaggtttgaaagtcaacatagtgctatttctgaactatcacattgttctggatccctggtaacatcctcttggcaaaaggatcaaagtaaacatatagtgatgtcctctgattctgaggagaaggatccaaacaatggacattctctagacgttcatgaggaagtttacaagagacattcccttgaaagcaacaattcagaggaggaacggtataaatatgtagaaactgctcatgatgcatgcttaaatgaaacatgtaaatcgtttgatatgtcctgttttccaggaacaatatccattcctgagacagcaattcaaaatggaataaagccaatgtctggaccagtgtcttctggctgccatgctgatccggtagaagtttctctgaataatgagctgacaccgttcactttcagtgtttgtcagtccttagacaaattgccacaaaattctgattcattggtaaatactgaaattccggaatctttttcaaaagccgcagtgcaaaatctcagagatgggaacacggaaacctcaactgtgtgtaatgtaatagatgagtgcggccatgctgattttaaatggaaatcaaagtttgctgagtccagtccatctatggcgatggatatggtacatttgtggaggaaacatcgtatttgtcaaaaggatttaggacagcatgacaacccagaactgggtgttattcaagttgttaaacttactagtggactgaccaatctaatttctgaagctgacttactgtttcatgggtattatggagcctctgatgtccctttccgatga

SEQ ID NO: 4539 - DNA, 669 bp, Glycine max
  Peptide Sequence Number=SeqID_96224
atggcccctctgtatcttaattactatggtctttgtatgctgaacgacaattataaagtgaaacttcattttgctgagatagcattctctaatgaccaatcatatagcagccttgggaagcatgtattcgatgtttcaattcaagaatttgtgcagatagctactcgggcaggtggtttatctgctatcattgttgttggtatggctgtaattggtatagtagtcctttatgccacattttatgtttggttggaagtggaaccgcctaatttaatgaaggctgcttataaaggatattggtgtattgctggtgaggaggataaaggtgctaaaacctcaaggcagctgagaaaacaagcagctcgtagacttgaaacagttcattcaatgaggatgttgaagataataatgaccttgacccttataattctaatggagctgaacttcaagaaaaaagaggtgatgacttcaaatacttcttccaccaatcaaagcaatcttgtgcaatcttgttcaggagttgaaatagcaggtgcactcaagaacgtgcttgcaatagcagctgggatagtagaaggtatgaatcttggtaacaactcaatggctgctcttgtctcacaaggttgttcagagatatggtggcttccttgcaatgctagacactgttaa

SEQ ID NO: 4540 - DNA, 684 bp, Glycine max
  Peptide Sequence Number=SeqID_96225
atgaaaagcgtagaggtggcgaagacggtgctcgaggtcgccgacgtggcttggaccgccgttgaacacacccaccatctccgccaccgcagtcatcccgtccccgctgcccccgcagccgatgtctgcccatccgaccaagatttggagtctctgcgatccgaaaatcgacgtctcaggaacttactcgaccagaatctgaaattgctgcaaaacctctctgaggcgacttgcttcgataattgccctcccgatttgaatgaccggttagttgctaccatgaggtctgatgagtacttgactcggctcaagtaccttcaacaagaaactgctagtggaggaaatcaatttcctttcaaggaggccactgagcttgattaccgatcagctgacattttggtcaacatcaactctcaggaacccagttggtgggtttgggttacggatgagaaggaacctattaatgttgaggaattgagtggaattgatgatgagaattacttggtcatcagtgaggaacatgtggttgatggtgttgccaactttatggccagatgcattttgtcaaacccgaaagctctgaaattttctccagaggaactgcagaaagtaagaatttctccaatccatttatatttcatgctcggtgaggaaactgctagacatgaggcccagcctcaatag

SEQ ID NO: 4541 - DNA, 347 bp, Glycine max
  Peptide Sequence Number=SeqID_96226
atgtgggtgtcgacggagtggtttccgacagatttcgggcgggaggagaaagagaacaacaatttcaggcaggaggatgacaaagagaagaggcttggttataagaatatcacagttttggagaaacatcacacggttggtggcatgtgtgaattagtagaaattgaagggtcggggtcggggtggatacaggaatcccatacccgtacccgtacccgacttttggttatctgggaaaacccgaacccgaacccatacccggttaactcgggtattacccgtcaaagtcgggacgggcttgggcgggtacccacgggtacggattttcttgccatgtctaagcctag

SEQ ID NO: 4542 - DNA, 609 bp, Glycine max
  Peptide Sequence Number=SeqID_96227
atgaacaacatgatcacactacaacacactaaaattaaggtatcttttgagacaagtacacatgtggttggacatgtttttaaagttaccgtatacaaaaaactacttggcatgatatcaaggtatgctttaaaccaaattgttgctgagtgtgagcgtgtgagttatgttggtatagacagttctcgttgtggttgtggaatgagaactattcatggtcttccttgtgcattaattctttcagtcaaacgcagtgcatcatcatctgaccaagcaattccaagaaggactttgccaattttggatcgatttcatccgtgcattcatcattctattgaaaacattgttgaagattcatggtctttggtgtgcaaccatttgcttaaagaacttgtcaaatggtctgatgagtatatcaacctccttggtggcatagacaaatttgaggaattaaagcagtccctacttgttgatgaattatccatggttgccatggataagtggatgaatataaccgacatgggatatgtcattgcatcaagagacagttgtcccttactgcctctagctttgttatggtctagacattgtcatcctcaggcaaagtag

SEQ ID NO: 4543 - DNA, 204 bp, Glycine max
  Peptide Sequence Number=SeqID_96228
atggatgttgccattgttaaggagttctatgctaacctttatgatcctgaggaaaaatcacctaagcaagtgagggtgagaggccacttaattaagtttgatgaagacgccctcaacaccttcctgaagacaccagtgatcatcgaggagagggaagacctcccagcttactccagattctgtcgtttgaggccagatccatag

SEQ ID NO: 4544 - DNA, 507 bp, Glycine max
  Peptide Sequence Number=SeqID_96229
ccaaactgtaatcattgtgatcaaaaggaaagaatgcactttacggcgcccttaccaaatgcttgccagagctagagtaatgagtgaaatagaggaggtgcaagagcagatgaaggtcgacatgaaggccatgaaagagaaaatgactacaatgatggaagccatgataagtatgagaaaaatgatggaggtcaacacaactacagttgttgccacaagtaccgccacagaagtggacctgactcacccacctggcttcaatcaagttcagaataagcattccttcccaccatatggcttgcctcccaactatacaccacccaatgttgcacacactcccgatgagaatacacatgaagcaccccaagaccacactctagccgactttgagcctcacctcggatgtgctacagaggggcaagcatttggcagaggttatgcctttgctcacatggcagaactgtgcctagtgcctgatgtcgttatccctccaaagtttagggtctg

SEQ ID NO: 4545 - DNA, 53 bp, Glycine max
  Peptide Sequence Number=SeqID_96230
atggataagaagcttgaagaggatgctttaatggaggaaaagaaagagacaag

SEQ ID NO: 4546 - DNA, 516 bp, Glycine max
  Peptide Sequence Number=SeqID_96231
atggtggaaaatggaaattacattccatataacgatcagttaaacaaaattcctaaaagtcaatggacaaaggagcaatcagattttctcaactcgaagactcgaaatgtgatgctatatgctctatcagaagaggagtacaccaaggacgaaggatccaagggagagaagtttttggctcttagcagtcaaaagaacataaagacatcattgtctaaagaacaagtcttgagaagcttgtccaaagctcttaaagttgataactcctctaatgaagaatctgaggaagactttgatgaagataaactcgatttcatctcacgaaagatctacaagatgtggaaaaacaaaggtggctccagatggagttcctcaaaaagggtgctcaaggaaaagaaagataaagacaaaagctctataatgttgaagcaaagacattttgatgttttgatgatgccaaaggatcatgtgcttctcaagtttaattcaagaggatcatgcgcttctcaagtttaa

SEQ ID NO: 4547 - DNA, 219 bp, Glycine max
  Peptide Sequence Number=SeqID_96232
atgaagatgctcttgataccacatgatgcaagctccattggagcttatgaatggcagcgaaatgaagaaaggaagagagagaggagacgccacttcaaggagaagatgagtctagaagaagttcaccatcataggaggccatggataagagcttggaggaagaaggagatgaatgaagggagagggagagaagagcacgaaattttgtgctctaaatga

SEQ ID NO: 4548 - DNA, 294 bp, Glycine max
  Peptide Sequence Number=SeqID_96233
atggcgatggcggtgatggtgatactgctggtagtgacggtggttgtggtggtggcaatagcgatggcgatggtggtaatacaaatgtcaatggccatggtggtgatggtgacagtggtggtagtggtgttagtgtcggcaagcaatggtggtgtggtggtggtggtgacaaaggtggtattggtggtggtggcagtgatagttgcattggtgatagtgatggtggtggtggtggtggtggcagtgacaacaaaaagtgtcattatcaaatatgggaaatatgtgtttttttaa

SEQ ID NO: 4549 - DNA, 624 bp, Glycine max
  Peptide Sequence Number=SeqID_96234
atggaaagtgctaagcacatggctacacccatgagtactgcttgctatttagataaagatgaaaccggtcaatctatagacatcaagcaatatcgaggtagtgcattagtttctaaggtgcatggaattcctatggttattgatcagtatgttttcttttcattgacacatctacccagtcaaggtgcaccttttgagggcaccattattgacgactggaagtttgatttctcaagtcatgatgcccaccgtatggatgatttaatcattatgtgggcttttctcaccggtcgtcagatcgactgggcccatctagttcgttatcacatgcataaggcattgcaatccagtgcacctctgccttatcctcagcttgtcactttatttcttcgccattttcaaattcccttggataatgagccctttgtgaaagtcaaacgttcttttgccattggtgctagtgcggtcacctcctttcgctaccacaaggatatggatggtcaatgggtgaagaaggatgtgcaacaacaggcacaggatgaacgcactccctctcctccaccacaacatgttgataccgcctctctcctacaagaagtcctcaccgacctccgagatttttga

SEQ ID NO: 4550 - DNA, 162 bp, Glycine max
  Peptide Sequence Number=SeqID_96235
atgtgcgtcttccaaaaaggagaatacgcgggagtcaccaccaacgcttattcgagaaaaacgttagaaaaaccaaaaagaggaaaatgggaacttggggcaatgggagctctcccaggagagctgaaacttagtactgaagcaatgagcttgcctagatga

SEQ ID NO: 4551 - DNA, 630 bp, Glycine max
  Peptide Sequence Number=SeqID_96236
atgagtgaaatagaggaggtgcaagaccagatgaaggctgacatggaagccatgatgagtatgagaaaaatgatggaggtcaacacggctacagtcgttgccgcaagtactaccactgaggtggacccgactcacccatctggcattaatcaagcaagtcatccagtcccggatatgcattctttcccaccatatggtttgcctcccaactatacaccgcccaatgttgcacacactcccgatgagaacgtcgataactctgctcccatgcccattgagagccaacaaccccaatctggtcatgcacaggtccctcaacccatgggggagacatatgaagcaccccgagaccacactctagccgactctgagcctcacctcggatatgccactgaggggcaggcttttggtggcatacccctgccaaacactttgggggggccctcggtatctgccacaaccacaacccttacattttgtggtggaaagactacttcctaccatggcagaaattatgcctttgctgacatggtagagttgtgcctagtgcccgacgtggtcattcctctgaagttcaaggtgccggatttcgataagtacacgggactacttgccccaagaatcacctga

SEQ ID NO: 4552 - DNA, 219 bp, Glycine max
  Peptide Sequence Number=SeqID_96237
atgggcacttgggcaaaggcagtttgcccaggcgagctgaaactttgtgctgaagcaatgagcttgcccaggcgagttggagcttgcccagcccatgagcgcaaaatctaccctaaggctcatgagaacccttgggccttctcctgcatctctggcccaatcttcttggagttttctatccaatgccctttgagggtaggattgcatcaaaagggttag

SEQ ID NO: 4553 - DNA, 339 bp, Glycine max
  Peptide Sequence Number=SeqID_96238
atgaataagagtgatataccattagaatctcatcatcgggaaggggaaatcgagccaagtttctggatgcaaagctacacttctagtgaatgcaaccacatcctttgtaactccaaggacaccttcgagattgtattcctattcggatccaagctgaaggaaactcgaagctatcttagtgaatttggatattgtcttattatcagaaatttggagatctcgctcttgaactttgggattgggattggaatcaatgatagcatcaacgacgagaggcgagggcttgagagttgttttggcatgataacaatgatgatgacagcgacaatgagaaactag

SEQ ID NO: 4554 - DNA, 315 bp, Glycine max
  Peptide Sequence Number=SeqID_96239
atggacactaagatcaaaagtaaactaagcagaagtggactacttcgagtccaaccaccacaaattgaattccctctagcaccagcaccatgtacagaattgcggaaaacaaaagcctcggcgacagaagagggtaggacgccagttgcaaattcagagacccaaacggcacaggcgaagacagcaactaaaacaatgattgtgcttacgatggaaccgtcgcttgctgctactattgttcttgttgaggctgaacctgaggcagtggaggcaaggaagaaaggcctgaaaagttcttggcgtttcaatcgatga

SEQ ID NO: 4555 - DNA, 570 bp, Glycine max
  Peptide Sequence Number=SeqID_96240
atgactagaggcaatccatctgacttacaaccctttgatcctaagatagataggacatttcatagattagttagacatcatttagtacctttcgagcatcctgagcattttgttattggtgattttgagcattatagttttgaacattctgattttgaacattctaaaaacatggcacaacctccaccccgtgagaggactctatgggaaatggctgcacctaatttcacctacggaagcttgtgcatccaataccctgatgaggatgtcccatatgttcttaaaactggactgatccatttgcttccaaagtttcatggccttgcaggtccatcacgagctgggatgacctcaagagagtattctaagaaaaaaatttccctgcttctaggaccacgaccatcagaaaagatatttcaaagcattagacaactcagtggagagagcatatatgaatactgtgagaggtctaagaaactatgtgccagtttccctcaccaccaaatttctgagcagctgctcctccaatatctctcattgaaggactcaataacatggagagaagtatga

SEQ ID NO: 4556 - DNA, 339 bp, Glycine max
  Peptide Sequence Number=SeqID_96241
atgaggatgacatcgagcagttcttgcaatttgcttcagaaagaggcgcgtgataaggtggacgtcacgtacaagaactggaaggaggtccctactgctcagaaggacttgatttgggaggatattcaggcggaatttgaaatcccaaagactggtgagagatggaggcagtttaaattagacttcacgaggaaatgggcccttgcagccgatcaggatggtgtggacggcactatctgtgagaaatacggcataagcaaggaaaaatgggtccagttttgccagactcgcagagacccttcttgggaggatgtaagcaaaaaggcacaagccatctag

SEQ ID NO: 4557 - DNA, 186 bp, Glycine max
  Peptide Sequence Number=SeqID_96242
atgtctgcttacagtcctttcgctaagtgcgagcctcgtgctaagcgcatctttgatcatgcactaagctgtgagtctcaagcgcttagcgcccaacccttgcatctaaggctgatttggtatgctaagctggccaaggatgagctaagccaacttcaattcgatctgaattcgactaagctttag

SEQ ID NO: 4558 - DNA, 474 bp, Glycine max
  Peptide Sequence Number=SeqID_96243
atggataatttcttccaacattcacctactgcaggaacatttgctactgatagaagatggaaaatctggtggttggcaactacaaactcaatctgggtgctcagaaatgatatgatcttccatagtcaatcctttgatatttctaagctggcagatagggtgggaaagggatttcaatgtcccttttctctaatggtcctcagcaatgtcattagcttttatttaatgcttctaggaagggcagggtttgtgttcaaaaaaaaaaacactagtcctggtaatgctaatgcattagctgctgctgctctagaaaataaggatctagcattcctagtcgctcaacttggttcagattcacaccaaagcagcaacaacaacaatagtgatggtcatggtagacaaaagttggacaataaagaaaatgaatacagaaatgggtgcagctgtgttagcaatgcgtatctaagacaatag

SEQ ID NO: 4559 - DNA, 612 bp, Glycine max
  Peptide Sequence Number=SeqID_96244
gattcaacaagcgattctcctcaaatttcagccagcccacatcaattagactttgcaccttatgcttcagggtcatacaatgttcaatggaatgccccagggctcctccatgatatgcacatgttgcgttcaagttgtatcctcagaaaaatggaggggttatggctaccattgaattatcaagtagatatgagagcaagtttatcatatgacaccggaatttggggctttgtggttgatttagggatggcctttatggataattgggtggtggggaatttcatgtgtctcccccatggtttaagagacatgtgcatgataagtttgaggttgttggctctcaatgagcatagaagtggagttattgacattctcattgggagtgtgcgccacattgggtggtgtaagttgggaggcaagccatatggcgggaaggcgccagatgggggcatcgggttcactttagtaacagcgctggtagcggcaactgcaaccatattatcttcttcaagctcatcatggcctccatcattgtggccatttgctctctcatggcctccatgtcggccttcatctgctcttgcacctcttttacttcacccattactctag

SEQ ID NO: 4560 - DNA, 462 bp, Glycine max
  Peptide Sequence Number=SeqID_96245
atgggggacatagagctttgtcaattgttccttttcaatgaagaattcaagtatgtaagagtgaggcaagatgagaagatggggctagcaaagcttttggactatgttccaatccccatcaaggaaagtctagaagagcctattaatgatgcttgtgtcctgtactgtgagaggtttatggaatttctaattgacctcttcagtcaattgccaatgaggaggtatttgaggcctcttgtggctaatgtagctatagttgccaaatgccatttaagtgcagtctataggcatgaaaaggggaaactttttgcccaattcgttgatttactacaattctatgaatggtttgagattaatgatcatacaggaacacaattaacagatgataaggttcttgaatctcattatagccgaatgcagtcattccagctacttgcatttaaaaagatggaaaagatataa

SEQ ID NO: 4561 - DNA, 204 bp, Glycine max
  Peptide Sequence Number=SeqID_96246
atgacccgcaacggtcgcatccctgacctgccgacacagcctgcaaatgctaaagggaaggcgaagatagcagaagaacaaaataacaaagtgatccccgctccggatgaggatattccaatgaaaggtctttctgagaaaaaggatggctgtggcaagaaagaagtattgctagaggaggctggccgttcaggcagcagttga

(The sequence listing continues in the following parts.)

What is claimed is:

1. A recombinant DNA construct comprising an exogenous promoter operably linked to a polynucleotide that encodes a non-coding RNA molecule, wherein said non-coding RNA molecule is capable of binding to an RNA encoding a polypeptide having at least 90% identity to SEQ ID NO: 129,017, and wherein said non-coding RNA molecule suppresses the expression of said polypeptide.

2. A transgenic plant cell comprising the recombinant DNA construct of claim 1.

3. The transgenic plant cell of claim 2 further comprising DNA expressing a protein that provides tolerance from exposure to an herbicide.

4. The transgenic plant cell of claim 3 wherein said herbicide comprises a glyphosate, dicamba, or glufosinate compound.

5. A transgenic plant comprising a plurality of the transgenic plant cells of claim 2.

6. The transgenic plant of claim 5 which is homozygous for said recombinant DNA.

7. A transgenic seed comprising a plurality of the transgenic plant cells of claim 2.

8. The transgenic seed of claim 7, wherein said seed is a corn, soybean, cotton, canola, alfalfa, wheat, rice, sugarcane, or sugar beet seed.

9. A method for manufacturing non-natural, transgenic seed comprising the recombinant DNA construct of claim 1, said method comprising:
 (a) screening a population of plants for said recombinant DNA construct;
 (b) selecting from said population one or more plants that comprise said recombinant DNA construct, and
 (c) collecting seed from selected one or more plants from step b.

10. The method of claim 9 wherein said method for manufacturing said transgenic seed further comprises analyzing a tissue of said selected one or more plants to determine the suppression of said polypeptide.

11. The method of claim 10, wherein said seed is a corn, soybean, cotton, canola, alfalfa, wheat, rice, sugarcane, or sugar beet seed.

12. The transgenic plant cell of claim 2, wherein said polypeptide has at least 92% sequence identity to SEQ ID NO: 129,017.

13. The transgenic plant cell of claim 12, wherein said polypeptide has at least 95% sequence identity to SEQ ID NO: 129,017.

14. The transgenic plant cell of claim 13, wherein said polypeptide has at least 98% sequence identity to SEQ ID NO: 129,017.

15. The transgenic plant cell of claim 2, wherein said polypeptide comprises at least 15 contiguous amino acid residues identical to said SEQ ID NO: 129,017.

16. The transgenic plant cell of claim 15, wherein said polypeptide comprises at least 20 contiguous amino acid residues identical to said SEQ ID NO: 129,017.

17. A recombinant DNA construct comprising an exogenous promoter operably linked to a polynucleotide encoding a microRNA or ta-siRNA that is capable of binding to and suppressing the expression of a RNA molecule comprising a sequence having at least 90% sequence identity to SEQ ID NO: 37,332.

18. The recombinant DNA construct of claim 17, wherein said polynucleotide comprises at least 20, 21, 22, 23, 24, 25, 26, 27, 28, 29, 30 or more consecutive nucleotides of SEQ ID NO: 37,332.

19. A transgenic cell, plant, or seed comprising said recombinant DNA construct of claim 17.

20. The transgenic cell of claim 2, wherein said non-coding RNA molecule is a double-stranded RNA, an antisense RNA, a microRNA, or a ta-siRNA.

21. A soybean cell, plant, or seed comprising a transgene or mutation, wherein said transgene or mutation reduces the level or activity of a polypeptide having at least 90% identity to SEQ ID NO: 129,017, wherein said transgene encodes a microRNA or ta-siRNA.

22. The soybean cell, plant, or seed of claim 21, wherein said soybean cell, plant, or seed comprises an insertion mutation in an endogenous gene encoding said polypeptide.

23. The soybean cell, plant, or seed of claim 22, wherein said insertion mutation is created by a transposable element or T-DNA.

* * * * *

UNITED STATES PATENT AND TRADEMARK OFFICE
CERTIFICATE OF CORRECTION

PATENT NO. : 9,012,723 B2
APPLICATION NO. : 13/138181
DATED : April 21, 2015
INVENTOR(S) : Liang Guo et al.

Page 1 of 1

It is certified that error appears in the above-identified patent and that said Letters Patent is hereby corrected as shown below:

On the title page, item 54 and in the specification, column 1, lines 1-5, please change "ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS" to --ISOLATED NOVEL NUCLEIC ACID AND PROTEIN MOLECULES FROM SOYBEANS AND METHODS OF USING THOSE MOLECULES TO GENERATE TRANSGENIC PLANTS WITH ENHANCED AGRONOMIC TRAITS--.

Signed and Sealed this
Twenty-seventh Day of October, 2015

Michelle K. Lee
*Director of the United States Patent and Trademark Office*